United States Patent 9,328,346 (POLYCOMB-ASSOCIATED NON-CODING RNAS) - sequence listing, part 6

SEQ ID NO: 714 - RNA, 153464 nt, Mus musculus
cagcgaucaaacuucgggggucccucaacguugguucuuggagucuggccaggucgggguaccugaggcgggaagaaucuaggaucagggugggccaucagguuuuggaggccgccgcccagagcggggagaaagaacgggggcgccggccccgucccacguccgcucccgccccgggccagccccuuccucgccgcgacucgcccgcuauccccacccccucgcccucggcgcccagugggaggcggggaccggccuugcugagcggggcgccgggcucugauuugcugcgggcguugggggcgguggggggugggggaauccacagccuccgcguugucugccagcagcgagggagggagggaaaggggggaaaagugcucagcgccgaaggcgagguccgcacuccugguccccgcggcuggcgcaggaccucacuccagcggagcgcccacggggagcgggucgcggggcagcagcggugaggaggccacgagacuagaaggaggaggacagggagugcgcgagcagccagcgagggggucccggccgucccgggccacagucgaucccugcgccgugggcgagcgcgcccgcugccucuuccagaacagccaccgccgcgggggagaucgggcgggugccgagcuuccuaugacucccugaaguugucgugcuccccuagcguccgccacccgggacgugucucugguccccgugcaucgugugcgucucccgcuccccggcccgcgcaccccgccggcauggacguacacacccgcuggaaagcugcgcgcccaggcgcccugcugcugucuucgccgcuacuccuguuccugcugcugcugugggcgccgccuucgagccgcgcagguaagagugcucuggggaccggaccucggggacuguaagaggugcgcagaaccuccgcgccgcugucaucucgggcuccuucgccgccggccuccuccgagccugcagaacuuuccuccuuggccuguggaaugcaccgggcaagacaacgaauaccauucguugggggcccaggagagggagccgggccaacuccauccccgcggcguaccgcccccuccucaaacgggccugcuggguggggcuguuggucgagucaaggaagaaucugccucguguuagaucccagcagaggugcucacacuuuuguccccaaaccucgcauuuucugucccacaucacaggcgacccgcugcaucccacgcagcccuuaagcagaaacuuuccuucugaaagcuggaaagggccgcccccuagagucaaggccauucaguuccucagggacgccuagggguggagggggaucccagaaguuugaaaccccagcuauggacuucccucuguacacacccucuugcuugucugagcuaaguuucugcaauucccaggggacagaguucccuguagucccugacaagucuucaggggcacuggggagcccugugagguaggccagcccuacuccuagccgucaaaccuccaaaccccuuagagguaguuuucuugggcuuucugcccaaagaugggaugaacgggaagccuggagagggccuuggagucugggcugggagcuucucagaugaucugcagaugugagacuccugccagguuggguucucugaaggagcccugauccaaugggcagaaucagggagguacugggauugucccugucuguauuucagcgcuuucaggcucaggucugggcaggcauauuauuuucagcaucacucuuguuaguuaguugugggauaaaccuccccagagcccuuaaacaccauagcccagggugggaaggcaccaggcaugugcugauacagggaggcgaaggcaguuagaaagaguucaggcagccgaacagcggguggaguggucagcccuugcgcagugacagggcucuccuuagcuuagcugguguuacuaggacuagcaggagaauccauuuccaccccccauggccaauuacaauauucuucuccugcuuucuggcaccauuaguguccaguggccacaggaugagcaagaguggaaaugggaggggccagggccugcggggaccgagggagagcaugggcugacgaugcucacucuuguggaacuuggaccaacugccccggaguucccaggguuaagcuagcaguagggaaugcugaaggcccucaggaaaguguggaggagagacaagagaggucagccucucuuuucccuauacccccacaauguuccccugugcgccccagaaccccaggagggaagccuucaguggaccucucgccugggaagcugggguuaccacuagcauagguuggguguuccggguucacccuguccacccuguaccuugucccagcccugcccuguccuguggccaccuaccucucuucgucacucuauuacuaugcucugccccacuucccugugcuguugagggugcggccauuuggaaggggcugccuggguccuggcugugcuguuagcuguuuugcuuuggacagaguugacuuuuagaagcacauaaagaaacugcuuuucugggugggcuucgggaagcuuuccccucugcuccuguggugcgacccacuuugaagucacccucagugcauggccagaggggcagcagugcacguuugaugcugacaggucaggagaaagugcaaacagacccugcucugcucucccucucggaccugccagauguuuuccgagguuucugugagcacagauccucugucucucucuuggccaagugugugaaggagugagaaguccgauugcucugggagcugcuaaaagccuuaagggggggaggaaugagaaaugaaaugugaccccaauauuuggaaauugaggucaucucuuccaugugcuauuggugggcuugggucaugugacugcuuuuuuugcaauaauuugcggggaaagccagccaaguuuuguaagacuugacagauacugaaugguuaaauuuccugugacucaaugaguuggcuacagggacauccuugggccuucccuccucucuccccucuccucccuccccccuccucucucccuccucuucucuccucucuccccucuccuuccuccccucucuuccccuuaucucuccuucacuuuucccacaaaguccagucuguagaagcccccugugucugucaggguguauuacucuggcugcaggguuggagcugugugcccucaccagcugugugguagaugaguccccucugggggcuagcucacagccucuucucugaugaugcugucuugggggcuggcccugcggugcuggccagagacugccccucuaccccacccuguagauauuucuggaugcuccucauagucacacccuuagccgagggcagcugaugcccgcugccugcuccugccucuggcuggaagccucuuucuucauuuaaaaaagcaaaccaaaacaacuuccuguacccucuuaggguuacaguuguugaguagaauacagauuguacagaucuaacccaguccccagggucacagcagggauggugaguggugcccagugggucaggaaagcauuuucuccccuaccccaggacacuguuugcuguagucuggggcucagggaacagugaauacugguggcuagugugcugguaccugucuggacagaagcucagcuguggagaagcagagcugacuaaccuggcuggagcccuuccugcgagcccuggcccacucccacucguucuguucuuugaucucacauccauuuccuagcuuuccccugggagacccaguacccugagcuacgaucccagcuugggggcccaguccaggcagggcccugggggacagaugggguguuccacucugccagcgccaugucuccugcugcugcugcuccugccucuccaucucuccucucucccccggcccuuucuuucuucuucucucuuauucuuucccgccauccucucucuccuugagguccacagccuucugcaggggcuccuuaucuccuuuuggaucacccaggcucuucccagucaccagaaccuucaaguaccacagacuuuauuuagcuugcucuuggucuggagguccugggggugguggugaaggcauuccucauuccuucuccacaucagacaucuuucuucuuguucuuaggccacuucagacaugcuggcccugugaagcagcaauggaggacaucuccauggagucccugguggccugaccccuuucuuuuuauuaccaucccucacugugucaccuccuucugguuuaauuuugcuuuuguugaauauuccaaacuuaucuaaggagguucucccuggacugucuuccuuggcuggaaacccccucaucaguggguuggcagguccccaguucuugccugccuuguugacauuacaccaggagagcagaaaugcuaccaacaaaaaauaaguaggugucccagggccccacugguauccccuuccuguucaggaugggagcguguccagguaccguguuagcaggauacacucaguacaaaccagacgggccuuggcuuugcccgugggaacucugcugaugguugguggaggacagcccuuggugguacugcaccuucaagggaugugcauggcugagaaagccagcaugcacugucucugccucugagguugaagguuagcuagaaugagucucugccucaguuuuccuuccugaaaaaugagaagacuagcaucugccacuuuggggaggugggugggucugagacugucuggugguccugccaguuccucuuagguagugacuuaggcacugggaugaagggccaucucacaagcuguguucugugcuaaugggcaguguucccuaaauccucuccaaacaucaugauucuagaaacuugggcagaagaguguguguucaaggaggugccaugcaucuccugucuuucugccuggcucucauaugcauguggcucccuggccagucacaucucagagguauuguagucacccgaggagugugugugugugugaaggcacuggacaggucaauuucaggguuauucucuguguguaugugcacgucaggcugugugugaguguaaugugcuuguccaugugggacccacgugcucaugccugcauguguaaaacaacuguguauguaagagcacauaugugugggaguauaaaagcacacacauaaugcuugugugguugacguagcugucccgaaaaggcucuuuacucugugcaggaugggaggugaagaggcucucauggcccuggaaccccuggugcucucagugaccacagacccuggguccugccacagggugggcugguccacagguccucccaguuugaugagagcaaugucaugugauaccugggcuccuuaucuuguauucuccuauguaaucagcguguauacggucagcacuuggacagaugccuguagcaauuccgacccagcucuuggaugugccaggaugccacugauagagccugccugggcccuucucacaggccaucuugcagucacuguaggacauggucugacugcagaccccaguguuggggggugggauagaaagaacaggggucuugggugagacagccugcaugcucauccugucuccgauucuucccagcuggguacucaauagcuugggccucaguuuccccacucgugagcagauggauaugauuguaaugacagcagaucccggugagaucacuacacggcuauaugaaucacagauaagcagcaugcuuacgguuaugaucauugggguucuugauuggcuagaagcugggaucgucagcugugggagccaccugucccccuucucccgagagagccacacugggucuucaagaugggacaaacauuggaagcagugccuuugugacuguuucaccucuccagaggucccaagcucugcuggccauugggagucugauccugugcaguguggaccagagaccuccacaccccucccacugcagcugccccacccuacaaggaggaucuggggucaggacguccaaauggacuuggccauucauggcucuuggccaccucuucugggucuggggagggagugaggggaugaaagaacugucaguggcacauuuccggucauaucacaggcuacaaguucacucucugucaccaugucaaguagucucagcuccuguaaacacagucauuuuucugggauauucccaacuucagugaugaacccacaucagugguaaauguuaccaguuuggugacucagagcuaagacaugaaccgcagacugacccacuuuccuuaaaauguaauaauuuggaguuccaggggagaggugcugcugggcaugacguggguaccguugcuucgacuguaauccugcuuccuaacauuuuuuguauugcauuuauuuauuuauuuauuuauuuauuuauuuauuuauuuaugugugugugcauguguguguguguauguguguauguauguuugugugugugugcauguguguguauaugugcauguaugugugugugugcauguguguguauaugugcgugugcauguguguguguauaugugcgugugcauguguguuuguauaugugcguguguguauauguguguguguguguuuguguacagaggacaacuugcuggaguugauucuccuucuaucaucuggguuccaggaauggaguuuagguuuccaggcuugacaggaaggaaccauaaccugcaaugcaaucuuucuggccccagugcugguuucuugugggcaaauuuaguuucucauccuuuucuuuccuacuagugccuuggcaauggggauucuaauagcauccuuaaaaaagagaaaaggaaagaaaugaguggcacaaacgggacauaaaaaugugugugugugugcacauguacaugugucugcagguaugugcacacacaugugcaugugugcacaugucugcauguguguguguacaugugugugugcacgugucugcauguguguguacauccacauguccguguguguguguguguauccguguguguguguguguguguguguacauguacaugugucugcaggugugugcacacacaugugcaugugugcacaugucugcauguguguguacauguguguguacauugugugugugcacgugucugcauguguguguacguccguauguccguguguguguccguguguguguugcugcggacagcuuagaaaagcagugacuucccagcgagacuggugagcaucuccgccuaagugggcacugugguguggugaggcucggaaagguggccuccauccugccuuguacuaccgugaggaaacugaaauuuacaucuugcugggauuuaccucucauagucccugugagcgacugguaagcucucccuggcugacagaaacuucuagaguaggguguguagaggggacaaagaacuguauagauaguucugucaaguaguguacaggccuugggauuugugucagucauccgagguaccugucaagacgagaucaccccuaccggucccaaagaggcuuugaagaaucaaaagaaggcacuugccagccccuauggaggacugggcaaucagagaccagauuguguuucuaggccugccuccaaagcacugugcuaagcacccuggggcccaccccuugcacaauugaagguagguaccucugcaugaaugcagaaggcacuuaccccuauuguuccuuuuggcucccuuucauccucguuauaauccugcucuccaggcauaacucacacagugcuugugcuccugaaugcuccccaggcaugaccugcauagugcuugugcuccugagugcuccccgggcaugaccugcacagugcuugugauccugagugcuccccgggcaugaccugcacagugcuugugcuccugagugcuccccgggcaugaccugcacagugcuugugcuccugagugcuccccgggcaugaccugcacagugcuugugcuccugagugcuccccgggcaugaccugcacagugcuugagccccucagacaucuuugggugggaaugaaucuugcaaauguguacauggaggcucugccaggccaggccacaggaaaccaugcaaguuacucucugcuuuugugggccucacuucagucauauaaagucauaaaagccaaugcgguaucauugcccuggcccccuuauucccuucagacagaagugggugauuucggaaaacagcaguguccuugccacaggcgcuggacaacaauucucccuuucugauacaggacgaggcaccccugaagcauccuucuuugggagggcaaugguccagguguaugcccagcuaauuuuucuccauugucagagcucauaguggcagacuaguggguuagaaaagcuggcuccugccccaguaugggacagccugcaguugucacacugggcacaaaaagagccccuugaauuucuucuggcucugggaugcuaagugacaugggcuugaguuucagcaugggagagccuggcuggagaaaugugugagaagcugugugaagucuggggaugccccaccagccccuuccuuacauucuucguucaacggaagaaucaggauacugcccacuuccugucuguggaaucuauccagucuucuccaaagggaagacugcuugcuauucagccgacucuuguauacuuugcagcagaucuuagggaucaaggcugggcuggaguguauggagcugugagguucuggagcauaauauggcugagucugucagcacugaggguagugagagaaacuugguccaacaaggcccuauauccugcgaagcccccaggucugcuagucuugccucaucccccuuucaguagugacucuuugggcauaugucccuaaaagccagccuccuggcugaacucugccucucuggacucucccuguugucgcccacaggcgcucucccuauaggcuaugguaguguggucuuauuggugacacaucugcgugggaaggaugaagagauggaguuuagagcgggucagugcccuggaggcccaggccagaggggcagaggacagcuguuucccacacccucagacauccaguucacaaucagggguuaggagggagggccccugcaucuugcccuucccugugugcugggacuuagcacaacacucacuuagaggcaccuacugugccugaguuuccccaucugcagaguggacauaaaaugcuaucucaucaccgaggcaagcugaauagagauugcaacaccugcuguagauccucuugugcauaugacaucagugugugccugugugaggcacgcaaggagccugcaaaacucacacauggagcuauacugccuggaguuuauuaaggagcugcagggaagccuaggaccaucccgcuucagccaacuauggguagguugauggugcagacuccagccccuucuauccccugaguagacaauacugaagcagagggccuguggugcucuccuggagcuuguccuggcuaggugucucugaggccucugccugcugcuggcugaugagcugaguggcaggcacaggacaagcucuacucagccaagccuggagcuaaggaccuucagugacugccuagugugugacacaagauggguacccugugugcugugcccuguaucaggaaagcugcaucccagauguucugugugcugccauuccaacugcagcaggggcuuacccgcccucuaguaacgcccuggcauggcgggcugguccccagagagcugaaugcuagccuuuugcagagggcccuggcccugcccagacaugccugguguucuuuaggcuugaggaaagugaagcaggggcugcacuuccuucagaaagggucuugaggggcucagcagggcaccuagacugagaccagcggguggagucaggcacccacauaacugucagcuucaguggcccuaggacccugccuuguacuuguggguucguuaauggagccaguucuacgaagcucucuagcaguccucccacauucuggugcuaaugaucaguugagggcacagugggauaacucugggcacagcaggcaguccccagggcauccugucuccauugccagcucaguuguauugcaggcauggggaaaguucagcagauauuaagagaacaggacaguggaggguccugaggaucagaagaguguguuuaggcuccugguggugggccuuggagcgugccaguaaaucucucugaccugaucaguucaucaauucguuagaaucguuuaacuggaaacagcugguagguagguccagaucucgugagguugcugugggcuuugagccuaggauggugaguugccuccagcccauggggguaguagaugguagcaggauggaggauggccuaugauguaacuguuccccagcuugucuuuguacugauugggaucgaggagcaccccuuaauuucugugaaggguaaaggugcuguguggcuguguguggguauagugccaugccaccucagccacagucacuuccuuagggcaagggcucccaguggugaugagggugaaucucugggucacguuggggccaucccaccuuccccugcacuugacaccuggggcuuaggacagaagguguuuuucuacccaggaaugugagcgcucuggccacuuuggaaggaacugacagaugcaccgagggagugcuuauagaaucuggggucuggccugcagcuacaggccacuugcagauaauuacacucagaugaguuggggauuucugaagucacaggucgggaggagagggaagcagagaggguccaucugccauaauccuggugcuggggaaaggagccuggcuguccugauccaaccagcuggggaagcuauuccagcucuaaugucuuugccucugauggcugaaaggucacugcaggauggcucauccaaggcuuucuuggaugaccaugaugguucccaaacaucucacuuggguggugugcagacaggagagcccaccccacccccuggcaggugcuauaaaaugucuccaagccauuguguugaacucuggcuugaggcuggugagauguucccuguucaucagcagugacugaaaaugggcugcaagaagagagcucuuuccugcccuuuuaggcccgccccauuucuucacuguugcuggcucuguccauggggaggggcagcccugggucuccuagcuuuggggaugccuguccucacaugccccgagacucucugaguccagccuguggacuuacuuacuccaccuccucugcuuggggcuagggcugggccgauugcaaacagcugcuuggcccucgaggcggauuuucaggcuccaggagggacuguuguacuagggcaugaacaguguggcagaaaggccacacgggauguaguaggggaaagccaagacccuucucucugcuugccuuuguacgugaggaaggcuagagaauggagaacagacagcucaucuguccauugugguccuucagguaccccuguaaucaggucaggacagccaaggagggucagccucuggacuggaggggaggggccacagguuccaaucaggcccuggggucuugcuauuccccagagcuuccuuugguucugguaacggaaccuuugcacaugaagacgcaugcccgauguucacugaaugugaagaccaggacucuccagguugcugccuccuccugcuccccucucccccuucuccuccuuuuucuucuuucccucuuuauccucuucuuacuuccccuccacuucccccuccucucuucccuucucagucuccucuuccuguuccuccccaccccuucucccccucuuccucuccaccuuccuccccacuccucuccccacccuccucccacuuacccaaguguuucccuaccuagucuauccuaauggcaucuucuaagccagggcucuaaauguguccugcuugaacccccuuuucaugugacccuggcucuacagauauguaaaauaggcgcacaaaccaaacauuuacugauuagugugaggaaguuuauuuuaaaacaguucuuugcuauaccuauuaugccaucuuuuaaagauaaaagcaaguuugggugcuaauuaaauagguacauguauuuaucuuuauauaaagauuaaaucuuggcugaauauugccauggucagauguauaguggucuccguguuuuucagagaugcucaaugucuugauuuuaugaucgucagugcugagaauucagccucguacaaaugcauaguacaagugggcagagauggguuuggggccauuugauaaauuguuggaaauuucacccuaaucccaagccaaaauucauuuaaugauuuuuuguuuucacaaacagaaaucauuuuguuuucaugcucagaucagcagcucaaaugacaacuuuugaaaaaucaaacauaguggcauaauaaaauucaaagauaugcuaauuugaugcuugcuccugagggaugaugguggggaaauaugaaagcuugugucguuuguuugugaugaaaucauuaugcuucuuuaagagcaggagacauuacauguagaugaagcauugguuucccgaggugcagcagucugggcuccaagcugaggcguauguagugagcaccuguguccgcauccaaggucguaguggggucacacaauucaccauagguggccacuugccagagaaaccucagauucaugguacauuugauuugaaaauaauuuuuggucagugcucauugagacacuuguugcuguugccaagcuguuucaugacaccccuccauauugucauguggcccaugaggugauacaaccugugguuuaaagagcuuggcucuaagacaugagacaucaccacccccaccaucuccccauuucacaggugagaagaccaaggcccacugaagcucugcaacuggcaaagacagaucuuaagcucuuaagacaauaucugugcucuaggaaugacugucagccugaggggugacauucaggcugggugucagggccaguagagaaggcugauugaagauaacauuuucaucuccacugaaggcauuucccccuuuucuuuggggaggggucuccaucccuguggcagggacuaaugagaggguguggagagaguggcagaaugaguguuccugugugaguguguguggucaucggggcugggguucagguuccugucucccugggcuuccugaagcccacagcccuggauuccuggguucugcuccgugugaucuaucuuuggagaccucuguggguuugcucuccacagcauccagcugugaggagccuguuuguuuaggagucugagucacguuuuuuccauuuuagugggaagaaggucagauaguggggauuauggccagguaggggcugucuguuccaucucaguuggcagcugaugaaaugagugugggggaugcucugggaaagccaaacaugaauggcaagaguggauggguuccugggccugccccccgcggcccuuccccucccgauaagcccgguggaugcgggugggggguugagucaucaguuagaggguccaagaaucaagcugccacagcuuagcaguaagcucaagguggccagagaaguuaagugcgguguagcccacaguuaaaucaugagccuuuggagaagaaaauuaaaaacucugagaacaaugucuggugaccuggcugucuuagugugccucacggggcucugauccuauaacuggugcuugcugucuagaccaacuaccugacccccugguguacuugugaucuuagacacuuuggucacucaguggaccagaguucucagcacacaguagcagaagguggccuaggucuguggaggggcagagaccuggaacucaggucucucuggcuguaguggggaagagaaagcaucaccuagaggcugagggugguauugcaccucagggcuucuugccuuuuaaaauuggguguggcuuggguagccagugugacucgguggaguccucauccaggaugaugccccauccuucauaggcuugcgguguggaucuaaggaggcagaguugaggccauaaagaaccagacagggcuguagucugcuguaucucauaguggaccagcaugggggcaugccuagugaauccuuucugggacuagcugaaaguaauuugcagacuccagggugucugcugaacaagaguauagccauucuggaguagcaguuggugcugggaaaccaggggagcccugguccacgcuguccgugccauucuggggcaggccgcgguaguccuggcaagguaaucugaacacuggagagcugggcucucgggcuagguguccugauaucugcagggauggggugcccaguguuuuccaggcacaccuagggacugcccaccaaugugugguggaucagaauaucuggugugagcucccacugcaccguccccucuucagacagagguccagacccagaguugcgcaucacaauucccauggugauuggaaccacccugggccuuucagugaugccuaggaaaauaacagacuugaagcuggccauggugaugggcaucugcacucuagcguaauaugugugaugucuccagagagcccuguggcccugcacauagcuaagcaugucuugucuccuuguggggaugagguaauuuuuaccugcuuuuuuuuuuuaauaacccuaggccagccucagacuuaacuauguagccaaagaugaccuugaacuuccaacccuuuuacuuccacaucccaaggguugugaguauagcuaugugcuguuguaauuuuaugcaguaccagagacugaacuaugggcuuuguacauuuuaggcaagcgcucgccaacugagcuguguuccaagcuuugacuuaauuucuguguccccuucaccccaugugguugcuacccugccccuggaagaacuuuccaggugacugugcccacgaggagccagccugagguuggguugacacucuccugggaucucugccuucccugcagcucucugcugaccagccaagccugccaucucucaguauucauuccucagaugcugcuuuuagccccagcucaucugauuccaggaucuaccauuucacccuauaaaaacucccagccguguuuugcaaugauuuaaauacagccugcugcuacccacucucucuggcugcuucuuucuguuugggcccuucccuugaacaguuccuauuaucuacaacuuugagugugggaagugagauuauaaaggucuccucacuuuagacacaggcaugcucccagccucccucccggggcuaagacaccaggccccugccgugugcucuuucugccugacugcucacgccuggucaauaucauggccagcagauaaauuccuuggcugagaggcaguccgaccucuuuccagucacuuauaaaacuguuuccuggucuggcuucuugagugaugcugcagccaggacagagccacgccacccggucuuggcaucccacucuaccuccuaugcagcucuaccccagccuacgucagagugagugcugggaugcucucacacccugccugguucaugccuguucggccaucaccuuccuuuccauuuggacauuuguacugguccagggacacccuccaucuguaggugccagagaagcugguuucuguuuucccuuuccugauucacagaguucucuacccauugacucucaaauuugaaccccauuugugggcccccuccuauaucccucagugguucaugagugcgcuccuccccacauccuuggguaggaguugaugcagacaugguguugauggcugaguagcuucccuggcagggauuauucuuggcccucuccacucucacccucacagcucuguggcuuugccucgucucugaucucaucccuggccucaguucugagcucuucaagggauggguacacacagcugccugcuuggguaggagccugcugcugaucucccaaacuauuguucaucgugucucuguugggccacagguucaaaccagagccuguucugugacucaaguccagaacuauuagccauaggagaaccuugucugccgcguuccugagaaugcuguauaccuacuaaaugcccugccugcucggcuaagccccagaauucagcucagcagcaccucuaugggcaccggcaauguccaaggcacuguguguggcuuugccaaggaguccuuaaggaaaccucuuuccugaaguguaaugcagugagcucuaugcaccuguaauuggcacacagcuggcacagcuccaaggagaagaguggcauccuggcugggccaugggcucuuugaaaucugagcugcauccuggagcuaguuauggcagcaccauggcuuugcccacaugaggccuaaaccacggaugcagcucugauucuccugccagcccaggagggaggaagaguagaccccauuuggguucuguucccaggggucacaggucagucuggugaggauagcaugagcagagccaggguucccacugagggugaccucgugugugugugugugugugugugugugugugugugugugggcaaugaccuuggaaaacaggaaaauucaugaaaaagugacuaaaaccaucuauaauucuugaagucagagcucaugggucuuaauagagagaagaaaggaggggauuuguaacaguggcuaccuggggaguuccugcagacacucuacuaaggacccugugcucacugggugcuccucccugaagaugacaaccccgaggccugcaggcaggcaggcagggaggacucacugcaggcuagagggaggacucacugucguuguguugugugugcuguagguuucaccccgucucucccgaccucucugaguacuugcguuacuugagucucucucuuacuaguggacauucaggugguccccaugccucauauucuaaaccaccuguugcagagaaagcaugccacagggguggguggcaagaaggcuugggccuccuccuugaacugcauuuagggagaagaacauauugggggggggcuagugagcaguguacccccauuccaugugagccaaucagcugcagaugggagauauauagcccuugcccuuaaaagucaggacacuagcgguaguuuaggaucuaauaaaguuuguaguuucagaagggccuuggaagaagggauuaaucacugaacuggacugggauaauggagaagccaucuggggcaaagaugccucugucuacccuccucuugcacuaaauuaauuccagguggaucaaagaugugaacuuuaaaaaugaaaccacaggaccacuagaagcaagcuagggagguagguguuuaugauuaugaggccacgguggggguggguggggugggaaagugacauuguuagugugacacaaaccucagaaauuguaaaagagaauuauaauuugaguuuuucugucuggcugaagguaaaagcaacuaccaauugcaagaaaagaauguaagccuaugugacaggaaaaggggucaauaugguaucauaugcaaagaguucccacaaaucaauuuaaaaagguauaaucaaagguauaaucaguucuccgaaaggaaaacauuuggaacuuugguacauuugaaaguuguauaacuuuaacaaggauaacacaauguaaggcuucacugucagcuggggaagugaacaccuggcaucuugcccuuuuacaauaggcaaccaacaguagcuguugagauguuagaaugcacacgcuccuuuggcccggcagcucugcgccuuggaguguguuauauuccucacucaugugugugcaaggugcugcugggaagagaagggguucacaacaugugcaugcucaccaagagaagucauuuuccagauaggcucuccuuaaguagcccaggcuagccucaguguguguugggaucacaggcauacaccaucgugccuagccacggggaaugcauuuaaauacguuaugguguguccacgggacaggccagagaucagaaagcaaugagguuuaagagguuccgauucacugagcagcacccaucuucaagaaacuugaggugaagccuagcaaggaagagggcuccucccagugugagcccgcccuuccaggggaaaacacccagguccauggcuacacaugugucagucaugggaaaggauguucaaauaucuggacucggguuuuccucccgaguggguagcaggucccuaggccacaguucuuacguacuucuuuugagagaugaaugcaggaccccagagguguguugcuaggaagcaggcagauguacagcuacagaaaacagaggcagugaggugugaaccggcugcucugggcugcaugccuuuugguguggaaaaacaguaaaaccaauuugugaccuuaaaaguuuguaaagcaaggacuggggagauggcucuaugguuaagaacauauacuguuugguuuccaguacaaauguuaugaggauaacaaccacauguaacugcaguuccagaggaauccaguaccccucucuaaacucaauggcacccacaugcgugugcacacacacauccaugcauuuaguggaaaguaaguuuuuaagaguucaugaagcaagccggucgugguggcacacaccuuuaaucccagcacucgggaggcagaggcaggcggauuucugaguucgaggccagccuggucuacaaagugaguuccaggacacccagggcuauacagagaaacccugugucaaaaaaaccaaaaccaaaaccaaaaaaaaaaaaaaaaaaagaguucaugaagcugccaggcaguggugauggaagccuuuacucccagcacucgggaggcagcggcaggcagaucuccaaguucaaguaggccagccuggucuacagagugaguuccaggacaaccagagcuaccuagagaaacaaaaaccaaaccaaccaaacaaaaaaguucguaaagcaaauccaggagauuaaguggcuuuguccaugcgcccucuccuaugugagguuguggaaguagagccugcagcugaggacugccagggcugcucauuuuacagcaggagaaacugaggcugccacaggcuuccucaagcaucacuuggaaauugggggucucuggguucagcgaaggcuccugggacuguucugcucagacacuguagcccuauuuucuacagaguguuuuuuggcuuuuuggcuuuuggugaaucuauucaggaauaagaguccuucugcaugucauugagaacucauuguaaguacagacacuacccccuauccccauccaccagcuacacauuccaagccuccccggggaugcuugaaaccacaguuauagauagagaagccugggugugcugccuuuguuccuguguauacauaccuguggcaagcuuucauucacagagugggcacagucccagaugaacaacuguucuguauuuguaacauuguaacaguauguuauaguaaauguuauuuuaaaugucugaauuuuuuuuucuggaccuucccaugucacguguggggacugagacucucacugucccuguguuaacugguuggaucugggcugcuuccagcuccgggcuguugggaauagagcuugggugaacaucucuccagaagaucccuucagccucggauuguuuccuuagggugauuucugagacacuuacucacaugccaaaacacaggaagaguagagcccuuuaguuuucccauuccaucccugccgcagugggcaauuaccaccuagcuaccacauccuggguggcgugcuccucaggugucgagguagaccucaccuguaaaaugggugagugugggggcauucaacccaccaccaagacacaaggugcuucugcuucuggagaggcagcaggggacuuuuacuuaaaguuugagacccagcuuggcccuuucuugcaccugugacacaugcuaggucccuuaggccuuuaggugaacgugaguguuucccaguauaaggaaugugacaaguacuuccaagucugggaucaacaugaguggcugaacuguuaagaauaagaacagagggggcuggugagauggcucaguggguaagagcacccgacugcucauccgaagguccagaguucaaaucccagcaaccacaugguggcucacaaccaucuguaaugagaucugacgcccucuucuggcaugucugaagacagcuacaguguacuuacauauaauaaauaaauaaauaaauaaauaaauaaauaaauaaauaaauaaaaagaauaagaacagcacaucuaugcucuaugcuucauagcuguccuuccauuagucagaaaucacgauggaaccuuuagaacccaguagacaccuaacagauacuaaccauacuccgauucucuucuucccuuucuggaugucuguauuugccaaguccuagcuggggcccagugagcaagcacaccgcauucugcuggugucagggucuucuccgugucccuccgguugacggugggaaaugcaucacagcucggggcaucuguaagguaguggaaugggcugggugcugcugagcaucaggagagggaccagccugagcuggaagaagaugggcaucaugaaaggccucucagcauccuucuuaggaagacauugcccagaaugcuaaugacaugcagcccaggagggcuggcugcagcuccggagccugcagagugaggcagagucccuuacggucuauucuugggaauaagaccuugagggccagugugguuuacucacgagaagggguaguguucagccaugacaugggcuuguggaaggaaggagucucuuuccugcuccucagccuuggggucauuucugucccucacagaacuggcccugagcuuuagaaauggaaaaaugcuuucugguccugggguguggugugagauguuuguccaagggucagagugaccaaugcaugguuuugcaucaugcaauuggauuagaucauuuuggagucaugaagauaaucaaauagagggacagaaaggacugguagaaagguauccaucuacuugcuguuguaaccaguaagcaaacagcuggaaacaagccacaguuucuacacagaaccagcaaaaugccucccaauagggugcaugcagucugugaucagacagcagcaccauuccgaccuggagagcggugcgaauggaggaugugcugguuaacaucuguaaccugaaauguaucccacuuaccuuccuucucagcuugcugucuucucagcaguuaauaggcgguaaaccaucuucaggggccaauucccuucuguuucuaaagcuguuucuucuaacgagaauuuaaaggcaaugccagcucgcugcccgugcugggaggggauagcagcuaacagacacauuugccuuuuguccacauuucaucugaaagggcaagggugaggcagacccaggaccgccaaguggaccugggcagacuuacaauguaggguggccaccuucaagugccaguauccugugauauguacacagccuugagaauugaagacaugguuuugauuuagaaagaccaguugaaaauugcccacugucgaggcaaagacaaugggcacuggggccaucuugcuguuggggguaggcacaaagagagaaugaguauuuagcuauagaguguugcuuccuguugggcacuaacuggcucucgcugucuguuuaauaugcuauaaaaagcaacauguuaauauggaaacauuaaaagcuaccaagaaguagagaagaaacaaaaaacaucauaauuccuuacuuaaguuauagugauggcaguuggcagugaugauggcuuuggugaugguggugaugauggugauaguggaggugauguggugguggugauaauguagauggcagugauggugacaaugguagugauggugguagucauaauggugaugaggauaaugacuaaugaugguggugugaugauggugaagaugguagugguggggguggugauggugcugaugguggugauggugguagugaugauagugaagauggugauguugguagccauggugaugaugaugauggugacaauguugguuucuauaaauuguagucaagcacacuacuaaaugaauaccuucauauuugccuuuuccuauuuaucugugccuuuauagacaagggugagauuacauguacuuugcacaaguguuuuaaauggaaacucugaugagcaaaucucaguaaguaagggauaaagaggauuucuucauccugauagaaguccugcuuguaaaaaucugugcagcucaagaagcagggugagccacaugcucuucauuuaauaucaaauggaaauccucgccaaugcaguaaggcaggaaaaggaaacaaaaggcuuauagauuguaaagaaagagggagacugucuuuauuuauagaugauguuugucuacgaaaaaacccaaaggaaucuacaaagcagcuucaaaagcuaauaauauuauuuaggacgguaauagaguaugaaaccaauaaaaagucaguuguacuuuuagacagaaguaacaaacaaccagaaaugggaaacuuaaaagcauuacaauagcaucaauguggaauucuugaacuuaauagaauaaagcaaaacaugugggucuguauaacaaguauuacagacuaucacuuagcaaaauaaaaauuguaaacacacugagcuauaccaagcucacagaucaagacucaaaucauuagggcauccugaacuuucuguguauauguaguguguguguguguguguguguguguguguguguguguguaugcaugcuuguauguggcggccagagacugauguuggugucuucuuccacugcucuguuuuauuucugugacagacucucucaaugaacauagagcucaucaccucaggaggccaccuagcuccaggaaccugccugccaagcgcagcccccaccccaccccgccccgccacacaccagcacugcaguuacaggcacacaucgcuagccacgccaggcuuuuauguggguuuuggggaucugagcucaaggccucauacuugugagacagggacuuuacuaacaucucgccagauucuguguuagaggacucaugcagucucaguguaaggcagugguucucagucuuccuaaagcuguggcccuuaauacagagucucauguuguggugacccccaaucauaaaguuacuuuuguugcuacuucauaacuguaauuuugcuaguuaugaaucauuauauaaauauaugauaugcaagauaucugauaugccaucccucaaaggggucacaagccauagcuugagaacagcuagcucaaggcuugucaucuguagugaucaagacugugcaauggugacauaaaggcacagacucauggauaggacaaaguagauagguaguacauacacacacacacacauacacacccagagagacacauacacacguauacacacauauacacacgaauacacacacaugaauacacacauguacacacacgcauacacaaauguguacacacacauacacaugcacauacacauauguacacaugcacacucacaugcauacacacaugugcacacacaugauugugcagcauauacacacaggcaugaucauuugauauuuguuugcuucuuuguuuugagacagggucucacuguguagcuuugucuggccucaaacucagagaucuaccugccucugccuccaucaugccuggaaagaucauuuguuuugaucaaggcauuagugguggaagauaguccuuaucaacaacuuguguccaaaaacccuggauguacaauuacaaaggcauaaaccuugacucuuacuuugauauucaacaguuaggacuuagaucaguuuugcacuugaguuaggaaagaauucuaaccuggggaacccacagaagcagguagaaagccagugugucuccauugaagcacauggucucacacuuugcagaaaaugaagagauaguugcaauaagauauuugcaaaacacauauugauacagaauuugcaucuggaaucuagaaagcacagucacagugagacccagaaagaauaugaaccaguuuaaaacaagaugucucaugaaagaugugaggauauccaguacacaucugaaaacaugcuuacuuuucagucaucagggaguuacaaguugagcccaugagaugaaaccccuuacugcauaugggaggauauacaguggugcaugcaugcauguguguguguuugugugagugugugagagcaugugugugcaugcaugagugugugugcaugugugugugcuugugugcgaauguauaugugcauguaugcauguguguauguaugugugugugugcaagagcaugugugcacacauaugagugcaugugugugcauguaugugugugugucugugugugugcccccuugcacacgugccucuaugugcaugugcagaugcagguucagauguguggugacccuguuugugccugcccagagcagagggcagaaccugaauuggagguguugagucccugcucguagacugacacccuguccccaguggaccaagaaucaccauccaugcuacuugugccaugucaaauagacacaaaagggucugauuuaauuggagcauaccuauucauuagugacacugaacauuaguuguuugcuugucuuccauccuuuuuaaucacaaggcguccccuggggauuucuaucacaaauauaccucuuugcuuuucgauagcucccugugaugcuuacucugaugccaauggcaaacccuguguucuggucucuuacucugcaugugggcucacuuuugggacauggcuugccaacaugacuugaucucucuguauagcucaggaccagcagcaaaauggcuuggggcccagggcucaggacucggggcucagcuccuaagcuggcuuuccagaguggguagugagugaggccuggcucaugguuaggggccugggugacuccuucccugggaccuucuugucaggauacucuggguuucuccagccugacaucugcagaggcagguccuguggcuuuuaaagccaagauugcagaguuagcagugugucccuuggucacaugcauuccucaccuuccagagagcccaccucuguuagagggauuguaccauuugacagacucuuguauuaaagagcuaugccugguuuuaaaugcccacacuuaaauauauuuugagcucuuuuuaaaaaauagauuguguaagguuuacacugauacacacauggcucuucagagguagaugcugaugauuagcgagcacacaucuguccaauguuggauccauccaaggcuauugaccccuggggucauuuguucuggauugggggugaguucagaguuugauuucuguuaccuaguuuaacuuaguuuaacacagggugcugcaugcuuucaguguuucugaacaugauuguggucacuuagcaguguguucuggccaccuugccaugucaggcuguguagguugaccaaucccacuccaucuuugcagugagcuagacagggacagcuuuuuuuuuuuuuuuuuuuuugauucaacuagcucccuucugaugggcauagaccuugcuuuuaucucacaagcaauccugcacaccuaggcacaauacaacccuuucuauacaaucuaccccaaagagcagaugccaggcuaauguggccuggccucgguauucucaccaagauccuauagguacccuucccacucaagguuucuuccacucuagugauugcuguuagcacccagcacacgaaccucuuuuauuuguuggaugguucauuuguucauugguuaguugguucauugguuaguugguucaguggcuaguuaguuuguucauugauugaugaucugguucauuggcucauugauuaaauggcuggugaguuuauucaucaguuaguugguguguguguacauugguugguuaguuuuauuccuugauuuguuaguugauuaauuuguucauugguuaguugguugauuucuuuuucccuaaugguuaccugcuggaugccucauuuguucaucggcuacuuggugggugacucauuuguucauugguuaauuaguggguggcucauuuguucauugguuaguuaguggguggcucauuuguucauugguuaauuaguggguggcucauuuguucauugguuaguuaguagguggcucauuuguucauugguuaguuaguggguggcuuauuuguuuauuggcuuguuaguaggugauuuuuuaguuaguuucuggauccauggaccuuaucagcacacacaaaaaaugaugcccuuacugcugugugccuugaaaacucuggcagaacauccagggaggcuuugugucucugguggugacaggccauccaucuggaaaugcuugggacaggacagcuuugaccuugucugacuccagaaugaaucagagguggcaugguccuucagcugcucauggaacauugcugaggaaagacagccuggagcugcucugcaggugucagugacccuaugggcagugggacccugagagggccugacuugcagcuggcaaguuauauaaucaucaugaccauauagaugcccacucccugagccuucccaggaguugguauggcucuauaaacacacucacucaaaugcagccaacuccauguugcacaauccgucuccuggcaucuuccuccacuuccuccagaacaaugagguaaaacuaucuuugaggaagcagaaugaaccacuuggucccuuacucagcucacuggucaaguccuacagugagcagagucuucuggcagugcccauauucaaggagccuggcauucauccugucccucuggguguuggcuguaggcaugguguccuugacacaaguuccauucuguuguggucacaauucuuugauaaaggacaggaagagagaaacaggccuauuaacaaccauacaugaagaacagcagugaucguccaaaaggagaaaaagaugcugaacagauuugagaaaaguagauacauccucucuuccagcugcugccuggugugaggcacuccugugccuaccacaauguuaauguggccuaggagucugcaugguggcaucuacugauucccaaguaacauugcaucuuccucuuuacucuucacggcuuggcucaggccuccuugcaggaguccuuugcaugaugucucugccccuccacuccccuuacccuucauggaguccuuacuguuggcuuggcucuauuuugaguaacaguauguguguauuaugggugaucuuuguaucuggguaucaccaucuguacuuggggauugcauuagggagaauugcaggcacaugugucugagccuuucugaaggugucucagcccuugucuggggucuguguacaaaguaauucaaaggugccaggugucuagaccucaggccagcuuucaggagaggugagagaugggcagucacagacugaaggagagaagccuuggggcacugguacacucuguaauuauuuguucccaagcagagggacagacuccuccuuucccuuauccagauuuuccauaaaacugcugaucuaggacacaguggucaguggcuuccuggaagccauagcuuucugccaggaaugaagaagugccuuugagaugaaagaaaaaaagccaaguggucagagaugugugcccaguccagccauggagcagggcagggcacugaggaacuuauugauggucuuugcuggggguagauauggguagugaugacuuauguggcucuuuuugagcuacuucauuuccuggggaaguaauucaauuuuagucuuuccauucaugguauauccucuuguauauauuccuucuucuaaccuaugccauuauacaugguuuguccaucuauccacccacccaaccacucaucuacccauccauccguucacccaucuguccauccauccguccgucugucuauccaugcaugcaugcaugcauccauccacccacccauccacccacccacccacccauccacccaucacccaucuauaaauccauccauccauccguccauccauccaucuguccaucaugcauccauccauccacccauccuuuauugaucuuaucuagucacaaagccauucuucagccaccccuuuuuuucccuuucauuacucauccauaauucugugucuguucuuccauccugagguugacggaacuuacagcugugagcuuugcaaacaagugaccuggcuuuccagggugcuuucaggaucuggagcguuagauaaggacaguguuucugcccacagcaugaccuucugagacucugacagcucuacccauccucccuggagcgaccgcauccuguccuuugacccuguccaguacucuccugcauggauaccugugaggggcagggacucagugcuccucauugcucugagaucauacaucuccucugggagcauccuaccagcuuccuguccaugauguagagggaagaaugaaggcuuuagaucccaguauagaguugguuggagucuggccagccccuagguaucuuccucaguauuuuggucagauuuccucuugaagggcagacucugaagacugugagagugagggguuugggguugggaggagguacacaguacagagccucugucauuccuccccggacaggacuguugcacgugcuuauagccccaguggguauaacccuugcuugggggaaucucuguaggcagagaugacaaccuguugggccuaaguggcugcuuguacacuaaugcauguguuauaagacaccugcugcuccccucugccguucagagagcguuuacacacuaucuucugccaguccucaacagggguuuccucucgcaccucauuucuugcuauguuguggauuucuggacugucuaccacuaccaccaugugggucuauagggcucaucccucccgacacaguucagggcaguaaaaugaaccuggcaauuguugggaaggaaauacugggcauucugggugaaggaacagagcugugcgaaauagaacaacguacagcgggucccagcuuucacccuccaugcauauacccuuccauccaccccacccccacccccuaugcauauaucccccccccauccucccgcacaaccuccaugugugugugcucucuugggcagagcccugcugccuagggaacccugggguuccauagaaaggaucagggaugugacugcugggugacuggcccugaaucgguguagagggaaaucccagagacaguauugacuuccaguucccacucugugaagagacaccucugccuuugguugcccaagaucuccuucaguucuagucaguccuuccuccugucuuacccucaaccccauauugugaugucaagucuggccgaccaugcucuucuuuuuguuccaucucugaucccuccccccuuguugcugggacugucaccccauacuuuguauacuuuauagucccugccuucugcccugaggggcuagugggaaguguccacuagguggugccaugguagagcaugcugaucggguaggcagagaaagcccuuccaggugcaggcuccuacaagguugccacuucacgcucguaacugcucaucccuggccaggucccacagcugggggacauggcuuuguagaggacaaaacagguucccaggagucuggcuacacccagccucacacugcugaaucugcugugccuuggugucugucacaggugugcaaaugguccuguggcagucuggggcuaagugggggaaguuucucaugcugugugcugugcaaacuaggugugcccuuggaugggucauggugggguccacaagguuguggcugugauguggagauaagccagccagcucaggcuuccugggugaggaacgggcugugauggcaggcugaggacccugugccuggagaaaauagaagcuauaaauuacauuuuggggggaggugaagggacccauguuuaugguagaggugaaccuggcaagggaucugaggucagggcaccaacagccagaggccuggggagagcagggacagaagagguccuggcuagcuccaaaggccagcacugccugccugcagcccuggccacgcccucccuuguccccagcguuagucacuggagaagaauuucaucagggccuccaaggcacccucuuuguuuuccagcccccugguugaccuuggaugaggccacugcccucagggagggcugguggaaggaccugggcagacccucaggggcugccaugucuucagguguggcuaucaggccuuuaguaaaacuggcucuuugcucuaggaagccaagggggaagagaggcaggcaagagagugggagauuggccaccccagccuaugaaggcugcugcccuguguauguggguaggucaggggugagaggcugggcaccaacgugcuguguaguguugguaugcuggcuguagcucucugagcuucgugugauucuuuaggacagacgcuguucguccagcccuuguugcugacccuuugguccuucugucugugaacuuacagaguugaacccggguggucgguugucuagaaggcccacauguucuucucuugaagaugaagacguugaccucggaguuugcaacacaaaacagaacaccucacugacuguuucucuguuggucugucugucuguccuucuguaccuaagccugucuuucucagucguucuucuuaugucccucagucucuguauauuuauuuucuccaaggcucagcaucaaaagaaggugguccucaguuucuccuugcaggcgcgauguggggaaggccuggugucugaggcagguuuuggauugugggggcagcaugggaagaggccugcuugacuguaaggugguaacauacgggcuagagcuugggcucagaugacuaagucacaguacccacucagcccuggugagauaccagucaucagggaguggccaguggggcugaggcuguguuggggauucugggacagugacuucccugugaguguacagaggccacaugaguccccacagaacuccuuggggagagagcucugccagauguaugucaggagacagguagaugggcuggagucuuucugaucccagcaagugcuuaaaaugugcaguuuacugagggugugugugugugccuaauuggagcaaaggguuguaucacccaaaucuguugggucaggagugugacuucuuccgacugcuucccuucugcaacacccaagcucauagcucagucucucagcucacaguugcucugagaauggagcccggagagagagauguagcacggcagccaaggugaagugaauuucauucaugaaagcagaacaggagagcugaccucauucaccuuugaacugcuaggggcucauuuagucacucaacaaacgcaagggagugcugccuaugcucugccccugcccagcacaggacagggcacucugaccuucuuguuucuuuuggugcccaaccccagugggguaggguacaugaugaaucugagagcuguuucaugaaguccuccuaucaggacuucgccucucugcuguuaccugugaauguguuugcaccaggcccccuguuugagcuggaggucugugcuugaccaggguccuuucugaguguuugcauuccuugggcuggucagggcugggguggcagaaagccugugauuguagauucuauucugaagacauguccugagcggcuccagauggugauccgggccucacuggccuucccaagagcaggcugucuuuugcaguguuggcacugugggcugggauguguuccuuugccagggccacgaguuaggcugcugaacaugggacuggcucuccucuacugcaggcuggcgucgucacagauguccuuuucugugucugagcaggaggcaggaguguuuagaugccagcuaugaccagcuaugaccagaacaauuucugcucuuucugaaagcagacaccuuguuccaucugcucuuaaagccugaggccuccugguguuagacuguggcgugcuccuccagggccuugccacgagcugucugccuuuuugguccuucugagaggaguguagacagagccagggucugcagccucaugugccagcagcaagguuuuaguugucuaucucuagguaacaggucaggagagccuaugugaugagacugcucacucacguuccuccaaggugagugaagcuugugcauagcuggguggcaggcugucugagggaggacaagcugucuggggagcagagccaguuggaguuagaagucuugaggcaacuauggagcuuucacacugagguugcuauucacaggacagggucacugcugcagauguauggaagccagggcucuuagugccaugacugccucaccacgggcaugguccaggagcuuacuacaacucgugguccacucuaggauaaucacugacugguagauucuggcuugcugcaauaauucuuaucgcaaaggccucuaggaaacauaguuuuagucucccaggcuguggaacaggacucucugggaggaggcugggucuagcugaagugaacagauaaagccaggcauucuucucucuggaaccuggucuguucauagguggaacacccggggaagagcaagggaguacuugcaugcaaaccauuuggagguggucucauuugcagcagguagugacuggucucugaauucuucagggucacucaagugccucuuacuuugaagcaaagaccucuuguugggagcaagggccauggaugcaauaccaugugugugcuccuccagucugcgggacuccgaugaguccugagagcacugugaauagcauuuuccuuccagagggcccuguacuuaagcuacggaguucuggggauugcucacuggcaggcucccaguggcuucuguggcuucucuaaugggccucagcuggcaugaucuucccuuggggcugugguaauccugauuuuuaggcacaucuaccugugucaauagccccugccacuucagaguugaggugcucagccugggugaggcauuggccugaagggcaaauaagacaucuuguguggaagggaagaguuuuccagaugccuguaugcuggacacuacucuagugcuccccacaccuuguuuaagacuaaauauaucuugcucucuggcacaaaaaagcccuggccagcgggaaggguggcacugggccuaggagaggucugauggccuuuuaaacugguagcgauacaggucugcaaacauccuagucagacuccugugaaaccgcucucugcuuugacaauggggaaagcaggcuucgaccuggucugggaagagcaucaucguauagaugcagugauguagggccaggaaacgcugcugggauccccaucucuuccccaggccauugccagccuuagagcugaguuuccgagaugacccaggcuuuggugcuaugucguucuggccaggugugcuggcaguuggcacggccaucuucccacagcuguguccaggccugggacugugccacacagcucugccaacacacucagcauugccugugauguucacuaaacaagagcucagugaagacuuugucaucacauagaguaccuggggggggggcacagauacacaaauaacuggacacugggugguuaccuaagagcugccaggauucugaaaugaguugaggcuauccugggucaauaaugggccguccguccacacugugcccugcuguccuucauaaugauuuccuguagggguggggaacccuucucuggugucaggaaguuggcacagaccuggccacuuagguugccuuggagcgcaggcuaacaggagucaggcuugagacucgguggcugcuguuggaggacuccucacccugaggaagcuugcaugaucauucuucuuuaacaccuucuuaaaaacgguucaacuguccucccggggaauccacuuggggaggaaggugaauugaguuugagaggaauagucaagagaugagccuccuguggucgucagaugugggugcugaguguuuagcaggauauguuguauucugauauggacaagccugagaaugaacauaugggcauguauaugauagcuucaggcguagcuggauccaggugcccauuuagcacugcgagaguuggccuaugcaugcacuagauucccuugagauaguugcccucugacuucaucuucuguguauguagcccacagaacagcuuuuuccuagacgaagccacaggauggugcgacacugguccagcuuggccaugugucaggggcuucacauccuguggguagcacuuugaaauuuauucucugcuggacauccaagagccuccuauuugauguaacucaaacugaacauacauaaacaggaaaacaagcagucuggggcgggcauguguggacucaaaggccucuagauguaaggaaagggggcuuugucaggggggcauguuuuguguuuggggauguucuagcuucauuucugucucuggacaaaaauaccccaacgaaaagaaacuuagagacgaaagcaguuuguuucagcuuagaauuccagguuacagcucauuguuguggggaagucaaggcagggacuucaaacaucugguuacaucacauccagagucaagagcagagggaaaugaauggaacacacacucaccugcuugcuuguguucagcuugaucgccucacuguuauucuucacaaccccaugccuagggaauggugccaccuguagugggcugugucuucccauauuagcuaguuaaagaccuaccccucauagacaugcccacgggccaacucaguauaaacaguuccucacugaaucgcucuuacaaggucaaguuggcacagcuaaccaaugcaggggcaacuguugagcucuugaggaagcgccugcacuucaggggucagagggucaagcuucugcuguccucugaguggcucccagaggauggggugucagaagcuuuccuaaagggacguccugcaagcauucuccugaccuggguauucaggccuaaaucuuuugauaccagacagaaaucggauauuugcucuaagcuguugugggaacaugggggacgaaaugacaucaaagacagugcagagacuagagguugcuuggcaguuucuuaagcugucaaucacuccaauguuggaaacagccccguagagauugcuggagcuauugaggcuuccuggcugcgucuaggugacagaccuaucuccaguguugcugagaagaaguggagauugugugacucaggcaagugaggauguggaguaagaagucccugcaguuuguaaaacaaggaaguuugggggcuuucagaggguguaggugaggccaggcucuaaccugggcaacuaguuggagauagagccacuucuaagacgugucccuccugagcaagcccucagucucuucugaacaccagauguuugcugguuucaguugucuaagauucaccuucucuuugggggugccccucaguuguguccaucuuggggcugacauagcuucucugucuuugcagcucagccagcagaucuucuggagaugcuagauuuucacaauuugcccucagggguaacgaaaaccacagguuucugugcuacucgaagaucuuccagcgagccggauguugccuaccgagucucuaaagaugcacagcucagcaugcccaccaagcagcuguacccugguaagaggugccucauuccuguucuggguggcagagugcuggggacuucaggcuucuggccagggccaaagaggaagccggagugggugguugugccagagccgugggugugcuuugugugagucuuccucauuauagugaaaccaacacccacucaccacuugugugugcgcaaggccuugucugugcuaaaugggauacaaguaggcauguuuacauuaaugacagaccaccaugagaaaggacagaaaggaggugagaugaagugagaucuuaggucauggagaagaaaggcuuauacuggggaacauaauccuaacuggggccagugacauuaagagacacaaguccagaacccuggcuggcagcgagcuugagagauucuuaaugagcgucugcugccaggugccagacaucuacuuuuaauuauguauccagagggagccaccauguuggacagaggcgugcaucuaagugauucacccacaaggggaguuagcuccucucuaccacaucuacugguacuaagugcccuggguuuauucagugugggcaggugauagauucuucuuccccugccucaggagggccugccagcuuagccugaggugcccugacucuguugaccugaguaagagguaggucagccagacacuccucuuuugcgauuagaagucugcauucaaucuuuuauggucuggauaugaccgcagcauugaaccagaauugggcaguuuuagcaaccugugcugucccucauguccccacugugucccuggaugaugcuuuugccucccccccccccccccgguguuggcacuucuggucuucugucaggguuuguccuccacucagcauugcucuggagucauugugacuuuacagcugaggaagaagcugggugcuuugguccaagguaucauuuuggauggauggaucucgugcgcaaugcaccuuccuugcagccacaggggaagcagccuggggucuccaaggagcacaccuuuagugcagaaucacccuggcucacagaugccccucuaauucuucuguaaagauaaaugucccaccacgacccuuucuaaacgggaaccucacccuuccuugugaggggcugcagggauggauucuaugccuuauuuuuggagaaaacauuuuugcagaggggggggggaggucaucuugagaacacucagucucaucuguuuucagagaguuguaauuuuucugucuuguggcccaagaguuagaauucccaaauuggagccauggagaccugggcccaggcuggaagggucugcuagucaggaacagagggcuggaggugaugaugaugaagcugaaauggggauggcugcagaaaagaaaggcucccagcccaaggagcuauacagagcucacugaugcuuguauucuuaccauugucacccaagacaagggggcuagccgagcagguagcuagaauccccaucugucacucucuucucccuggguggcuuaugguaagaauucucacaggaucagguagcugagcccaggaaauggaguggauucccaaguaacaugauaggggauauuuuuuugguaguugacuaguuuguugauauuuuguuuuugagacggaaucucauguagguugaggcuggccuugaacuugccaagcagcuacggagaccuugaacucccagucuuccugcugccaccucccaagcagugggauuacaggcacagugccugucuucagccugcccucagcucguguccucugccuuagacuugccagugugcggggugaaccgugggccuuuacuguauuuguuuuuggcacggucucagcuguucuagacuagccuuagauuuugcuuuacaguuaaggaugacccugaacuuccaauuauuuugaauccaccuuuuuuuuuuuuuuugcccuaagagugcaggcaugcaucaguaugaaauuuaugugguuuuggcgaucaagcucagagcuccauauggguucaggaaguacucugacaaccgagucccagccccaguccugggaagcuuuugguuuuguuuucaacuguccucaaauuaguaacuugauuagauaaucagaauugcuguagcuagggugugggggacaccgggucaaucacugauugucugacaguggccagugcagccaagguggcuucggagucucugcagaggaguuucuguggugucaucuccucaggucccaugggucagucuggaaaagcuguuccagggucagcauuauccaucaucuggugucugaggcuguauaccucagaguaggugauugacccuggaaaauccuggaagguacugcaggcuuucugauuggcaagugcuuaggaaacaggucagaccuugugggaugucuuccacaggacucacguggcuacaugccagccauugcagcagccuagguaagaaugaggguggcugcuagcuacugugugccuucuuccagagugcaggagcuccuuggcuacaccaggguggggaggcugucugugguagcugcacuaggaggcccgagggcuccaggcaaccgcagcaagacuggauuggguagagcaugaauagaugucuggaauugucuuagugcuugcucaaugaugcccuugguuaugggcugaucucccaagacagccuuauccuagugagcagcauaaucuuuccuucaugggcuguguggaucugggucuuuagauggcugggcuagcuuguucauggcauaagaucuggccauucucccccacagggugggcgccauaucuaaaagaaacuagcaggccaugcaugaagacgguccuggacuucccuguauacugcuuuauugcuccuaugucuacccagcuagcaccagcugcuuguaauggucuccugacugacacuaaggccugaccccuggccucaccuuguguguggagaaccaguccccaccauucuuccacugaggacugaggucuccccucuguucuccucagcauccuucucugaggagguaccugagauuucuggcucacucagaacuagauaggguggauuggccaggagcucuucuccuuauccccccauuuccagggcuccaucuuuacuccaggaucccaagucuucagcuagcuccaggagcagccccugaccagcuaccccuauugcucccuccuauccuuacugaccagaggcccuggguccaaccaguccacugcagaccacaggauaaauuacaucucagaaugcuggcccuagacaaaggccaugcaugggaagcagggugcggcugccugggcuggaccaugggauacggggccccaggaugguguaagaauacagcagcaggucagagguacugcauuccuucagugagcagaacugugucuucucugagaggcuguggccauccugcccauaugguaguaugugagauucucugggagagucaauuccauggcagcugcauuuauuagcugccuacuguauccccgccguggaccggggcccuuggguguuggugggaagagggaggauaccccaugagcggagcugcuggcccuccacugugguggcuuuucugagugagaucagucaggaggcaccagaccgcacaugcacuucuccagacuacccggaagcuuggcguacagugucagcuccugucguagugaagagagaccuucuuaaagggacuauaaauccauuguuauuuugcuaggagagagauuaauguucaacauaauucaucuuuuccaaguuuugucugagcugagaaaauuuguuaccauagugauuuuaaacauugaggaggggcauuuuaaugagcugggagagaugggcuggcugcccuccaccauagaucaugauggaggaagaggacucucucaugugccaugcgucucauccuuucagucaaugacacagagucagggugggcacagagacuggauaaugaccgcaugguccacccugaaugcagacagugaccucccggcugcuguaggguccgcucugguguccacguccuacagguacagcgcccagccacuggcagggcuaacuggggccuucaauuggguaggcacagcaguucucagugcccaucaacaccagugaagguggagaccucuguuuuccuucacaccccugccuaguagagggugcaguguggcacccagggugacaagacagugcaggcucgcauguccccuuccaagaagcuucccgucuggaacuugaaagcaggcuaagcaggucccccaguggaguccuuuuuuccccaacuaccucaaguaggugcauggccaucauuaccagcuaucagagcagccugaaauugucacucugagcccaggggagcuggugaugcccagcacacaaacaggccccugcacacccagccucuuugggcuccugacuugggcuaggacacguggcuaucccacaucagagucugagguccccuugaccuugaugagaggucgugacccuaugggauaguucuuccacuggcuuccuaucccaccauacccugugccaccccugggaucugcaguuucccugucagaagcgaccacagccuccauuagcucucucugccugugcccuauaucagaaacgggagggaagagcaguuaagucguuauguccuguuugugccccaacccccagcccccaaccccagaucuaggacaucuugauuuuccccagcauuguaccugcagccugcaguuccaacaacagagggcacccuuggauagcuuugcaaggaaacugugacaaagccugcuacagcagugacuaguggccuacugggccaaguggcugaccuuguuccaacucuaaaggagaaaauggaauagccagacacuccugccucaucccagcccguaacucagacucccagcaucuacagaggaaacaguguggcuuggugguaccucacuaccuggugcuucgucagucuguuucugccaguuccuugcuggguguuacccauugagggaucugagaggugcccuauccaugggugggggaaggaaggaauauuucuagaucgcauuccuucacauuaaguaacuguguggcuuacauccuaucagacccaggcaguugguggcaaaacuucaaucauaggaggauaguugacauuuccaucaggcuccauggggagggggcagccaagggcucacugagcuccagcugaggguggguuuaggugcucucagggcuaggagugaguuuagguacucaaaaaaggggcuuccuguuuugaaaggcacaggcuuuccuguucaacauacuagauauuuguuuuucuuaaaauuuuaaauugggaguauuuuuaaaauuugcuucugauuuuucuuugaugagcuuauugacaaggaauccucagaccaugugagucaagacgagcucaagucugucucccacuccucucuccuccacuccucacaucccuugugaucgacacuggaugaggcacacaguauauuuagccuuugaugcagcuggagacucaaaggucccccuuaagcugcugaguccagugggucccuaguaggacucauaagcagaugcacagaggugcagcucgcagccaaggagaggguguugugggguccucaccggaagggccuuccuagagaaacuuguguuuugauugugccuugaacggccagcuugaacccuggugguggaggaggcuguagagguuugaucuuagggcggauaagcugaagaggagugccacccacagcagaguuugccagaucagucucagcuugccauagcuggccagggucuggguucuccuauggccuucucauccugucuucuguuccagagucugguuuucccgaggacuucuccauccugacaaccgugaaagccaagaaaggcagccaggccuuccuagucuccauuuacaaugagcagggcauccagcaguuggggcuggagcugggccgcuccccugucuuccucuaugaggaccacacagggaagcccgggccugaagaguauccgcuuuucccuggcaucaacuuguccgauggcaaguaaguaucccacugagguaggggauggagcugcuggccagauagagugcggcggcagcuagcccgauaguagaugguuuaugaugcucaccugcaggguaccaggugguggggcgcuggacauggaguucaaaggcuugggcuuguuucuucucuucucuaaaacucuaggggaccuuugcuauucccuagcccugcuguccuguaaaaugcaccaugugugcccugugcuggcccuagaucagaaggggcagaggacauggccuugcucaccuguucccaaagggacuuccuuuuuggauuuggacagucucugugugagugagggaaaacaaagaccuaucuucagaauucugcugguggcaucccuggggaccacaggcuauggcuucuggguuuucuagcaagacucuguaucgagccaucacaucuagcccacaguggucagagauaacaucccauguaaagaguuauaaugugacugugaccacagccuccguaugacuucuuucaauggcugaacccacgcuaaguccucaugcucaccucucccaaggagcucacgggauuugcaucuuagagaugagaaaucuggcuuugaggaucugaggggacuggagaacagugggaucuccuguaaguuacaucuguuccccagaaguaccuguguuacaagcgcucuuccuagagucuggccccguucacuguacguaccaggccuacauuaggauuucucaaagcagggaucauggaagcccagaacauucucagcugcacugaaagagggagguuaaacagagaugacucucugaacuaggacaagugcuuucugguuuauaaacauuaaugacguguugcguauggaugcuauauucagaaugggaaacgaagccuccuguugccuuugaaaauuaguucugaagccaguggaugugaucccuuucuugacucuuagagauucucuaagugacaguaugauucucgggugcuauuguccagauguguguccagaguugucacacagaggcuuugcggugcaaggcccuggggacucugcugugaagccacucuggccuucugcagugugcaaccuuuccccgccugaauguuuguuucuuugcagguggcaccgaauugcucucagugucuacaagaaaaaugucaccuugauccucgacuguaagaagaagauuacgaaguuccucagccgcagugaccaccccauaauagacaccaaugggauugucauguuuggcucccggauucuggaugaugaaauauuugagguaggcaggagaugggcaguccccuaugccacuugggauguuuguggucacguggugguucuucauguagagaucuguggcuacugugggagacccaucuccucguuuaggggucaguuugauucuauugcuucccaaggaugccacgaccuaugaguggaacggccugacuggcuaccauguggguaccaugcagggguggcggugacugccuguuucuaagcaacccaguaguugucuccugggugccacauugggauagagacagggcuuuggcaagcuugcucugacuggcaccuucuuauggguaaggguucuacugaggagagccagcuuccucugagugguacuugcagggcagaacugggccacuccugggauaacugggagggaaccaaaugacucgggguguguguguguguguguguguguguguguguguuuguguguguuuguguguguuuguguguguguuuguguguguguguguguguguguguguguguucaaugauccagcagcugagccugcuucucugggaaauuccccagagacaagagcagaaaacagagaaggggcuugagccugcauuucagucuagagucuucuggauuccuguugggcauagaagcauuuugggaacugucuuugcuucaggaagaagguugagagcccgugcaggugucugguggcccuggaggccaccugaaaccagaugcacuggaacaggcaucucugaggucugugucccaagcgcaucuggagccugagaccauggacuugggcugggacacuuggccugguuucuuuucuuugacauacuuuggacuuugugggaaguuugggagcugagggccccuggcugaagaaguuugguaaucacccagagaauggucuccgagggugaucuugguucuuagauaucucccuccagggguuggacaggacagaaugggggucgugcucuccucagucucuaaauaccaugugaaugcuauuuccuccuugugcuggcucaccaccaggugcaguugccaccugugucugaugaggccugcugaugcucucaccgcugugguggagguucugggccauguccucccagugacucaggcccagcaggcuggaugccaugucgaaccgaccuuagugcucugcugguacuuugugacugauguggaauugcaaugcuauacauggaucuguggcaaaagugacauguagcugagugugccaaggagugagugccugaugggugugaaccacacucauuguggagguugggccaaggucagcuagggugagguugggcuagaaucugcagucaauagcugaggagaguccagagcagccagcugccucauguggaaauggggucagucuccagaaggugagagcggugggugaaugggucugcuggacucauaguccaggccuucugccaggugggacaggcacaugggaacaggcaguacuggauccuguaagcuauggggcugcccucugggcaagcuucugacuagaugugcccagaaaucugggaugaacagggguguggcugaguguccucagcuagacagguaccugcugggucuugugggaagcuagugcuuacagcuugcccaggggucaaguacugcuuuuacggauuaccuugugggaggaucuagguaaaagcuaagaugcugggaagugccagggcugcccugaagagugggcauaagaggguacuagaggagccggagagagaacucuuagccaggagagcgaggguggccccugcuguccacucucuggugaccaaaaucuuaaaggcaggcauacaaggacaucccagagcuaagcaaaacauccggucugacugaauuugcuguguacuagcagugucgggcugugcuugucauuucuacaggcugugccaacaugccuuuuaucaucaaguuucuggaaacgcuuugcauuuuuaaaaaaagcaucuguguauuuuucucuguauguauauguguguuuauuucugugucugugugugcuucucuguguguaugugucucuauauguguguguuucucuguguguguguguguguguguguggucuaugcacaugcaugugcaugcaugugugcaucugaaggccagcagucaaugccaaauggcucccucaccuuccaccuuguuucuggagacuagauuucacugagccugacucucacugacuuagugcacgcaugcacacacacacacacacacacacacacacacacacacacacacucacucacucaggaaucaguccacagaagacauacacaugugugauccacagcaggcccucgguaaugguuaccaauuuguguugagaaugaagacaggccccagucuuuaaacacguuuggacacuggcugcagaguccagcuuugccccuuuggcuuucucuugccaugcacagggugguucucacccugcaacugaugucuggcaacucuguuagaacagcagggugcaaugcaugcacaguucugaguugcuggugagcucuuuccuccugccuuggaauuugauuugagggggagcggcugccagaagccagggauuuuuguugaccacaaguuguuaauggucugaggucuguguuuucccagccccaggguuuccuggcuguuagcugugcucacggugggaaauuggaccugucuuccuuaaugaagaccagcuagggcagcaaggcggaggguggccaguagggacuuuuucuacucuuugcuucucacagugcaauggcagaggaggggggcuggucucagcuucuaugugucuccuugcaagugaauuuuuaaucccuuuuggaaucgaagguauuuaacucucugcuuuccagguuucagauaaugguguccgcugcuuucuucauuuucauugccuggcuccuccagaaaguucuugcuggaaacuucuccaauggccuuuacuucccacaagauucuuaugcuuguuaaaggccacuuuguuccguagcucucugauuugaggagugggaggcugcuggugcugaggcugaggccagggcacugcuggcacaggcuugcaguuacugcacagcgcaucuucuaggcagauccgccaaacuccacagggcuuccaagggguuuuggggaagccugggaugccacagccucucagagacccuguauagcaugaagacacucugagggaggcagcuagggaggacacucccagggccacaguagaggcuucugugacaguggccuguucaucuucauggcacaaguugagcccagccacaguggccuuggcaaacagucucuggcaucugcuggcucccugaggcauggguccuuuuggucucacuaguuuggaucugagucuugggguuucccugaaguucaaggaauguugugcauaccagggucuugcaaagcuauacagagaggaagagaagguguauagacuguagacuuucagcucuuccuggauggucuuuauguggucuuccugacugaggauguggagcucaguguucacaucuguaaaauggguacaaagaggccaccacuguggagcugcgcaucaagggcugugugaaaugucugcucaagugcuucagggaaccaugcugaacucaggucccuuuggccagggcuguagccccucuggccuguaauucguugcagucacugcuuucuccauggaggcaaagacacaaguugucucaccuuaucuaguaagugcuuugacucccccucagagauggggagggaggggagccucaugcuccccaacuccuaccugagcugagagacuacagauauggauagacaggaaguuguaacccuggcuccugggacacccuggccccagcuuuccccugccaucucaggagcucacuaugaaccaugagcuaauguucuuuacccugggccuucacacugucugggucuugggggcuuacuagggacucacuucaugcucuuccuugcucccuuggccagcucuaacccaaugcucuuguauuccagagggcuaugcugaggcuacccugcacaguuugagucuugucuauuuccuugcaaugugucugagaucugaggugcaggcgaugcugggcaggccaaagccuuaccauacaggaaguggaggagguguuucuugaucucccuacaugggaaaacacucccuuuucauuuaagagugagcuuugggguuugggagcagggacacagcugucacguaaggguguuaucuggacaggaggaagcaagcuguuuugguggagugucuuugcagacaggacaccagcagcaguggcucugugcugugccugcccaccucaagguacuggaggcugggaaccuuguuucuaucuggagagcuugcaaaacuggccccgagagcugagcaaccuagcaaagaucaucugcagcgugacagccgagcgggguugugcagccagguagccuagcucugggucuuugccccuggcuccugugacucuacguuagccaaagacagagaaugggaccuuccagaaagaaccagaacaaacaucuuuccaggauggaaguucacccaccgcacugacggcuaaugaccguccaagcauccuugacuccccuugcgccauccuucuauuucccaccccaccccaccccgaggcugcccuuguucuggugccugcggguuugaggcugaccagugcucucaagggaagggcagagauuggcaccuucugcuugcucuagggccccaggguggagaggccuucuugcuggugugugccgcggaggagggccacggaggaggcugaagcuucugggauagggggcguggucggcugcagacucugggccaggagccaaaugugcuuuuaagcuguugaauguuucaaggggcaacaagaccaaacagacuguaaacucagcuuucacuguguacccccagucgcuggcggguuccccuucccaaccgcaccucagcauuugaagaaggccaaguguuuaccuaauccugccuucccugucugcaggagccuggcuuuuccacugacguguuuuuuccuggagucugcucugaggcaggaacgggcugugcugaggagacgccuuccucaguagccagcucaaggagaucuggucuggccuucucaaacaggucugagaccaagccaucuucugugugaguggagagagcuguguucucguggggagauauaccaguguggccccagauccaggccccacuuuagcuccgauuuuaaaccucugaauccugccggggaaacucucuuuuucuucugcucaccuguccaccaagggccuccguggcgagcuaucaugggccgaggcauucagcccaggcuugcuguugagugggauucagggccaguggaaagggacuugugucaugggggaguggacugaggggaaagaccucuagagagagcuggccccagccugugggagucggccagugauugguggccaagcuaaagagcuccugagagcggcugccccuguccagcuaucagcuuugccugugcuucauaucugucguccucccuugccgaccugaaggucauacgcauuucagaaggagccccaguaaggcaugaggugcccuacccacccugagaacagcugaggaaggcugauucugacucugguugcagauagcuaggagccggcuuucccgaagcccaucugauaccaucucugugcccuggucuccauccauuaugaugcuugcaguuuagguggggcagccuggaccagcugcuccugagauuuggccugagucccuauuucuacccaggucaguguagccauggcuguggucauguuggccaugcugugagggaccuaacacagcaacgagaccugcuuucccauagcccucuuguacugcuccaggccccugcauccugaggcacagacaggaauauggaagcuucuagaacuaaacgcuaggaccugggcucagugacuagaagggaaaccucaaacccaggcucucagcugcccauccugggcauggccaaguuggggccaagcaacaaaugggaggagugcacaucagugagcaagcagggugugcacggggccuuguccuuguggcuugggacaugauucacauuuagccaguucuggucuucuguauuccacucagucaaaaugcagaugcugccuggccaucucaggcuaucacaucugugcuccagcacacugaugaggccucaguaugugcccuugugaugugugugugugugugugugugugugugugcgugugugugcacagauguaugugcacguauaugagugcgggugugcaugcauggugcacaugaggaggucaguggucagccucaguugcucgcucuccccuucugccuugcuagagauaggaugacuuugccauuugcuguuuccugcacuagacagcugcuuuggguauagggugcagggugcagggugcaggguguaggguguaggguguagacacgagauuucagggauucugucuccgccucucaucuugcugcagaacacuaggcugugcaccuacuguggcaggcuuuaccuggaugcagggagccauuuacuuagacacaacauggcucccuuggaggccccaggacacuggcaaguggggauucaagacuucaucugguuguaucuucagucugacuucucccugguaccuccugacuccuggaaaggcagaguuguucugaugagucaccuggagcugacaggcacggucacaagugguagcaaaaugaagacucuguuuccuuccagucuagaaggcucugaguccgaggucaggugucggcaggacacacaaggcuuacacuaaaccuaguggucucacuucaaaacccucagcugagcuccauccaagucccuuccgugaaggcuuagagcugaaacauagcugaaauauaagcuuucauuuagcuuauaucucuaaagcagcuugacaaggcuuccccugaucccaccagagcaugcacacuucaguguaaggcacugggcacuccugaguggcuucuaauuccccagcuaccagguuuaggaagaacuucauguugggacagaggcuggccccagcgugugcuguggcuggcagcgagccacacagcgugauucaccaaguaaagcuguugccuggcaggcaaccagauggagguuucugcuucuaggacccauuaaaucaugguccugaggcccaaagcugcagagauucagcccuucauagcacucgccuggccugugaggguuccaggcuuguuccauggaaaucgugagcaagcaucucccaggagacaggguugaccugauguuggaagucaggcuuuguccagugauaucaugcugggcuggcaugcaguagacauucugguucccccgagaccauugugggcaaggagcucuaggaaguuggaccucuuugccaggagacacacagggccaagacauugagggaggugaccagggcaggcaggacacguguagggggacagagggacagugugucaccugcaggagcggcauguggccagggaccggugagagccuagaaacugcuaucaagcuagugacaggugagagugucugagugcugucugggggcguggccaagcccuguccuucagcucccauggcugacugcgugggcauugggagcauguuuucagaaacacugauggacaccuuugaaucucuucgaugcuaacaggaagccugaaagcugugucauuugauuggcuguaauccaccaagcacuccuaauuggaauugauaggcagugccacugcuagccacaggcccuuucuuuccgcuccuaaugguaaauauuaacuaguauuauauauuuauucugguuaguuuuuuuuuaaagauuuauuuauuuauuauauguaaguacacuguagcugucuucacacacuccagaagagggagucagaucucguuauggaugguugugaaccaccaugugguugcugggauuugaacuccggaccuucggaagaacagucgggugcucuuacccacugagccaucucaccagccccuaguuauuuuuuauuuugucaacucaacacaagcugaggacagccaggaagagagaaccucaaaugaaaaacuuccuccaucagaucggccuguggagcguuuucuugagugaugguugaugugagaugguccacccuagaugggugguccugcauucauuaaaaaagaaggcugagcaaaccgugaggagcaagcuagugagcaguguuccccuccgugaucucugcuuuaauuccuaccuccagguuccugccuugaguuccuacccugacuucccuuggugauggacugggacugggacugggacuugugagccaaauaaacccuuuccuccccagauuucuuugugucaaaauguuuuaucauagcaauaggaagcaaacuaggacaauauuacauuuuacagcaaaguuacauauucucucucucucucucucucucucucucucucucucucucucucagacacacacacauauucacacacacuauagaauuauuaagaggcugcagaauugauaauggcuauccuaagaggucuggguuuggccauacucauagcccuggcucaagucaauauguagccuucuucagauagccucacccgcaccacugggcucaauacaucccgugcugauggguuaggaggccacagccaagcucugaacuguguccuccauccugccuuccuguaucucagaggcagaauccaauuuuucaguuguguaaauuggaaagccuaggggcugcgcucuucucccuggagacccgcagucauucaccuauguccacaggcauagaggcgaguaugaaacacuggauggacggaagaaggaggaguccaagcugugugcucuccugcaugcuuaccugcugcagagggccgucagggggauggucccccuucacgagggauugagggccacuuggcaucauuauggucaugauuggagacugguggugguauacuggcaggugugcaugguaaugggguuaugguggucuuggugguagaaauggugaguauugugauugugguaguggugauagugaucuacauggugguaugggguugguagugcugaugauagugaaugugguagugaugauggugguggugagccugguaaugguggucuucgugguggugauggugaacuuagugguggugguggugauggcccuugugauggugaucuugguaguguuaaugguggugguggugauccugaugaugguugucuuggugguggugauggugauuuagugguagugguggugauggcccuugugauggugaucuugguaguguuaaugguggugguggugauccugaugaugguugucuuggugguggugauggugauuuagugguagugguggugguggugguggugaggauggugaucauccaucucuuucucuagggcccagcucugugauauuucccaaugaugccguuauaccaugcacccuugauaggauccagagaaagacaacaacauuugacauagacuugaagcuguuuccuucauucucuugugaucacagcgcagcccacucugcacagccacacugaaaaccaugaagcaguguuuucagguccccuuccuguggcuuagauacguuuuauuuccauccuguguagcccaugagcaauaaugccaaugccagauuuuaaaugugacuggugagggaggccccugaaagccagaauguaugcccugucuacagggaacuucugaggacaacauagagcggcacccaacugcucugcccuaggucuguggaagucacccuggccugcugacuggguguguccugaaccuguggguaccuggcaugugccuguguggccuggcucugcaauccuucacugcuguuggaaacaagucaugcucugcuccaguugaggaaguugggcugagccguucccuggcaaccgcugagcccaguccuguuuccauccucauggauaggaaguguggccugaugugguuugggacagugccuaagaucacagagugucauucagaugggaagccaggggagcugggcagugcuggcuucugguuccacuccucuaccugugacagcaaucaaggcaguccugggaaugaguccaagccacacgugccuagguguguuuuguaugggcgguggagaggucuacccuaaccagcucuggggcaugguucugggaauggcuuauggccagggaguguggcagugagggcucaagauucacuugacugguacacuuggggccaccucuccugcaacccggaagaagaaggguucauuuucucagcuuauuugcacauguccauuugugggugugagguagucugggugaaauggugaaauuggcaaggcaagcacagaucuguggggaucccugcagagcacauuuugauuuggagagggcuagguguaacugucuuaguguaggggcugcugugccucagggaggagaaagaauggaaaggaagagggacguugcaaagcucugugcuguaugugaguccacugcauagccuccaggguugcagacucuccaacaaaagcuuugcaauuuccucggcccaaugcagcuuagcugaaaccucauuaucggccgagacagaacugacucgcucagcaaaaugcuuugggcuccaugagcgccaaggacagcaugaucucaacuguguccaaauggagauggacuuguccuccgcagaaaaaugggccgcucacucgaugcugccaguauggcugcacggucagcacagcgcacuggaacaacagugauggccaacaggcacugggaccagaagcuugaagaggcucaguaggggcucagaaaguaagcuuguacacagaagggggaagggcgggcaaaguccgucaugagaguuuccucaggugauuuaggguugccauaggcaggcuguguggggcugccaguuccgggcugugacauuugaaaugaaaugaagugauggccagacuuggccugggcccuguagguagaagaguggguuagccagcuuccuacccuguauuagccugugugaaucugcagugagaggguguccucuguggggugugcaccgcuccaagugagcagcucuagggagcugggaggacugcaggcaaccuucuugccagguggugugugacaguggucucauuucucuguguucacacaucugugucguguaggagacaaaaagaugaaagaagccauccauccucucacuuggacgugcaaggaaaagaguauggucaggccuggggaaaauggcaccuuugcugaaacacugcaguagccuugagagaauugguggacaacacucgaccuugcgugaggcggcucagucaggguucucuguuccccaugugagcucauaugggggauggagaggggucucaguucagcuugugagcugcaguugagagggagaaauuguguccuagacacucagguaccacuucagugcucucugagggccagcugauuacucuauagaggacccuccuaugacacacacaugucaugccuguguacauguacacaugcaagucuguacuuagcuguaguacauaccugcacauucacguguguacacaaaauccaugcuuuauaccuaugaacacacuaggcuacuugagaucuugcuauuagaccagaagaccuaugagugcagcggggugggggagauggaguacagguaaugggguuggggguaaugggggugaugggguagggauaaugggguuggggguaaugggggugauggaauagggauaaugggguggggugauggaggugauaggggugggggugaugggguagggauaaugggggugggggugaugggggggugggggugauaggggaggccuuguggcacacuugggaaaacagacccuggacuccugcaccagagacuucucccuggcugugcaggaaggcuggacaugacauuaaaagagccucagugagaggcuggauggccagugagucuacacagggguagagagucuggcucuccauagagaaccuauguauggcccaaucccaaauuucagccaguugaucuuggguaccugcugccagagcucaccugugggagggcagcuggcacugacauccuuauagcaacccagugccucuaggugcugcccaugagcaauuccaacuuacugccuaugccaagaagccaggaguguccuggacugcaggccugagaccuuccggugugcucuugaguagugggggguacagggguguuauaaggcuagcuugggguucuugcuuccugccuauaucccugcaggauacugcuggguccugauguggcccugaggccagcuaccaacccccagcccugcauguuuagagccuguguuucuuccuuuuccaugauguaacgaggacauugugggaauucaaggcuguugcacagagccugaauuucuuccaggaagcuuugucaggauauucucaauauaagacucuggcaacuguuuguuuuaagauuauuuuauuuuauuuuauuuuauuuuauuuuauuuuauuuuauuuuauuuuauuuuauuuuauaugugugagugcuuuugccugcauauguauaugcacuuuaugcccauggaggcaagaagaguaggauuuuucuggaacuggagauacagguggcugugaaccaccaagugguagaaauugaaccgagauccucugugaaagcucuaaguucucuuaaugggcugagccaucucuuuagccuugggcuugauuuuaacaaguaguuuguguccacccuggggcuuccaggguucuacuguccaggccacagaugguggcuuccagaaaguuugcugaggcugcaucuggagugaacauggcagccucaggaggcugagccucugacaaggguccucgaagccuccugcagaucuggcucguccacaggggagcaaggccauuggggacauccuacaaagucuuaagauuguccugaacagcugcccccugcuggggcucccugcagugggugccuggacuccaaacuaucacauauuccuggcccagagagaggcagauguaucagauucacucuagaaacauuccugggcucccgaggggucuggggaguccucugggaugccuuugaaguugcaggggcagaacuuguucuauccaccucuaccccagccucuugagacccaccacaucagagacuucuagagucuuuggacauggauuuuuagacaagacacuuguguacaagacugcugccuguccgccauccauuguagcgcugccugccuaucuaucuaucuaucuaucuaucuaucuaucuaucuaucuaucuaucuaucuaucuaucugagacauguucuccuguagaucaggcuggccuugaacuucuaauuuucuugcuagugcugaguuauaagcuaccacaaacccagggcuuugcacuugcuagacaagcauucgacuaaccagucaucauuccacuuucacuagguuagcaaugguuccagggaccugggagugccuuagcacagugcucugcauucugcauugcacuccaacagggcugagaccaugugauagcucccagucaaagguagcccaggauggagguagggucuucucagagccagacuggguuuucagccuuccucuugguccagcgucuccucccacuucucacaaggucuggaaggagucuaugaugaugucauggcaccuuuacccuguccucacacccccacacuguggcacacacaacugggguacagaaacagguacaggguagagcuacugcccuacccucuuguccuccuguccugcagagagcuccuugucccuugguagacuugcugggcacugggcauucaaggcccuucuccccuauccucacgugcagugaagagaagcuggaugggcuggaggcccccugggccaagacagguuuacccagcuccccauagggcuuggggauggauggguuaggaaggcagggacuccuugcccagccacaucuagacugagaacguugguugucugaagccagcuucaccugaguucuggaguaggcacauagggacauggagcucugcaccaguuccuggagcccuuuacccaaucauggaaugaguugucaugugguguguacccacacucagcaacagcgagccaccuuacuccaagccugcucucuggacugcugugauggauugcagagaugugcuagacagguuuccuggagagacagagcccguaaggggcagugaucaccaacauccuagcugcuagaucccaaaggcucccagugcuacaucgccucccaaaggcaucucuuccucccaucaaguguguuuauuuacaugucaagcuauggacuuaaagagaaaguauuuuauuugaacuggaugacauuugagcuacgggucguguugcuuaaugaagaugcaugguuuucaugcaccguucugccacaaggcucucaucugugggaguuuagaacacaagccuccgggacaaguaugggagggagggagucagggcggugggcaccucugcuggccucagagaagguguggaggagugauaggagggaggcaucuagacuggaugucaguaggggaagguacuauguaagcuaccgagagaggaucacuggggcccuguccccccccccauucucuugucccccaccucgcuguucccccugccuccauuugcugcagugcaggcugcagacagccucaagcagcagcagguagcuuugugcauguuuucucuguucccccaucccacugugacaggggcugaagccuagggcuagucuaagacaggaaggugcauccauccuaccucugguccccaaggguccagagugagcaagaccacccuucucucagcugccucuugcacaacuguuuuucucaucuuauggaaggggccuggcuccaguacauaguacugguguggaaugugguguggugguguggaaugcuggcguaccgauucugauugcuacaggcacaaacgagguagccacuauccugcuugcugguggaaagaacccuuuucugucugcagucuggauaggaguuugccugcugagguggggucagguguggugggucagcugguggucauggguacugggcucaugaguuaccucugcaacucaauguuaguuucaacccucagcuuggcccagccuaaagucacccgagaagggagucucaguugagagacugcucagaucagauuggccuaugagcaugugugugaggcuuguucuugauugauuaucauuugacagagucuagcccagguuggguugcuuuauucuuuagguacguuguccuggacuauggaagagagcuagcugagcugggcagggguguacuucuuuaagcccagcacuugggaggcagaggcaggcagaucucugagauugaggccagccuggucuacagagugaguuccaggauagccacggcuacacagagaaagacgaaaacaaacaaacaagguagcugagcauggaugugugagggagccagcaggcagcauucuccauggcuucuguucuacuuuagcugugagugagcucucucuuagagguaaugcuucacggaagagcaaauagguguaccuucacgucccugaccugcacuuaugcagucauggccugugaccuggaagggaaagccaaaugaauccauuccuccuuaauuuguuucugucagagugcuuugucagaaauggaaaggaagauagaguacccugagaccagggucaguggccucuccugguccucaugugacggucacuaggcagaccucaggaggaacuguuggccccuccuuuuccauagaggucagggcuugggaucucgucugcuauggguacagggaggagagaaccauguguagaccacacuggacgcaggcuugcucaaggauacuccgaaucccuugauccuuacaauggguuuuccgaaccccagugaggcuaggguguggaacuaagcuuugggguucagggggcgcagccuuugauguauucugagccugcuuuuccaucugucagugagcauucacuccuacuuuaacccaacccuagaccuguuucaucucagagauaggaguuggggaugacaagggacccuagaucacaagacacccacacucuccuucucagguccuagaaggccaucaugaguccauacucagugacuacaggugacacauccauacaggugacacugccauggcucaguagauaggaggccacaucuagacuuccugccccuccaaccuccagguuagccugggguccagcucacagaaaaguucacacuccaccucauggaaagcagggauaaagggcuuccuguauugugcaagaagaucauuucuuccuccccaccucccgagagcagagcagaacuguggguucaggaccagagguaguccugagaucuugcuagaaaagggucccgagaagcucaaugauuacauggucuugggaggaugugacauugucagaaaagcacaaggugaaucugugguguggacagaaugugagcaccacuguggagcuguucugugucagaguuacaucugcagugugugccacaguggccuggacuuaggaggugugugauaacucuugaauggacagguuaacggauggacacauggauggauggauggauggauggauggauggauggauggauggaugggugaauggaugaauggguggguggguggguagauggaugacauggguggguggauagacaagugauauacaaggaugauagauggaugaauagaugacauuaauaaauggauggaugagaggugguuaucugaaugauaugcaugaguagauggagggcauucauggcuagauggaugaaugggugaacaaaugaauugugugaauggauggauggaugggugaggagauaggugaggaagagcugggggugucacucaugguaauaauggaaauguuuccuuccuguuucgggugcucacuauuuacuguugacucccucugagccccucuuucuugcccuguggcuuugcuaaugauuccuguggucugguccucgcccauauuucaagugucugauucucucuguucuucauccugccugaguccucucccggcuccaccccugcaauuccacaucccacugucccccgaggauguuucuccucaccucucacggauacccagguuuguuauuggacacuuugguuacgccaguuugccuggaggaucauggccuccucagugucgugugaauuggauauuguucauuuugugcucaguuuucacagagagaaagcaaaucucagacaggcuccaggccacacagccaaagagcuggcuaguuucccacaccugacugccuacguguggaguacucuaugcuucugugccaccgaaaguugggguucccacacguucccaucuccccuccaccucugaacuaguaguagaggcagacacuacaaucugcucugcuuugguaggaaccccacaauccucuuaucaaggucuucagagaggagaggaaucuuugaaaugagcugggagccccccuccuuccacacucugggugacuugucauggccacagggacccagcacugcagauccaucaggacugcggagcccagcuagagaggcaaagaugccauugagcauacagcccugcagaggcuuuggaaaccagggagguagcaauucugccugggaugaagaaaaagcccaaaauaaaccugagagacugugcugucuuccagacagcacgcaggccccgucccugcagcuuauugcuggaaaguuucagacuaagucuguccuuagccagaauauauuacauauucuauuccaguauaguguaauauauuacaguauagucuuggugguagcgcugugugauggauggacuucaagcacagagaacuccacaccuggcacagcccugggucaccuuuguuugcuguacuguuuccauuguggucuucagagugcuuggauguucuggcacuuucugccccagcccugagcccacuggcaggaaaucacuggccccuuguggagcaccuucacaggccuugccucaccugcuccugcacacugagcccuacuuuccuuggccacggaauggggguuagugggugugcugugauggccacagugggaggccaugagcagguccuucacccugugcucaguaaguggaaacacucgcucuccuggucacugucacuagaaaaaucugauggacugggaggacccagccccugucuaaagcuggcucuuguccuugugggaaggguaugcacacauuguguucacggucccugcaggcucuucauccuacacugucugcaugucuugaugagaaaaggguguagugcaugauucugugagcucagcugcuccgugagcaggugucgccugagcagcuggaaaguuccagauucagcuuuguggggucaucugggcuaugacuuguuccuguggcauucaucauugauucuacuuaccugucaucuuuggauggacacguggugcuaccacucuggggcuauugacaauacugcuaugagaguguguguacauuuauguguguguauguauauauauacauguauauguauguauauguauauauauauacacacacacauauauauauguauauauacacauauacacauauauauauauaugugugugugugugugugaauauauguguguagguauauauauauguuguguguauguuugcauguuuguguauauauauauauauauauguauaugcaugugucuauguuuguauauauguauguguguauguauaugaguguguauauguguguguauauauguuuauauguguguguguauauguauaaauguguguauguauguguauauauauuguguguguauuuguauguauauauauguaugugcauguguguauguauauauguauguguguauguguguauguguguguauauauauauuuauauguguguguauguauguucguauguauguacauauauguguaugugugaguguauuggccugaguucuuuucaccuuuacaggugaaaugacuugagaaaauuuguuccaguguuugcucuaguuuccagguuuggaacuucugggucaugugguaauuccauguuuaacucaauaaaaaagcaaacauugcaucuuaaagaaacaucccucaguacuggaggcugauggugacagggacaugcccuccugauucuagggcagcugcauuuauacuugguaacugcaguaacugugagcaccaagcuagcaagugugcaagagguguuugguagauggauggaugaacuaugguggauggauggauaguugagugaauuguguagaaggauacauaaguagauggaugggcggguuaguagcugccugccuggcaggcuguuggcuagaugaaaagguggauaaaugaaugagugggugacagcagggguggguggaggguugauuaauugaaggguagaugagcagauagguugguggguaaauggauggauggauggauggauggaugaugaguggauggguaggugacuagauggauggacgaauggauggaugggugggaaggugaauaacgaaugguuagauacuagaugaauggaagguagauaagagcauagguggguggguaaauggaugggaagaugagucccuggauggguuacuagcuuaaguagcucuugagagcagcgucugcugggaagaagugugcuccugaggauagcuccuugcaaggucucuucuaggcuucucuccugcccacgacaucaggcuggacccccgaguucccagacccccaugggugucugcauuguuugcucaggagcucuugucuguuugcagggugacauccaacaguugcuuuucgucucugacaaccgagcugccuaugacuacugugagcacuacagccccgacugugacacugcggucccugacacaccucagucacaggacccuaacccggaugaauaugugagucaucucuggcuggguucaugguggcagcacaggcggaaccccaggaugguucagagucggcaggguugugguuauaaaggauucuggaagccagaggacugaguuuucagcaaacuguaggggaagcaguguaugaugucugacccaccuuaccacagaggagcucccccugacccacacauaccuugaucaagucucucaagggagugucaucaacaacugugucccuuagcucuccauaugcauccuuagaugaaugcagacagacaguuguccuuugcccucagccuguggccucaguuguuuuuuagagcucgguugauucccucaugggcaccugaaauuuuuuaauagggcaugcccggcccuguguauauuggacaugacuccgagaaacaguaagucugaagggccgccaugucuguccccuuggucccucuccucauuucccacucugcugggucacucuccucauccccugugcccuccuccagccccccccccccaggucccugguuuguauuugaggacagagugccuguuagugacugugaaccccuuucacugggcacccaugcuuuggggcuaaaggugaacuuugcuggucuggguuugauuuuuaugggucacauguaaccacuuuuagggcucagcuuuugcugaccucucaguaacguguggggucauccuuccccaugcuaggcuucuggggagaggcugaggcaagagcccuaucugaggaccccugggacuugacagugccuuauggcacugcuuuuucacccaaguaggacaaggugguugauaggcugcuuugguaauacauuccuuuucuucuccacaugggcaccauugaccucaguacccagaaggagagggugagaccuauuacuaugaguauccauauuaugaagacccugaagacccgggaaaggagccugccccuacucagaagccaguggaagcugccagagaaaccacagagguuccugaggucugaucuggacugggcugggcuagggagguuccugguuccccuaggccacaggguugagagccagaggcuaugggcauuauggcacacuaauaggacauuguggaccuauaauccuaucccuugggacgaugaaguaggaaguaggaacucaugaaguaagcaugaguucugggccagccugggcuacaggguaagaggccaccccaucucccccccgcccccucauacacacauggaagcuuaagcuguuguuggauaucuggaaauauccugauaugucacuagaugguccuucaccaauucaugacaucuugguaccugaucucacacacacacagacacacacacacacacaccacaaugguugccucccucauuuucucugccuuccaggaauggagggccuucguguaacuccaugcccacacuuugcugaucacugaugugcuaggaggaugcuggcuugggagcuugggaaauccuggaucagguaucugacugccucuuucuacacucugcccacaggagcagacccagccccuacccgaagccccuacagugccugagaccagugacacggcugacaaggaggacagucuagggaucggggacuaugacuacgugcccccagaugacuauuacacuccacccccauaugaagacuuuggauauggcgaggguguggagaacccugaccagcccaccaaccccgacucaggggcugagguccccaccagcaccacuguuaccuccaacaccuccaauguaauugccuuccuuccaguuuguauugaucucgggggcagggguggagagggggcaaaggcuucguggcucugggucacugcugagcacgaaccuccuuggguggccuuccuuguccacacuccacacccuggcucccgaguccucaguagcaggguugagugugguuuagaagccauuggcuuuucugaguuuauuucaguucccccugaaaaauggguagaauaucuccgugggcucugcauucuugcucucaggguagcucacauaacacuguaguuuugggauacaggaguuccauccaugaacaucacuggugguuacccaugcuaccagaauaaagcucauagcccacuguguucuucacuauuggaaagagccccaguuuccagugugcaaacucuuaaucagcaacugaacgcagaccuccccagggauagagucagcuuugagggacacuguugcuccuuccugcccugacuuguuauagugucuuagguagccuggagaaccauccccaugguggccgggagguaugcagagaaccuuugggggccacaggucuucccucauggaaucccccuuggacuuuaucuuuagauguucugugguggggccacugacagcucuaugcaggaagugcuaggcucagugccugcuaggcagagccugcauguggccaggcagagccugcauguggccagccucccagagugacucugccacuucccucccuuaaucugcagccagcuccaggagaagggaaggaugaccugggcggcgaauucaccgaggaaaccaucaagaaucuagaggaaaacuacuaugacccguacuuugaccccgacuccgacuccagugucucuccaucagagauagggccaggcaugcccgcuaaccaggacaccaucuuugaggggguaagagacucagcuucucucugcaucccagggcaucuagguggugagaaagggccagcgcuuuuagaagucugagggugacugagugaggcaagagugacaugggcugccaugcauuucaacuauuaauuaauuaauuaacuagcuagagacacguucucacuauguagcccuggcuguccagaaacucucuauguagacuagacuggccugguacucacagagauccaccugccucugccucccaaguuccaggauuaaaggcgugcgccaccaugccuggcugagcuucauucuuuaaaguagccucucugauuccuguuauggucaucugugccucacugccugucuaugcugguguauacauggcuaaggguggggaugggaggucuauuucagcuugcuaucuuccuccaguuaugaggagaggugacuagcuguggggagaauuucacccugguuuugcacaaguuuugugucauguggauuuucuguuccuuuucucucuccccaucuuuccagauuggaggaccccgaggugagaaagggcaaaagggagaaccagccaucauugagccgguaaggauuucugguggugguggugguggcgguugcaaugguggugaguguguguguguauguguguuugugugugugugugugugugugugugugugugagagagagagagagagagagagagagagagagagagagagagagcgcacugugguguccucuaacaagcucaugaugauuuguaggguguggacagauugugggucccacugucugccuaccaagccaugcaagaagccacacccauguacucuacauccuuuguaucacagauucuugggagaggcucuggggagucagggaauauucuagaguuuaguaaaggugauagaucacacguguuuguccuuguagagaaggcagaggccagagcaccucugcagagauuuccucaagagaaggcacacagaccaugagaggaaggcuaagccaggggcugggugggaaauuucuaguguagguagcaggcagggggcaguuaguuagggccuucaccucucugugcccuuuaugccuccacuugagccuguuugcugcaacaggaaagaucugaagccaugccaagggaauguaagcaguguugagguaggauuccccuuuguguaaagccccauguuauuagacaguggaauccuggguaagcuagcaccagggccuguagagaaugugauugugugccauccauggcccuccugggucagaguuuugugagagucugccuuggauagggcauucuggaccagcuaggugcuguggccugcuugggucucagaacuguugaggucagggucuuggccccagacaacagaaagcugugugauuggcugagcugggcuugguggaccugggaauguggacucagaccuggcuuugcccccaaggagccggccacugaggucguccauccuagcauccugugaguacacaagggaggaaguacuuguccuacaucauggccauugccaggcugaacagcugucagcuccggugccaggaucagcuucugggacacugccaggaucagcuccugggacugaguuuauaaugugaccuugggacuuccuaggagagagaagcagccucauagggcccccacccucuugcagggaaagagccuugcuuggcagugcuuaguaggccagugggccagggcaagcucccuggcuuggcuucuccuggccaaggggagccuuggauggaagccucuuucugguuccaagggcucugccugcugcuugugccccuggcucccccuggcagugagccugaggacacagaggcucuucccagaucucuuccuagaucucucuauggguccagagaaaagauccuuaccugaggcuguaggaucagggcccaaaucagugcauggauugcacacagcgaagggugcagagcauaagguuagcccaacauggggcuuuuugcucaaccucaugagaaauuucaacugaaguucauguucaugggagaaggaaauuccugaagaggagcauccuaagggacuagagacuuauccccuggaacaugucugaggcuuuuucucuuccacaccagaggaaggcuguggcacagaugcccccccugcugugcugggccuucuuagagcaccacaucaacugcacuuggccccagguggacuuggccaucacuugcagcccauugaugggcucccuggugcuucacuaaaaggggcgucuuucccgagucaaugauguuccagagaaggcaggcaccugaggcucugugggcuucaagggugguccccaguuucagaagugguugggucauaccuuugaauaagacuuacuuaagcuuauuguguguagaguuggcaccccaguucugggaggagagaggggcaugcagagaguuccacuagagggcugcccugaagaaggcugugggugaaggugagccagagacagcacugagaauguagagguggccugccggacaccaucucuaucuacaugguccaguuccucuucucugggaacagcacaagccaucuggaggcaguuacagaaggggcccacccccuccugaugcuugcuucuucccagcuuccucagaguguccacagggccuuuggugaguccccauggagagaaauguaaacauuuggaauugucaacccggagaauugccagaugucuucacagucuuagccauacauaaacagauggaggcccuggggacugguggugcauacccugcccugugucgggguggcugauaucccauccccuacaucugccccacagaauagguuuacaccaacugcugggcacagggucagugcaacccugcauccagaaggaccuggcaggccuuuuccaccgagguucagcuccucucauuugucagcaagacaagggguuccucaaaaggacagaucuagcuuggcugagaugggggaagauccagcaaugcccuuggcaucagcccacacugggucagggaccacuaaguccugauuggacaccucuuaccuguuggaccucaagccguuccugguuugucuuuuucugagacgauguuucaaguaucccaggcuggccuugcuaugcacuugaggaugacuuugaacuccugcuucuuccuuccuuuucugaguccugggauuguagaccauacccaguaacgacagugcugaaguucaaacccguggcuuuggcuaugcuaggcaaugucugcugugcgagcccagcccgacucugacauugcuuuuaguucugcuuagcaggugaauggaccacugcuuagcagaugaacggaccacuguuaaggaugggagcugcaaaugacaguacauaccuaugauaccaggaagguugaggcaggaggaucugagcucugggauagccuaggcuacagaaugaaguuuggucaagccugaggucuucuguuucugaauuuuuguuuaaccauauguacuuaaaguaacaaaacagcuuuucauuugugugugugugugugugugugugugugugugugugcacaugcaugugcacacacaugcuuuuugguauggguaugugcagugcauaccuguggguguauguacauauauacagaugccagagguagaugccaguugacuuucucaauugcucuccacuuuauuuccuaaagauuaaagaagauuaguaugucauaagugucugcugugugugugcaggugcccucagcauccugaagagggcuccccaagaauuacgaugguugugauaagcucagcaguuggcuagacugcugggcuagugagcuccagggcuccaccagucuccgguacaggugcacaccaccaugccuggcuuuuggauuauauuguauguauguauguauguauguauguauguauguauguauguauguauuuuggauacuagggaucuagacucaugcucacacacuuuauugacugagccaucucugcagcccucaggcaggaugcuuugacauuucugaguuacauacagugaagagcugagccugccacccagugccuuucuuugugugaacgugggcagcaugugcguggcuguguugggaguuaguggggguagcugaguuuacuccuuacaggcaaccagugacugcagcccuguaagccacagagaccauuuccuguaguugcgagccccagugcauucagugguagguggguuggugagguacaggguagagauagcgugccucagaagaacaugggaccgggcugcuuccucuauccuuuuuaaucugaccugggugauccaggacugaccuccugugagauccagcaaugcugcccccgcucugcaaaacaacaguauguguaucuggaaagacagcugcugucuccugggcccugcaguguuccccuuaaucucccuucccaacuccugagucuucccagcugccugucagaggaaaugggaagugggagaugagcagcuuggaugaguucuccguguacaucgaacgcacaaauauuucuccucggcgcaucuguguaaacaugguguacggcuuccuagagaccagaggaccucauaggcagugugaauaaggcuuguguguguguguggcacuuugcagccccuggucaguuguaccucaccucaccccacacuccuuggcuaugguugaccagccugccaggccucacaccuaugccuacauaggucuuuuuucacuugucaagacuaagcccaaguuugacaagagaguugugggcuuucaaagacauaucugaggcauccauuauccugggagaauagccauuccuaguuuccuuuggcugggagacuagaaagggaccuggcccagggccaaggccuccagccacucacucauuauucuugcaaucucgagagugaauaggcagacacuaugccugucuugcacguggcuagccugcaggcaugcaagugucucgacaggguccugcagcuaucgacccaaagccuguccagacucuugaguaccagccccacaggacucuuguguugauuuugccccccucuacucaugccccaagcacagauccucuuuccuaagguauacguggggacucagaaauucaauguucuaaguggguggugguagggagaccaagagaaaucugggaguacuuuuugaaagaggacauccagaaauacagauccuagaacagaaaagcucucuuuucaagacagagccaauagacaagaggaggggguugggcacagcaaggguuaguggcaggauggaccaagggcccaggaaugauggagagaagagugaugucagcagggcgcugggcagaggagggacugagccuucugcuggcugaggcaggaggccugacuacccuaggccuuccuagcuuuucccaucaguccaccugggguccugggcccgggguccauucuguccuuccagauacucuucagacagacagcaaagacagcacaggaguugugucugggcucuguuuucucauuuuggcaaauugcgguguuuuugucaaaguuguguuugaggggcgcccgugggccccuggucacuggcuggaguucugcaaagauagagugcucucccagcacaggcuauuucccaugagcccuagcaggaccgacugaccucuuggcugacuguugucuacccaguuuggaagcuggguugggcuccuggucuuagcugcccccuuucucuuucucucugcaggggaugcugaucgaggggcccccuggcccugaaggcccugcugugagugccugguuuuauuagccucugacuugugacaggaacuacggggggggggggaggagguggggaucuccuggauagaaaguuggauacuccucacuuucgcagauacccgggcaaggacuucccugacccugcuucuguucucacuuaacuagaggagaaggucuuugcccugaggccaggucugaaacucugucuugacuuuauuuuaauuccagggucuuccaggaccuccaggaacuacagguccuacuggccaaaugggugacccuggagaaaggguaagagaccacaguucagugccaagaccauggacucuggggguugucuguguauucuuccuccugccuguaggcugucuucccuccccgcucuggauccuguguuguuauucaauguagaaaugacaguaagaacaaccacuccuuccucaaauugccccucuucccagggccagcccaugucacccccucagaucuuuauggacuugacugcaccuggcuaugugccaugagcccaauaaccaaccuggguccagaggcagccaucagucagcccuaaacccucagcaguggcucuacauuacaucaguggccccaggagucauuuuaagugacagcuuggguugggugcuuccucugugcuuugcaggagcagcuccugaccuggagccugcauugguucucacacuagccccucuuauuagcaaucaagccacuggcuggggagguuuguucugggugggauauaagccaugccauggggccuugagcuucuucugauacuuggugauggguucgugcacugaagccuguggguuucugaaucccucccuccccuuucugcuggcucaccuaaugaauaucaccauuaaaaaucaaacagccggaccgggcagugguggcgcaugccuuuaaucccagcacuugggagucagaggcagguggauuucugaguucgaggccagccuggucuacagagugagauccaggacagccagggcuauacagagaaacccugucucaaaaaaccaaccaccccccaaaaaauucagacagccaaguuguaguugaugacaugcauacaugugguaaggacaggcauuugucucugauucuuggaccagcaagcacaguuuucuagguagucaagcaugaaaugaaaaggcagaauaugaugucgucacaugguaggguauccuguagcgugcucugcuggcuagggccucuucuggcagcagcugggauagcauggugguuugggcaaugaguaaagagugugacaguauucaggagguaagggugaccagcccucgggcagcaggaagagcacaugccugugaugcucggggaacuaagugccuugcugggacguccccucaauggcucuguaaaccagcgaagcaaaaucaauuuugccuggccaccuccaaacuugccgcuaucaauggagguuguaaggguggguguccccacuagcuggauucaguuuggggagggucuuucaguuugaguucacuuuauaaggaggucugaccucugucccuguaagccagggcuugaaaauuaaucccgaacauacuuaaaguugcucuggauggcucugugcucccauggguggacuuuccuucucuucucaccuaucucugggucuguccaagcgagugggugcucuacccuguccuccagccccugaccacaugcagagcuaaggacuggaugaaagauaaacugaaagauaaacacuguccucauucagccagaagagcuuggggcugcaguucucaguccccacucugguaaagacugcaggggcuacauggaaggauacgagccagccuccgccuuucucaagccuccagccuggaacuagacacaaucgccugccuuuccucucagaauuucuuacaucuaacucagcucccucacucccuaucuccacagcccccuaucauguugcuccuuucuagagcauuccaauguuucuagaacauuccauguuauggagucucauguugcucugugcuugccuagccugcuuucugaccucucguucucacacugcugcucagcuaugucccuuugucuuucugaccaguuuucuuuccucccuggcugcagggucccccugggcgcccaggucuuccuggagcugauggcuugccuggccccccagguaccaugcucaugcugccggugaguaucuuuagcugggaugagggguugcaguggguggguccuggaaggaucugcggugucccaggaaugggguuugggcaggguguuugcagcugcucuagguccaugugauccagucugucauugguaccaggaggagaaagaaaaaucccacucucuuggugagguuccuagagaaacuuacuucaaggcucuuugugacaauggcuagacuccugucucccuaaagaaucgaccagugauugugggugggagggaaacagggacuucacuggaagcuaucuguguggucagaugucaucuagaaccuucuagaugcugcuuuccacugaaguuaauccuaaguaguaagaaugaagcccaggcucacauucucaguguccauaagaggagaaugguuccucuggcuaguucauucagccaugaaggauuuggagcucagagagugcugaaggcuagccaggcuccaggauuccaaacccagaaguuucuuagacaucuauguccugguagccaguacccagccacugcugcuggcacuggggucucugcacuuacggaagaccaugaagugaggguguaugcccugggcuccuguuuauccucuggagaacaacugggcccuugcagaggugcucucaggauggaggauucuagguaggucaggccuaacaaacaaacuuggguaagugaaugaguuagaaccaggcagagcuggaccagacccucagccaccuugaucuaaacuauuuuccuucaccuucaucucccucacugugccugaguacuguguccgcaggacugugccuucagcaguguguccucagcacugugcucucaggacuauguuaucggcauuguauccucaggacugugcccuggcacugugcccucagcacugugcccuagcacuguguccucagcacugugcccucaggacugugcccucagcacugugaccuagcacuguguccucagcacugugcccccagcacugugcccucaggacugugcccuggcacugugcccucuggacugugcccucagcacugugcccccaggacuguguuaucagcacuauucuuucaguacagugauccugggacagcuggucugaaggaggauggaaaguuggcagguuccccucuccaagggcagaugauaaagaaugccacauuuggaacucauguccucuuccuaaggucucagaucaaguguaccaacuucacuuuacccccaagaugccuguugcacuaagggagaccuaacauggaaccaggguguccccugcaagucccuucaaccuaguccaguuucuuuggccuuuggcuacucuuugcaguugugagggucugugguucaucaagaugcaaagcaauggagguucaaaguccuuuguaggcacagagcagguuucagguguccaaggcgaaggcugacaggaggggcuguggcguguagauuagggucgugugcacacauggggucugcuauugggagucucugcuuuacuuaaggcccaugagacccaccuugcucuggggucagagugggugcccuguaccaccucuuguaacuuuucaccuugcucuugcaguuccgguuuggaggcgguggcgaugccgguucuaagggccccauggucucugcgcaggagucccaggcccaggcuauccuccagcaagccaggguaaguaauguggaccccuagggacucaugugacagagcuuggccaugguggcugcacagagugaaugauuguccuacaguugucuggucaggaaccuagggaagguugggucuuccaugugcagcuggagaaugugggggaacuuacagagagcuuucagggcuauccucuccacaguuagggauaagaggucucugggcuuggguugggauugagugcaaggccacauccuaggagagagcucccagauccagggucccucacucugggcccagaaucuuucauggacccucccaagcucuugcacuggcuccaggaucucucacacugagcccagggucacuuggucuggguuaaggguucccuguuuccccagugagaguaucugcagauggcaucauuagagaauguaccuccagauugcugguugccuaugacuggccugaugccaccacuuccuauggggugggcaggaaguguggagaaagccaacguagaauccuuguuugggaaauguugauacuacucugcauggcuuagaggagacauuaauggccagagucugcuaggauaauuggaggacaguuucaguacggacuggaugccauggaacaggcuugccggugauaaacccagucagaugaggcuguaugugugacuagcuuugcuggccugugccugcccggcagccucuuaaacugugugcauuuuaauagaagccaaccaggagaaaggcuuuaugguuugucuguuuuuuuguuuuguuuuguuuuguuuuuuuaagauguauuuuuuucuuucugugagugaguuuuuuugccugcauguaugugccuagugcccacagaggccaggagagggcaucagaucgugaagguugugagccaccaugugggucuuuuagaagaugugcucuuaaucccugagcuaucucuccaguccugauuucuuuuuuuaauuuuuaauuuuuuggaauauuuuaaauuuuguauauuuuuauuuauaaguuuaaaaaguauguuuuuauuauuguguguugguauguuuacacaugugugugccuguguggggcaaccugaggucaacguugggaauuuucuuuugagacagugucucucaucaaaccuggagcacacugguucagcuggcuggguuggccggcccggggacccucaggaaucucucuguuuuugccuucccagugagaugagacagaugcugaaacaucuggcuuuuuacauguguagugggaauccugacucagauucucacguuugcauggcaagcaauuuaccagcugagccuucuccagaacccccagaucauuuaaaaugcaaaauaaucuuccaaaauuaucauggcucugugguggggguuguaacgcugcucuguugcagggagacaaguugagccugcgugauggcuggcaggagccacaccaagggggacggucaauucaugacugagaucccagggcccacaggcuccuccauguaccuaccaugcacaccccucuugcuacuggagaguacuuugugccucuuccagaagugaagucugaaauccacaaggaaaauauaggccucagcccggcccaggaagggagauuauauuccagauuugguacaggaugguccaccucuccaacagggaaaaaaaagagagaggaaggcuuuggggacccugcccacaguggggcagcagguagcacugacuucuaccucugugccccacuucucuguggagaugcugagagcccagaauugggucagugagaccuucucugugaaugucuagucuuuucuguccuaggcuccuuuuccucgugaccacguguuauagaacaggagccagaaaaccaggacaggaccaaccauagucuuuuucugaucuccuccgcuuuccuuuacaguuggcacugaggggaccagcuggcccaaugggucucaccgggagaccuggccccauggugagugauuggcaggacuggcaccaguugguggagcacacuggauagcccugugcccagaaccuuuguuuccagcugggaaccagcucagacagguucuuucccuuugugggagcacgugucaggggggguggcuguguucaaggucaccugaaguuuugggggauuccugggaaguagcccucagcuugagugugaugggagaugggggugcucccuucccacuugugcauuccagcucuaagcagcucucccugugaaggacaggcucuaggcuucucccacuuuucucuaucacagggaacacagcggauaggggcacugcuguaguacaggccuggagaugucccccaaauagcucuuagaccuaugcugacugugcucucagcucaugaggagucagccucuguccuuuuugggggucuucuuucuuacaguucugucccagugucaaagguaaccccaggacuggggaaagcacgggguuuccuaucaggcuuaggugccccagcucagagcaaagcagggaugcuauggauucagggacccucggcugucauccgugugucaaauacauauugugggcacugggaguaggacccuacaaggacacagccaccuccugguccuccagagcugaggacugaacccagagccuugagcuugcuaggcaaaugcucuaucacugagcuaaauccacagcccuaaggacacaugauuucuauaccauugagccccuggcugacuuugacauaggcuaccucccacccccaggucugaccucaguacccugcacccaggaggugagaccagucuuaacuugaacuggcccauaggcuaugcacuguguuccaagcuaggggcugucacaaaucacgagccagcuuguccugggggagagaaaccucuuaagacuucauggucucugugagccccaucuccuggaguucuaguaagcaccaggaggagaccuuggcggccauaggucucugccuccuagaacucacauuuuuacuuuugucacaauaggcaggccagccuugugaugcgggcucccuaccuguuccacacauagcaucucaugucacuuguugguguacacacugauuugauacugucucccuaggguccuccugggaguggcgguuugaaaggugagccaggagacaugggaccucagguacgugugugaaccuaccucugcuuugcucucaggaaggugacuccugguuguugcuggugguccaauugcugauacuucuucaacagaagcaggaagaauuguuacuugauagcauagaacaagcucuuuguguugucuguugcuagcccucacuaagggaauacccccaagauacucacaugugagcaacucgaaaaacaagccuuaggcuagguugacaugcgugggaugaauuuucuuccuuagaagagggacauguccugaugcuuuguccucugguuucuggcaggguccucgaggugugcaaggcccaccuggcccaacagggaagccuggaagacggguaagugcuuggugcuaagaccaugugguaugagacagcauccaugcccagaucugagguagacuguccccuuuaggacccauggucccauguccaccuccaaagcugugucugagccacugcuuaggaauaaaugcugcguguccagggcugagaugguucacuggucccuaaagccaugucccagacaggucacagcaggagcuggauccacauuguugauuguuugauagugggccuuaucuuuagggacaccucaugccuccucuccagaaauggcuaugucggcucuguacgggucuuucuucagcucacuagccucuugagauuuccuguugaguacgcuguccuccuggauggauccagcugguuuccucaggcacacagcggcuauaagaugccauccucuuaaaaagugaugaccacacacuaggaaggcuagaaaagucuuaauuaacuugaccuauuucuacaaucagaccuuauguguuucauguggagaccaaaacugccacuguccacacggccugugugccugaccaugagcccaugagcaacaaccccaacacauggucaggcaucuauaggagacagaaacgaagaggcugguggaccucgauagugagcagggguuuggcagggaguuccucucccucuagugacuguagccuuuauagcagacucugaagguccaggcuuggggccuucagucucagggcaaucaacugggcacccuggguuugcucuugaacauuuuccauaacugagaagcaagugcaagaauggacaaagacggcugaccagcuggucacacagugcagacccugccuuuaggucacuguguugugugagugggacacacacccucugggccggucucauacuugcuaagguggacugagagaggccuuuaucucucccaugcaucuccagucuuuaauuuucuucccgguaguagcaaagagcugagcuucuccaugguugucugaggcacgucacaagccagaagagcaagcucccugugccagagcucccaaaucccaucauccuccacaagccuagaggacaggcaacaucaggcuccuggggcacacugccggccaguggugugucauggccuuggggcuguuggaucuggguccccuguccagccugaugacaguggacaaucacccuugguuggucgccucucucugcuugguuuacugggaagcugcucccagaggauguggcaggcugccuuuucuuccuuauggacaucuugucuucucuguuccagggccgugcuggaagugauggagccagaggcaugccuggacaaacaggccccaagguaggccgucacccacacucauacagucaccaucaucccugacaucauguugaugacauaacuaucauguuugaugagugugccugcagggagcguaagcacucacuuugaugagccccccccccccuaguguguugagaugacagauugacaggugacuugcaugggugagauucagucuccuuaaagggucaggugcccuguucauguggccagugaguguggugggguggaucagggagaaccccuugggagugugcagguaagcagacuacaccguuggugcuuggguggccaggugaucucaagucuaugggacaugaauuuuccuacccugccuuggaaagucaggacucaaggccuguaggggugaguugacacagucugugcuugagcagggggcacaggacucauauagacacguggcagcuguuuuuucccccugauacuguggaugcugggcucaucccucuuccugugaccccguauggacucucucauauuccugagucaccaggaacugucacuguucaguacaucugugcuggguccccugguuccauagucucacuuccugugaccuccaaguuaauaaacacugaaggcuguggaugauggaagaaucccacuguucugucaaguaguuuacgaucucuuaacugcaaagucauaaaaauaccccaguacccuacucugauuucauccuaccuggguugaauacccacaugaugggcugcugguacugggcucuaugcuggaaugcaggagccaggggucccugcagguaaagaugcaggggucuccaccagugagugugaucacuggugugugacagcccucaggaccauggggauauuccugcagggagagacucggagcaaaugagcccaugcugacuuugcaguggucacugaauaacuucaugacuacauucccaaggaugcccuggccuuuggcuuggggacaacaguguuccucucuuuccagccucugcuuuguuuggggagaggagguggcauauacagacuccacaguguccugaggcaggagggcugugcauggccauaagaaggcccugaguccaggguguugaauuauggguaccccuaguuccugcugugugggcuguuugguucaucucucuuguucuugcagggugaccguggcuuugauggucuggcuggguugccgggagagaaaggccauagagugaguauuugcugugggauuugugggggucuuuucuuuccaacagccucagguuccuccauuucacagugucucuguauguacuguggagucucucuuaauggagaaucuagucaagagaaguuggauuuccuacaugagacuuacgagcaugucuggcaagcaccucacuccagggugucacaggggacagagaagugagggaaaauaugugcuagaacuaguuuuagaaucuucuagaagccacuuuuuaccuaauggagccuucacauucaugggaaaucugaacagcuaucgcaugcaagcuuagagucaggacuguggccgcaggaagguagggcagucucagagccugcugcuaaggauggcugggguugggccacuauggugcuuggccgccuuucucaccgcucgcugggagugguuccuuucuuacuugcuuuaccuuaaaguggauuuauuggucaaauuucucauuuuggggcauccaggcacacauguauguguauuuacauguuuguacagauauaccuucacaggcauacacacaaaggcacaagagcacauauucauccauacacauaugcauauauacacauacauucauagccacacacacauauacauauucacaggcauacacauauacacacucauacaaacaugaugacauguguggauacauagcaagcauaaucacuuaggacucagauacauaugcacacauucacaagcacauauacauacaguuacacacagacauaggcacauagauauccaugcgcauauacguguauguaagcacgcuuguaugcaaauacauacacauaggcacagacauucauacuuaccuagucacacacauacauacagggcauacaugcauacauauauauuaccugcacaaaauacacacaaagagggaugcaacaauacagucaugcauacacauggacaaaaacaugcacauauaggaacaugggcuauugaugaauuaaaaaacauaugcagauaugugucuuacagugaaaaaugucugugcucuguauacucugaauagugucucacccacagcugcuacuucucugcucuuucguaauuacgugaaaacaagcucacagucaccaguuguggggaguugggagaggugcguaguccuuugaccagcugaugagaguauacauugagcgccagcuacaggcgacacugggaaugacccucagggauucuugguccagcgugguccuuuuugugcugcccucccucacacugaaugcacagugugccugccugucuguggcuccugcuaaaccugcuaggugcucaggcuggugauucugccaccagcaagguaugcagauggggcucgagugcaaggcucuuggccagccacuagacugaccucucagcacacgcccuccgcccaggggaacuaggcuucaagacugaggguuaggauuaggaggacagaaaaaaaaggggggagggguugggacaguugggaaggaccugcucuguggugguuaacauugacccugguugguuuuucuagggugacccugguccuucuggcccgcccggaaucccaggagaugauggagaaaggguaaguaucucucagcauccuuuuacacugggaaacucugagugcaggccaggcagggucgguagggcgggggggggggguaagggggggaggaggaagcaugcauguuggcccaggcagguggcugugugcuucugagauugaagcaaggcacaagcauucacuuuacuuuacccuucuugccaaugagggucaaacugucaugggucucagaaaggaaaccucuaacuacaggaggcaggugccccagauccuguggaggggagaugccagggacuuaaugagcucagcggcucugcugaucucaucuaaaugaggugucagauggagaagcaagggcucggggagagcaggcgguggagggaugggggaagucauuggugaaguaacugaauauaggaacaguggggagggaagggcugcaguugggcuucuuagccugggcuuuuguacccagaggacuccucaguguccauucccaguauccucagcggcuggaggcugagcucauaggccacagcacagaugugcacagcagagaaugcauggcaggauuuaugggcuccuugcacuauuguugggagcccacaaaccccaggaaagugggagcuaggugccaucaucucuagauuuugaacuuuguccagaaaguuccccucucuggaccuuggccuaagcagcugcaagcugaggaaggagagggguacuuuuggaugccucacccucuugguucaugguggguuucauaugcaugcauuugugugcacauaugccuuugucgacguaugugcauucacagcaugugcauacauguacacuacuguauaugcauaaguguacucacuccuaggugugugcauguauaugcaugugugugcguauaugcaugcauaugcaaguaauauguguggcugcaguuauugaacauaggcacacaugagcauauaugcuggcaggugcuaugugagcaugcauggcuguguuugaggaaggcaggagaacugaguucugugguaggaagcagcaucugcuaguggccccuguguggccuggugaaccagagcaagcaucccaucuggagucaggaggaaaaguuugccacuggauggcuuggaucccgguagacccugagcucaccgaagucugccugggcuccucugccucuccucugacacccuguucuucuguuucuguuacucaugaggguggccuaggccuugaacucagugucugccuaacugcccuugcuacaguugugaguguagcugagaagcaggaccugcuucagagccucacgguucccugcagcagcugcacccuugcagcuccagaaugaggacagggcccucuccaauggagccagcauuaacacauuaguguaugccugaggagcaggcagaguccugcugucggguguguguguguauguguguguaugugugugugagagagagagagagagagagagacagagagacagagagacagagagagacagagacagagagagagagacagagagaaagagagagacagagacagagagagagagagacagagagagagagagagagagagagagauuguguguguguguguacccaggccucaaugcuuguacuuaaacauuuuuuuucuuucuccauagggugacgauggagaaguugggcccaggggacugcccggggagccuguaaguugcugaugggagggacucugggccucagcuccacagucaugagcugauggguguggaguagguuagagagcuuggucuagagaaagaggcacaugacauuugcccaggaaagaaaagagggaggacacuaggggcugggcaccucuagggaguguauacuggcccuuucuacaagaggaagaugggccuuggagagcuauagcaaaugcccaggggcaccguaaccccaguggaauuaugcugggugccgacgugcugcauggaggacauucagagggcccaugguggacacucaagugugucagaguagacaggaagacacaguauaguggguguucugcaggaaucauaacaguaacaagguaggcauugagggcauggugguagguguccaaggugcugcagcagacauuccaucagcagcuauagugggugccgggcagucgaggggacugaauaggcccaagcuugucuuaggccuggcaacuacacucuacaggguggugcucagcucgcugcaggaaaagcugccuuuugccagccaccuuguauuuaggcuuaaagcauauuuccacaagggcaaaaggacauuaauuacccugcauuuacugauguucagaaaccuaccuuuauuauccaagucaggcggcuguuuguaucuggugaagcuaauugaugagcuacgccuuaaacgccgugcagggcagagcccgggucggcaugcucagguucauuugggaugaaauuauacccuagccgucugauuaaccaccgaggaggauccgucagccuuguucuccuuaacacacaucuaaauggugccuucuggguuagccgugucucaaacacauguauaagacuaaguauuaaaauaaugaaggaagcauuuaagacgcagagaaugugaagaaagguugggcuuuuuugguuugguuuuguuuguuuauguccuccccagccccaucuaauagguucuggcaaaauaagggcaauugagauccaagugucuugagugaaaccuauaauuuccuagguggaccauuccccuagacuucaguugcgccucaggccagaucuucaguguaggaugcaggcauugggcaccgcccuucaguguccagaggagggaagauagauuguggcucucccaaguagcuguccccuacaaggcccuauaaaguuucuugcaagucugcugucuucugaaccuguucccugcucccuugaacucugucaucccagaaauggcagcauugcaugucacuggggagagagauugaagaaagacucggugauaaacacgggacccagcaguacaauguaacuucacgaguuuucaauagagaauuuugugcucaccuuccugaguaucagaggcaggcagaaaagaccccuuaccuuaggacaccccugaugccuagccgggucccuccauaccaggagcguccuacuucugauccccaguguccagguggagaggaagauggggugagugacagugggggcgcaucauggcaacucucucaggauucuggagucaccagcugcgcucuagucgggcacaggguacugggugugggcuguacagggcagacaagcaggccacaccuccagccggguuccauccuucuucaucuuuucuuuuugcagggaccacguggucugcuugggccaaaaggccccccagggccuccuggaccuccuguaaguucugucaccuccuggugaauguguacacaguauagcaccagaaacccucugacccagcuagcaacaccggggccaugggaccauggggccagggggccaugcugaccuuaguguaugccggcuguaggugugaggggcuaugggucauucaugcucauacaugaggaaccagaaaacgcguggugcucaggcagcuggccuugcugcuccuuuagacuuuucuacccccguucuggcacacagcaccugcugugcugcucuugcuauuguuguuguuuucugucauaagcaguaccucaggaugccacacugucccucugcuuaagagccuuccagcauuuugggggguuugguuuugggaaggagggagaggcucaugguauugauugggguucucuguuuugggugggugaaauuagccuugcccucuucggccucucuaggagacuuuuucuagauugcagggucugcucauaugagggugcuggggccugacagcucagcuaccuuauugugaaggguaguagccccagcuguuagggguggacagucgagacuguccuuuccccagaaacuacccacguccaaguaugcagaauggagugaguuauucuguguugaaaacaccuuuucucccccuuuuuuauaacucuccugcaggguguaacggguauggauggccagccuggcccaaaaggaaauguggugagucccaggggucacauggccuggauuuuggucauggucugugggcacaguccaugccuggcuguggaggucuacaucaccuggaaauugggguaggagagugggcaccuuagccucuggcccauggcuuagugcugcccucugguggcaaagccucaugucagaaccccaaguugauauuuguuauccaaagccagcuaggaguuggaagucaguuccaucagaugggucuguuugcucuauauccaagucaagggcgcacauuucuaccaauagauuauugccuggccagcuccugucaaacuuuugccuugauggacaccggggugcugggugcaaguccacaugcccuuuggguguaaggaucugacaccaaaagcaggcagauucccccuuuccagaaagcugcucccacacaucgacuccugggguuacugguggaaaagaugaggcauggaaaugggauuucccccaaauggggugugguuccuagaucucuucucagggccuuugccucuguuuuucuaggguccccagggagagccugggccgccaggacagcaggguaauccuggugcccagguaagugucucaggaaaaggugacuuggaggcaucaggggugggacacagguucuggccaagugucugggaagugcacuuagcucugccaccaacauguuugguaccuggaugugguggucacugggaagaugguggagggugaggaggggccucuggucaguccucucauuccucugcugguuuuuccucuuagggucuuccagguccccagggugccauugguccuccaggagaaaagguagguggaacagauggaugugugaagaggggcugccugucauggggcauacgucugugcaggccugggagaccugcaguccuuccauggcaggcaugcacaccuugcuccugaaguuuagcccauuauccagauucauauauugauuugccugccaucuauguauagagguggcaguuuuagcaaucuucaauaccagcacacacuguugacugugaaauaugugccauuuaucagaagauuaaauugggcaucuuauuuaguugaguuuuguuuggcacauagacguacaguacuuaccguguccugggacuuguacccuuccgacagcaucacagagcccaggcacgggccguuucaggaagugcaaacugucuaggucucgaccagcaagagccacuacagaggugguucugauggagucucccagauccccggagagcuuaagaaaugcagacagccaggcugugauggaccuuguuaagaacgucacaggaugguggccuggugguccuguggcugcccugcccugccaugggagggauugcauaggugccaauggggaaugugaggaagguacugaccucagaaggcuccuaggacagcagcaucucaggagaugaaagggagaaagaagauggggguggaggugaucccauagcagaacugaagguucugguggaggaggcaccucguugggugcaugagugacagugucugaauauuuacuuugggugucuauagagaaggauuggacaucccaggaaagaaauaaacgucagagguguuugcucacagacugucuuauuugcacuaggguccuuuggggaaaccaggucucccaggaaugccaggcgcugauggacccccggugaguagugucccccacccugucccucuccuccccagaggggcacugggagcauuguuguccagaagcacugugggugaagaucgugugcccuggucucugugcugagugaugacuggguucuggacaagccuucaugccauguuccugucauggaguugaugugacugcgcagaaggagauguacuuguuagggugugcaaauuaguccccugaaaucagcaucauguuugaaacugugaggaguacugggcugggcuccaagccaucacaccugucccugguguggaagugaggggcagggugugccagagguauuuuuaguguucacagagugaguuagggggugggggagguugcugggggugggcaauucaucugcagugagcgcagcugggagccagauuaggcagagccuggaaauagcaagugagcgacagguccaaccugggggggggggggaccaggguuugcagaaagagagaagcagggaagaggaagcaauuaggggcacgugugugccuguguguguguguguguguguguguguguguguguguguguguguguguguguaagagagagagagagagagacagagacacacacacacacagagagagagagagagagagagagagagagagagagagagagagagagcuugcgugugugugcgugugugucuauccacaccugccauucugacugaagaugcccucugguuugagaguuuuuuuaauuuuaaauuuaauuuaaguauuuuuaaaguaaauuauuaaauucaccccuccaauuucuccccucccuuucccacuucgugugcucuuuuguguuuagugaaacucaaagaaucuaucucagaaggcaagaugagauacaugaauuauuuaugacaguuucauuuauuauuuuaauaacaccauuaaaacguaaaugcaggggguagcucggggggggggcugagaaaaugccccaggggcacggaagggauugcagcacaaaugugaggaccagaguucagguccauagaccccaugaaaugcuggguggucauggugugcacauacuaucuggaaagcagagauaggggacucaccacagcaagcuggcuggcaagacuaguuacaguggcaaucucugggucugugaaugagacagugaccaaggaugacuccugacauaagucucaagccuccguguccucaugcacacauacauguguuuacauguaaacauacauuguacacacauguguacauuauacacucacaugcaaacauauaaagaaaaagaacuaaaugggaauguugagugugcuaacaugcuggggaugguucuccaucagcugucaccuccacuccacaagggucacauggcccagugaaucccagaccccagaccgucuuugguuagccugagcaaauaaguuuagucacccccacucccauguggacaugcgggggaguuugggagcuaagugauugguauuucccaguguaucauuucugcccuuuuaauugucauuuauuucauguugugucaaugacauauuuucuaauagacauugaggucagggaauuggcaaguagauggcuccauccauccccauuggccaucacucaucacaggaccauggcuuccuagugucuguuuccuguaggugaugaccacagauggaggucuacugcagugucgcauaucgucugcagggaggagagcagcuauacccuuuccauaaccagacaugucucuggccuccauagaccuggcugguucuggccuggaauucaauuccucucaccacacugaacgcccccucccccguagcggcagguccugagcauggucuccuuuugcaucuugugaaugcagcacccagcacccccuggccuggagacucucuucucuguuucuggcucuauuaguuacuuuuccuauuauugugacaaaauagggaacaaaaccaacuuaagguaggaagggcucacgguuugaggauguacaguccauuauaacagggaaguugcccacagcugcagacggagcagcugguaacauuguaucagcaagaagcagagguggaugcuggugcucugcugacuuuggucuuuucauucaguccggaaccccagccccugggauggugccacccacacacaguuagggggagucuucaccucauuuaaccuaauuuuagacccucucuugaagguaugcccggagguuugccucuuaggugauuccacauucugucagguccaauacugaagcuuuaaaaugccccgugggagaggccugguuucugccugugaagggcccaaagacagcagguggggcagaaaggcaugggggauccuaaacagaucuagcuuuccaugucuggaaaggagggaagauggguggcuuucccuauaaaagcagcuuacuguugauaaaccuugaagagggcagcuugugcugaggcgguuuuccuccaguauuccuuuaguuuugguugugaacaaagagugauugacaggccagggagauggcucaguuaggaaaguguuuagccccgcauguauagaggcugggcauggcaaugcaggccuggcauucuggggcugugagaaagaaaagagacagaucccuggaccucuauagaguuuuagguucaguaagaucccaucuuaaagguuacgauggggagcaguugagaaagacaccugauagcaaccucuggccccuacaugcacucacacauguauacacaugcccauaaauaugcacacacguggagggacagaggagagagaggagaggggaggagggagagacagagagagacacacagagaggaaggguuuaagucauaccuaguacucugaaaugugauuaauuccccagagcacacagcaaaaugaugggaaaauagggccaguaaaaauaaaaugugaaagucuauccaagguuuggagaaagugcucaugauccaauacuaaaugcggaucauauuauaccugcccacuuuguaugcacacacacagaaaaaaaaaugaacuggaagccugugcccccgaccagucucauggcucugcauggugggcugcagagggguuuaauuuccuuuucugcucuccuaauugucuacaaugaacauauauuacuuuuuuaaucagaaaaauaucaaauacaaauaauuuaagcuuuauuauuuuuccauuaugaaaguaacauucaccauaaaauauuggggaaaugugcagugggagaggagagggagaggaagagagagaaggagagggagaaggaaggagggagggagggagggagggagggagacagagagagagacagagagagagagagaaggagagggaggagggagggagggagggagggagggagggagagagagagagagagagagagagagagagagagagagagagagagagagagagagagagagaacagccuagccuugcacaacaggaagauuugucaguguuaaauuuucuucucuucuccccagccucaugguuacaaaaugaguccugggccucuccgcugcaguugcuuccuucuagaacgcagcugagacucaucuaaggcaccugggcagccguggcaauggugccccagcuccugccccucacacucugcuagguguuugcugagcaccuggggaaccucuccuuggugucucuggggcuuucugcaguguaagcacaugcaguuucccacaugccucugaaggaguuccacaugacgagggcaucugcguucucuagugacccucacugcauguccuggcuuaggacuccugagcagauccauaugguggcugggcacugagaagaagagcacaggucugccuguggcgggacacgcgcuccuuggcgucuuacauucaaccuugcagccuuaaccucugauacccuaggcacauguagggcgcacggaccuacugcaagcaugaucaucauuucugaaaggcaggggcugguccagcuuguccucugggccagaacagcagccacaguccaucagugggugcccuaguuucccuccaaggucacuggacucccacaugggaacuuugugucccaauucacuuguuaggagcuuuauaaaaucaauuauucaaccacaggaaacaauggagcacaugcuggguucuuccccucagagacagagccccagacccacucaagcuagagcaaggguuuaucuuuccaaugcucaccugagggagaaugggccuagagagcacagaagacuugcucaagcaugcacgauaguuucaauguauccaagguagacuugagccccucuccaucaccuggaaaaggugggggccagagugcauguucauaagugagcacugccuuuuugcuuuccucucucccugaggcucuaaccacagggucagccugcuccagcagagccucugcuguauuguggaggauguaauuaguccaggcacagguaggugagacacggucagaggacacagguaccucugcagggccaccucucaucuuugcucaguuucucuggacucagggacccucugggaugugacugaagcaauuugaagugcugaggcacucagucaggugacaagauggccuucuuucugcucuaacugccugcccuuaguuuccccaaacagccaguugcuguguuuggcagacauuguguggcccuugcugguccuggaagucaggauccagaagucuugucuaaguucauuauccuguggguucauucugugaagagggcagagcugggggguugggacauaaauacugcuaagguagaaggccucuuucugagcagguggcuaacuaaugaagaccuucucuauugugacaggggcacccuggaaaagaagguccuccaggagagaaaggaggccagguggguacccacagcacccugccucagcagccagucucuguauuggucuccuaagaccaauggggucugggggcauggggugagggagaggcagugccuggacuguaagcuucagucagucaugggaaagggcuuuugacuacugaaggaugccaucucccuagacaggauacccuuguuccccucagcugaaaagugucucaccucaagguccccaggagggagacauguuauuucaaugacccuguuuuuucuugacccagggcuauguuuccuuauauuacauagcaacaacuccccccaaucccucugggccuccugaagcuggacacagcaucugacuguccucagauauuuuugcuuuuugaaaggcaucacccacuaccuccaucaucagcaucaguaccagugaggaccacaaggcagggccuccugcaucucccacaaggcuagggucccacagugguugcccagguacucacaccugaaaauagcuaauguucuuucacuuugaucuuaggguccuccuggcccccagggucccauuggcuaccccgguccacgaggagucaagguaagagggacucugcagcucugggucuucauagaagucaaggugggaaggauguaugucccuggcugguuccuggcagcuucucuguuguuaagcccugcuccaggcacucuagaguagccuaguuccccaguucaguaugcacaugcugggaccucagacagcaugucugagcaggugaggaucuugccugccagcuaggggacagacugcuacaggaugagggauuaccuccuagacagcuugugaagaaguggggacacuguacuggccacccucuuguguuuaccauuuguucauaccaggcugaccucuggagccuuucauggauguggaucuugugaggcaggggcauggccagccuagggaagcucagaaacaguccuuugagcuacuggcauguuggaagaggaaaaagacuaguauguccucucaaauccccagcaggcaggguucgugagagauguccauuuguuuacaaucguguuucugcugguagaaauuccuggaaccuuguuaaguggggcacagagugccagagcaauauugagagcaagguccccuuugucccuucagcacuaacugaguuugcucugagcugcaugauuuaaucuugaguuccacgguuccuggggcgaaggcacauuccuguguagaagaugagcgucuuaucgacagggucucuuccuucaccauacagggacuuugcaauaucucaaagcuccagucucuuuccccaccccagcacccggcaaaaaugauaacagccccuuccuucaaacugacaugaaggggaacagaggugugccccccugugagugugcauauaugcagaagcacaccacaaagcaacuucaguuugaagaauuuauauaaacaugacccaggccgcugccccacccauguaccuugugguacuuucuguccagcauugaugcagacccaaaguauacagcugcccuggguuguggaggguggggagcucacaaccuccguguucagagacugucuggaaucccuccaaacaugguacccgcgucuagacuugaacccaaauggcccuguuucugugccucagaaacccugacauccuaguuucaagagugaccucucgaagauggcagccuuaggcaggucagguuccuccugaagcuugcuuuuccugacacugugccuacugaaggcugggagggagauaacugagcagcagcgcugauuauaggagcucuacguguguuuaucuuacaaauuucugucuccuaccccaagccuuuggcagcuccuauacauggcuaauugcguaaggcuuccucugcaagcugaaagguguuuacuuuaaaauguuuauggagaaugcucuuaucuaucgaucugguucaaauucacucagaacaugagcaauccaguuaagacuuggaagcagagagggaagcaagcauuaagacaguuuucacaagagcaagagauaguacugccccgugugcucuugagaacugacgugguguuggccaccucaugagugccaggcucacgggcacagcagagguaggugugggagcugucaccauuaggguagagagaucugauuauuuccuacccaggcuucuuccaagaugggguucucucauggccugucugcuauaagaaaaaucccacaaucuaggguuuuguaauagagacuggaaguucaaggucaaggugcaagcagaucaucauuugguuagggucgcuuucuccuucacagccuggcucuucucacugcagccucauaagguggaaagagcagacagccucucucaccccgcuccccuacuucccaccaagaguugaacucggggcuugcccacauccccugggcacucuaccaccaaacuaaauaacccccuuauuuuuaaucguuguuuugaggaagaaucucacuaaguugccuaggugucuggucuuaaacucaugcuccuucugcugcagggucaugagcaguuggguuugcaggucugugucagcuucagggucaugagcaguuggguuugcaggucugugucagcuucagggucaugagcauugaguuugcaggucugugucagcuucagggucaugagcaguuggguuugcaggucugugucagcaggccugaaccugagagaucaucucugcuggguucuucuguuuauguuucucuccaccacagagaugccuggaagagugugguggguggggcucuaggucucuccuauggagacuucuagauauccagaaggcaucucaggcaaaaaacagugcccagaaaccauugguuccaaggcagcuguccagacagggcacauuguaccuuccugaaucuguuggaccacagauguucuucaacuccuguuacuuaggugcauguggcaagccuugcucacggacucuguguagacaugucaugauaucuccaugucugcucuacgcuccucuucauuuuucaguuugcugcccaacauugacucagguuugagcaagcacagagcagacucccuagagucagcacuccuuccuuagagccauuccauccauggcugcuuucaagggccaggauccuaaugggcugggcaccuaugcugucaacccacauccauuuauuugguguugggaugagugagcaagagcugcucugacccagcugcuauccagauccauccuguucagcagcuguccucuugccccuccauucuucauucuaagcugugcaucaugggauacugaguaaggauguugucaaccaugggcuugucucuugaugcuccaagcccuccuuccuuccagugguugagaucucaggguaccuguccaccuggcuuauagcuccuaccuuccugugucaaagcucagaucucagcccugacuccugggucuguaugucuccauuccaaagagcuucuuucuaaagcucuucccagccccaaccucggaacuaccaagccuauguggaucucuggccagcagagggcagcugguggcaccugggucuagaagguggcucaggcccaggcugcagccucaaucaugaagaaacugagccuugugacuccucugcgguccuaggcagagguggcuugaggcaacuccuggagucaacagugaguccauguagguaaaugucaccccucucaggagcccaaggucagaaggcaugggcgguuaagcuguggcuccaucuguuacuagguuuuaugacuucgccucugacaacagagggacugggaccauugauaauagaagaaagggggccugcuguguguccuuagagcugugucuaacagggauuccauguccacccugggcugaggccagccauacucauugugacauuaguuggugcaauaccaugucaccuuucaaugauaaugcagaauuaacacaaacagccagugcacagcauuuuucuacuggauguccaguaugcacagggcacugcccugaggacuuucagaucacccuuuuucaaacaguagagauaggcuagaguccuugucaauccacuuccagauaagaaaacaggcaugcagaagucugggacaucuucagaggccacagaaagggucaggaucuuaacucgccggccugcauugaguuuuuccuagcugcaggauugggggacucuuccuagaacaggcaggcaugcuagccugggaaacuguuggcagggcuuugggccguuagaaaggcaauaucaggccuuugaguaauuugggcaggggaaaguauggauguuugugcagaggccaggguaggaguuaaggacagugggggccucacaugagcuccugucaaucaaugagagaacaggaaguaccccucccuccagagauggagguauguuggaugaggacucaucuaaggcugguccauacugccugugggagcuguucccucuugggcugugcguguuugugaucacucucuauucuugcuugcacagggggcagauggcauccgaggucugaagggcaccaagggggagaagguaagaaucuauccccuugagggugggcugucucagugugguacaggacucaaugggguugccuccgaauguggaggggaauugaugccguccugguccuaaaggagacuggggaucaugacacugucagcaucuccugggcuggcccagagcaucuaccuaggaggcccuaggguggccacauggcuguauccacauaccuucgucccccaagucucucccugcggguccuuugcaggcaacaguccucaugguagucaguucucaccugagaggcccagaauuccuacacagagucuaucuaguuuuacaguccagucucaggcuuagagccaaggcaugugaaggcacgugcagcccggugacacuuagcauauaagccacaauguagaaugugguacugccugccauguucaaggcuguauaucaggccuauguggaucaucuugguuaauacaaagcuaaauaaugacacccugaaucacauagucagagugcccaguaccccuggcagaagagauaucccgagccuuguggaacugugcagcagccagccacuucugucccuccauuuggugguaagaggccuggcauuuggaugggauccgaccauuugagcuccauccuauuggcuguaacuacugggugugguugcccuuugugucaggcuguggcauucccuguggaaucuaaaggcuaugagaacagaccugacacccgcaucugcuuaugcuuggaagguauacauugcuucucacuggguaccuguggacaguuuuuugccuccauuacugacugaucugauagccugaaaacuauucucuaaagacugcuuuaagggcuaugguuggggacaucucaagguagagccuguguggucuaccuugaacuucagggugcuaaccaccuggccacccuuugggaagaucaggccaaaaggucuuccauuuuccacuauuucuagagcaccucucccugauagaguagaauccuagaucuccuucugcaggaucaggagaauggguuugucuuuugaacaauucagccaagaacauacauacauggaccucauagggguuuagggaaaaagcgaguucucuuaggagcagaugcccacuugcuccucagaaggacucuuuccaagcccucugucccagauuucccauucuuuugggacacuuuacuacuggacgguccuucugaggaugguuuccagagccucggcuuuauuacuuuaucuugucuuguuugucuucacgagacaggaugugucccguuacauacuuggaaggauaugacuggguuaccugaugauggugccuuaccagggaaguuccugggcuguuccaaacgacccaggaaggcagauuaagagggcucuagggagaggggugcccgaggaucuguggguuuaauacauugugcguacuguagcaggucuaagggauggguaaaggccugugguaugcaggccuccuucugugcaggcuguauguuuccucccugggcagcucuccugcuccuguccugggcuggggcuccguguugugcaggcccauugugaguggacaguagugugguggaguggaguucucuguagacugauguuuucuuuguuucuguucagggugaagacggcuucccuggguuuaaaggcgacaugggaauaaagggugaccgggugaguguccugggccuaggauuugggccagggacaagcagagugaguuuggggaccugcaugaaagcuucggguauucgggaccacagagcagcuuaucagaagggagacaaacacuucugcaaaauccuggucugaggacagaaugucuggagcccagggccucugugcagugcucucuagccugcuccucagucuccacuccaaagccgggguugcucucaccuguguuaacuccaaggacagcuguggcuacugucacucuacccugaguguuggacaggugccuuagugaggacuggggacccuggauuacagagaaauuugauuucagaggaugaagaggaaagacuggguggaaacacuccaggcaggcccauaagcaagccccuguccaagguguaguggauggcuagcagaacuaugcgcuguugaggaucugcagucccuccugcaacccuccugaggguuugcucaucuccuggaugcacccaagucacauuugaagcccauacaagcccaacacccugcccucugcugcucugccaugggugaagcccacagcccaaacacucuggugucugcugcugggccaugggugaagccccccacagccuggcuguuuucugauacauuguccgucccagcuccagggaaagcuguugguacagaaaaggguguggcuugcucaggucagggguuggggaggguacuacugcccagcacagcaagcacaaugaaccagggguuaacagugacacugagggcggcuucuaggagcugaucuauaaagucgccuauuagcuccugcugagaaguuuccccacaucuucagaauaacucagagccugacagaaggugacacacugugcgccugguagcccagcuguugcacacaccugagugccgucuaucuguuaauucuggccuguugucugcuuguauaauuaucuucauagcaggcccugaaagcaccuuugcccaacaucccagaacaagagggccuauauacuugacacuuugccacaacccgauggggaaugucugaagccaccugcuugucugucagaagagaagaauauaaaagggacuugguguucucuuaugcugccacugauggugacugcucccggucuccuccaagugaaggauucucagugccucuggcugaggggcagaagucccuuugacucccucuuucugcugaccuggcacagaccauuagaguucacuuaacugaggcaugugugguggugcaugccaauaaucaguggcaggagacagaggcaggaggauagauauggguuugcagccaguuugguguuuauaaagagacuaguuggagaugauuuagaaaugggagauaggaguugauagguagacagacagacagacagacauagcgaaucacacaaaagacacuuccugggagcacagaucaguuuucaguagaugacggugagcuagggaagcaggugcuaugguuugcuuucucuacaaacagagcuuugcucugggcuuucugugggugcucagaugugacuaccuaaaggauuaaugggcuauaggagugccucccaaggacagggggagggcuucuuagcccugcaguuggugcucaagagcucggaugucacuugucucugagcagucuguuuugaugugagggccauccaucugucugcagcugcucuuggaagcagguagucacuggaggacucaggcaucaguugccgggagcuccagagaugcuauuuggagaugagcacagugcuucugcggcccgaguggguugaagucccucuugguuuaggcauagacuucaugccugcaacuaaggacacuggaugaagucucugggucucccggguguggguauagcuggcuuacucccaguuggggagagguccccuugaugccuccugaggcuucagaagaaggugaauguggggacugugacaguugggucuggaucagcuaaggaacauuccuggguaggucuuugagguccuuuguccuggagugauuauuauuccuuuagagaauccagaguaauacaggggcagagccauucacagccauuauugcuaaccaguuauuuuagccaggagucccuuaccuagacaggggagucaggaagcagagauggcagcuaugguggcacucggugcagaggguugacagcgguccagcuacaccuuggauuugccacugguuuucaaagagaggccaggggaauacggcucaggcugcacugcaagcacagcaugccuguuugauagccauacuccaaggugguaggaggggucaguuggggguggagccugggaaggaucacccuaaccuccucuuuucugauugcagggggaaaucggcccaccugguccccgaggagaagaugguccugaagguccaaagggucgagguggucccaauggugauccugguccccuggggcccacuggggaaaagguuugugcuuacaauccuagauuaugcuuagagguuucugagugccagauggccccuccuaugugcaacacggguagugggacuccugaauagcccaugccacaaccccuagccuuucgucaccucucccagucgaugugugcgcgugcguucguguacccuuugaucuucauucuguuccaaguuccccuucucaucccaccaccgccgcacaccuuggaggagugucuuccaccaaauauaggcaaagcuugggcaucucacccgagccucacacgagcacccaucccuaucaaacccugccuccacucugggggugacagaauguucucacuacagccugacaucauggcuugugcgugaggcuccgguaggugccuguguccuagcuugcccuguaacaacagcgccuccuacaucugguccccagaaaccugggcaggaggggacucaaggagugguuaagccucccauucccucugguccuguggcuagaacucuuacagaguguucagaacccccacagauacgaauauucuuccugcccauggugcccauggugcccauggugcuuguuuggauuuccacgcaugcugguaggauccacacacccuacuuccugagggcuuagagacccacucaguucccggggagaugcagcugccucuguacaccaacccuacccuuccaaccugcccuagcuccucucagaaccaccccucccugcuuacaggacaagguugagaaagucauuuaugauuuaugagucuuuuuuuuuuuccugcuccuagggaaagcuuggcgugcccggauuaccgggguacccaggaagacaagggccaaagguaacuaaaccuugcuaaguauguccuggcaggcacugccucauguggcaccccacacuccagacgcccucuuccauucucuaccucuguguggcuucuguaccgcaguggaacaaugcauucgcugugaucucauagucuccuguguuaauuugaccaagcucaaagaaagcacuugcacaaugaguugagccuuucagagaagagggcagaaccuaccccugguggccugcugggggucuuacccccuuaguccccccuggcuuauccacaccagccuccucuuagccccacuuacuuuggaaguauggagacuguuuauaauggagcagaagaggggcaaccguugucuuaucugcacucauguucaggcuuaaguggaacagguccugaaggcuuugaaaaucagugagaacauuauuuucuucucaucccacauuuuauuauucauggcuucuucuuaaacaauaacugcugccugcgcuggagaccugguuagcagcacgcagccagcccgccccagaucugcauccccacgcuucugcugccugcuagcuucacugucuuugacucacaagagccugggccugccaaccgaaggaggaagggcuguaugggcaagcgguggccuacccuccccccuucacccccccccccccgcgucugcucgguguggacacacacccugccugcaggagagugucccuuagaugagagccaccacccaagcacauuggcuuuccuucucuucaggucccuuucuuaggaagagagagaaggagaagaggcaucugagagcagagggugggugggcugacuaagugcuggcagccuugcaugugagaacuguucucaggcuaugacuggaugcagcaaugggcuguacaguggccugggcguucugugucauccacuccaugccccuuuguuucaaucuccugccugggugaccaggcagacauaaaggaggaaggcagagcauggaaacaagcagccuuccagaauaggguuguucucagguuaggguggucagccaccccgagggcagagacuaacagagaacaguagacaacacccacaccaaugggcagugggcugccccgaguauguccuggggagcccuugugaugucuuuuuuuuuuuccgagacaggguuucucuguguagccuuggcuguccuggaacucacuuuguagaccaggcuggccucgaacucagagaucugccugccucugccucccaagugcugggauuaaaggcgugccccaccacgccuggcuugugaugucuuuuuguacauagaguuuggaugcuuggcagaucaaagucuugaagaccauauuugggcccugugugucuauagacaugaaaaugguagauacuacagucuauaccuggauuuguaaacugucacuuaguucagguguuauggacaggucacaaaguaugacagcaggaccagugaacagagcugugagaugcagcccccauuuccggggacucucagcaaagcauguucucccaucccccacaucaucagcuggcacugcacauucucugugugaggcugagcaggacagaauggggcaugcuaggacuuggcuuuaggguuagauuuggggucuggaaaauguuugggaaauauuuauugagugggugguggguggcuggacauaugaaugauggaagaauaaaaagguaggugaguggguauuccacagguuggugagugguagaguggcuaucugggggguggggggagguguuacauugguggucagguacaaaucggaucugaucaguauagauaagcaugugugugaacucccuguagagcauggcaguguggcccucgugccugccuugguggucauguuucaucuucccuuaacucucuugcaggguuccauuggauucccuggcuucccgggcgccaacggagagaaggguggcaggguaaggaccguggucgcuugguguguaguauuggcucucuggucaaugcccuguugaguuuucuccacuugucauccaaagcacuuuucagaaguagcugaucucagcuccaggccuuuaaguuauggaggcacugucacaggaaggggcaacggugagaaggaagagcaugcuaggaaaauggagguuuugauggacaggagccaggaagcucuugagguuccuccagauuauucucuuucuaggagacuuuuccuacauccuaauuuuacagggagaaagaggguuauuuuguucucuuugagauccaccaccucccggaggcuagguguguguuaccuuggggcuaugcacagugauucccagauguacaaucccuguuagaaguuacccugguuguaaauaugggacagggcaugacacugucgguucccccuguuaucauccucacagagaccucuucagguuccucuuggggaucccgauauccaccuaccuucugugauguugcgguuggcucagaccuccccugcagaagcccuccuggaugugucuggguggugucacagagccuaagcacugguagcucguugagagauggagugugauggucaucauggaccuuggacaugcagggcagagaggccuggcugcuuuuccuccaugacauagagcacacauggucuuccucaugcaacauugcuucaucacaaugccauaugccauguguaaagcagagucuacgagcucuugaaagccagcagaaugacuucagggucacugcagacaagcugguggucacuagccucaugagacucugcagacaaucugguggucacuagccucaugagacucugcagacaaucuggugguuacuagccucacaauguggaaaguagaguuguccuggaagagagcacacagagaggacacucucuacugccaccauuuccccucucaugcaggcccuuuaucaucuuucuguuuuucuacauaucuucaauuuucucuucauccaucuauuuucugucuguccguccaucagucccucccucaauccaucugucuaucauuuaucuucuauccuucucucucagucagacucuuuaucuagggucaucugacuacugguuggggggaggguugugaccuaaaaauacuuggaggugcucccggcaaaaagugguccugggucucacagguguggaauaugcugcagggguagaacggggagcucguggguuauuacuuggccuaagcaagagcccaacagaaaaguggguacccuuggaccacaagguauggcuggcuucccuaacuggccauggaugcuggaggcugggcuggccuugcaaacagccucgggugcaaaaucauauccugaaugaacgccagcccuaaggaucaggcuguguuacccuguuguuugcuugugcugugggucccuuagugacauggggcuucauggaaggcagcucauucacuugcauugcacguuuccuaaguccuugcuaagcuaggagcuuaccaggcaggggacgcuucaaugacugagcaagauaaggaacagccuguaaccagugcucaaggguaaugagcaugcaaggaaggagaaacccagccccuagaccuggguaauuccaggaggcagagauguuccugcugagaccagaaagggagugggggguggggagggaagcagaacugcuuagagaagcugggguagcugaacccaguguagaggccugggcuggcgcggaagguguggagugucuccacaguguugccuccacagugucuuuaucccaagguagccaggguuuagucauggggguaacucuggggagaguucugaagguaguucugguuucaugugggagaggaucaggagggcugugaagugggccagugugugcugcacccuggagaacaaccagcucugcuugcaggcugccucugguauuggaugccaggcaggguuuacaugguguguguguguuugccacuuacccagugcuaccuauacacuucaguccucuguuacgagagaucuggcuucugcagagccagaggcucaugucugugccugacagugggagguuaaaugggaaaccaucagaagcaaggcugcacuguuucaagccagcagcagcucaaggcagugcuaugauacacgcaaagcgauguucuaugaagagacuguacccugccccuuggaggggucccaggagaggaagaccccacugaggucucccaacaaauccaaggcuccuuauacaucagcuugccucuggcucugggagaguuguaggcaaggcuguuucagggaccuccuguucuuuccuggcagggacuagagaccagguacaccugagcaauucucugugagggaguccuggagguacagugugcucauugggcuaagcucuagugcggguuagguuacuccaugcccugcugaacaccaugcugcccgaggacccagauggaaccugggccgagaccuguuugccugcucccaagacuugggugccuagaugccccaguacaucagggcaggcugcgccugggucccaggggugcugcaagguuaaaugggaucugaauugagauccagguggugcuaaagguaagagagggacagaggugugcgcagcccagccuggcucacauacccaggugagucagguugcucauacuguugauaagggcacacaauuagcacgagaagagaggagguauuuuacuuaauuuucauaugcaaauguuuaccugaagccaaaggauguugucauagaguugaagcaugaguugguccugaagguaacaggaccaaguaaguuuguuuguuaaggaaaacaaacaaacaaacaaacaaccauaauuccuuugcuaugaauuguuucauaaaugccuuuaaaaaaugggagacuguuuugcuucugauaguaagacagaaaaugcuaaggagagacucauccuguggcuucagcuauaagcugaccuagcuuuguugauagagaccggcauaaacccaggaugaaccucagcgcacaggagccucugagcuccauccauuacgucugugugcuguggguaaacugcacuugccggccauuauauccuugcuaugguaaaaaacagaaaauaaaugccaugcauuugcuuuccgugguucggaaaaugcagaucagcaacagcaaaaggacugaacuccgagcgaugccgggaacucuucgauauaugauuuauacguuaaauugcaguuucccuucgcgccugcagagccugaugaaaauuuaaugccuaauauucuuaacaguagcagaagaaaauuaugugugauaggaguugacuuucuucucucuucauguaaugauuucugugccuacuaaaaggagcagagagaagggaaggaagaagggguggggggagggagggaggaaaugaaccaucgaagcagcagacauugcccaucauuauuucugcccuauacucucccauucacccccagauaggcccuccaggccucacucuggacucaugaagccucucaugaauggggguaggagagucgggggugggggagggggagaguggcaugcugagcagggccauacaugccccgugugacucauauccaauucucuguuucuaggggacaccuggaaagccaggaccacggggacagagaggcccaacgguaaccguaacuguucuuguggcaaaggauaugggguguaggugggugggcucugugagucugaagccccugagcuaacuggucugccuucucucugucuaucuguucagggcccgcggggugaacgaggcccacgaggcaucacggggaagccuggcccuaagguauguuccugcuccuucgaggcaggagagggaggucaguggccuuuucauguaacaacaauaaaaagaacaguuuucuugaacaucaguaaagggauucugccugcuagcauccuucaacaaacuucagcaaacauggcugaggguaacccccaaaagacccaagacaaacagaggaaggacagccccccccccccccguuuuuguguagcuucagacccaggaagccaccaaggucugguggggaagccucguuguuuuuuguuuuuguuuuuuucugguaaagauggcuggggacuguagaguucuuucuuagaagguucuuucugguacaggcagaaacucugccuaccccugcaaggaccccccucaugcccaggaaugaagcaagcucccccugcuguaaaucuaggggaaagccaagcauggcacagcuguccgguucuaaccaguaaaaaucacgaauagggggcugaagaggcagaagaccaagguuugguucccagcgcccacauaguggcacaaaaccaucugucacuguaguucugggagaucugaugcugucuacugcagcaccaggcaugugcuggaugcacagacaaaacagccaugcacauaaaaauuaaaaaaaaauaauuccucaggggggguguguguguuacugagaggagauuccaguuagcugacccaucccuaacagagaaccagcugggugcauggaaugguccugaagcugagccuuauguucuucaagucauuuuuuauguguucuuggcugagcacagccuguguccagcuagucauggggaccuguucuggaaaugucccgauccugcucaugcaggcuccauaguuggcugugcauagaggcaggcuagcacugcugccacacugcacuggggucaggaugaccuugggagagcaaucauggugaccuuuucucucccaccacagggcaacuccggaggugauggcccagcuggcccuccuggugaacggguaagagucuuccaggccugggcuuugaggagauuuccagggacaaaucugaccccaaacauacacuuagcccugggugggccaguggaggaggccaacagugcccugcagaggagcagcgggcuugcugagacccaagguggcucauacacagaagugauguguuccuuggggaggagucucaucccaccuuuuggacuugaccuuagugugcuagaggugaccgucaccacaguaaucgacucuugacgucauacagaacagaggacucuggggcauugccauguaucuuggccaacagauuuccuaucgaggaaucugccuaucuaucggucugucuaucuaucuaucuaucuaucuaucuaucuaucuaucuaucuaucuaucuaucuaucuauuaucugccugccugccuaucuguuuaucugucugccuaguaucuaucuuaccuaucucucgucucccacccuccuaacuucucucuggcaucuacucccucucuucucacuuccucuagauucaaauggggaaagcagggccaggauaaacagagaaaacguuuuagguguagccagugccacaguggggaaacagugggggcugcuagcaggaagaaugccuccucaaacuggauguucucuguucccagggacccaacggaccccaaggucccaccggcuuuccuggacccaagggucccccgguaagucaugcuuucuuccauggaggugggcagagcagauuccccgucaguguucucaucucccuaggcuauggggagcguggaugggcaugcuggacuccuguugggucggcaguagagacaaccucugaaacccagcugcuaaggcuguggcuauggcuccccacccaugcaagccuucuuuucaggagagcauuuaguuuuagacagacuuucccugccaugaacaugcccugugagguccucgcccugguguggaccuccuguagcagguccugcugucauugagaccauagugaccuucugccuagguuugcauuaaugucuaggguaaccacacaaauguagcagacaugguguugcaaaaccacagaaaggucuuuguucauuccuggggccauuucugaaaccaaagcuggguccuccccaggaaccaagcagaaguccacaucaggggaaggcucacucagggcccacccacugcaggggagugcccgcagaagaagacacaugguagaggcuaucccacagcaaaugagcauucauaccaaaggagggcuuaugacaggagaaggcccagggaaagugaggacccaugccaggggagguccaugcccgcaaaggaucuguuguaggagaaggcacaagcauggaaggcccaugcagaaguccaugccagggaaaguccacauuggggagggaucacagccaggggaaggucugugacauggaaggucccuaggagggaagggucccuggcgugggagguccacagaagggaagggacaccagcagggggagguucauggcuaggaaaguccagaccucucucuggguucuggaguuaugguccguccuugggguuugucaagauagacauuugagggucccagugcaaccaggcugcccaccugcucgagucuggggagcuagguugaccuccucugccccuguuaaccccuuggggcagcuauagggauuguggggcagguucuuccauggcaauuaguuccacaauuacugucccagccacuacgaugacagucacuuuuguccccugcuucucugaguugcugagugagccaucauugcucugauucuuuccccagggcccaccaggcaaggacggacucccuggacacccugggcagagaggggagaccgugaguaucacaagugcuggggacauggcuguuccuggccucucuagcugggucucccacagcuuacaaugcugcuggcugccuggcacagucaggagccccuuccucccugggaaagaccaaaggccuuggcaaggcuuccuguaggccagccaaucugcuguugacuuaaggucaggcuguagggugggcgggagccccaggaugucacaguggaaacccaacaauggcucuuugcauguuuuagcagcuuugccaaaggccauguuuaaagcaucaggacacugcgucggcaucacaaaaaccuuuauuuucugaggguaaccgugaguguagccuugcugggaccaugggccuuacuuggaaaaguaccugggaggcucuguacuuguagagagcugguuguuuaggcuacaaaaccucaugacaagggccaugggccuugggccucgcacagacaccagcuuuguccaucugggagauuucagcccuggggagcuggugggaaggaguggaaugaagucuuucgccuccucuauaaagaagaugcugugugggagagaugggauggcucaguggccugacugggcaaauaugagcaucugaacuauccccagcacugaugugaaagcuuagcgugcggcacaagucaguaagccuggugcuggaaaagugggcaagaggauucauuccuaggacuggccagccagcgaggccagccagugggucaacucugaguucaggaagagacccugucucaaaaagagcaugugcacauuugucgccuugcuugcacuucugacccugugauuccagacuuugagcaacugagcccucaaagugcaggugauacccgugcguucucuuuguguggcucugccuuauccauauuaaaggccaguucguaccgguguaagcguuccucccugacaggguccugugccauugcguccuguucauugugcugggguuggagugagggcucucauggcugaaacuggcauuucugaugugggccuuugaccaccccgucuauuuccugguaccugcuuuaacauguguuaaaguguaaaguaccugcuuguccuucucugucuuucagcacacagggacgugaaaucuuuuaauuacgccuuugcugguguucgagcagccugugcuggcugauaaauggagaguaccuugcucuuuuguuuagagagaagaauuaaaacguuucuucagagcuuugcgcauuuuccucuaaugccuuuccaaggagacaagagagaagaguuuugcauacugcaugcuuuucucccucagacucauucugcagaaaauuaagccuccuaauuugcuuggaaaaguauaauuuccagcaacuucuaccauguccagcuaccuuuguagaaacaggggugcugcaugccgcugcuggccaucuugacucucucugagacucguucgugguucucuagaguagacuuccucguuuucuuuuuccuuuccuccccuuccucuucuucuccaucuuccuccuccaaugaacacaaaugccgguuacuucuccuuaacgggagccaaagccuguuugucagugaggaacagaagaccaucucccuccuuaucaggcacgucaccuuagagugacuguggccagccagcaaggagagccagugcauccauucuggguccagaaagagacccuaucucaaaaagagcaugugcuugccuguggccuugccugcacuugugaccccaggaugccagacuuggagcaagugagcccccagagugcugggguauucacugugugcccccgccucaaccacaggaaagggcaguugggacugcuugcccuccccgcuaacacugcuguaagcaaagcuuuggcuccaaccuccucucagacacuucucccuccugaccucuccuucacucuuugcuuuugaccaucagagaaauguauguuagaaauggccaggucugcccccugugugaguugugcugagagagaagagcccucuggggucuacagggcagagucugcugaggccagugaauugugugugauaguagcuuguugccugcuggcccugagccaucugcucacccucacgucauaguuaugaccucugcacagcuagacugcccuuggguagauccacccuuguacaccuggcagcugccagugcaucucauugugccuacuccaucaucaugccccaaaucaagcuugacuuucuucagccuccugcuccauaggagaguuugggaagcagaggcgagugggaggcgagccugggccauucuaggcaugaacacucagauccucaaggagucagggucuaugaagugacuuuaaaguaacacauuggagcugacagcuucagagagcagucagacccugcucccaccuguccuaaauucgaagaggagcaggcuggcgagucaccugccgggagucagagacguggauaacaaaggcuaaaaagucccacgacguugcuaaugagcaccagccccgagaugguucuuauguguccucaaaaaaaugaacacgcggugacaugagggggaauaacaggcuuacaaauccauuucucagcacaaagacacaguguggagcuaacccucuuggcuccaguacuuucaugaaauuaauaugagaaggggaacauaaggcaugacuucaaacugagcguugggcacacagccauuggggacaggugggggacgggcuucugagacugcaucaggaugggggugccgcugcaauggcccucagcugccugacucucuccacaggguuuccaaggcaagacuggcccuccagggcccccaggagugguuggcccucaggugagaccuugcagcauccuggggcugggauucucugguguuacagaaacauggggcuacggucaguuuucuagagggguggaccccacugguggagaggcauaagucccauggcagguaugugcuaacuguaguagauaaacuccuugaaaggggcugugcugagacaaagcaggugacucauggagcacugcccugagcuuggcagcagagcucaggugaccccagaacagucagggccaggcucuagaguuugacucuccccaagggcacaggggucaguagaaucuucuugucccauuguggacauacuggucagugucauggaguucugauuccaaccagcacagaucagugaaggguauagauuccagcuagggcugacagcuuuagagccaaggacaguaaguaccugucaccuugccacuuagcaagccacaccugacauaaugagaagucagaggcugacacaugaugucaccacagaacuggagcccaugagaccuucuccccucuguggcaaauauggcagcccucagcaucuuucugaacacaccccagaaacacagccuccagagagguuuaugggcagaaggauaccagccauggcuacugcugucuaccuggcuucauuaucuccuucuggauuuuggcuggcaugaggagucuugagaaagaguagaaaggagugguaggcccacugugagcaucaccauggucagggcuguauucagugguaggcccacugugggcaucaccauagucagagcuguacccaggcuuggaggaagagaucauuccuuuguaagucacucaaaaccaacaugugaacauguaacaacauugucucuccccauagggucccacaggagagacgggccccaugggugagcguggccauccugguccuccaggcccuccuggugaacagggccucccaggugcugcugggaaagaaggaacgaagguaaguuucuggaagcuuccgugccagguugauauuuuuuuucuagaaaaucagaacuuuguguuuucucuugauccuuuuggacagauggguaauuucucaaacaaaugcgucucugaaauucacacguucagaucuguuuggcuugaacugaggcagggcuucuguagauggagcacagagggacugugggaucaaaccuucccaggccucauggagugcgccuuccccucgccgcccacugcucccggagcagacuaaaggccccaagucuaacagcauacagaucugcuagagaaugguccuuugaaacccccucacuuggacacacugcaaauagauucugaaaguggaaaaugaacguauccccagccuugugcccagugcuaggccuuuuuauaguuuguucagccugcuggggugccccaaauuugugguuguaaugcuuguguguuagcauuaaaaccuucagguuuccuugaggggaacuaaagacacaggcucuuagucuguuuuuguuguuuugaaacagggucucacuguguagcccuggcuggccugaaacuggccauauagaccaggcuguccucagacucacagagauccacccaccucugccuccugagugcuggaauuaaaggugugagccuuucaccagggaaaauucuggaaaauauucuagcuuuugcagcaucagggaaggcacacccccauggugcccugguggucacugaacugagagcaaguuccuugaauggcuguacuuuuuuagccacaagucacugggguguccuuagcuuggcacaggcccauggaggaacccaacccaaguaagaacuuugauuucacuccauucccauucaaccucuuauggcccugcuggaccuggcaggucugggaccugagaaagcacagagacagacagagggagagagucagucacaguuggaaucccuuccccagaucuauacacagagccagucaggaaaccauggcuuccaggugugugcagggucugagcucaaguccacgaagagaauagagaagauaugucaguucccggcuuccauccccagccuccaacucaaaauaaauaagagaauuucuguaaagccaaggggcuaaagaaagcucaggucaacccagacccccagugggucuugacagaagacucccccugcuccucagacguggguccuggauccuggagguuggugcgaagucaacacuggagcuuccgggugggauuaacccuggcucucuuuuucagggugacccagguccugcuggccucccugggaaggauggcccuccaggauugcguggauucccuggggaccgagggcuaccuggccccguggugagugaggggccagguggguguagugguauggcacacagcccuagggcucugucugaggcccucaaccuaaauucuuacugcuucucagggagcccuuggacucaaaggcagugaaggccccccuggcccaccagguccugcgguaagucaaaaccuugcaucauauccuauccuacaaacaagagccgggagggcaugcuggaugccaagguccccaucaagugugucaggggacaguaucccugagccagagguuggcuugauagagcccgagggccacuuuguauggcagaaaaguggcagcuuagagaacuacaagugaccucucugggcauggaggcaaguagagaggcccacauuugguguagacuucuugggucagcagagagaggucaguaagcauucuucuuaugaacuucaaagacguauccuagagcaggcugggcuaccuggcacaggcagggaaggggucuaucucuagccugcaguccaggagccuaacacauguuccucaugaacuagcuagcccuucaucaaucucagaaucccagaugugaaagguuuuaugauccugcacucccaggccuuuagcuguggcucagugucugagacuguuccuccccucgaaugaguaaggauggucagcuuugcauccuucaagccagccugauggcugugcucagguauaaagcccagcuggguuuagaagugaccucuccuagcugaguuccagacuaggcaagucaaaugggguaagaaauuagccuuccuuuugauagggcauauagaggcuugcaggcuguguugagcucuuaaugugacuuuaagcuuagccuggaugcccauuaccaucaauaucuacccccuggucuaggaccuccuccucuaaaucuaugagcacuuugugggcaggcagacccuacaggaauggguagaugccaggccucuggaaaagaccaucaaagauagacacaaaguaagacuuauucccagacacuuaaugggagagaguggauguguaagauggauuacgggagguaaagagcuaagaaagggccuaacaauagccuuaaguacuagaucaaauaguccauguuugcagaaagcuauguagggagccacugaggccucuaaaguggggggaagaguggugugacccauuaacgaagucuucccauaugguucaagaaccucuaaagcaagcccuuuucuuacugcucuguaggguucuccaggggagagaggaccagcuggugccgcugggcccaucggaauuccagggagaccugggccucagggaccuccggggccugcuggagagaaaggacuuccuguaagugccacuugagauuggggucccuuccauguuuggucuagucccuccugcuguguuaucuccuugugugcuccucuggggugggaggaggcagaggcuguggagucugauuauccuacagggguagacacucugaggaguccuaggcagcucagccuggccugcccggaaugcugaugucacaguggcuagacauagugugucccuauaaaacuugcucucuguuuagccucugugcucuggaguagcuggaccauacugucugcugagugagcaucaucucuccacuggccucaccccacggcugggccuuuuaggaaaacgacgaauaucugggaauggguggccccuuuauugaugagagagcauaggagggacacacuggcagagaacagcaggcagguccccagaaaguaggacaggucgcccuuaaggcuugaguucacugggcucugaaaggucucugaagccuggguuuccacacagcccuucucucaucacccagcauggcucuccgauccauuaguggccuccagcccccauuuauacccccaguucauguguagcuccgugcccucccgucagcccugauugcccacggcugugggguagauuccaucccagcuuccccuugugagcacagagugcuggaaggaagcuugguggaggaucggcauggagcauugagccggacacugacuucugcuagugacacucuaugcucucuguguccugcucucugggcucacuaggaggaaaggcauucagacuacacugggacaucaguaccauggagagccuugcaacguacuguuggcaguugauagcauuguggcauuuuuagugaggagcccaggacacagagccagcuggauucugugugcaacacagaaguucuuggaguucaggacacguggagcucacagacucaccugaaggaagcucgguguuucccaagacuuaacaguuaagcagaaaccuugcaagaacugcccuaagcagggcaagcucacuaucucccagaauagcucuagcaagaggaaaacguugagagagugucuggggucucugcaaacucccagccugacagggcaugcagggccagaagcuuggaagcccuggaccugccagagcacguacgagcacggagaggacaggcugacuucaaagagagggaguggagugcaggaaggauggggugagcuaacgaagcaucuguguccccuccuguugcacacaauuuccuucugugugacauuggaagaaggaauuccuagcugaggugagaaaaugccuguugcucauggccgauggaauuucaucaaaaccaagcauuagcaggaaccggugagcucccaggguuaugaaggggcagccaugaguagagcaagucagaguucugagggcagaaacgauaauuuuguauauguaugucugugugcaggacaugucaugcauguauauacgugaauacgcaugucugcaugcauuuguauguauguguauuuguaugugugggccugcaugugugguaugcuugcgcguaaucuccugcgugugaacaugaccguggacgugcaugugugcuuguuuauuugugcuuauggguaugugugugcucacauggcauguguacauguguauaugugugucugugugugcacaggcagagcguucacaaagaauugacagaauaacaguuuucggaagcugcugcuuaggcccuggaguacaguguggucucugcucaccagcuuggaggaggccaaaccggcucagagacuuccguucacaagcucugcuaguaaccuuccugucacuuugacaaauaucugcgcaaagccacuuaaauaaaaggauuuguuugggcccggugguuccagagguuucgguucaugguuggcuccauugcugugggucuguagugagagggggcauccagucggaaggacaugcugggucagaggugcucaucucgugggagccaggaacgggugggcagguccuaguucuccagaacaaguguggugccguccucccucucccucccuccagcuccucacaucccuacagccuccacagagcagcaggcccucaccacuacgggucuaaaccacagcgucagcugugccucgguuugcucguguuuccuucuacauuccucccugccucccucucagccauuucagaccgaacucuauggggcuggauucagugagauuuuaaucaugugucauucugagcguggccccggcacagcaaggugcccgccauucaggguccagacugguuggaauuggcuuccaugccacuggcugauauguuaggaucaugaugguccuaaccacucccucaaagcccuggcuuucccuccccugugucccucucgggugaggagccaugacauggcguucccaauaugaaaccauauugagucucaauggccuguccucucuagggcgagaaagguccacaaggcccagcuggccgagauggccuccaaggucccguggggcucccuggaccagccggcccaguggguccuccuggagaagauggagauaagguaaggaggacuuggaguguguguggccaggcaggcaguggguggaaggguuuuaaacagcgguguaugauaaagaggguucgaugggcagagcagugcugugcccccucaaccuggcggaggggugauuuugaaguuagcacacaaauaaauggcaacaaacaagaccuggagugugugucguguggcugcggggagccuggaaagcacuugguuccucagcaacucugcugucaccugaggcgugugcaggucacagccagagcugaagaaauuacucccugcucccuccugaacccuuucagacaggggauuguguggggcuggaguuaaugagauuuuacucugagucuauuuuuaagcaucuucucuugaaugaucgaagcucuguuuuuauugcuauuucugauaccauuacagaggagccuggauuuuauacuucauuaaggaaagaugguacggcuuagcucuucagggacgaucuccauuugucauaguucucuggugauauuucugacuuugucaccucugcacaaaggacgucuuagucuuaugucucugugugggaggcaguccaacagaaacaccagagaggacauuaguccaccacauagccaugccuacuauuaacaccuuggcaguaauccaaguaucacaaaggaaacaaagggacuggggaaaugucucucucacucaguggagugcuugucuugcaagcuuaggacaugaguuugacacccccaauccuuguuuauaaaagucagauguggugcugugucuguaaucucggaacuggggagguagagacagaaagaucucuggguucucuggcuggcuaaccuggucuacagaggcgaguucaaggccauugagaaauggaacagacagcaauuagggggucugcagagauggcucagugauuaagaacgcugcugcucuuaucugggguucaguucccagcacccaugugguagcuuucaacugccuguaauuccaauuccaaggaaucuaacacccucucuggcuuccucacagugcucacaugcagacacauguacagacacacaugcaggccaccugcacacauauguauuuguaccucuacacacucacacacacacagagacaucuguguacacacagauaucaaguucagaaaggauaucaaauucauauaaggaaaugcuuucuguugguuaguccuggaccaagagaggcacacacuaacagccuccucccuguccauccccagggagagaucggagagccagggcagaagggaagcaagggcgacaaaggcgagcagguaagacugugagugugcagggguggcugcugagcacagaaguuauacccuggguucauacuccaugaucccagcacugccaacuccugggucacaucauugacuuucuuuccugagaaugucccaugcacauguggacauucauguauguucaggugucugagagaaucucuuggcaugagaccaugaccaguccugcgucugccugggggcccagcacugaggaccacagagcucugcagaggcagggcauccauuuguaccuuggccuuucaugcauucagggaugcaagggggugggugcuucagccaggucacccacaccagcccucuccagugccaugagcccccgauuaaugucaguguucuuacuccugaggugacaucaccaggcuucucuacaggcucuggcucuccaauagcagggcucuguucccacuggcuuuucucucucccuguuccugcgcucacagugauaggugauuaaggacggcaugacauuaggggucguggugaaguccuuccuagccuagcacuuaggagauucgaguccucugauccuuguugucccaggggccccaugugccacaacgggguauuuggcgguugcugagaggacacauagugaccuguccugcuucuguuacccauaacaacaugaucaugguugaauugagagcuccgcccacuucuccaaccuuauaaccuggcuuaugcuaugauguuaauaguugguauuccuuggugacuggcacauuuggggacuaauauucacauccuguaggagccagccacuucuggagucagaauuguccuacuccuggacucaucugccauuucaauuucuuuuugacaccuacaggguccuccugggccuaccgguccucaaggcccgauuggacagccaggcccuucggugaguaucugugucagaugacauagcaaggccugccugucaaccuguuguccauccaugugagcucacccaugcucacuuccuuccuccagggagcagauggugaaccuggcccucguggacagcagggccuguuugggcagaaaggagaugaagguucaagagguuucccaggaccccccgggccagugggauugcagguaaccacagagcuuccccaggacccucuuagcagaggugucagucucuugcugggucuauucuuccugucauuuuaagacuagggaaacugagccucaguaguagagaguuuuugcugcaaguauccugugaguccaaacauaugaaugcauacacacacacacacacacacacacacacacacacguguguaccgcccccccccccacacacacacaguagaagcuguuuccacauuuacuauggaauccugggaaaugguguccuguaagaaaggaguacagaguccucaucugaacacacaaccuagaagugacagcaucaacccagcccaccucauccagugcccucuaggcuaccuguuccuaccacaugacucuaccugaugucaguaaagccccaagcuugccgugugcuauagagcacacagcagccguuauuuuaucuuacgaggcauguugaacaucauuaagucuucauuggacacaagacuuaacuuuggaaaacaggguuuugaguuacugauaguauuuggcauaugguggggacuugauuuauccggaagguuccccgaugccggcucauuaggcuuaucguuuaugggaagccaccauaagcacuguugcccauaaaucuuugcauucuccucugauuauguccucaguguucgagcccuaauccuuccgugcaggcagauucauggagacacauuucagggccuccaggaaccaucaugggacuggcgauccugagagccacgugugucucucacggcguggcaccucaccacaguuuucuguccacaggguuugccaggaccuccaggagaaaagggcgagacaggagacgugggccagaugguaagcagcuaugccaucgagacccacuauggcucccucugguuuucauuccagagauggauauuugcaucuugucuugcucaauggccuuucuucuucccagggcccuccugguccaccaggcccccgaggacccucuggagcuccaggugccgauggaccacaggguccuccuggagggauuggcaacccuggugcagucggagaaaaggugauauuugccuccguauuagugucugccccacagcugcacgagaauuaguguguuuguguguacacauaguccugugugccuguguguaugcacucacgugccuguguaugugcacacauaugcguucgugugugugugugugugugugugugcgcgcgcgcgagugcgcgcgcacgcgcgcgcgcggagacacucccaacgcacccaucaugaguaaacuaauggaccugaggugggagcucugacaguguucauuuguaacagcuguuugcaaaaccuaaagcaauaaugugcccauucgaucuccaauccccacagccuccuuccauccaguucagaccugaugaaagucccccuuucucccuccacccugagcuugcucugacagccugcuuucucacagcgagggccuugucaugccuuccuguuggugucagggccuggcccuugagacugagccacugagcccaagagugugggcaugaauacacaugaaugugugcacacacacuucugaauacacauaugugaacaugugagugggugccaugacaguuacagugugagacugagcuccacagagugcugagagcauggccuuaggaagccaucuugagccuugagaagguuggaaaccugcugccugccauugugagggcuugcuucugaugugggguacucugcucggcacaugcugcucuuguuccuuaugauaugaaaggucagagaaacgggugcagggguagaggcccugcugucucucccguccugccucaccccugcacagccuucgcuugccacccccuaaccccuccccccagggcccugccuuccugucucagugcugcaggagaaugcgcugggccucugcgcuccacccugcuuugcguccuguguuaguuaccugucccacugcugggacagaauaccugagaaaucaacucuaaggcugccaggcuugcuuggcucauguuagcggggaaggcauggcggcagggcugugagguggcugaucaugucacacccguggucaggaagcagagcaccugcuugggacagccuuuagcugguguccccuugugauuuguacaguauccuaccucuuccccuacccccacgucccccucaucccucacacacucuuucuuccuaauugcuuucucacugccaucugugagcuauuuaagacaguaaccgugauucuauagaguccugaacaccagaugcccaaaagcagaugggaagaugggcaggugcuggcagauggacccucugcuagcaccucagugugggaaccuucuaauacugacuugucuccucagggagaaccuggugaagcuggagauccuggccuuccaggagaaggagguccccugguaagugugacccuggaggaggaauaggacaugcccagugggaacacugacaaggcgcuggaccaggagcuucaauuuugccucaguuuccccuccugugaaaugggagucauggcccugcugugcugcacacuacagaacugugguggggaaguguggcaugcuguggggagugagcuuaugugcauucauguguacagaugugggggugagcacauaugcguacacaggcagcccucagcaaugagcccacaacuccuggccaccggugacuuccaucugugguauauaggcccuuucauaggcugcugugacugugaccauaucuaccuugcgacguagacauucaaggcuagccugagaauagccagaccucuaaagguuggccuaagaagcauccugagggacugaggacugagaugucucaguuuccucagcugccuuguauuaauccaggagccagcccuaacacagagcugagccuaggccuuggagguuugagaagggcaggguucuuugccuguccuguguuacauaugggguugcuauggagaauagguagcaagagcagcaaccaucccuguccugggacccgggggaugcugggaaagagcuggcagugaagagcagcaguaaguccauagauggcccacuguaggccagcacauuucaggcucuaagugagcacccagugagcucugagaacugaaccauggccucuuucuccacagggaccuaaaggagaaagaggggagaagggagaggcuggccccucuggugcugcuggacccccuggacccaaaggcccuccuggagaugauggccccaaaggcagcccugugaguaaugcuagaugcagugguaucugggcagagcccugaacacaggccauucugcaucccuggagugccugcaucguguacauucugaucuggggacagcugugugagugcugugugucuuagggguaauuuugucuacucuagagguguccacgccagcuacuggugaggcuguaagaggggaacagggacgcaugggauaaaagcagcauucauggggaggggguguccugaugaaagcccuucagucucaggguacuguuucugcuggccccaacuuugcaucggaagucaaaaggggcaccagaguggauguacaggcaggacgccugcccucacuagaguccaaagagcagaaggcugcuaccccggcucugccucacggguggguuugcugcucugugaacucuuuaggauaggguuccccugaucaaaagugcuggagguauugagacugucuuuugucuuguaaccugggucccggugggccgggcagggugugccaggcuguuaauagcuuaccucucucuucucagggcccugugggcuuuccuggagauccuggucccccuggagagccaggccccgcaguaaguguccaucuugucucuacugccucuugucacccccaguuuuccugcucucuguuuccucuccucuccuggguucuccggggcgcagcaccucuccaggcugucccuguuccaaugcccagcccgugggagaggaccugaggacacacuuggacuggaggaugaacuucaucugugcaguggaaacaauuuucuuguucccacagggucaagacggcccaccuggugacaaaggggacgauggugaaccugggcagacggugaguguguggucugauggcuuucucauggagccucccugcauucucgggucuucgugagaagucaaaacuuaggucccucuugauugugggcggagcucaggggcuccaaggcugggacccuuccuccaaaggaaggaugcauaugcaucccagcagaagaccuguaugaagcuccaaggguucugcaaagugccccagaucucacccugaaugccagccaaagcugaucaacagguguacaacccccucccacaggcccgacuccugcaacuguggccacuugaccuugaguggcuguuuaaaugugaaguggucucuuugggguggggccaggugacuucuucaggucccugggcuggacugugccucugucaagaggucucuucagcccacacccaaggugggacuagcuccuaggaacgaaugacuaucaaggucuuuuuacugauaaugugaauguuacaggcugggugauuaaaacaagauaaguguguugggcuuagugcugcaggcuaggaagucaaaauagagggaacuuaucagguaggguguugggcuguggcuuaacaaggcaagaacagaugugguggcucaugcuucugauccagcacgugggaaacugaggcaggaggauugcugcgaguuugaggccuuucuggucuacauuaugaguucaaggucagcuuugguuucagaguaagacccugucucugaugaugaugaugaugaugaugaugaugaugaugaugauaauguaguagaugucaucaugcgguuauggggagggggaggugggcuuaaccccccuuuuauaauuagcucauuucucugauagugaugaaaucuaugcauacucacaggaucugaaaagcagggccccuccugucaauaccagcacaagggcaauuugauaugagccuagauuucagaggccauccaaacccuaucacugacccaaggguaaaauacuuguaucauugauaugagacaggcagcaguggaagcgaagggcuggggacacaggcugugagccagauguguccuguccaugccccuguucccaagccccugccuugagcucccagcuuggcccuucugcaaaugagaggcaggugaugguagagcgguggaaaccagacagcagagugcugggugcaagcaugccccaggggaucucuuugcucaaggugcagcaacugugggaugugaguuggauucucugagugccaccaccagggagggcgaagggaugugaaggcuguagggaauugguuguggacuugcuaugcucacaccagagaaggggcugugcagggcugggcauauggagaugacacauuucuguguguuuccuuggcuguggccagcauacucguguguccugaugggacaaauuucuaacgcucuguguucuuucuccuaaccagggguccccgggcccuacuggugaaccugguccaucugggccuccaggaaagaggguaaguccuucugcccacccuuccucaccccuuguggaaucccuggugcuccccauggccccaaggagaguacauggauaucugaaaugugggacacacucaucaggucacagauaugugggggugacacagcuggaugcaguaacuucugagaaaacagagucuggucggugaccaacaugcccauuauacuaucauguggggaaaucaucuacaaaagcugggcucuccuugucccuagaccugaccauuauaagagaggagaccaggccuagucuguguuacaagcucuagugggugccuagacugcaugcagcacuugagccaaagagugcacagaggagagagggccuucuguaugcaaggcaccuaagacaucucuagauccaccagaggccuggccagcaccuggaucugugaaccccauauggggccuugcaucuucacuggccaguggcccagcguggccucauauccuguagcuuuucuggucuccaaacucaagucuuuguuguucuauuguuuuucuagggucccccaggcccugcaggcccugaaggcaggcagggggagaaaggagccaagguaaguuacucugguggcuguaacaucugugacccugagagagguuaggggcaggggcaggggcagggcacagccugagaauacaggauccggggcccagagggagaugggaagggucagggagccuuaagggaggaugaaguagccggaggaaguagacagaaagaggucaggcugagaucacgcccagucuuugaccuaugacagaagggaagacaacacacacaggaagugaggccuugggagacugggcuagccaccaccuaaguguuucacauggugcccagcacugggcgcuccgccacucucucagugaggugacccacauggccaacaugggaacauuugccaguuuucuuugagacuuagugagcucugcaucugggugcuguguggccugacaccggguaggugaccuucuguggucagcaggaucagggagccacuauguuuggauaacagaauggagcuugggccaagucagccuccacaggaaggugggguguggcaccacucaggacgcgugggagcaccuccacaacaccccagggguuuggggcugggcccuuugagccucugaacauauacguccuccucugcagggagaagcuggcuuagaaggcccuccugggaagacuggccccauuggcccccaaggggccccugggaagccuggccccgauggucuccguggaaucccugguccugugguaaguggccugucaggccugggaugagggagaggugcugauggaggcacagaauuacaccaacggacucuguuucagggugagcaaggccucccaggauccccaggccccgaugguccacccggccccauggugagcggcaugcagugucacugggucuguauuguuagggcacuggaacccgcuaggaaaaggacacugacuccucucuccuguccugcaggguccuccaggacucccuggccucaaaggagacuccggucccaaaggugaaaaggugagcugagacuuaggggacccuagcauugcaagaacagcacccugacucagacuuaggggacccaagcauugcaguaacagcacccaugacuccaucccaggaguuacugacccacugccaaguaccugcuguggcucucaugggaugcuaauguagagcaacggaagagaaauacucacaggacucugagacucaugucuguaugccagcauugacaagaaccugcuagagcccugguggcuucauuaacagauggugacuuuucuccuuccaucgauuuauuuguaaauaaacgagcucacaagacaaacagcugcucacagagaaggcaacaagaacguccuuucgacucggaaguccucccagaacacuguagaugcucacacaaaaccaaaagacguaugaggcagaugugggggcuuuuucuccugaaagguguucagaugagucuauuauccucaguucucagcaguuuccaucccgugucagccuugggccuugcaggaaaaagguggcaugcuuaccgaaagucagaauguuuccuaaguaaaaacauagacagaaacuaucaggagaaucccauggucucuggaucugggugcccgucggcuucuuuuugguuguuauuggggcccagugccagggauggugguggcucacugccagggaugguggcaguacuguaaacugaacccagagccccauacaugcuggucaaaugcuucacugcucagccauacccugucucucccugaguguuuuugcaaauacauuccuuacuagcaaggggccaggagacucgucaccuguccugucucugcuuacuuucacuccccaacauguugacugugauauguuucccugagcuguggcuaugagcccugucaccccacccacugugcaguggacucaggguacugguagcauagauaccuaucauggcucuauuuccucacagggccauccaggccugauuggacucaucggcccuccgggagagcaaggugaaaagggugaccguggacucccaggcccccaggguucaucugguccuaaaggagaucagguauauauaguaacuggauccauggagcaaauucuaguuucccaaggaggcugggaggaugcccucauugccauggaaucucaagucuugcuuugcagauggggacaguggggcuuggacuuagcuaggucugggaggcacaguuagaacacaccccaacccagaccucaaguggaggugggagcucucuccucgcugcuccgaggauccucagaauuugugggggggucuuagcagucagauccuuccuuccaacuccaugcaaaagccucuaggcagaagauaguggcgagccaacagccauguuuacuugugaggagggguggagcaauggccacuaacauccuugcccccaccuuaccgcagaugcccacaucugaccccagacuuaccccagaacccacuguagcugguuagcuugcaaucacggugagccauggcagaggaaacccuggcugugucuugauuugaggagacucccaaauucaagaggcagucuguguguggcacuggagagauccccauucacugcagugggaauuccuacacaguccccacaguaugacagcacucacaucuggggaucuuugccuacccagccuacaucugucuuuaaagacagcaggauguggggugucgggagccucugggggcugagaaaacaguagacaucaaucuuuaggucauaguggaagugcauggcaugagaggauggggcuccuuggagccccgccucagccacugcacguuuuucugacugucccguguccccaggcuucagacuugucuggcucucuuugugaauguauauucacuucugugagccacaaacuauguccuuggccagggggcaggaggaggcaucuccagggcgcaggcuugggaagcaugggacccaucagggacccugagguccaggcccaggacaggagagggacuuuguucccugugaggcugggcugucuacuguggcuggaaaacacguucauauuucucuguccacggugguaaggccuaacauuaugagcugagauauguggccaagcugggcaggagguuggagcagacuuuuauuaguuccaguaguguaugguaggggugaugucuuaauguacagauccuuccagccugggcagggagcugacccuggggacuucagccuguggcuguuuuggucgaucaguucaauccauugaggagaugugguggcucucaccgugauguaagcuccacccagagugguugacuacagcugccagccaggauucaugguuccuggaaaggggacuaugcgggauuccggaaucauggcagggucaaggcggucacuucccucaauuccaccuccaucuaaaagcugauaaccugcauuuucugcuuccuuccagggcaucacagguccuucuggcccacuugggccuccugguccuccuggcuugccgguauguaucuaggauggaugcaagggucuagggcccaguugauacaaggacagaugggagauggaugagccuguccagcgaaccacaaggauguuaggaaagaugauugaaugagggaugauguguacauaacacaaccuuggaguccuaagggacaggagcaggagauggguugcugcucuccugauugccuugccaaaggggaagggaagggcaaacaaacuuuagucccugaaccuccucacaaaggauggagagccuuuuguaucuggggagagggaagggaguggucuuggcucuccucuucccaguguguaugagcagggccagcccagucuaggcuugaaaacaagggaccuguuuucuuaggaaccuagccugggccucccuggugcuuugaggguccaucacuacaauaucaucgccacaucccugggcucuacccacucugagcaaccuguguaggcuggaccuugggcccauauggccauggauguauagcagcugauucccuccaggccccauaggaguccaggggcuccuuggcuuuugauguccaaauguccaaauguccuuggcuuuugauguccagcugagcacugugggcagggugaccucccaucagaugcccuccugcaggcagugguagccacauccacccuccugcccacucacugaccaggcaggcauagugaggacucuuagggggugaccaagcaaaccugggaccugaguggccccucuguuuacugacauucugaccuuugcucucugcagggcccuccaggucccaaaggugcuaagggcucuucgguaagugacucugacuugucugggcccaccugagacugccuuguaggugggagaggagucuccuagggcuggacccccaacccagacccccccaccccagacccccaccccuacucauagcuguacucuccccacaccuucucuuuucuucuucauuacacuguauguugcuggcauuucuuguugucuuuagguuuucaguuuuguuuuuuuguuuguuuauuugguugguugguugguugguugguuaguuuuuuuguuuucaaauaaccaauugcucugcuccuggcuguuuuuaaaguauuauuuuaaucguagcuguucaugagguaaggugggagaaaaucaagugagacuagcuagcucugacagauccugcagccucuugacacuuugggcuaacauggaauaaucacguguauuaugggccuugguguggcuuuuuuacuaugcuggggccauuggcgguuccauggcuuuacugauggagccauccagccucucuagauauucaugaaaccuagcaggcuaguguguguguguguguguguguguguguguguguguguguguguguguguguguguaugugugucccacugugcuacagaauacacgguuuuacuccuguguagccauguuugguacccagcacgucuucauccauccucccaguguuccagagcccugccccucccccagccucugaaaccacuguccuacccuaccuccugcuuuccaugaacuguuaaugcuccaaauuaucauacacuguauuucuguuaauguucacuucugagcgccccucgucugucugucccccuccucgucccugcccugcaaacccccccauugcccaugcaaagacaagauggccuccuuuaugacugagcaacacuccuuguguguguauaagauacauuccguauuuacucccuggauggacgucuaggcugacuccacaucucagcuauuguggucagugcaguagccacaugggugugugagcaccacucagacacgcucagacacacucagacacacucagacacacucagagguggagcagcaagcucgaguagcaugucugucuuugguuuccagcauggcggagccauucugcauucguaccagcagugccccauccucuccagcacuuuuugucuuucugauagcggaguugcugacuguguggaaaugaaggcccacugaggguugggcuuacauuucccugauggcccacacagcugccuugcuuccauaagccuguuuguuggcauuuuuguuuccuuugaccuccgucuccugucuuuauaaaugagccuagcccaucucaggccaagguggcugggccuggccucaggagcagagaacccugccugccuugucccuuugucccggccuucuuggagcuaauaggucauucagaacacaggaggccccaugaccaagugcugcuuucuuguuuucccuccagggucccaccggcccgaagggugaggcaggccacccaggacuccccggcccaccugugaguagucugugaggugugaaggggaacugagggauugucuguggggcuugcugucugagaugcagugagccccacauggcauacccaggggauacaggggggacugugagucuccuaucucucuggccaauaaucccacccauuggcuaacuugcccugggugggauuauuggccagagagauaggauguacauguguguggauguuaugugcuauguggguauauaugacuauguaagugugucauauugcuauacaugcauauguguacugaguuguguguguauguauucauauguguaaguaacauuuugugucuguauacauguuugcuugcaaguauggacuugugcauuugugugugcucuaugcauauguguguaaauaugcauuaaguauauaugaaaguguucauauauguaucaacaugcacauauacuuguacaggcauauauguauguuucucugugcuauaugcaugugugugaacauguauacauauguguguauaagcguauggcauguguauauaugugaaaaugcauauguaaguguguauauauauauacacacacacacauacaaugugugugugugugcguguguguguauucuucccuagguauguguauguaugcugguuuacauauuauuaagauauauauguauguacauauauguacaugcauguguauguaugcaaggauguguuuuucugucuguguauugugcauguucauguaugugugugaacauggauuuguuaaugugaagguguguuucuauauaugugugugcauguauauaagcaugcauauguauauauaucacagaggauguuuguaaguauauguauagauguauguauauguauuuaugcacauguguaugaacaugaaguguguauuguauauuucuacauggguauuguacaugugcauauauguauugugaacaugcauucaugaaugugguauaugcauuuauguguauaugccaacauaccuguguaaugugcaggcauauuuccauauguuuauguaugugaacauauauguguuucugugugcauauuguacauguguauaugaauaugcauauauacauauguagguguuucuagauguguauauguaugcauauguaugauuauaaaaguguguauuacuauguguguauuauucuuauguguauguaugaaacagcauauauaaacaucuaugcauguuucuauauguauauugugcauguguauaguuguuugacuaaauuuuuccugggaguauacaacacaaauaccuacuuaauaccagaaagacuaaaguauaguuauugcucaagucaaaccuggugaaccaugaauuuuuuugguggggagggguugguuuuucaagauaggguuucucuguguagcccuggcuauccuggaacucacucuguagaccagguucgucucaaacucagaaauccaccugccucugccucccaaaugcugggauuauaggcgugcaccaccacugcccggugugaaccaugauuuuuauuggacuuacaggaauauggggaaggguuacuuauaggagcagaaaugacucaaaaccagcugcaucuuuaaagccuaccccagugugggugacaguucacaagcugggaacuuggagcaacuaugcagccuacaggcaacucagaggauugaagaguguccuuucuaaguggaccaguucaucuaagcuucuuccaggcagcuuggcugguuuuugcaucuuccaggcaucuggucuggucucagagucuuugcagcuuaagucuacuuccuagagagagagggacccucagcuuuuauugcuuagucuggcagggagagagaggccuagugaaucuagucaguuauagggacuuucugaagcuauuuugaguuguuuaccuuccuuuuaaagauacuuaccugcaggauugaauguuucagccuuggagaaacuuuuacauagcgguuauaugugaucaugcauguguuaguauguacacaugcauaugauguauauaguccuguauugaggauauguguauauugugucugcaugugugguucugugguuguaugugcaugcaggaaaagcuugaugugguugggugcugccagucccuagacuaccuuacacagagccugagggacccagacuucuggcucagggucaucuuaacucugcccuuggggcagggcaauucucauccucucuuacucauaauugcucuguucuguacccuagggcccuccgggugaggucauccagccccugccaauccaggccuccaggacucggcggaacauugaugccagccagcuccuggacgauggggcuggggagagcuacguggauuaugcagauggcauggaagagaucuuugguucccucaacucccugaagcuggagauugaacagaugaagcgaccacugggcacccagcagaacccagcccguaccugcaaggaucuacagcucugucauccugacuucccagauggugagggaggaccgcagggugggagacagggccagccagagucacccccucacucacucacaucugugggaggagauuugggcuaggccccucauuaaucuucagaaacauaagagagggagguugacguguugggagaagccacagaggaaagaagucaaaccucagagugccaaggcugauuggguauuauccuguggccuggcacuaguggccccgaaagcagcuugaagucaggaguaugugcagugcugggcuugggaaagugggucuuaagcacuggcagaaccauagaaccucacccucacccacuucaaaccaagggccuguugagcaguaaaaugaaaucgacuucuuuccccagaaguaaggggugcuccuccucuggauuugagggguaucugauuucaguagauucugacgccaugcccaugaaguuccagguucauuucggaacacucuuggucuuugugccauccacccaucaaggucagcagacacuuacacagugugcuuccugcccgagcugcacuucugcgaacaggacugucugcuucucuuuaugcuccccucaggaaaagcaaaguacugugagacaggaaaggaggcggugucgguggcuuuauggcccuggcugugcauuuaacagcuaggcugaaauguugcgguggcuucugcggacaguccagggagccauucucaugaaucugccucccugucucugaaauccaggcgaauacugggucgaucccaaccaagggugcuccagggacuccuucaaagucuacugcaauuucacagcuggaggguccacgugcgucuucccugacaagaagucugagggagugaguaccugugucaacugccggcguccgcuuggaccagggcuucaguguuucuuguguguauacagcuuuaaggcuaaaagccagcagacagucacuuucaguaccaagaacauucuucuggaaaccauacuuaaguuguccuaagaugagauaguuuaggugugcagcagcagaugcagccuagguuccugugugugaagagcgccugcccugagcaugcuccccccaccucaccccgccuccacaauagauuauccuggggcuggcagccaucccugcucagcaucaucacagcucaaaccaaccgaaaacuuggaaagaccuuuggcgacaagugagaagaagaacucauuugucugagugugccugaacugggggugccagccuauuuuugugggauccuaggccucucaggugccaggcaggggcaugcaugaggaaucuguaggcagauaacuggguucugacucaagauauuuugugggguaucauguagucaccccuuucugaggucacuccuguagguaggauuguguaugcaugugauaggugagugaauugugcugcagacucugugucagaggcuacuccggcugggacaggccggcaagagaauaagccuucccauaucugagagcaugaccaugaccccagucucaguggcccuccaucagaguugucccaugccauuuucuagaggccacagcagguguguauguagagccacaccacagcucccuagcaacccuagcaccugggaaguggguuccugcuggagagggcauaagggcucccuggggcugccauccucucucuaaaucacaccauaaaagugguaagcgccagcacgcccuugggucgcacucugccgcuggcagcaggagcagagcaaucccuccugcacucugauguacuggacucccagagaagagccagggcuuugcagagaucugagacaugagaaccucuaugggucucauguccccccaucuggcuggagcugucaauggaguugaaccaagagcccuuucucaccccccuuagugcccucugcagacagccucuuggagccaaccugucucugggacuaugucagauagagucugugcagaugcacagacacucgguccccuugcuucucccucguguacagacugugggcugagccagagcugcccugcccaggauaaauagaccuucuccuagagccagugagacacggcuccagagccuggagcagguaugaucagaagucugaguugaagccuccaucccuaacuugggaggagcugccccaacacaauuugaguguggcauugacagaccacaggcaaaggugcaggacucugggggagggggcaggcagacaggacaccucauuuccccagcagucaggcuuuguucuagcacccagccagcucaaagggggcaaucauguugauccauaucccugccucuuccccaccuaacguuugugacuggaucccauguauggucagccuaugaugucuugaaaacucugguuuuccacaccaacugaaucagucuggagacacgaccucccacccucccccuacagagacucagcccauaugaucucugagaccacucuguuggucagucuuacauaucuucagccuuggcuuucauagagauagaggccccaagugagacuccccaaggaggcacagaggcaagcccuaugaugaaggaggucaccuuagcccugcaguuucuggaggcuuugaggacagucucuguucccuugucauagcaaauuaccuacuggcuccaggaaccccaaagaccauaaguccccagugaagaccuucacacacacacacacacacacacacacacacacacacacacacaccucuauuguaugccauuuucuggagagacaccaacaaacaucuuuccaccucauaaagggcaacaacaauagaacaaagacuaaaaauauaauuccacccaggucuagcugaguggaacuguagaguuuauugggguuacucacaggagcucuggugauucaaaagcagcugucucacugaaaagaccaccacaggaggccuacaacucacaaaagcugcaucauuggaguuuugugacuggcacacaaccuggcuggucagagaacccccccuuucccacugcuuucauaguguuuuaaggggccaucuauacuguaagucugaggagguuccugaaacuugugaguuguguuuacccccggaagcuuacuaagcuuaguucuaggaaagauguuuccauuuggaggcuauaacuacacaacacuuccccccuucugacuauaacauuguuuccacaucuccuguugcaaaaaauaaacuuccuuugaugaccaacugagaaagcaguacuguauaggccuaaacaccagugauuaagauguaacugauaggugcaugugaguucccgucagugaaacagaccuuaaaccuauugaaaagcagcuggugacaccacaacacuuguaccacuauggcaccaaugugcacaucuugucuggcuuguuggagcauagcacacaggacuacugggggcaauccuccuccagcagccuacuugauaacuccuggcacuaagaaagccaaccagaagggggggggaacuuccagcuccgucucagccugauucuuccauggccugaggccagcacagagggggcuccccauauggcuacauacuugacacauaccacaaccacguaccuuacgcacacacauacauuaugcauaugcacuuauacauauauguacacauacuguacacacacacguacuacauacacugggauucuauguugcugcaguacuggguggcagcugaagagccugagccauugucucuuaaaacugagagcaggaugaggagauguccacacauugcaagcccaucaacuuaugcuggcugcaacuuucucugucacuggcaugagguuucuguguucgucauuuacuguuccacuaugaccuuucagcagucacuagauaccuugguacacacaagcggauaggugcgccuguaauccuggcaugaccauguugacauguaccuggucucuauagagcucuagaacaguuuucaccccaugucaccccagggaggaggcauagauaucucggcaggacacaggggcuggaaaagcugggaaggucugucuguagaggcagaaguaacccuuucauuuucuguuucucucccuccccaccaucccugcccuauguguaggccagaaucacuucuuggcccaaagaaaacccagguuccugguucagugaauucaagcgugggaaacugguaaggugacaccacguucuuugcauuugucacuuuaaacccgccaucuccuaucuugcagaguaaaauggcccgguggcccaaagaacagccuuccaccugguauagucaguacaagcgggguucccugguaaguggccaccucacgcugccugcuugcagcucagccuggcucuggguacugcaugggccuaaucacagcuggggccacaucugcuauggcccuuuaggccaaaaugcuccacacgccuggcagcaaggcccagaugggcgugaugccccuuccucucgccucuccuuccauccuggaaguagguggguagcuucccacugagacucagggcaucugcagcuggaggugggcacgccaguaaagccacaugcugcuuauggauggcacaccgucgcuggcaagccacaggucagagacauacaccgaguaggagauccuucuucauaggcaugaccaguuaggagguucacagagaguacuucuagaccccugcuguucacacccucuuucugggcuaugcaaggcccucggacucuggcugcuguugaccuuguaggcaccaggugugccccacauggcuguauuagucuguguuuaacuuaugggagguguaucuuagaacauaacccaucuuggaggugaagagaucuuaaugucacccagaaggcucuuauggccagcauggaggucagaaacuuguuuagguucauugcuaugagaccaaugcucucccacuugaaacaggacauuuuuuuccuccaaauacucagggccuuuaguaaagucagcucaagacuuuguaaagacccagcuagacuucagguuccaggucuagagaagagccccacaccuucuuuugacucuucagucuaguggaccucucccuaugaguccuugcucgcacaaaccccauuggggcuuccgcugccucucagcacugcaccaaccucagccucuuuaguaagcacagagucaaguggcuuccaggacuauccugccuccaccucugucaucccucagcccggaggcaugccuggcuuucugucaggggucccaaggagcucaccucugcacacaagcuguggccuggacucuuugggcuucagccccgcagcuucucuuccccugcugggagccgggcauccucaucuguugcuuccucucuucugcuccuuuugcucucuugagaggaaaaugguugucacacagaaggaccugucaggaggaagacccaguagcagugacaggagaucugaggggucagacaaggaaacugcccagguccgagauccuuuggguccugucugcccaagcuugaccuggcuucuccccucuccaaauggcuuccaccugguggaguccaggucccccaggggcagccacccaauugcuagcauugcuaagggagcaaauggucauagaauacccaugucuaggcacgccccugucugaguugguuaucagagacagaggccagggaccauucaaggcaaaccagccugccuucaggcuacagugcccggcucccaguucccaguuagaaccaggagcugccuaagacggccucucacacggaggaugcagggaaucaauccacuagagcagguccucuugaauucaacuuggaacaguacuagggcuucagguccuucuguggggccaccccugccucugcuguggcauguguccucucucaagucagucguguguccuuccaggagcacuggauacccggacugccgguugguaugcauuuuuccuuugcagagucugacuguggguuuuucucaagcugucuucaaggaaguggagcguccuugguagcuugggaacccuuagggugucccaccaucaugguggaaaggaacaagguccugggccugccucccccacccuaucccuucccccuauuacuauugaaguuguugugucuucuuggucaccguggccugugcuacaccuagcacugccccaagcauuccuucacuguacacaugcccuuuggaguggccgacacagaacaggguuggagcugcagcugcugggagcuggguuuaccagaaugagacacugaccucugccagucucuucccugaugcaaaugucacuacagaaccugccccgcugagcccugcugguccuugccuggagagaggccuucagucacaccaggcuuggggaggcugugcuuucccccacagcuaagaguuuuguaccccugauaauacugaugccucagaaaacucuuugcaaaagacaaugcaacucuucucucaggguguccauggcagccugcaccuaguggagcagaauggcuugagauacuggugacacagugggagccacuuccagggugccauucauucucuuucccugaggcuguucccaguuuguugcggagaguggggccuuccagagagaguccuaacuccagagcccugcucugcuugcuugguaugcguaguggucugcaggauagccuguuugcugccucaguagccugucccuuggcagaacaggauacaucuggucacucggguucccacacagcucagacccuacucaggcgaguccaucauccauccaggcugagccauucuucaacguucccugaggucucuuggccauucuagcucuugauccccggcaguggccuucaagcaguggcucacaagagccccggcugccuuccucugcucaacacagugacagggacaagaggcugagcuccugugcuuguggcauguguacucugaggaaggugacagacagauugacaccaggacacaggaccugagcuggugcacccagccucagggaacagugagcacagugacagagcugugaccaaaggggacacuuagcagcaucuccugccuaugggccaugugcacuacagagagaagcgcuccuaucaagucucagggucagacagaacacuggagaagugccagggccggaaagggcguggucaccagaccccaggagccuuuucuccuccaaggccuucuucccauacaucugcucgcccgccuugaggaaucagaccuuaccucuugcucccagcagacugacucaugcauuggcggguggggccuucugcgucccacggcagaaggagaagggcagaaggagaaggcggcucuuaauggagcaccauggggugcagucaagccaggcagacccugccaaguggagaggaggugaccagcuccccagaaguggccuggaagcuggaggcagaaaagagggucacauggaagaaaugaccuaggcaggcuuccuggaggaagcagggcaggcacuguaucuagagaggcagggcugcuggaugaaggguaauaagacugucagucucugaagaauacguuaugagguguaucucacuuggcuccuauucucagggcucucaggagcgaggaguacagaagcuuccaggcagcggccuaaagggacaggcuugggugaagcccuguggguguggggaacugucuauugcuguguguccacccugcucacccccuugcuaugccuacccccagcucuccuauguggaugcugaaggcaaccccgugggcgugguacaaaugaccuuccugcggcugcugagcgccucugcccaccagaacgucaccuacaacugcuaccaguccguggccuggcaggaugccgccacaggcagcuaugauaaggcuauccgcuucuugggcuccaacgaugaggaaaugucuuaugauaacaaccccuacauccgugcccugguggauggcugugcugugaguaugccucccauggaugcucaccuagugcagauuuacagaggacuuugugugugccauucucucuguguuagggaugcaucaagagccggauagggccccagccuggccauaucagaguguggcugaccuggaagggccugguuggaguuuagagaccaugcaguuaagcagguguuuucugggcagggugagaauuaugaacaggcugccuuuguguguaugcgugcauguguuuguauuugugcgugugugcuuggauguaugaguauaugagcggcgguguacauggaagggacagugguugucauuccuguagaaugaaaagguguuucacuggcucuaaccugccaaguaagcuaagcuaaguggcugaccagcaaaauccaggaaucugccagccacucacuuccaccuccagcaccaagacugccagcaucuaccaccucccagccuuuauuuuuaaggaaggauuuauuucacgugcgugcguguuuugcucacauguaugccugguacccauggaggccacaagagagcccugaaucuccuggaacuggcacugugguaaaucauuaugagccaccaugugggugcuugagucuaaacccaggucucugcaagaaugacaggugaucucuccgacccucacacccagcuuuuaaauguggguucuggggaaucaaacucugcucuucaugcuugucugacugagacaucucccuggccugggacuggcuucugagggagaagccaagcauguuggggaacucuccacagcuccagaucuggcugaccccugggagugugguagcugagguggaaguucugaccacagcccacaugaaggccuucucuauucuaaacacuguucuaagcuguggccuccccagcaucucuggugcagaggcgagguauagaacagaaguacacuggggggaggggggaggagaaagcagcccccuccugguuuuaguucgggaaagauccaagauccugucuugggaaaggugggaaaauaauggcucagaacagaauaacccgcugauggaaaaaauggcucuguguacugggagggaacucagggaggggaagcaggcuggcaggacuguagaauugcaaggcaaauccaaagggagcagcaugcagcaggcugacuggaguggugaaccgcucucugccccgaaaccccugaguucagccaugaucugaaaugucacaacucucuccuuauuggccaggcuccuucaggauucuucuauccuccaggugcaggccagcggugccaaggccugcccagcccugggaggccaguuugacucauuuuguaaucacagccacugaaauuggaaugccagcgcugcuauuguguggcuggguagccugauugacugggcugccaagcggccggcccuguggaggggcagagagucauuccacaucaauccauuguuugugcaguuugugugccccuggggggccguugcuagcuggcaaugguuauuuaugucucuucuuuaaauaugucccucucuaagcgcucugauaauuggagcaacgggacuccacaaaucugugugaaaucaccugccggcuccacacaugguggucccuggggugggagagaaagacccauuugauguugaugccguaaaguggggaaauaugggcuggcaucggcuuguggccucaugacucacuggugugugacaguaacacuccaucacugaccucacauggcucuccaagacucuagcaccuuccauggcccaagaaaggccaggcugaucaccucagauaaauuucugggucuggaagcagagaccaagguaaccggcccuagauggcagcggugaccagcucugacucccuagccuagccaggagagugaggcucucagguacccccaaccauacaugggugcguaagucuagccccugaagcuacccagaucccucauagauaucuuuuuugagacaggguuuuucuacauagccuggucacaauucucucauuaguacagcgguauagucucucuuuagucuauagaccagacuggccuugaacuuguagaucuaccuaccucuaucuccugaguguuggaauuaaaaacaugggccacuaccccugucucuuuuuuuccucuuauauuuuuauguuuauggugugcauauuugugucuaugcaugcuuuuucauguauuggcauguggguguuugugugugucucugugugugugugccugacauuaggggcuguugagaaucauccaucuuauucauuggucagggucucucaacgaaacccagagcucacugauguggcuugucuugcuagccuagcuuacucuagaauuuccugucucugacuuccaaagauggcauuacaucuuuggaguugcuacacccaccuagcauuuacauguauuucugaggauucaaacuucagucucuguguuugcauggcuaacaguuuaaccacuaagccaacucuaaaugcucagauauauaacaugguaaguuucaggcaaugaccacggaaguggaaagauauggccauuucuuuggccagucuccuuacaaccugccuggccagaucagcuauagguaucccuaaaacccaaccauguucuaagcaacuagaaucuguaccaggauccugguggcaaauucuuucaguguuucucaagggacagccaggaaacuauaaauaacaaaauuguccaagacucuaagaaaacacagauucugaauccaccaguuuuaguuaggauuuuauugcuaugaauagacuccaugacaaaggcaacuguuauaaaggacagcauuugguuggggcugacuuauaauuucagagauucagucuguuauuaucauggcaggaagcauggccuaagugacuuauagacagcagaacuacccaaaguucugcaagcaagaaguucaagguuggggccaucaccuuggguuguacacagucaaccuuugcauuguuaucacaaggcagagauagagggucuuucuggguucccuucauaagggaagcaaacccacuugugagggguccauucucauggucuaaucaucuuuccaaggccuaucucucaccaucaccuugagcaauaggguuccuauuuggauuugggguccacacucaguacucccagggagaguaaggccauguaguaaggcuacacaccaagcgugggaguuucaggacugacccaaggucaguaggaggcccucucuuccaggcugcacccuggcauguugcacccauaauuaacaugugggauacuugcugcccgucugcuuucucgugauuucugccagguuuaggcaguggagggauaccuuucccaggacaggcacaguuucaugagaauggaguucacauccaugguuguggaaaccccggcucaggacagauggccaguauauagcccaaaaauucauggaagaaaggcggggaugucaggcaccauugaaggaagucgguggaguggcagaacuagauugcccucagugacaaauguucuagacgccugaaguuaagcuugcuuggcuuuagggacagaaguacucaugugucuuccugccuauauucugugcuggaagagauguccuggcuagcagcucccucacccuggcugaggcucagccuacuuuucuuagaagagccuuguuccacucugcucaggagccccgagcagggcugaacacaugagggacacugaccuaucggguugcucaggcccuacaccaacaugacucuucugugucucaguuuacccacuucgcucuggaacagguaguauggccacaucugugaaggggccaggcauagcugcagagcuccacuucccucucccacgugaagucuuacaggggucccgucaccucucugcucagccauguuucuuccaacuuacuguucugcagcuaauuugguggcucaggaguucguggagccuugggguggagagaacugggccaggggcauucugccagcuuuaacagccuccacuucuuccccuuccuagaccaagaaaggcuaccagaagacggugcuggagaucgacacgcccaaaguagagcaaguccccauuguggacaucauguucaacgacuuuggcgaagccucacagaaauuuggauuugaaguggggccagcuugcuuccuaggcuaggagcugcugagcccaccggucuccagagcaaccucgugaccucagcaccccaccugugggcguccugugcacggcccaucccggacagugaacauuucucaccccugccugccugacucaucugugccucggacccuccguggcauuggaccccaugcccagagagaacaaagggaaagagccguguccccacggagccgaaucacaugaccuagccacaccacagccucuugccacccuucagcucucaggauagguucauuaaagguguuaauggaccguuggccgggagugggggcgggacaguauuugaagaucacuuuaaaaaaaauucaacuugaagauauguauucccccugaccuucaaaagauguucugagguggucuuguaaaggucgccaaagccuccauuuuuuuuuaaaacaacccucaacacauccacucagaggccaaaugucauuccacacgugccuuuccgauggauuaaaggugcuuauguuuuugugagaauuuuaaguaaauauuuguauuguauuguuauaaauguuaagugugccuggcuuucagucuugcauggaaacccagccuuaggcccaugggggcagcgggcagcugggacaagucacccgcucgggcucgaaauccggcucucgguagagggcaucgccuuacccccacccccacaagaaugugcaauaauuuggaaauuugcccagucagcaagaagcggcauugccacugcaggugccugggccccuuuccagacucuuuauuuuuuucuuuuugauuagcucuggauaauuuuuuauggggaggggaaaaaggcauuugauauccugccuuuccuacagcacucagauuaaaacacaggcuuaaauuaauucugauugcuuccuuuuuccuuguuccuuccugcagaggcugaugggacaguguccagggcuggagagccacguguucuguagaugauaaauaacuaugaacauuuggugcugaauuuuuuacacuugucucuuguggugcuauguguccggagacccuuagguggcccuagggugccugccaugccucauucccucccccaccuuccuuuauccuggccauuucuccacauucugagauuuuugccaaggaccugaagaccagauuggugccagagaccuuucuucccuccuggcaccuuguacucaugaugguggggagucccuuccugaagccugucccccucucugggcucugcuuaugucauuugaaaacacaugagcaaaacaaagacuucgugcauggccggcccaugguguacccauggucuuguucaguugcugaauguuuguggugcuaaucucugugugugugccaagauggaauggaagcugcugugugcccaccugacagccagacuucauugagagccauagguggcuugagaaaugugggauggacucuggcuccagggucgcugagcugacugaguuuccagcagaggaguguccugggugcugcagucagugcugggguccauagggaucccucuggaugcugcccucuuccuccucucccuccuccuccagggugugugugguggcugggcgggaggggugcugccuucugagugcagaggucuccagguccaacaaggaaaaccucacugagaguuaccugccuuccaccacgagaaagcuguggugcccacagagagucacucuggugcuuguguccccaccccaccccugaagugaagaaaacgaccgugaggcacccgggagcagccaggauugaugaacgccaccaacacgcaucccccaaaguucccugaagaacaaguucuacucuugccaaagaaaugccuggccuggagagcucuccuggaagccaggaugccaucgugagccagggacugcugugcaugccucugcaugagaaaaagccauauuggaagacggccauacgcccuguggauucuguguaggucaugugauucggauucugccucccacuccaucugacuuugcucuguccuguucuucugucggucccuuccacguuguaauuugcauugaaacccaaaauguguucuguucuccucaguccacuuuagcuccaauauuuuacaauaaaauuacuucuuauauuugcagaaaugccucuggcaucauuuuccguuuccauuuucucuggugugugcgcucucuacauauauauauauauauauguauauauauauauauauauauauauauauuuuuaaaaauugaacaaaugcugcugaaaauacacacaaaguaaacagaagggcugugugauaaaaacuauaggaccuuggguccuuuaaaauuccaggccaaacgguacauuguauauuucccagcagucuaaacuaagccucagauuuuaacuucuccccaggaagaguguuauaaaauauuuuaaaacuguguaacaaaggaaucguuguaacagugucucaauaaagcaguuuacuguuuacaccccagaaac

SEQ ID NO: 715 - RNA, 6579 nt, Mus musculus
cggugugaaccaugauuuuuauuggacuuacaggaauauggggaaggguuacuuauaggagcagaaaugacucaaaaccagcugcaucuuuaaagccuaccccagugugggugacaguucacaagcugggaacuuggagcaacuaugcagccuacaggcaacucagaggauugaagaguguccuuucuaaguggaccaguucaucuaagcuucuuccaggcagcuuggcugguuuuugcaucuuccaggcaucuggucuggucucagagucuuugcagcuuaagucuacuuccuagagagagagggacccucagcuuuuauugcuuagucuggcagggagagagaggccuagugaaucuagucaguuauagggacuuucugaagcuauuuugaguuguuuaccuuccuuuuaaagauacuuaccugcaggauugaauguuucagccuuggagaaacuuuuacauagcgguuauaugugaucaugcauguguuaguauguacacaugcauaugauguauauaguccuguauugaggauauguguauauugugucugcaugugugguucugugguuguaugugcaugcaggaaaagcuugaugugguugggugcugccagucccuagacuaccuuacacagagccugagggacccagacuucuggcucagggucaucuuaacucugcccuuggggcagggcaauucucauccucucuuacucauaauugcucuguucuguacccuagggcccuccgggugaggucauccagccccugccaauccaggccuccaggacucggcggaacauugaugccagccagcuccuggacgauggggcuggggagagcuacguggauuaugcagauggcauggaagagaucuuugguucccucaacucccugaagcuggagauugaacagaugaagcgaccacugggcacccagcagaacccagcccguaccugcaaggaucuacagcucugucauccugacuucccagauggugagggaggaccgcagggugggagacagggccagccagagucacccccucacucacucacaucugugggaggagauuugggcuaggccccucauuaaucuucagaaacauaagagagggagguugacguguugggagaagccacagaggaaagaagucaaaccucagagugccaaggcugauuggguauuauccuguggccuggcacuaguggccccgaaagcagcuugaagucaggaguaugugcagugcugggcuugggaaagugggucuuaagcacuggcagaaccauagaaccucacccucacccacuucaaaccaagggccuguugagcaguaaaaugaaaucgacuucuuuccccagaaguaaggggugcuccuccucuggauuugagggguaucugauuucaguagauucugacgccaugcccaugaaguuccagguucauuucggaacacucuuggucuuugugccauccacccaucaaggucagcagacacuuacacagugugcuuccugcccgagcugcacuucugcgaacaggacugucugcuucucuuuaugcuccccucaggaaaagcaaaguacugugagacaggaaaggaggcggugucgguggcuuuauggcccuggcugugcauuuaacagcuaggcugaaauguugcgguggcuucugcggacaguccagggagccauucucaugaaucugccucccugucucugaaauccaggcgaauacugggucgaucccaaccaagggugcuccagggacuccuucaaagucuacugcaauuucacagcuggaggguccacgugcgucuucccugacaagaagucugagggagugaguaccugugucaacugccggcguccgcuuggaccagggcuucaguguuucuuguguguauacagcuuuaaggcuaaaagccagcagacagucacuuucaguaccaagaacauucuucuggaaaccauacuuaaguuguccuaagaugagauaguuuaggugugcagcagcagaugcagccuagguuccugugugugaagagcgccugcccugagcaugcuccccccaccucaccccgccuccacaauagauuauccuggggcuggcagccaucccugcucagcaucaucacagcucaaaccaaccgaaaacuuggaaagaccuuuggcgacaagugagaagaagaacucauuugucugagugugccugaacugggggugccagccuauuuuugugggauccuaggccucucaggugccaggcaggggcaugcaugaggaaucuguaggcagauaacuggguucugacucaagauauuuugugggguaucauguagucaccccuuucugaggucacuccuguagguaggauuguguaugcaugugauaggugagugaauugugcugcagacucugugucagaggcuacuccggcugggacaggccggcaagagaauaagccuucccauaucugagagcaugaccaugaccccagucucaguggcccuccaucagaguugucccaugccauuuucuagaggccacagcagguguguauguagagccacaccacagcucccuagcaacccuagcaccugggaaguggguuccugcuggagagggcauaagggcucccuggggcugccauccucucucuaaaucacaccauaaaagugguaagcgccagcacgcccuugggucgcacucugccgcuggcagcaggagcagagcaaucccuccugcacucugauguacuggacucccagagaagagccagggcuuugcagagaucugagacaugagaaccucuaugggucucauguccccccaucuggcuggagcugucaauggaguugaaccaagagcccuuucucaccccccuuagugcccucugcagacagccucuuggagccaaccugucucugggacuaugucagauagagucugugcagaugcacagacacucgguccccuugcuucucccucguguacagacugugggcugagccagagcugcccugcccaggauaaauagaccuucuccuagagccagugagacacggcuccagagccuggagcagguaugaucagaagucugaguugaagccuccaucccuaacuugggaggagcugccccaacacaauuugaguguggcauugacagaccacaggcaaaggugcaggacucugggggagggggcaggcagacaggacaccucauuuccccagcagucaggcuuuguucuagcacccagccagcucaaagggggcaaucauguugauccauaucccugccucuuccccaccuaacguuugugacuggaucccauguauggucagccuaugaugucuugaaaacucugguuuuccacaccaacugaaucagucuggagacacgaccucccacccucccccuacagagacucagcccauaugaucucugagaccacucuguuggucagucuuacauaucuucagccuuggcuuucauagagauagaggccccaagugagacuccccaaggaggcacagaggcaagcccuaugaugaaggaggucaccuuagcccugcaguuucuggaggcuuugaggacagucucuguucccuugucauagcaaauuaccuacuggcuccaggaaccccaaagaccauaaguccccagugaagaccuucacacacacacacacacacacacacacacacacacacacacacaccucuauuguaugccauuuucuggagagacaccaacaaacaucuuuccaccucauaaagggcaacaacaauagaacaaagacuaaaaauauaauuccacccaggucuagcugaguggaacuguagaguuuauugggguuacucacaggagcucuggugauucaaaagcagcugucucacugaaaagaccaccacaggaggccuacaacucacaaaagcugcaucauuggaguuuugugacuggcacacaaccuggcuggucagagaacccccccuuucccacugcuuucauaguguuuuaaggggccaucuauacuguaagucugaggagguuccugaaacuugugaguuguguuuacccccggaagcuuacuaagcuuaguucuaggaaagauguuuccauuuggaggcuauaacuacacaacacuuccccccuucugacuauaacauuguuuccacaucuccuguugcaaaaaauaaacuuccuuugaugaccaacugagaaagcaguacuguauaggccuaaacaccagugauuaagauguaacugauaggugcaugugaguucccgucagugaaacagaccuuaaaccuauugaaaagcagcuggugacaccacaacacuuguaccacuauggcaccaaugugcacaucuugucuggcuuguuggagcauagcacacaggacuacugggggcaauccuccuccagcagccuacuugauaacuccuggcacuaagaaagccaaccagaagggggggggaacuuccagcuccgucucagccugauucuuccauggccugaggccagcacagagggggcuccccauauggcuacauacuugacacauaccacaaccacguaccuuacgcacacacauacauuaugcauaugcacuuauacauauauguacacauacuguacacacacacguacuacauacacugggauucuauguugcugcaguacuggguggcagcugaagagccugagccauugucucuuaaaacugagagcaggaugaggagauguccacacauugcaagcccaucaacuuaugcuggcugcaacuuucucugucacuggcaugagguuucuguguucgucauuuacuguuccacuaugaccuuucagcagucacuagauaccuugguacacacaagcggauaggugcgccuguaauccuggcaugaccauguugacauguaccuggucucuauagagcucuagaacaguuuucaccccaugucaccccagggaggaggcauagauaucucggcaggacacaggggcuggaaaagcugggaaggucugucuguagaggcagaaguaacccuuucauuuucuguuucucucccuccccaccaucccugcccuauguguaggccagaaucacuucuuggcccaaagaaaacccagguuccugguucagugaauucaagcgugggaaacugguaaggugacaccacguucuuugcauuugucacuuuaaacccgccaucuccuaucuugcagaguaaaauggcccgguggcccaaagaacagccuuccaccugguauagucaguacaagcgggguucccugguaaguggccaccucacgcugccugcuugcagcucagccuggcucuggguacugcaugggccuaaucacagcuggggccacaucugcuauggcccuuuaggccaaaaugcuccacacgccuggcagcaaggcccagaugggcgugaugccccuuccucucgccucuccuuccauccuggaaguagguggguagcuucccacugagacucagggcaucugcagcuggaggugggcacgccaguaaagccacaugcugcuuauggauggcacaccgucgcuggcaagccacaggucagagacauacaccgaguaggagauccuucuucauaggcaugaccaguuaggagguucacagagaguacuucuagaccccugcuguucacacccucuuucugggcuaugcaaggcccucggacucuggcugcuguugaccuuguaggcaccaggugugccccacauggcuguauuagucuguguuuaacuuaugggagguguaucuuagaacauaacccaucuuggaggugaagagaucuuaaugucacccagaaggcucuuauggccagcauggaggucagaaacuuguuuagguucauugcuaugagaccaaugcucucccacuugaaacaggacauuuuuuuccuccaaauacucagggccuuuaguaaagucagcucaagacuuuguaaagacccagcuagacuucagguuccaggucuagagaagagccccacaccuucuuuugacucuucagucuaguggaccucucccuaugaguccuugcucgcacaaaccccauuggggcuuccgcugccucucagcacugcaccaaccucagccucuuuaguaagcacagagucaaguggcuuccaggacuauccugccuccaccucugucaucccucagcccggaggcaugccuggcuuucugucaggggucccaaggagcucaccucugcacacaagcuguggccuggacucuuugggcuucagccccgcagcuucucuuccccugcugggagccgggcauccucaucuguugcuuccucucuucugcuccuuuugcucucuugagaggaaaaugguugucacacagaaggaccugucaggaggaagacccaguagcagugacaggagaucugaggggucagacaaggaaacugcccagguccgagauccuuuggguccugucugcccaagcuugaccuggcuucuccccucuccaaauggcuuccaccugguggaguccaggucccccaggggcagccacccaauug

SEQ ID NO: 716 - RNA, 6579 nt, Mus musculus
caauuggguggcugccccugggggaccuggacuccaccagguggaagccauuuggagaggggagaagccaggucaagcuugggcagacaggacccaaaggaucucggaccugggcaguuuccuugucugaccccucagaucuccugucacugcuacugggucuuccuccugacagguccuucugugugacaaccauuuuccucucaagagagcaaaaggagcagaagagaggaagcaacagaugaggaugcccggcucccagcaggggaagagaagcugcggggcugaagcccaaagaguccaggccacagcuugugugcagaggugagcuccuugggaccccugacagaaagccaggcaugccuccgggcugagggaugacagagguggaggcaggauaguccuggaagccacuugacucugugcuuacuaaagaggcugagguuggugcagugcugagaggcagcggaagccccaaugggguuugugcgagcaaggacucauagggagagguccacuagacugaagagucaaaagaagguguggggcucuucucuagaccuggaaccugaagucuagcugggucuuuacaaagucuugagcugacuuuacuaaaggcccugaguauuuggaggaaaaaaauguccuguuucaagugggagagcauuggucucauagcaaugaaccuaaacaaguuucugaccuccaugcuggccauaagagccuucugggugacauuaagaucucuucaccuccaagauggguuauguucuaagauacaccucccauaaguuaaacacagacuaauacagccauguggggcacaccuggugccuacaaggucaacagcagccagaguccgagggccuugcauagcccagaaagagggugugaacagcaggggucuagaaguacucucugugaaccuccuaacuggucaugccuaugaagaaggaucuccuacucgguguaugucucugaccuguggcuugccagcgacggugugccauccauaagcagcauguggcuuuacuggcgugcccaccuccagcugcagaugcccugagucucagugggaagcuacccaccuacuuccaggauggaaggagaggcgagaggaaggggcaucacgcccaucugggccuugcugccaggcguguggagcauuuuggccuaaagggccauagcagauguggccccagcugugauuaggcccaugcaguacccagagccaggcugagcugcaagcaggcagcgugagguggccacuuaccagggaaccccgcuuguacugacuauaccagguggaaggcuguucuuugggccaccgggccauuuuacucugcaagauaggagauggcggguuuaaagugacaaaugcaaagaacguggugucaccuuaccaguuucccacgcuugaauucacugaaccaggaaccuggguuuucuuugggccaagaagugauucuggccuacacauagggcagggaugguggggagggagagaaacagaaaaugaaaggguuacuucugccucuacagacagaccuucccagcuuuuccagccccuguguccugccgagauaucuaugccuccucccuggggugacauggggugaaaacuguucuagagcucuauagagaccagguacaugucaacauggucaugccaggauuacaggcgcaccuauccgcuuguguguaccaagguaucuagugacugcugaaaggucauaguggaacaguaaaugacgaacacagaaaccucaugccagugacagagaaaguugcagccagcauaaguugaugggcuugcaauguguggacaucuccucauccugcucucaguuuuaagagacaauggcucaggcucuucagcugccacccaguacugcagcaacauagaaucccaguguauguaguacguguguguguacaguauguguacauauauguauaagugcauaugcauaauguaugugugugcguaagguacgugguugugguaugugucaaguauguagccauauggggagcccccucugugcuggccucaggccauggaagaaucaggcugagacggagcuggaaguucccccccccuucugguuggcuuucuuagugccaggaguuaucaaguaggcugcuggaggaggauugcccccaguaguccugugugcuaugcuccaacaagccagacaagaugugcacauuggugccauagugguacaaguguuguggugucaccagcugcuuuucaauagguuuaaggucuguuucacugacgggaacucacaugcaccuaucaguuacaucuuaaucacugguguuuaggccuauacaguacugcuuucucaguuggucaucaaaggaaguuuauuuuuugcaacaggagauguggaaacaauguuauagucagaaggggggaaguguuguguaguuauagccuccaaauggaaacaucuuuccuagaacuaagcuuaguaagcuuccggggguaaacacaacucacaaguuucaggaaccuccucagacuuacaguauagauggccccuuaaaacacuaugaaagcagugggaaaggggggguucucugaccagccagguugugugccagucacaaaacuccaaugaugcagcuuuugugaguuguaggccuccugugguggucuuuucagugagacagcugcuuuugaaucaccagagcuccugugaguaaccccaauaaacucuacaguuccacucagcuagaccuggguggaauuauauuuuuagucuuuguucuauuguuguugcccuuuaugagguggaaagauguuuguuggugucucuccagaaaauggcauacaauagaggugugugugugugugugugugugugugugugugugugugugugugaaggucuucacuggggacuuauggucuuugggguuccuggagccaguagguaauuugcuaugacaagggaacagagacuguccucaaagccuccagaaacugcagggcuaaggugaccuccuucaucauagggcuugccucugugccuccuuggggagucucacuuggggccucuaucucuaugaaagccaaggcugaagauauguaagacugaccaacagaguggucucagagaucauaugggcugagucucuguagggggagggugggaggucgugucuccagacugauucaguugguguggaaaaccagaguuuucaagacaucauaggcugaccauacaugggauccagucacaaacguuagguggggaagaggcagggauauggaucaacaugauugcccccuuugagcuggcugggugcuagaacaaagccugacugcuggggaaaugagguguccugucugccugcccccucccccagaguccugcaccuuugccuguggucugucaaugccacacucaaauuguguuggggcagcuccucccaaguuagggauggaggcuucaacucagacuucugaucauaccugcuccaggcucuggagccgugucucacuggcucuaggagaaggucuauuuauccugggcagggcagcucuggcucagcccacagucuguacacgagggagaagcaaggggaccgagugucugugcaucugcacagacucuaucugacauagucccagagacagguuggcuccaagaggcugucugcagagggcacuaaggggggugagaaagggcucuugguucaacuccauugacagcuccagccagauggggggacaugagacccauagagguucucaugucucagaucucugcaaagcccuggcucuucucugggaguccaguacaucagagugcaggagggauugcucugcuccugcugccagcggcagagugcgacccaagggcgugcuggcgcuuaccacuuuuauggugugauuuagagagaggauggcagccccagggagcccuuaugcccucuccagcaggaacccacuucccaggugcuaggguugcuagggagcugugguguggcucuacauacacaccugcuguggccucuagaaaauggcaugggacaacucugauggagggccacugagacuggggucauggucaugcucucagauaugggaaggcuuauucucuugccggccugucccagccggaguagccucugacacagagucugcagcacaauucacucaccuaucacaugcauacacaauccuaccuacaggagugaccucagaaaggggugacuacaugauaccccacaaaauaucuugagucagaacccaguuaucugccuacagauuccucaugcaugccccugccuggcaccugagaggccuaggaucccacaaaaauaggcuggcacccccaguucaggcacacucagacaaaugaguucuucuucucacuugucgccaaaggucuuuccaaguuuucgguugguuugagcugugaugaugcugagcagggauggcugccagccccaggauaaucuauuguggaggcggggugagguggggggagcaugcucagggcaggcgcucuucacacacaggaaccuaggcugcaucugcugcugcacaccuaaacuaucucaucuuaggacaacuuaaguaugguuuccagaagaauguucuugguacugaaagugacugucugcuggcuuuuagccuuaaagcuguauacacacaagaaacacugaagcccugguccaagcggacgccggcaguugacacagguacucacucccucagacuucuugucagggaagacgcacguggacccuccagcugugaaauugcaguagacuuugaaggagucccuggagcacccuugguugggaucgacccaguauucgccuggauuucagagacagggaggcagauucaugagaauggcucccuggacuguccgcagaagccaccgcaacauuucagccuagcuguuaaaugcacagccagggccauaaagccaccgacaccgccuccuuuccugucucacaguacuuugcuuuuccugaggggagcauaaagagaagcagacaguccuguucgcagaagugcagcucgggcaggaagcacacuguguaagugucugcugaccuugauggguggauggcacaaagaccaagaguguuccgaaaugaaccuggaacuucaugggcauggcgucagaaucuacugaaaucagauaccccucaaauccagaggaggagcaccccuuacuucuggggaaagaagucgauuucauuuuacugcucaacaggcccuugguuugaagugggugagggugagguucuaugguucugccagugcuuaagacccacuuucccaagcccagcacugcacauacuccugacuucaagcugcuuucggggccacuagugccaggccacaggauaauacccaaucagccuuggcacucugagguuugacuucuuuccucuguggcuucucccaacacgucaaccucccucucuuauguuucugaagauuaaugaggggccuagcccaaaucuccucccacagaugugagugagugagggggugacucuggcuggcccugucucccacccugcgguccucccucaccaucugggaagucaggaugacagagcuguagauccuugcagguacgggcuggguucugcugggugcccaguggucgcuucaucuguucaaucuccagcuucagggaguugagggaaccaaagaucucuuccaugccaucugcauaauccacguagcucuccccagccccaucguccaggagcuggcuggcaucaauguuccgccgaguccuggaggccuggauuggcaggggcuggaugaccucacccggagggcccuaggguacagaacagagcaauuaugaguaagagaggaugagaauugcccugccccaagggcagaguuaagaugacccugagccagaagucugggucccucaggcucuguguaagguagucuagggacuggcagcacccaaccacaucaagcuuuuccugcaugcacauacaaccacagaaccacacaugcagacacaauauacacauauccucaauacaggacuauauacaucauaugcauguguacauacuaacacaugcaugaucacauauaaccgcuauguaaaaguuucuccaaggcugaaacauucaauccugcagguaaguaucuuuaaaaggaagguaaacaacucaaaauagcuucagaaagucccuauaacugacuagauucacuaggccucucucucccugccagacuaagcaauaaaagcugagggucccucucucucuaggaaguagacuuaagcugcaaagacucugagaccagaccagaugccuggaagaugcaaaaaccagccaagcugccuggaagaagcuuagaugaacugguccacuuagaaaggacacucuucaauccucugaguugccuguaggcugcauaguugcuccaaguucccagcuugugaacugucacccacacugggguaggcuuuaaagaugcagcugguuuugagucauuucugcuccuauaaguaacccuuccccauauuccuguaaguccaauaaaaaucaugguucacaccg

SEQ ID NO: 717 - RNA, 8713 nt, Mus musculus
cggccgggccgcgcgccucccccggaacucggccgugccauucccaugaugcccagccaccgggcacggcuuccggagcgcggucgccgccgccgcggguagguggcgggagagacggcccgggguggggggugggggucgccccgccccucgccgcgccggccccgcccuccuuucccgcgcucccacggcgcgccgggccccugaguccccgcgggacuccgcgguggcugcgggcgcccgaccgagggagggcggggcgggaguguccgugcuuccccgcucuccgggcccggcgccucccgggacgcggggcgcagggcgggcagcugggcuggcuucguggugcaggccgcggcgugcaggguccggaucggguugguggcugaggcugguguuaucacgggagagggucccggcccccgggaggcgccucucgcggaugccuggcgcuuguugcgcccugcguuccucgagagccagcgggcgccgggcgggcccagguguggcucaggugaggggcgggcucccggucacugaggccggccuggccuucaaggcugccuucucgaccugccacgaacagcuucgagacucccggauucccuaagccugggaucccagaaaauuacucgggggggauggauggaugggggcacagaccagccggaggcccugccacugacuggagaaggguuggcauuaaccugcugaagaccagacugcggcucccucucagacagugagaagagcagucaguacucaggcagcagggggaucugucuccccuugcuuccagcacugugcacagggauuggcagucacaacaauuuuucugggggccgaaucuugucagcaccucuggcuccuaaggaccaaaucuuacccacacccacuuuaaguuggaguacagggcccucuacaucauaaguuaagugcagaguccaugcugggggggggggggcagagaggggugaugauuguacccacaaccacccuggaaaccugauucccagagccuccaguuuaaagccccaauucuggcuucagcucacauuucuaacugugaaguucaugguucuccagagugacagcucccaagauugaccagguagcuggaccaacaaccauuaagacugucagaggagcucaguucuggguccaucguuauaagcugugagcaggugaguggaaauaaacugauuuauucccucggcucugcaccugcugucauguuaagauauuaauguuacucaccccaucccacccugcccugccccaacggggaaagcacuuuuuguuguguuuacuuugguggguugagacagcaucaaguagcccagauacugucuuugaacuagauaaggaaccaguacuagccuugaacuccugauccucuggccuucaccugagauuaaggcaugcauaccccaccacacccuacucgauucagacccuucacaguuaagcccugcaaauguuacgugauuucuauaguauugcaguuugaacaccaccuacagcaaagaagcgguagguccuccagccagugaaagcaguuacucuucccuuuaguucccacugccuugugccuguggggagucucaggaaagcaaagugauuguugaggauggccaggaugugagcucggguagcugguagaggaaagcacccuccauccugcggcucucacuagaggggaggcaaaucagccacaguuaguguaguuggugucagggcaaguuuuuccucaacuugucaagccuuucuuuacauuaaggacauaucauaacagaaaaaauauuuauaagccaugaucaguuucuaaauuagauguuacugaugauaauccugguaguaaaugcugguuuauuuauuuguuuauuuauuuagacaguuuggucucacuagagaccccuggcuaagccaggaacucacuaugcauagaccaggcuauccuggugcuuggacuaaaaguguacaccaccauguccagcccucacacggccgacuuuaaaagcugguagaagaugcuuugaagugcaagccgagcagugaagaccucaccuggaagccuugcagagcaucagccuacaccugagacuuacaaguaauuacaauagauuuuuuuuuauacuaguuuaacucuuuuuuuuuuuuuaagauuuauuuauuuauuauauguaaguucacuguagcugucuucagacacuccagaagagggcaucagaucuuguuacagaugguugugagccaccaugugguugcugggauuugaacuccggaccuucggaagagcagucgggugcucuuacccacugagccaucucaccagccccacuaguuuaacucuuaaagcacacauugguaaucaccaugaguugccgcugcaucuucagugaccucuccauuuguugccugucgcucugagcagauuuuggucuagaugcccagccccaccucuuagggaagggauuucaguaugucuacagcacaucccagccugucagaaaggcagguccugauuaaguacauagaaguaaagcaaaccgaaggucaggcucugcucuauggccuuggguuagagguggaacagccuuccaugccuucccuuggaggaacucaggucucuguccuucagccuugcaggugcuccucaaucucugggaggcagaagggcaucagagaagccuggaggaauugagagcuguacagagcagcuggcauuuuuccgugugacccagugccucuuagauuaggcuccucuuaggaugacucugugaacuuucuuaguguuccugacaccagccuagcugauauguagagaccuggcucuaaccacauaggcacgugacacuucacaguguccucggccuccaagcuggcaagcccaugaucugucuacacaccacacaguccuuucuccaggccuacccacaugauaggaccaccaaaauuuucaugcuaauugggcaaaauuggugucagccuuugaguagcagcugucaaauacacauuugacauuuuucacaugaaacagcauaaggaaggcaauucugaaaaaaaggcucgaggaaguguguucugagucugucauauggugcagcuuugaucauauuuauuggucauuuccagagaggauccacccauaaaguccuacuuaccuguguguugucauucuucuuaaagcacagacaagcauuucuagacugcuguggcuucugauaacacugggagguaaaugacgucuccuuuguccuccucuuacggaaaagugcgaacccagaagggaaaggaaagagcugcuggaguuugcacuuuguuuuuuuaacugagucuuccaccuacagggcggaagugacuccuagaacugcucacaaaacugacaccuaagaggcuggcauaagccacuccagucaacgagacauuagguuguaguggcgugauuauuugcugaugucacugcucagcucuacccuuccuuaugcucucucuguucccaggaugugaaacaggcugacccauaagcccugccucucagcacccagccugccugcuaggauguuccucaugaacgccccuccagugguggcgcuccaguccagaugggaggccuuugggcagcccaggagcuucugccucccagacugcuucucugaggcuaaagaggacggcuccagggcuuccgugagcgccaggguccagaugcucaucagcacgcuucagagggacgaggcugcccugggcaugggccaugagcgucucacccaaagaggccaacgugcagagaggucccgggacacgaggcuggcccccaagccugcuguaugcaaagagcagccagaguucccugcccguggucucguggcaaacugcagcgcccuggagaaagaugaagcugggagacgcagucccuuggagcuggauucugacagugaugacuccguggaccgagacauugaggaagcuauccaagaguaccugaaggcaagggguggggcuucugaaccuaugucccaaggggcccccucuauccccgagccugcccacagcagcaccuugcccaucccgugucccucacagcucacucccggcucagguaguguuccugugggagccagugaagaucagggcuccaccuccccagcgagcaugagcagcgaggacuccuuugaacagagcauccgagcugaaauagaacaguuucuuaaugagaaaagacagcaugaaaacccgaagugugauggguuuguggauaaaaaauccgacccaaacaacagcccugccagacuuagagggaaccgagaaaccucagccagggcagcucugaugggaacguguaaggaguucaucuuccgaaaaccucccagguuaacaaagaugagcacacagcagagaaacuuccagccuaagcccaccacagagccugagaccccagugagcacgaagcugaccgcccacagaccggaggcugcacagagcagggguggggugaggaggagcaugccugccaggcgcagcaagcgcaucaggagcucggccccagugcaccaggcaucagacuccagcagugacgacggcauugaggaggccauccagcuauaccagcuagagaaaaccaggaaggaggccaguggggacccaccucugagaggccagcugaaagaggaaagcccugguagugcccagccaaacgccuugccugaagcccacaggagacccccuagcaagaaaaagcuggcuguucccaagguuauagacaccacccaggggguccuccacccugauccccucuccaggcuccugacggauucgagagccucuuuaccuccaggacacgcagcugccaagagugaagcugugugccaggccucacgccuagcagacacaucuaccgaacugaugugugcagaagcgauccuggacaucuccaagaccauucugccagcccccauggaaggcagcgacaggccuccauccaggaacccacucuucuguccccaacccaugccuccccguucugaaggugacagcagcaacauugacagugaugauagcaucgagcaagagauccgaacguuuuuggcucucaaggcacaaguagggaguccucagccugcccaggguccacugucuucgccuggccccaguggccagccuggcauccccaaggucccuuuugcuaaaacacuagaucucccucuggucugcaaacggaaacggagagguggaggaggcagcacuacaaugcccaagaaaauaagggaggguagagaaaguacccaggacgcugaccacauccaggggaaagcucagccuggccaugacgggugggacccucucgggcacaacaaaaucacagagaccccaggaggagaggcugaagccaaggaacagccugucauuuccaggacaguugggcucagugauacacaccuaccacaaggggcccucgggaaggccacugagaaggaaagcucugaggauaagagcaguucucuggacagugacgaggaccuggacauggccaucaaggacuugcuaagauccaagcgcaaguuuaagaagaggugccgagacccacgggcuuccuguaagaaggucagauuuggcagcacagagacucgguguggggagaagccgagcaaccuuccaggggacuggaaagaccacagacagcaggcacuacggagcugucugcccaagugcagaggggacaauaaagauggcccaggacgaagcccaggaagcaguguggcagagaaggcaaagauggguggcacagggggcgaggacgcaaccccugccuuucuccucaggaggaaaaguccagaaggggcucuucccucuacagacacaggagccaguggccacccuccuucagccuccagccccacaucugaggacagugcaguggacagugaugacagcaucgagcuggagaucaggagguuuuuggcagagaaggccaaggagucuauacgcaacacagaaccucaagggggaccugccaagccagagaugcccuguaggaaagacccaacccugggguugcagccuggagugugcacacggagccaaaaagccaggggaaccccucagcuggccgaaggaaggagaggcccagagagagcucggacacaggcaaccggccucuugagccagucugggaagggcacccuccgugcugagcagaccgcccgccucaccacugcccugggccgaagugagccagcacuacccaagaacaccugcaggaacagcucugccaaagcaucuccgccaagcaggaaaagugcucacguucacaaagaccauagcccacagggaagccagacugcaacggcagaaaguguguucggucagcugcccaguugugccaaagugggugccgaggcuggaagcgccggggguaccuuucaccugaacuauggcagucagaacuugcuaacccccaacccugggucccaggcugaccucguccuuccuuggagugacuuugcacaccagagcaggcuauccagcccaugggugcugaacucgggucaaggcacaguguggacaggggucuuuaggggugagaaggaaaaaggggcuacaucacaggcuggggccccacccagccucuccucaggccccaggaagggccugccuuuccucuccacccagcucuuccacuuugggaagaauguuucuugggggggcaagcagaccagccucuucagccccaaucuaggcuuaccucugcaggcucccgcauucucagccuucagggagacccagccuggccacaacccuguauuuggaagcccacacuugcuaaugaaagacagugggaacuggccaagccggaaggcucaggggacccugagacaacaggacaggaggaauucugccucugaggacaaaguucuagaccugagauaucggcacaggguugacagggaaccgcaggaccaggagaccuugggcagugaugccagcgaauucagugacacuuccauggaggaugggggcagugccacagugagcaguaaaggccucaaguugugacaggcaugccaugccauggcugugggaagcaguguccgugucuugccugaugugugugcaugcaugccugucuguaugugugugacuuuguguuuaugugcgugcgugagccucugugugugugugugugugugagagagagagagagagagagagagagagagagagagagagagugugccuguguguuaggcagcauaggguggaaguaggggaucaugacagauaaagagcaaaaauugggucccuuccaugcagcucccauccaccccuaauauaaauauaaauauguacacuaacuucaaaugacauuuuuauuuaaugaauguguccugguacauaauggguuuuguagguuuuuuguaaauuauuuuaaaagugcuguaaaaaauacuuuuugaaaauguucagucuugcagggcguuccuagcugcaguucugggucucagugcaugugugguaggugaguagacccuugguucugccugucccugugagggucagagacagaggcuggaaccgcuuugcuugugaagauauucaggccuggagaucgcagcaaccauuuaccuuggaagugcuaaugugguugagguaugucaggauaccacuggggcaagggugucccuggauucuguagucaugaccuguaauuagaaaacauuucaaagcacaacagcuagcaaauagcuaaccauccaucccaucuagugugggaaucacuacuggcucuguagcucagcugaccccagaucauccaguauccaguagcugggggauucuaacauccuuauaaaucccuucauauaagggcuacagauuugcuuuuaaucauggcucuaaaaggugaucccacauauccguuuugacuguccuguuugugauguguguaugggugaguagugaggccaugagauggcuuggucuccaaacaccuuagccaccugugauggugagccccagcccuggaagcagugagggcaaacccucccacagcugcugugggugaccagugaugacaccagcaggcugcauggcuuucugcaaugcugccucuacccaggagaaagaaggcucuggccagugcugaggccagaccgcaggcacugggguccugggaguuuggcagugauacugccuuggugcugaggugccuguggcaacugggaacugaagaugugcuggagcccagaugugaagauuacaucuguguugugauuccaccugucuucccugaguucugcagcucaguauucuggauugcuguguggcuacuuuguggcugaauucuauugguauucugacaugggagagaguuuucuacuuuaugcaccugggucugaauuguaaaaagugcccaaaugcuggcacacacuccaaccauccuccccaucugccacguuggaacuuugaugugguggcaggcucuguggucccguugugguccuaaaugaucugguucuauguauaguaaauucaucgugauauuuguucguguguuucuaggagaaacagcuuugugucgucauccauguucccacuuuaaauuuucugagugcuuuuagccccugaaaacaaagagcaucuuguuuuguauauaagacccauccaguuuggguuuuuguuuuucuaaugaauaaaccaaguacuauccacagcu

SEQ ID NO: 718 - RNA, 4405 nt, Mus musculus
auugaggcuguggcaacuuuuuaauaaaacaaagaugcugucagcaucuuuccugugugaaaugcagaacacaagguauuguggcucuauuugcacauuuuucuccucuggaaaggaaaaguguuuucugagaaggcagugagauccaagccuuuagaauagggcaccugucaaggaucaagggcauccgugcuccccgaagcagcccugagucaggagagcccugaggacaggaacccagcucccuuagucacagauggacggccuguugacauuguaacuggggugaaaguucaaacggucauagugggugaugugauugucaggcccggucacuaagcucuucuccagggugacauuaauauuaugacucuggaacauuccaaaagcugcguguugucuggaaaacuuauuugaagauggauaaaauacuuucugaaagucaaacaaacaagaggauuaguggugcaugguaguaacacucaggcagucccaccaacugguucuuuggacgaagagugagaauuugugagaaaacacagccucuggugcuaggaagcccagaaaccaaggugagcaagauggucucccuuugccauccaaccaugccagugugugcuuaugucuaauaugauuaacacugccuccuucccacgccacauggacagcaagagaaguuacaggaucaccugaaugccgcagcuccaugccuagccuaggugugacagcaaucauuaaccugaaguuaggucagaguuagaccuacacacacacacacacacacacacacacacacacacacacacacacacacauugaggucuacuccugcuagccaugccacacuaggccuguguacccuucaaccuucucugugaguguagucacaauacucuacagcagugucugccauacucuuccaaaauacuuauaacuuaugaagagaaauaguugggugugguggggcagaccuuuaaucccagcacucaagaggcaggucucugugagacugaggccagccuggucuacauagaaaaaccauuucucagaaagagagagagagagagucagagacagagaacacaugugggccucacuucugaagcuccaguucaugaauacagccucaaugcuuuggcccuuggcugggguugcuggguaacugugauaagagcaaacaucaugggccaugaagaaaagcagagagaggacuggcuggaucccaggaucccucucgaggacacaccuccagagcccugaaaacuccuauaaagucccacaccccaauagcacacacuaguaacccugccuuuaacaugcagaccuuuuagggucaacuccuccaagccuuagcaaugagcuucuaucccaugagccaaaauccucugucaggugcuuuaaaaagggcacuaugcaccaccagcccgguguaugggaagggcugcccugcugaggccggaagcacucaguucuuuguuuguuuaguugguugguuuuguuuuuguuuuuguuuuucgagacaguauuucucuguguaguccuggcuguccugaaacucacucuguagaccaggcuggccucaaacucagaaauccaccugccucugccucccaagugcugggauuaaagucaugugccaccacuucccggcagcacucaguucuugcugaguguggccacugugaguccgggaacuccagugaugacagggggacauguggugugugcagaccaaccuccaccagguaguaguguccuaccuguccucagaccacccugggccaagaucaccugauguuuucucucuuuggcaggaaaagcaaagagaaauuauuucaggcauuuuucaagaggcaaauuugagaucuccugggaaacugaacauaaaauauaguguccaaguccgggugugguagagcaugccuuuaaccccagcacuuggaaggcagagucaggcggaucucugugaguuugaggccagccuggucuacaaaaagaguucaaggacagccaaggauguuacuuacacagagaacuccugucucugagaaaaaaaaaaaaaaaaaaaaaaaaaaguguccaaauaccauuccaaugcacacagcucccccuauugucugcaugguguauugcagguggagcugauggccaauaccugagcugugcacugagcacuggggccugcccgcucuuggcucugcacagucaaugcauucugacaguccauaauaauaaauauccaccagugccguagcugacagaauaauacuaagaguugcucacagggugcaguggacugagucagaaagcugacaagucaaccccagagaacaggacuaagaagcacggaauaccuacccccuagcuugccucugauacccgcggcuuguggcccaugaccugcuaaccugggugaaagcaccacuguugaaaagagcagcuucuucuccguggccuuuuacaaaggcagaacagaaaccagggguguggcucaguggacagaucaccacgucuaacgucugcaaagcccuggcacugcacaucuuuuaagccagcacuuucgaggugcaggcaguucaaagcuuugaacugauucagaacuagcccuggcuaacuugagaccaaaggcacuuauuaccaagccuggugaaaggagaaccagcucuuacacguggcccucugaccuccaaccacguguggcauggcguacccccacacagagacaaggcgaauguauuuaagaagguaugggcagcaguucccauguuccugcuucccacagaaacaccuugcgucugauuuuggaacacagacucuuuccguggacaggcucuuccgaggaguucugccacucguaugaacgcuugacuucacuaauuggccuucgagugcccgggcaaaggugugcgugccugucugauggggaggagaacguggaagcaaguuuacuuggacuuuccugucuacaaucuauucugcuuugaaauugcauucuaucaucucucugccccgccuuguccuaacucgauuugaggugccaugcauuuacaacgugggacgcugauucccaacucugacuccucauaagucugcuuuuccagauggcccucguccuggcaggccuggcuugcacuuacuggcaucucaugcaccgugggggcucugcuuccguagguuugguuacugguccuguacauggaaacagcuuccuugguccugugggagagagaugcacuguuucucacacauacucagaauaagucagccaggucauagccuggaagaauuugauugauggaacuuuauugucccugacgguggcaauaccauguccacggggcucccacugagagcacucucucccagcagaccuuucucucuggccuccucugcuggccauggccccugaucuuuccaaagggaaacccuagagaacacccagccagcaaaugcuggcggaggggucuuggugggacuuuggcacagacuaccacugccagguauguaagcuaccucggagacagcgucucaacuuccagacccuggaagucccucugcuuuugagccccaaccuuacagaggccaagcuccugucaggagggaaggagguaagaaaucuaguuugugagacuguggccugugauagaggcuaccagccgcucuucuucacacccgaggccucagcaaguugucuucuuacucguggaaagggagugugccugcaccagcuucacacaagucaagaagguuuccauccuuacuuccccgaaaaccaggcugcccuguaagguguacagcuuucagggaagcuuuaaaaauagagacauccccugccugcaacaaggcuauauucacacacguucacucugugguugcucagacagcaggacccuaacaguaaugaugacacaaauaaagguucaugacuggcuccuuuugaccucaguagccacagccacuugagaguucucaaacacauggccaaagcuagggccgcccugcugcaugaagaagguaaccucagucuuccuuacccguagccaugaaaccaccccggguuguugaaccugacugggagcuucucgcuaaugcgguaguagucgcuggucuucucuggggcaggcuuagccuugggcucccccggcuccggcuccucuggggcaggcuuagccuugggcucccccggcuccggcuccucuggggcgggcuuagccuugggcucccccggcuccggcuccuccgcggacuguugagguuuuucuucagacauuuggccucccgcaggaaacuagcccagaucaagucugugccugcugcggcaaggcguccuguugcuaggcaaugaagucaccugaucaggagguggggcggucuuuuguagguugcuuuggcuagcagcuagcug

SEQ ID NO: 719 - RNA, 4405 nt, Mus musculus
cagcuagcugcuagccaaagcaaccuacaaaagaccgccccaccuccugaucaggugacuucauugccuagcaacaggacgccuugccgcagcaggcacagacuugaucugggcuaguuuccugcgggaggccaaaugucugaagaaaaaccucaacaguccgcggaggagccggagccgggggagcccaaggcuaagcccgccccagaggagccggagccgggggagcccaaggcuaagccugccccagaggagccggagccgggggagcccaaggcuaagccugccccagagaagaccagcgacuacuaccgcauuagcgagaagcucccagucagguucaacaacccggggugguuucauggcuacggguaaggaagacugagguuaccuucuucaugcagcagggcggcccuagcuuuggccauguguuugagaacucucaaguggcuguggcuacugaggucaaaaggagccagucaugaaccuuuauuugugucaucauuacuguuaggguccugcugucugagcaaccacagagugaacgugugugaauauagccuuguugcaggcaggggaugucucuauuuuuaaagcuucccugaaagcuguacaccuuacagggcagccugguuuucggggaaguaaggauggaaaccuucuugacuugugugaagcuggugcaggcacacucccuuuccacgaguaagaagacaacuugcugaggccucgggugugaagaagagcggcugguagccucuaucacaggccacagucucacaaacuagauuucuuaccuccuucccuccugacaggagcuuggccucuguaagguuggggcucaaaagcagagggacuuccagggucuggaaguugagacgcugucuccgagguagcuuacauaccuggcagugguagucugugccaaagucccaccaagaccccuccgccagcauuugcuggcuggguguucucuaggguuucccuuuggaaagaucaggggccauggccagcagaggaggccagagagaaaggucugcugggagagagugcucucagugggagccccguggacaugguauugccaccgucagggacaauaaaguuccaucaaucaaauucuuccaggcuaugaccuggcugacuuauucugaguaugugugagaaacagugcaucucucucccacaggaccaaggaagcuguuuccauguacaggaccaguaaccaaaccuacggaagcagagcccccacggugcaugagaugccaguaagugcaagccaggccugccaggacgagggccaucuggaaaagcagacuuaugaggagucagaguugggaaucagcgucccacguuguaaaugcauggcaccucaaaucgaguuaggacaaggcggggcagagagaugauagaaugcaauuucaaagcagaauagauuguagacaggaaaguccaaguaaacuugcuuccacguucuccuccccaucagacaggcacgcacaccuuugcccgggcacucgaaggccaauuagugaagucaagcguucauacgaguggcagaacuccucggaagagccuguccacggaaagagucuguguuccaaaaucagacgcaagguguuucugugggaagcaggaacaugggaacugcugcccauaccuucuuaaauacauucgccuugucucuguguggggguacgccaugccacacgugguuggaggucagagggccacguguaagagcugguucuccuuucaccaggcuugguaauaagugccuuuggucucaaguuagccagggcuaguucugaaucaguucaaagcuuugaacugccugcaccucgaaagugcuggcuuaaaagaugugcagugccagggcuuugcagacguuagacguggugaucuguccacugagccacaccccugguuucuguucugccuuuguaaaaggccacggagaagaagcugcucuuuucaacaguggugcuuucacccagguuagcaggucaugggccacaagccgcggguaucagaggcaagcuaggggguagguauuccgugcuucuuaguccuguucucugggguugacuugucagcuuucugacucaguccacugcacccugugagcaacucuuaguauuauucugucagcuacggcacugguggauauuuauuauuauggacugucagaaugcauugacugugcagagccaagagcgggcaggccccagugcucagugcacagcucagguauuggccaucagcuccaccugcaauacaccaugcagacaauagggggagcugugugcauuggaaugguauuuggacacuuuuuuuuuuuuuuuuuuuuuuuuuucucagagacaggaguucucuguguaaguaacauccuuggcuguccuugaacucuuuuuguagaccaggcuggccucaaacucacagagauccgccugacucugccuuccaagugcugggguuaaaggcaugcucuaccacacccggacuuggacacuauauuuuauguucaguuucccaggagaucucaaauuugccucuugaaaaaugccugaaauaauuucucuuugcuuuuccugccaaagagagaaaacaucaggugaucuuggcccaggguggucugaggacagguaggacacuacuaccugguggagguuggucugcacacaccacaugucccccugucaucacuggaguucccggacucacaguggccacacucagcaagaacugagugcugccgggaagugguggcacaugacuuuaaucccagcacuugggaggcagaggcagguggauuucugaguuugaggccagccuggucuacagagugaguuucaggacagccaggacuacacagagaaauacugucucgaaaaacaaaaacaaaaacaaaaccaaccaacuaaacaaacaaagaacugagugcuuccggccucagcagggcagcccuucccauacaccgggcugguggugcauagugcccuuuuuaaagcaccugacagaggauuuuggcucaugggauagaagcucauugcuaaggcuuggaggaguugacccuaaaaggucugcauguuaaaggcaggguuacuagugugugcuauuggggugugggacuuuauaggaguuuucagggcucuggagguguguccucgagagggauccugggauccagccaguccucucucugcuuuucuucauggcccaugauguuugcucuuaucacaguuacccagcaaccccagccaagggccaaagcauugaggcuguauucaugaacuggagcuucagaagugaggcccacauguguucucugucucugacucucucucucucucuuucugagaaaugguuuuucuauguagaccaggcuggccucagucucacagagaccugccucuugagugcugggauuaaaggucugccccaccacacccaacuauuucucuucauaaguuauaaguauuuuggaagaguauggcagacacugcuguagaguauugugacuacacucacagagaagguugaaggguacacaggccuaguguggcauggcuagcaggaguagaccucaauguguguguguguguguguguguguguguguguguguguguguguguguguaggucuaacucugaccuaacuucagguuaaugauugcugucacaccuaggcuaggcauggagcugcggcauucaggugauccuguaacuucucuugcuguccauguggcgugggaaggaggcaguguuaaucauauuagacauaagcacacacuggcaugguuggauggcaaagggagaccaucuugcucaccuugguuucugggcuuccuagcaccagaggcuguguuuucucacaaauucucacucuucguccaaagaaccaguuggugggacugccugaguguuacuaccaugcaccacuaauccucuuguuuguuugacuuucagaaaguauuuuauccaucuucaaauaaguuuuccagacaacacgcagcuuuuggaauguuccagagucauaauauuaaugucacccuggagaagagcuuagugaccgggccugacaaucacaucacccacuaugaccguuugaacuuucaccccaguuacaaugucaacaggccguccaucugugacuaagggagcuggguuccuguccucagggcucuccugacucagggcugcuucggggagcacggaugcccuugauccuugacaggugcccuauucuaaaggcuuggaucucacugccuucucagaaaacacuuuuccuuuccagaggagaaaaaugugcaaauagagccacaauaccuuguguucugcauuucacacaggaaagaugcugacagcaucuuuguuuuauuaaaaaguugccacagccucaau

SEQ ID NO: 720 - RNA, 5238 nt, Mus musculus
uagagagucugacaccaggugguuuacuguaaacauauauuaaaauaguacaauucuggaaaaguuuccugauguaauacaaucccggguauaagaggcauaauuacauugaaacucagcucaaaguacaccgaccacaaagauggguccuauagcuuaagggccuaggaucugguauggucucugaccaagauaauguagaggucagcagguuauaaaauacuugugacaucuccccuaagcauggauuuuauugguggagaaacuaaguuaaaaauaaaggucuaggaaggaagaguccaagacaaacauuuagggggcauuugggugaggucuggcucuacaaauagcaaaggucaccaggucauuaacaacauccacgcccaguccucugggugggaaacagguauggauuuccuucuuuggggagucaacccuaugugauuaacauuccugguuuccuuggugaucugugggcucaaggacuuuugugcucccaucaguagguucuuuuaaaaaauacuucagccaaacauggaacaaacuuuugacaccuuuuuucacugugcgagcuuccauauuaaacauaagagcuccagagaagcccauauccauaaaacucagccugauucaguuuuauguucuuuccauuaccccaaaccuuuaaaauccauucccacauauauuccccagacuucugcuugaaugaauuagcaaacucauuaaguucuuuaguagugcagcacaaugcauggacuauacuuccuaucuucccucugggagccugcuuagccugguuacaggucuagaggcaacuacuggggguccugagggacaucaguguugguuuugcuuggaauuuucuucagagaaugaaggauuaauuagcagacaauggaggauuaauuuuaacugaaaagcggaaacuuggcuagcuauguucaagucuuaauggaugccagaggccaugugacuagguacuuuaccugaguuuguucccagaaaagagacagauaaggguuagcucaagaucauuggacuuugggguggccauaucuaaggaaauaggacuguggugcugaugcugaggacagggaguggggacacagaccaggguuggacaaggaccuuccugcucagaagagggcuggcuaucuagugugggagaagggcuuucuguuauggggaauggcucuuaucaggcacaggagaugucccacugcccucggaccccuugggacucugcagccgaugcagggccuccaucugccuccucuucuccuuggcccuguugaugguuguccggaagagcuugcagaagagcuggauagcuuggggcgagucgucguugccagggauaggguaagugaugaggcauggguugcaguugguguccacaaugcccacuguggggauguucaucuuggcugcaucccucacagccacaugggguucaaagacauuguugagugugugcagaaagaugaugaggucugguaggcggacugaaggcccaaagaggaguugugcguuagucagcaagccacccuugaaguagcgggugugggcguacuccccacaggccugggcuguagucucaauuaagugagagaacugacgauuccggcucacaaacagaaugaugcccuugcgguaggccacgugcgcggugaaguucaaagccaguuggagauucaaggcugucugauccagaucgaugauaucuuggcccaggcgguucccaaagauguacggcuccauaaaccugccaaaaaacccccaggguaaacggacccgugugcguggagcugcccugccccuuccacagccaccuaccuaccagccacccaggcucuuacauuuaccaacucccacuacuccugccuagggagugaugggcuggggacacagguguggacuugcgcacagacaaucagguuuguggcucaaccugucccaccuucucccuguggagauuugagaaccaacugcagauaaacaugaacccaaccaaggugcucugcccaguuuaacucucuagggccacuucuguucuauacagcagguccucuccaccgggcucccccgccugccaugacccucaguuuucacccugucugugaaccagcaucaauacuagcacugcacuugguguugccgcagacacccccacccugcccccacuuccaacccugacccaacuccaccacucugcccacacggccugugccaacuaccuauggcggcaaccagcuuuaugucccagguguacucgggccucgaagaggcucuucacagaaaacagcuccuugacauugaagaaauccgaaugcuguaauggcguaucuaggauccugcucuggaaaucugaaaaagagaguaagggcagacacuguggcccaucaccaaccaaccaaagacucaccagucuccugggagugggaaacucaaagcugugaggaaacgccaggaaagaucuggaagacacaggggcauuuuugcaacaccgagggacuagugucaaggucuaaagugacugugugcggggaaaaccuggccaaguccucuucccuuaaucuccacagauguaagaggaaaacgaaccaggggccucguugacuucgggugccuuaaacgccccuccagaagaccagcaagauggacagauacaaaaguaagucuucacggguuucgagagcuaccaggccacagggguucuaucucccucccaccacacuuagauugguacuggguuccuuuggggacccugcaaugacaaccucuccacgauuccgcgccccggcccagcuccacccgcugaucuuuaccgucgccauccuggggcucgcugacugcggggaccggggcucccgugaccuuccuaccauucugcuccgcagggcccgggaucgccuucugcaggaaaccuggccagcgccgcacaccugcggggaaagagccggugggggcgcguccaacccucgucccuguccuccccucucggauccccggguuccccccaucuccgagauucaccgcgcucaccugcacacagcagccgggucagcacggccggagcgggcgccauggcgggcgcguggacagagauccugcagagacucuuccugcccggcagagcgccuccuccucugagcgcgcggggucgcagcgccgcuugcuggcccggaggacccucuccgcugugcaccgcucgcugcgcccgcauccuuguaaaugggcgaguuggcacugugaccaguggucugcacucagcugggacguggggcugagcuagaaugagcgaccucucacccacagcucguuccucucgauaaaauuacagcauccucuggaggaggcgacccucuuguucaaauugguuuuuagagguuguuuuuaggguugcuguuuuuuuuuguuguuguuuuuguuuuuguuuuuguuuuguuuuguuuuguuuuuccugagacccgguuucuccguagccuugagccuugacugucaugguauucgcuauguagaccagguuggcuugaacucagagagcaacccgccucugccucuggagagcugagauugaaggcaugcccuaccaccgccccguuuauuguuuguuuuauaagugcauuaaaaaaaacuauuuauuuuauguauaugaauacacugugacuaucuucagacacaccagaagagggcaucagaucccauuacagauggucgugagccaccaugugguugcuggaaauugaacucaggaccuguggaagagcagucagugcucuuaacugcugagucgucgcuccagcaugcauuuuuuuuauuuuuuaacauuuguuuuaguuuuacuuauuuuuugccuacauguauguauguguaccuugugagugccuugucccuguggagagcaggugucugaccuccaggaacuagaguuaaaaguguuuaugagucaccuuguaggcucugggaguugaauccagguucccuacaagagcaaugaaugcccuaaauugcugagccaucucuccauccccaaauuacauuaaacuaugacgacaacaacgaugacauugacaaugaugacgacgacgaugacagcaacaacaacaacaacaaucucccugacuggccagacauucauagagaucugacugccucuguccccuggguguuggaauuauuggugcacaccaccacacugugcccuaaguaauuuuuuauuguuuguuuuaaaauuacuauuuauuuuuauuauuguuguuaagacaggguuucacuauauacuccugacuggucuaguacucucuuuuuaaaucaggcuggccucgaacucagagaucugccuccuggcauugcgcuagcacgucauuaaugcugaacuaugugcaugguucacaagaucauuuuuuauauuucaccaauauauggccuaggauucccuaaauuuagcagcaccucacaucuagauuuaggcugaguuguggggguauugggugauagaggccauggccaggacaguaaacgacagacuuguacuugcucaggcagagauuggaagcaccuaauuccugccuauuggcuggugaaaucccagguucuaagguuucauucguccaggaucugccuccuagugcauuuugggacgauacaaggauguucccacagucccagaaaaaggucagcggaucucccugaggagcagcguguggaagcuuggaauuccuuguuuagaacuuacggucuccuuuguuauucgcccucgggaagauucuagacuugccuacagcuagcugcuagccaaagcaaccuacaaaagaccgccccaccuccugaucaggugacuucauugccuagcaacaggacgccuugccgcagcaggcacagacuugaucugggcuaguuuccugcgggaggccaaaugucugaagaaaaaccucaacaguccgcggaggagccggagccgggggagcccaaggcuaagcccgccccagaggagccggagccgggggagcccaaggcuaagccugccccagaggagccggagccgggggagcccaaggcuaagccugccccagagaagaccagcgacuacuaccgcauuagcgagaagcucccagucagguucaacaacccggggugguuucauggcuacggguaaggaagacugagguuaccuucuucaugcagcagggcggcccuagcuuuggccauguguuugagaacucucaaguggcugug

SEQ ID NO: 721 - RNA, 1074 nt, Mus musculus
auuggagucccuucuuuuuuuuuuuuuuuuuuuuucagcuuuuagcaacuuuauuuuccuuccaucuuuuuucccuuugcucaggcaccugcacagcagcucaggaccacucagugguggcuccaacccacuccguggccugcgcugugggagcugcugaccaauccucaguggcuggcugugcacuccagucuucuguggggaacugcuggaugggcaccgagggaaccugcacacccucagaucagucggccaccucaggcugagcagcagugaacucaggagcuggugugguccauucacccuggaauuccuccuuggucacagccuucucagcagcagccugcuccuccuucucaaucuccucugggucucuguagaaguaaagaucaggcaugaccucccaggggugcucacgggagauaguaccucgcaugcggaguacuucccuggccagcauccaccacaucagacccacugagugaacucccuuguuguugcaugggauggcaauguccacauagcgcaggggagaaucuguguuacacagagcaaugguggguagauugacauaagaggccucugugaguggcugauggucagcccugggaucgguuaccacuagaagccguggcucccugaaggcugcuuggaucugguuagugaaggucccagguguaaagcggccagcaaucggaguggcuccuguggcagcagcaaacuucagcacagcucgcuggccaguguuccuggaggagaugacgcugacaucagcaggguucucgauggcaacaauagcucgagcugcgagcaacagcuucucccagguccucuucagguuuaugauguagauaccgucacuuuccuuuuauagauguacugcuccaucugaaagucaagguuggugccaccuaaguggguucccacagcaaggaauuugaggacauccuccuccuucaucugcaggacgucaagggcuccggacauuguguaaguuucccuuuaaguuacgaugggaaucaagaacaacgccguauggacccguccccggguagcgcggaaagcuggaguccc

SEQ ID NO: 722 - RNA, 1053 nt, Mus musculus
cuuuuuuuuuuuuuuuuuuuuucagcuuuuagcaacuuuauuuuccuuccaucuuuuuucccuuugcucaggcaccugcacagcagcucaggaccacucagugguggcuccaacccacuccguggccugcgcugugggagcugcugaccaauccucaguggcuggcugugcacuccagucuucuguggggaacugcuggaugggcaccgagggaaccugcacacccucagaucagucggccaccucaggcugagcagcagugaacucaggagcuggugugguccauucacccuggaauuccuccuuggucacagccuucucagcagcagccugcuccuccuucucaaucuccucugggucucuguagaaguaaagaucaggcaugaccucccaggggugcucacgggagauaguaccucgcaugcggaguacuucccuggccagcauccaccacaucagacccacugagugaacucccuuguuguugcaugggauggcaauguccacauagcgcaggggagaaucuguguuacacagagcaaugguggguagauugacauaagaggccucugugaguggcugauggucagcccugggaucgguuaccacuagaagccguggcucccugaaggcugcuuggaucugguuagugaaggucccagguguaaagcggccagcaaucggaguggcuccuguggcagcagcaaacuucagcacagcucgcuggccaguguuccuggaggagaugacgcugacaucagcaggguucucgauggcaacaauagcucgagcugcgagcaacagcuucucccagguccucuucagguuuaugauguagauaccgucacuuuccuuuuauagauguacugcuccaucugaaagucaagguuggugccaccuaaguggguucccacagcaaggaauuugaggacauccuccuccuucaucugcaggacgucaagggcuccggacauuguguaaguuucccuuuaaguuacgaugggaaucaagaacaacgccguauggacccguccccggguagcgcggaaagcu

SEQ ID NO: 723 - RNA, 8527 nt, Mus musculus
gggcgggucuuagcccggauguuagguccucagccaguuggcauucuuuuucacugaggagaaucgaaucaucuucaggcuucggggccgaggcuuccuuucaucccagagguacucuggggacagcaccuuagaugguuugugccagaugaaguggcgguucagguggcucuccuccugccaggcugccauaaugcuguuagcuuugucugccagaauggccauguggcaggcccggguaaacucauacacucuggccacucgucccccaaagagugccccaccauaauagaagucccccucauugucugccacaaaggcagaggaaacuugccugcguucauaagggaauuuccggcgagguacagcaaaauagccugggugaauggcagccacuagaucccccaaggucucggggccccauggguuacggaagaccauauccacaucgacacagaagagguaauccacuucuuugugggcucucuuggcaauguguuuguugauggucuccauucggcgcauggagaucuccucccaccgggaauaacccuggauagggaugaugcugaggagccgaccggggcccaggggaacucugggaacggcuguaggaucauggguaaagagguaauaguguacuugguacccacgcauaaagaacucuucagcugacuccaggaagcgcugaaugaagcagguguaccuggggaugauagcucuguuagccacugcuguccacaacugcccggguccccaguaugcgcugaagucuacacacuaguuuuucaccucaggaagucauugaggucuuaccuugggguccuuaucugucaaacucccacaauccuugucaaaguuggucacccucaucugaaagcccugcuucugaguuuuggauuaagauguauaauuguuaaagucuacacaaauucuauaccacgagacauuucugguucaaguguuuauaauuagagauaccagggauacuuagagugugacaaccauuugagauugucuuuagucaccuguaggcuguaugcacacguguccuggaggcuggcacuaggcacuugggcaucuuccucgcuguuuguucugguuuugguuuuugguuuuuucaagauggguuuuucucuguguagcccuggcuguccuggaacuagcucuguagaucagguuggccucaaacucacagagauccuccugccucugccucccaagugcugggauuaaaggcaugcaccaccaccaucuuauuuuuuugugauagggccuuaaugaaucuggaccucaauaaucuggcaaagccggcuagguggcaagacucggugauguuccuaugucugcaucccuggugcuagcauuacaggcaugugcuauugugugugucuuuuuuuuuucaacauggaugcuggggauggaacacagguuuucauguuugcaugaaagcauuuuaucagcugggcugucuuccucugugucugauaugcuuccuuaaauuuuuuuaauuaauuaauuaauuaauuaauuuauaugugugaaugcagaggacagcugccaggaguuauuucucuccucccauccuggggauugaacugaagucacugggcuuagaggcaagagccuuuaccuccugagucaucauguuuugauugagcauggcagacaguguuguuugggauuccuaugaucucuauuaauguucugcucagaaacuugaccacuuuauacacacucaaacugaacaccaggaggacgaaaguaguugagaggcuauucugaccaggggucagaaucaagggaaaaugaaugcuagacaaugggacauagagcagaauccaucccuaaaaccaggggcucaccucaccuaugugguccguuuuucaucuggccaguauuuuaaguucuagggcccaaacacaguuccagacagacuuaaaggaaaggccagguagggacaaggagagguagggaggacaauacauacccugcugauccugaccuagacgucucccuuuccauggcaggcgagcccuuauaucagaaagcucucccauacuccacagcacuuggccaggcaggcuucccccuagaccagaagccccuguggcucagggagaccaagccccacuccugccucagccaugacucacuuccccacggcaaacacggugacgccaauggucagguucaacggcugguacaugcucuucagaagcuccgggucaaagguucccucggagacgaugggugccaaccacgggguaagugucagcagcucugugggucuggcacagggcaggauuaggccauggaagccugccuuccuguugggaagccugggcagcaucuugguccuguuugcugggucucaauuuccccaugugaaaguggggauaauaacagcuuucuccagcucgggcugggcagccugagaguugggauagacacacagagugucuagagcagugguucucaaccugugggucaugacccccacaggacucgcauuccagauauuuacauuuaugaacccuaacacuagccaaguuacaguugugaaguagccacaaaauagcuuuuuugguugggggucaguacaacaugaggacuguauuagaggggucacaaaaaauggggcuggugagauggcucagcaguuaagagcucugacugcucuuucaaagguccugaguucaauucccagcaaccacauggugacucacaaccauccguaacgauaucugaugcucucuucuggagugucugaagacagcuacaguguacuuacauauaauaaauaaauaaauauuuuuuaaaagggggggguguccacagcauuaggcagguugagaaccagugcucuggaguguccuagaacucauaaggugacagacauagguggcgugcccuuucuaaguaaggcaugcugcacagugccacuguuuacuguuccagccuuguacaaaguagguaauauaugaucucaaaagguaaagcacagaguagauucuacugccuaaggucacacagucagugacagguggagcuuggcucccugacuuucuggggcccagguccccuuugcuauugaucccuccaccauccucaccauccucuggcuacucuggaucuccuugguccccucccugccacuaccaggucauuccaugacaccuacccguguuccagcagcuuaggcugaggguacuguaaccuguaaacaagaagagccagugugagggaggcagcucccaugcccagggccagaauccaaggagaaagggucuacuuacugugucacaggcugcaacgguuucuccuuccugaagggcagcuucauguugcugguggcagagagagagagaggaggacuugucaaggauaccuuacuguaagcauaaacacaaggguuaagagaaagagaggaggggcuggagagauggcucagcgguuaagagcacugacugcucuuccaaaggucaugaguucaaaucccagcaaccacaugguggcucacaaccauccuuaauaagaucugaugcccucuucuggugugucugaagacagcuacaguguacuuagauauaauaauaaaauaaaucuuaaaaaaaaagaaagaaaggcacgagaaugggggugagguguaagauacuggagaggcugcaugugcacucaagggggaguugccucaccuuuucuuugagaaaagaaaaaucuuucccuuguugaggaauuuccaaguaaguuaaucagcuagcagcaagccccagagaccuaccugccucuaccagcucagcaugaagauguaagggaauccacaccaccauacccauggauuucacagcuuuuggugcucaagcuugcaagaaaagcacuuuauugacugagcucucuugauggcccucuuucaauuauguugaggugcaaagcuuacuggcaugguggagcaacuauuacuugugccaugaauguuuucuuggcagagccaugguggcacacaacuuuaaucccagcacucggcagaggcagaggcagaggcagaggcagaggcagagaggcaguggcaguggcaguggcaguggcaguggcagaggcagaggcagaggcagaggcagaggcagauggaucucugugaguuuggggccagccuggucuacagagugaguuccagaacagccagggcuacacagagaaaaucuugucucuaaaaaccaaaacgagagagagagagagagagagagagaaauguuuucuuuguuguucuaaaacuuagauccaucaaacaguagcucucuguggaccugcccauugaggcucuaccaccacuuugccucugccucuaugaacugguaucuccucuuaaaguagaacaaugaagaaaaggcuaauuauuaaauacugauauauugauuuauuuagugauuuacuuaaagcacugcuugaauugccuaucugccaagcaugacuucacuugcuacaggaugagcuggagaaauaaccaagcugaugugucuuugcccuuagccgccugcagacugugacauuagccucuguaaaaucuuguuugcuugccugccuugccuugugguguuagagaauaaaaugugaguacaaacugggucccuuucaggagacccuucuccuccacucucuuuggugucggagugcuuauuccagaaagguauucgacaauacugugagugcaaaguaucuggcccuucaugauuugucucugcucuucaugccuuucucugaacuuuaucuacugugucccugcucagaagauaaagguguucugaggaagcagucagaaucaaguagaggaugucacacuaggauucagcauucugugcauccugacaauaauuucuuuucucugacaaguccagacaugcuuuagcuacguuagggaaugaugcacaagaauacagucccaaagaacuguuucuaaacagguucuccuuugccccauuagcccuuccuucccacuaccucuggugggugauaggcuagaagggagguuaaaggguuuaagaaccauuauuaaaguagguuuugaaaaauauaggccuacagaagccgcacuccuccauggccuuuguaucaucauuucuugccuccaucuuccugccugacuuccccuuugugaugggcuaugauggacacauauaagccaagaaacucuuuucucccaccccgcuuuuggugaugacguuuuguuacaggaauagaaaccuaauaggacagugugguggugugaauaaggaugguccccaucaggucauauagguguggccuuguuagagguuucaagguuccagcccagcccagucucucucucugcugcccguagaucacgggguagcucucagcaucaugcccgcuuguaugcugccacgcuccccaucaugaugauaauggacuaacuucugaagcugcaaguaggcccccaguuaaacacuuucuuuuauaagagcugccuuggucauggugucucuucccagcaacagaacagugacuaagacaggcagacagccugagcuacauaagauccuguauaggaacugaagagcuagcucagcgguuaagagaacugacugcucuugagcggacuuggguugcauucccaauaccuacaugguggcucacaaucaccuacaacuccuguuccagggcauaugacauccucuucuggccucuggcggcacuaggcacaugguacagagacauguagacacuuaauaaagaauaauaauaaccaggugguauugccguaugcccuucauccuagcaaucagaaggcaaaggccgaucuuugugaguucaauaucagcuagguuuacagagugaguucuaggacagccagaauuacacagagaaauucugucuaaaaaaaaaaaaaaccaauaauaauaauaauagccagguaugauaauauauacuaccuuuaaucccagguaauaauaaauaaauaauaaauaauaaauucaagguuagcuugguuguccccaucucaaaaaaaaacaaaacaacaacaaaacaaagcaaaacaaaacugucuucaaaacaaaaaagaaagaguccaaaacauauacacaaaccucuaucucuuagcauacaaugccguguacuugccuggagacuugccaacaagaaagccaucaacaaauucaacauagcggcuccuugaucaugggccagaacucugggauccuguuauaaacaucuggacaaggauuauucuguuuuuaauaaaaugugucaugccagguagugaugugcacaccuuuaaucccagcacucaggaggcagaggcagguggaucucugaaguugaagccagccuggucuacaaagcaaguuccaggacauucagggcuacacagagaaacuguaucucagaaaaauaucaaucuaucaaucaaucuauuagucaaucaaucacccauguuauaaaauagccuauaaucuagaugcuuaauuuuucuuuagcuauuaugaaacacaaaagaucuuuucccuuggcuaucaaacagguucaccaaauggggaaggccuuuuuagcccaaugccacucaguucccccugcauccacacaaaauggagcaagagguuccuuccuagcaggacucucuacugaccaccuucuagguaccagaacaccaggcuccucauaagcaucagcccaggaggggcaugucuacccucccgucuaacacacagcaagcagcaaaggagacccagaguggugcagcaaugucuaaagaggaaguaggcugagcucagcaguauguuggaaggcuggaaucuccgguucucagcucgagucuacggcagcucuaaggagcacugcucagagccauaaguuaaggcuacagguccccuuagacaacaucaaccuaaaagauuuccugucucuccaaauauggucaccccacacuguagccaaauucucuuauccaguacuuacaagaacucugggcaggggagguaauaggguauguaggagaccagcagccaguccuugauaaacuuccuagaaagaaaaacaccuguuaaaugcuauacuaccuuaaaggauggccucacuugugcacuucauuaggagcaaagaccuucauuugguaaagaguccugucacuccauggcaguugacugcagaguaaggacccauaucuagcauagggccuaguguguagcugucuuuuuguccacauagcuagucacucaugguaugacuagguccuugaagcauggcuucccacagacagacgguaaggagacaugcaguggccauaacucccccacaaggccaauagggguuacuuuaggaacaugaacaggguuucuuaucaacaugguuugaaggacagucuaggcagaaaacauggcaaauaaaaggcugggaaaacccaaaccauggcaaaacacaaaagccaaaacuaguuagccuuccugaggcuggaggauccugagccucgagaguugauggguccugaggaacugguugacuaucacauuuaggaggcaggagaacugagaagggcauggaagagauuccaaguagcaacucaccacaggacccagagaccugugccaccgagcaggaagaacgcuaggcccugggccagucuugggcgggucaucacugggugcagaauagaaacugggcacuuucagaaaccccuagggccuuaggucugucaggcucugggccuaccucacuugaggucuuagaaacgccugcaaagaaauguuccaauuauuucccucuuucagcuggccaggagcucaguggcagcuaggaugucauccccaggcaguggucuaugucuaggcucugcccauucaucaacagggcgacaaagaaucaccuagcaacggacugggacaguguccccagggacuuaaguucauggaggcaaacccuuaauuuccuaaagcuacuucuggccacuugggagagguggggucugagcuuugugacacaggcagaaggugcuuaagcaaucuggcucaaagaccuuuugcuuggugauucuucaccaccaaaggguugggggaagaugagauaacgcuccaggccaaggagaggagagugugguaagccugaaaucggagaaaguucccagaucuggaguccuggagguuagggcucugccuucccucucuugcccucucuugcccucucuugcccccugggaccccaguuucccuucccagcucaccauuucugccucacuagccucaggcucagacucgagcugcacagaacugcgaagcagaugacaaacucagacccaaacccugcagguccaacccagaaguuggggcugcagaggaguaccugaacuuuguccagcuuguucuggcacugggacuuccuccuccucuuccuccuccuccuccucagcggcugcggugggguacggugcaaggacccagucggguagggcagagcagaugagacugucuuugggauuauagaaccacucccuuugggcugaccaagcuuuaggaca

SEQ ID NO: 724 - RNA, 40284 nt, Mus musculus
cucccugagauuuccgcauaugugugugcucuuagcuguagagcccccaccccacuccccaaucuccuaucucuauagagacugaucccuggagccaccgccugacaccagccauucacaggccaucuccucaugagaacaccccaggagugcugagaggcuguagcacugagcacaucacuccuuuaacuugucugcugcacaugaagugggugugugcuccuucagcugccucuucucugccugcaugaaaucaacugaguccuuacaaaagagucagaaaacccugaaaauaagcaaggaaauaaaaacaguaaaaccacagugaccaggccguaguagaaacgggauuuuaauauaauauucaagucuagcauuuucuauuuacaacaaauaaauauugucccaccccaaucaguaaacuuuuuacguuuuauacaaauguucaguugucuuccuccuccccacaaaccucccacugcgugucgucuuguacagcccggaugcagcgguggucaauggcacuuucaguggacugggauucaauaccaaccgggcaguucacgagagggcuucucucucugauccaagggagggcuugggcuccuggugggcgaggcucccucacucuguaggcccugaagguggaaucuuuggugcagccugagaaaggcuagagugugggaggaaaggcuaggaccuccaugaaagucccaggccagugccugugggcacaaggagagaaugcagucggcagcccugcuggguguauguguguccuggagcauccgggagcauggguggcagugaucugcaccuggggaggugucagcaaagugugguggauaguguccagggcaggcaaggucccaugcccaguuggcaacacuccuuggcaaaagucagcuaguccucugguuucagagagcagaaggcaccgaaggcggcaagugguccccagaggccaggucagccugucaguggcaggugucaaucccggcagcaggagagguucagggugaaaguggaguagggggguagccuggacuggcaggugggcagagguaccuguguggccagggccacucuagucuguaagugcuuagucuccagccagucagcccgucccaggagacguccuuagaagaugccuuuggcaauccugagucccuucugcuucauacgagggaggguggagcuggcuccaugcuugacuuuagcccccuuagugaagguccgcuucuuuaggaugaagucauaguuggcgguagaguucauggcauagaacacauuggcguuuucuggaaucuucagcucuggugggagagggacagggaguggugcuuuaugcggcugagaugcccccaccuccugagagccuccucccggccaggccacagcagggccuugggaguccuccaauccagcuccaacaaggaccucuccugcgaccccaguagaggucaaugagagccuaaggaagucucuccacaccaccuuuacggcucucucugcuggcuaggacuuccagccagagcagguuuccaggaauccacacugccuuccaugaugcuccacugcuacucaccaaggcuccaaggaccagcagagggcagaaccuuccucuggguuccauuccacuagucaccucuggccuagaaucuguccaucauuaccaagcgggacuuccugcugaccccgugucugccucuaguuccugagccucuguaggccugccuucuggaaggaaggggcccccucacccuguccauauaaccaaaacaguggagaagcugagaggagguuugcaguagaacaucuagguaucuugggaguuacugcagacagcagcaaauggugagauggggguguucagcucacuucagcagugucuguggugacagacauggguggccucuguggugaugucucucucuaacauuaagcugcuggccacagccuccuuuuggggaaaaggacauaggcacagagccccugaaauucuccaagauccuugagaauggccugauuuuucuauuuaucuuuuuaauuacauucaugcaucuauggaggcccaaagagggcaucacauccuguacaacuggacucauaggagguugucagccagcuguggagaagcugagaggggggaacugaacucagauccucugcaagagcagcacacacuuaggggauuauaaguaaccauguggguacuagguacugacucaggaccucuggaaaagcaucaaguucuaacugcugagccaucuguccagcacacaguagucuguacacuguaaccacuaggcugucugcccagcacacaguacacuguacacugcacacuguacacuguaaccacugagccgacuccccagcccaggcuugugacuccauccuucuuucuagaaugcugacucgucugugcgcuuuuuugcaucucauguguggauuuuuuuuuaaagauguauuuauuuguauuuuguguguguugguguuuagccugcauguauggcuaggaaggugccagaucuaugcaaaugaagcuacagugaugagcugccauguaggugcugggaacugaaccuggguacccugaaagagcagccagcgcucugaaccgcugagccauccagccucucguguguggauuuuaaacugagcauucuuccugaaguaccugcuuucuuauuuuaaccaggcaauguccucucugacaggcccacgcaugagccucucuccucaacucuugucucuuauggagaggcccagcagcaggcucuggggaaggggccggugcugagccgccccucagcccuggccuacaguugacugacuuacugugauccucugagaugaucugcaccagcucauaauccuccggcucguccucaucuagguuguguuuguccauggcuuuucggaugacagucggagccuuauccuggcuggucaccugaauugggauggggagcaggcuaucaggacagggcacaguguccuacaacagcuugccaccaacuuccacauggucuuggggagcuaugugccccugaagcaagaggaaccaauaauuuccacucggaugauaaggaggaagcagcugaugcucacuggccucccaugcccagcccugcccuaaggcugcgguggcaggcagcacaggcuacuagcucagaggguucagacauggggucacccaggugaacaugacuaagcaccauuccggcuccuggcacugaggggcaccaaggggccgaggcccuacugggguggguaugguaggguaccugacccaguguagcggccgucugcagcuuaagcccuggcaggugggaaaggcccuccguguacugcccauccauagucugaguagaucccaucccauuggcuccauguucaaacaacauccacaccuuggcacuacugagucuggccauggcuaccagccugcuuugguccccgccuuccugagcuuggacuacaacaagcuccuaagcagucugccuccaucuuggucagcagccuauccccauggacacacccagucaccacuggcuucuguuucaacccccaagagaaagucaagggccuuacaggucaacggguccugaaugacucuccccuaaucccuguccuguugccuugggacugaugcccuacaggcuggcccauuuccuggggugggugggcauagugcuccugucccuccucaugggccagagugcugacccaggucuccagguauuucucucuauucuuuuuuaagauaguuuaagaugauucaaauaccgacaacaggcagguaucugugcacgucugccgucuagccaagucaggccccacaggcacaugggcugcagcucacucaccaggaugcucuuguacauguugccguuguccacauccaggcugacccugaugaugcagcagucgcccaccugcugguuguagagaggcagugaggagcuguagcugcagaccccugagacggagcgcuugugggugcgcgugguagacacgggcgugguggaggcugacgaagaggaggugcugcuggaggcggagcugaugccagaggucucuggggacgacugggaggcugacucccagaacugugggcgacagcagugucaacagcagccugaaccacgaagggcccugaaggccagcagccagcuuuggggacuucugggccccuuguuggacaaagugaggauggguagaggagggagcauggguggucaccuucuuuuccuggccaucaggagacucugggacgaagcucauguugaucuccuccacaucagagcuggaagagccagcugagugcacacugagcgcgucggugauguccccgcugccgagguaagggcugcaccgaagcuggucacaggacuuggagugggcacugcuacuggugcugagcuccgugcugggagccuggcggcuacaggaaacacuuggcuuacucucagggucuucccaggggugccaaccuugacugcgcucaguucuguuucccuggauaucugaggggccaucccaucucauagaggugaaaacugaggcccagaucgcugacucagcucacucugugaagggcugauggguguuaggauuaggccccagcacuuacucgcuccagcgcuugacaauggcugugcuuuucuugcuccucaggguguugcuggccgacucagacgggggcuccagcucacacgacaggguguagcuaagguagacauggcugugaggcuaccaggagccaagcuggggcucccaaucgggguagcccccaagcuggagccuggauacgcagcugucaccaggcaacagugaugacaucaugucccucccccacaacccccaccccacccccacggccagcauccucaccucucagccucacugagucgcuccauagcucggaaccauguuccaaaguguucuuccggagcaaugcuguaguuguugcaggcugacuguagcaacuugaucugggcaaugacuucgaacuccuggaucaaaagacaauaggguggugaagcuucugugucuuuaccgccgccuuacacccacucacgcgucucccucuuuuuacacaggaggcugucccggaugucaucaccccaagacccuuuucuauggaauagccucugaagaguguaccaacuaucaccauagagcaacacaaggacgcacaugccuugcccagcccacgaccucccccgcccccugaagcuggcagcuccucaccuuccuucucuuuucaaaguugaucagucuccccuagaagacagaaagccaauguccguaagaaaacaggcaccuucgagcacugccuaccuucugcacuaccacagacacccacuagggggcaggaaguacccacgccuggcucuaggcaauagcaaggggaaaacccuaagggcagagguuguagacauuuuuguccaacccacucugaguucgagggcccugccuggcccacaugcugucuguccagcccacucugaguuccagggcccuggcuggcccacaugcugucuguccagcccacucugaguucgaaggcccugccuggcccacaugcugucugaccuuggaguggcaagcuucacucucuugcccaugcaugucuaguuuggccaacccucauuucugcugucagaacucuguagucuccaagggggcaaccuccaagaucucuugagaaccagagcucagggggcucuguccuccuugcccuucagaccccaccacaggcccagguacacucacauagagauaguccuucauggcaguguccagcaucaccaggucagugaggaaugugcccagguagggaacggugcccuggaugacucccuggggcaucagucaggugggaaagaagcgaggccuggucagggccucuccacggcucacccgaccccagccaggcccaccagggcucuccacuuagagcagcucaagaaccuuugcugcuuccagcccaggguccccugcugcccccagcccaggcugcagacaucuauggucccugcucauacccuucccaaagagcucugccacgcccugacucugauguccccaaagaucuagcaggucaccuugccacaggagguaagggccaaccaagggagcccuuccucucccaaccucugggcgggccacucacugucuccuucugccgccucugggcucuccuaggguucaucuccaguguggcaaacuuggagguuccuuccugccaggguugaaugugaagucaauaacauuuucuucuucucccaagcccaaccuaugcugcgauccugggccuggcugggccaaugugucuguuuccacauuugauauuucuagaucaguguccuguuuuaacacucacugggugggggagggagggccugggccuggccuuugugcaccucaccuucaaaguucccggggacaggagggcuuaauuucuggccccuagugccaucuugacuggcucccugcagcagugagggguaugcagcccggugaccuccugcacaccccucauuucccuuagacccauuguguccugcgagcucagcauccuccauuugccagacaagaaaacagaagccugcacacuggcagcaccuggcauggaaccccacagggacccaaaggacugcaggcuacugacucugaguccuguucuccggccacaugaagcaugguaggacggucucuaacugagcugucauaugggagagggagaaggcggggccugagaccaaagcuucccaguuccacaggucccauagcagaugcuuuguucucuaaggaucuuggccugcauagccagagcagggcccacugauaacgcucuucuuaugugguagcuucuagggugaggucaucagcccccacccagcuaagcugccgggacacccuauggccucaagggaugaagcagucaguccaccaccguuccucaugcuggucagcaguugcugcuucagggcagcggggagagccaccuauacaagcauagcugcacccugggacuagauguuuggaauggaggaugacacccaucccagguagccucucacugggacaagccuggccccacagauagaacaggcuggcucagggaaguagcacccucuuccaucugccaucagucugccaguggcuaagccacagcaggaagcuguagaccugcuaaucuggcugucucaucuuccugcagcaggcuggcuggcugucccuacuacaucagauuaccagaggccuacuguuccaccaaaugccugccaccuguccaagaacaaagucauccccuccuccugucuggucuugacaggacuggaaguuggccaaaagcuuucagugaggagaugaaacccugccaucuccugcccccuccccccuccuccccuguccccuuccuccaacacccugucugccaccucaccuugaugagcagcucucugcucagggaguaguuguucucaucagagaagaucuccgacaguuucuggaacacucgaaagcugucccugaaggaggcacagagcgaaggcggcuguagggaaggcugugcacuggggcaagcaccguggggaacccguuuuccuuuacaacaaagcuuccgcgcugcuggagaagaacccuaaauaugguuccauggaagccuaccagagcaggcaaaaccguuuugcucucagcuggguaguucugugcugugugcaagcacgagauacuuaccuggcucuaaucagggugagcacacugagcugugccgaccagugagccuacccuucucuuggucucugcuguugggccucacuaaagguagagccagccugggauacaguaggguuggggauggggagaccuaccuggagaccucuucccacgucuucuuuaggcgguggauggcauugcucuguagagcagagaggauggcguagagggaggagaaauucuugagcgcucugcacuccuggggacaaggagucugugaguggagcccauggaugagcccuuccugaugccaggaagcucccagagggcaugccagggacacauguucacacagcgacucaaguguacagugccuggagcgaguauacaccuggcuguguggcccugaggucuaugaagaaaaagaagaggcccuccuguagcuuacccuggccaccucgauccaguguuccaccacccgggcccuguccggagccuucauacucugguccccaaggcagguaguaaugacacaguuggccacguuguugaacugggcgacaguggcgcggaugguaggcgcgaggugcuccuugcccuucuugucccguugggaccagauggagcccaggcagugguagggcacgacuuucuugaauaguuccuagggagggggucagugucacagccccgcacagcccaaaggcccaagcugcagcauguaagagugaggauguggcugagccugugggacccucaccccuucaccugacuucugaggguacccagugcaaggcaaaccagguaaagugaagggagaggaaacacacacauagcaguggcccugccugcucaccucugagagcaucugcugccccucgcuagcaggcacgccugcugcuauaggcccaccugagucucagucuccagugcacagugagcacuucauaaaugcugagguuagacgggcuucaggguggaguggaggagggggacccaggcgcaccuuggcgagcacuccuccaucucucagaggacacacacacacacacacacacacacacacacucucucucucucucucucucucuuucuccccuccccccuuuccaugucuaccacgggggugggaaaucaaugccuuggguuaaguaguaugcucuaaucacacguuuguuaacugugaagcuaggacuugcccugggacaaaggcucugaaccagaaaacaggucuagacagcggaggauaaaaggaagccugccuugccccggccccaagccacucacugcauccaucagaguaaacuguucagccaccaagucaggagggaacagcagaaggugaggcuucucgguuaguccauucuccguggcuucaggcagagaccaggaaggcucuaaggcaggagugggcacaggagcugacuccaguuccaggcucugugagacggcgggcuccagcucuggagccagugcuagggauggcucaggcucuugagguggcucuggaacugguucuagcucaggagcuggugccaccacugggcuggaggccagcacuggcacuggggccgcagcgggcucucguacuggaguugaugucaccacuuggcugggcgucagcagcagugcagguucuagcugugaagcuggcuucagagacagcacuggagcuggggacagggcugcaggagauaagaugcccacuauggcugccuuguccagagcauuucaagaccgagaaucaccgacugccagagaacaagcccccaucccaacaacaagaugguaucccagacucugguguacuaccuacugggccccaggcuugcucuugcuccuggcucgguggcuggagccucucugugguagaaacuuuuacugacccuccuagcaggcucuguguggcuaccccugguuccucacccucagacucagccucacugggcuccagguccuccagcugggccaggagaaggugagcgcggcgcuccagaucugagccaggcauguugagcuguacauaagccaccagcugcuugaggcagggaaaguccggagguugacagaaauccucugaguauugguccagccaggugcccaggauggaggagauggcacuggggacacgcaacagagucagaggcauggucucuccucguacccucccacagcauccuggugugccuccacccacaaguccccuuuggcuguccaaguaacuagacagaggcuacagaggguccuacaggaggcagcaaaggcucaucaaugggaugguggcucacccgguucccacuccugcccaacucuacuggaauggagaugcccaaagggccugccauucaaccaguggcaaggguuaccucaguaccuauucuuuguaagccagguauggguugcauuuuccugagggacucagggaccagcuaaaugcccauucuuaaggagugaggcugcacgucuauugagacaggcuaugcuagggaaggauuuucacagugacugguucugaaucaaucaaucaaucucucucucucuuucacacacacacacacacacacacacacacacacacacacacacacacacaccccuccucuuccaucugacacagggguagccuuagaccuuagcccagcaucaggaaccacaugugugggccuauaguuugcucgacccuuguucccuaaaccuccccucuggacguaaagccuacuuacuuuuugaguugguccugcgguccgccguccucacuggaguaggggaggaugcagccauaucuagaggaggccgugagggcgucacaucuaccguaccugcuuaugaugucuaguguuacuggucaacucccugaugggaauggggcccagggaggcagggacucagcuccugucacagaguuaggugcuuggcaacauggcuacgcacagcagauugcuuuagaaaccgaggcacuucagcagaccugaggucucucagucgauuaccacagggccguccuugcucuguguucuagguugagguccccuccuuucuauguagggaacccacuuaaccugaggcugaggagaggaaggcccuggcagcccacccugacaggagccugaaaggaggcuuauccccaagcugggcucccccaaggugcggccggcaggaaggguguccugggucuggcggcagugcucaccuuuugaacagcaggucuagcaccugcugggugguagugaaggcucuguaggugcacaggaagacagugacguaggaaaggucacugcccuggaaggcaggcaccagguguuccaccagcuucuccagaguaccagccuucaccgugcgcaccuugcaggucucauagagguucagagccgacucguucucacacugcggggacaggagaagagcgaggucaguagcagggucauguucucagggacgcuggaggcuggagcucgggucaccuccuggacacccucagcagaauguggcccaaacugggacagagggucucucucugguuuuaaagucuuggauuuucaagcagaguuugaaguguugagcccuucagggcgguuucuuaggugagugacagcauucucuaacauacucugugggagggggauguuuccaaacugaacaguccauccuagagguggaaagacaggcuuacuccgggggcgggggugggguggugguggacccagaauguucccugagcaaguucaaugaccacaggaaagaaucaugcuggaugcaacaguggugaagcauggccguguggcggcaucagcgcugucuucuggaauguuauguggcugagucggucaggcucagcuucuuagcucaagggacccacaagacuuguucugagacagcaaguugcagagaaguguauacauguugaagaauuuugucaacuugauacaucugacaaaauuagagucaucugagaagagaccccccgcccccaacugagagaugccuccuuaagccugcuguggacaagacugcugggagaggguccagcccuuguggguggggccgucccugggcuggugagccuggguucgugagacagcaggcugaacaagcaaugggagcaaaccagucaggagcucccgccccuccauggccucugcaucagcuccugccuccaggcuccagcucuccccuccugacuuccuucagugauggaugaggaugccaaaaugugagccaaaugaacccuuuccuccccagcuugcuuuuggucaugguguuucuuuauagcaauaguaauccuggugagauggcucaguggauaagagcacccgacugcucuuccgaaaguccgaaguucaaaucccagcaaccacauggcucacaaccauauguaacaaaaucugaugcucucuucuggagugucugaagaaagcuacaguguacuuacauauaauaaacaaauaaguggaaaaaaaagaguuuaaaauaaaaauaaaaaaaaaaaguaauccuaagacagaccgcuuacaaagccuaaacuuccauucaaugagggcaaagggcaguccugcugugagaggauuucugacacuaggaggaagaggacaggggaggggaggagugacaugugaggacagcuuuuaaaccgagcaaaauauuugaauaugcauggccuuaugggcaaugagaagcaaagccaauggcuucucuucucaccuguggguagggaugucagcaggaucuuugugcaugggcuggggaagggagggaggcucagcccagagucgcaagagggacuggggcccucaaacagaaaacucuggaaaggagucuggcagggucacccuccuggucuccucuccacacuuaccccuagccagcgcuggcccuuaguggcuccuugguguagcuggaccuugcgcagggagauggaguagaugaccccguugaucagcuccuccccaaucuccugcguggagcucuggaaagacaaggcccaagagccaggccaggccaucaggggucugcuauaggggcauggcacagacagguggcuucuggacuuccagggcgaagaaaauggagagccaggacuccccuucccaccuggcuccucacgaccuuaaggucaacaucucaggaaccugcuccuacuuaguacuggacagcccaacacagucuaccuggacaguacuguuauucagccauuucagagacggguaaguggaggcugaggcagccaaacugucugguguauaugacagauccccuaugccaaggcccuagcauggucacagguggcacuggccucagaacccaaggccagggucacccacacucuucuuucauugucccaucugagguuccaggcugaccaggcagcagcaggcagcucuuucuagcccagugcuggagucggcaccauggcucuagggcaggugcagacgcugaccacaucugaggccacuuccuuccccuucugcucauucaugcugcugagacuucuuggguaacauggggguucccagcuggcuguucuuccucaugugagugagugggguacugcaacagugcuggggauccacagaaccccaaaucaugaggccuauauggagaagggggucaugugacugcuucucagagccuaaagcagaaaugaaacauucacuuccuugcaccucaggcucucucuacuccugcccucuggagaagggauagaggggaccugauuccuggaagucaguggguaacaagaaggcucaugacccuaagcaauccuggccuggacccugugggagugucauguguuccucagcgcagggaacuucccuucagacacuaguggcacugucaucagcuaaccccugacccaaaucuagaaagucuuucagcaaagauaaaggagaccauggcucuggaacacccacugugucggcucagcguucuuaaaagucagggcuggcagagucuuccuucccugaggagccuggccguacccagcaucagcagcagagucagggucacacaugaggcuccugccauacaacacugggguucagccuggggacccuaguacagugcuacuuuguaacagguuuuuaucgaugcccauuagacagaaaugugcccuggccaggcacacccgcggccauagcuggaugcgagcagcaguggccaucccugagcagggcucaaaugcaaggcuuugcuuggccugggcuuccgcugacagcccagcagcuggccugggcccugugggagugucaugugaucccuguacccuucccccaaccgagggggggccauucugccagcuggaugggggugggggugcagacaggcucugagagccauacaugucuuccucuggggagccgacacccuguugcacagaugggaacuguuccagccaugaggagcuaagcccauacacucugcuuccuucaaacaaucacagcagaaugaaucagaccaccucacaauacugagugugggccccuuugcaccagauacccagagaagacagagauaccccaggccugguuagaaagcaacagagaagagcuucccuccccagucuaaggagcuauccucaggucccucugagguuggaagggcagggaccauguaaccugaggcuaccuugagcuaccuuucuaguaggcagcccauguaggaagugucauauucaagcaguccagggagaggaggggguaagcuggccugguaaacagcugaaacagcaaagaugucugccagccugccugccuagggcaggcauccaggaggccucugagcuccaagaaaggaaugccacaugguuggcuguguccuuagagaggaucaucuccucccaacaccgccccccccccccaggcccucaaaugugcaaggcccccagggaccuaggaugaagcuggcuguugucgcuugagggugaaagugucccugggaguccugggaguaagccguccccacaaucacagucucuucagagcucccagaaugaggugugucaccugaucaaaguucucaggguggcaggccagcaggauguauguccccagcuaaaagaaagagagcugcaggccaagcccagaacagcaaggggcucaauaaggauggggaugccaggccugugucauaucucccuagagagcacugggugguggugguggccgggccuggcagacacugcugcuucugcuuuggaaggccuuggcagaugugguagaguucaagcaugagaucacaguuucucucuaugugugcagaggccgggugauucuaaccucaccacaccuaccuguaccacagucaccaggguaccccagggcucuagcaggucccuugcagauccccuacagcucuggacacacagaguccacaggaccagacccagguacuguaucucaggaggagucucacuccccagcuuagcucagcaagcuggccaugggcugagagaacagcaguagcagcuaacagguggcacggugugggcugcagcugacuaaggauggcagacaacaccugggacagcacaggaacuggugauguacgagagucgcaccugccugaggaccaccuggacuacuggauccagauggcagcucacucagaguccuaccccaugcuuggaaaggagcuuccagaacagggaggggcaguccagauucgagugagccaucucaggcucuugucauggagggagagcaccuuccaguuuuacagguggaaacaaagcccaggggaggguugaggugagaauccaugauuucucacgcccaggccaugagcuccaaaggaguggguaaaauguaaacaucaagcauuagaacccugucucagccccggcacuggguggacagccucgaugcugugccucuguggcagcccucagugaucagaggaagcuucagcuagggacugcacaaggagccugguugccauggcagcaggagagcaccaagaccaaagaaaagucuugggccugugcagagcucccaccgagucagauucaggucccaggaacccucccugucagccugaguccugcuaauggccaaguuagcauuucaggaaagaaaacuagacucaagugugggagggggcacgccccaguccucacaggguauaaagcagacccagcugacggcagacucacgccagcccaugaccaugccauccagcuaacacgggcacuuccugccccugagcuucuguauauuuagugcauguaauuuaguguggugccugguggaugaagggacaccagguagacagguagagcuaggaaauagcagccaggacaaggauuucaccccuggccuguaaggacacacccaugguacacagaugcaggggagaggcugaagacugaaaugacuuccucgggcuacauagcagauggaagguggccaggcugguggcgucacacaggugccucugagcagaggcuuaaggacgaguccuggggaauggauccugcaagccuggcuccucugcuggcugucagucucacguggccaacuccacaacuccuuuuuguuuguuuguuuugguuuugguuuucaagacaggguuucucaacucacuccauagaccaggcuggccucaaacucagagauucgccugccucugcuuccugagauuaaaggcguacaccaccacugccuggcaacauguccauuuuacagaugaagaaacuggugcucagaggggcuagccuuccacagagcucaagcucuuugccuauuggguucaaaaggacagauggggccugcaggugugaccuguaggacaacagcugcaggaaaagguaucaaaaggaggggagcaugccaacagaacagccauggcccagcaguucuggucccuguguccugcucaagugagcagcccccgggcugucauuucucuggggaacugaguuugcuuggagccccagcuccuguuuuaggaagcaauucaucucaaucgcucucucucacugggcugggcuggcucacuccucugugguauauaccugauaacacagcauuugugaggguaucagaaguccgggucagggcaggugcuaaacugugagacccuucagagugaagcugaagccccuccagaugcuuccucggucagagccagcaagagaucuauccagagucuugaaaacugucugacaggaggucccuguuccuguccugcuagcaaucugguuccuccugcuccagagcugccuagaggcuccuaggaaaugggccagcauccucucucucucucucucucucucucucucucucucucucucucucucucucucucucucucucucucucuccagccaucuggcccuccucauccucagcuacugugcuucugaggaaagcaacuguaaguaggaggagacccugggggcguggcuuugauggcaagucuccucaccaacacaacaggcucuaaaguucuugaaggcugcccuuuuagagucagccaggaaguaucucuagaacauuaucuugugcgagcgagcgugcgcguguacacacacacacacacacacacacacacacacacacacgcacacacguacacgcacgcacgcacgagcgcgcgcgugcacacacacacacuauguaccuauaucucugaguuuucagggucaagggaacaaaagaacccugggguaaacuacgagcugcacacagugugaucaagaaagcagacggcucggaggaagaaaccuggccucacuguguccaacccacacagccuucaggcgacacaggcaagcagccaggauaagacgccugccugccuggccucggccucugcaguugaccagcuuguugagugcaaccuaauuaguuguuucauuuguuaaaugggcuauuaauagcccugaaccccucaaaggacaaaaugcaugcaaauuauuuagccuaggcucuuccaccaagccccagcggcuguuagcuuuuauguuaagccccugguuacaguucccaaggucucaaaaucugagguacucucaccuucuccuggacucuaagccuccccaucacucacccgacaaaggcuuuuuugcagugcuugggucaagcucuauccacgaccuuugcgggcuucuacugcucacuagccaucucugcuggguccugcuucuagaucuuauauguaccagacacccuacccccaaccccagggaacacugugcugaaguccugucugcgacccuuucugacaauguauuuauuuaggucagggacuucaccucucuggccuccagccucuuagcagauggcacuggcaucugagcuggaggucugugugagccgggaggaacacgguauuggugccugcugccugugaaugcuacagauucacagucacucucgccaggaugaagcugaagcaagccuguggcaggagcauaaaccucgugaccucuauaaagcagacuggggcaggucaagcuaggucggugguggcuugacuuagaacugagagaguaggcagaugcccagaugugugaggacaucuggcaaccccaggcugauggaaacaaaugacagaagacgaaaggcaaagacagagagugcagggaccuuaauuggauugauuucauuucuggaccugggucugcuaccaggaaaccagacucaggauggggaugggagggaauuauuggcaaaacagacagggauuucccugcccccucccccaggcgaaugcuaaauggucauuguguucaguuuccggcuguggccuccucuccugccaggacccuggcuuuccugacccagccagaagcuucccucugauuucuaaacggugaccaggcugcaugacaacacagaggccuggagagagggcagcagaggaggcacagauagcagcaacccaugcaggaacagaaccuuucaacagcccugccacaaaggguccuuagggauguagccagacagagucagagagaagcuugacaccccccuccaggagugaucaggcuaggcccuuccagcacacaaagccggagacucugccagacauaaugaaagccagaugagugcagggcugguggugggccgcccaccaccaagcuccccggagucccuccccagccgccuccaggaugagaccacugggugaaugagcagccuggcuugggacaccugccaagcacaagaggccuccuaggccugggggccccaugaccagaaguucccgaguaugcuuugucugagccuucucuaggcagagcaggaugcagggcugccuugggauuccacuaccccuggggcaugguggcagguguacacuaaggugaaaggaagagggcacugcugggugucccugcccaggacacuagaaacaagcuccuacccacauucacuauucccaccacccacacauaagggcauggucucugaaucuuccagcccaucccacucccuuccugccacugccuccucugaacagccucgauguucccgggucauuagaccuaugucugacucagugauggguauucaaaggccccugaggucccacucaccucuggggaguuuagggcugugccaccacaaccacuugcuggcccacuauauuguggccuccucgugucacgcgccccauugacaaggguuugaaaugaggauaggcccucgugguuggagcauucacacaccacaggcguguaaauagugacagcauggaggggcuuaaagguuugacugacugcaguaauugggguugucacaccugugaugagugggagcagguacugggaugaauugagggggcacgggaauucagcucugauuccccaccuacugcugagggugugcuggaagcuguaaugcccaacuggcugccccagggcugauacagcagggggacuucugaggaaggaaccccccagccacacacaaugcugcaaaggacguugggcucacccaccuccaggcgcggcagaucagggucgagcugcgugaagcugugcagcaccacugggcagcugucggggacgcccaccuccaggcgcacggcgucccacacgcugcggcugcgccgggaaccgggaaacaacggcucggugcccccuaugggcccggccgccucagcccacaugcgcugcaccauggacgacucacgguggcgcggguggccggcgggccgcgagacccggggcagcgcggggcgcagggccggcgcggcuccgcgcugccugcgcucugcgccagaggccgggccucgcugaugucagcugggggcgugggcugcugggggagugguuucagagggggcgugggccuccucuaguuggcaggccugguggacagcgcuugcauacacagucuauguauugugugggcggcccgugaugcuguuuugcugaaaucagauccacuucccgggaauuccaguuacaacacccccuagcucuguagccucaguuucuucaccuggaaaguauggguaaugaaaaugacuuccuccaagagugugacugggaggaugucaaugaggucacugacuaugugcucauauauuagaguauggggaagggugacccugaggauugauugggcucaguguccacagggcguuggcauccaguccaagcuccauugggagagggaugcuuccagccucagcuccagucaccacagucaugcacaaacuagacaaaccuacuaugcaaaagcaaugcugguuaccacuaggugagguggcguacuuuuaaaggcuuguuuauuuuauuguauguguacuguuauuugccaugcauguguguacauugcagacaugguagacgcugaugccugaggggaacaaacugugaaugcugggccaucucucccgccacaaggccuaaauuuucuuugaaauuuuuaauugucagaaaguauuuuuaugaacaggcuccagugaauaugauuuaagaaaaagauaggcagauuuggcuagguguggagauccccuaaggcugcucagaagcccgggcucugcccuaucuccaggaaguccaggcguguggggguauaucacaggaaggcaguggcucccacacauucuguaggcuuuuccccagccccauuccugggccaaggacccggcagcagcucagcuuuguuuccugacccugcugcucucuccuauucuggcuuucuuuuucuaagggccacuucucucugauacuuaguccccaggcgucaacccugcgggcaggccgucggcaggcaggcugccuccagacacacuaauugcagggauggacgguggcagaggugagguuccaucaucuacucugcuuuucugguugcuguccaccuguuuuaucaaguuccuuuccugucucgcucugcauuucccuccugggaagucuguucauggauaucacaugcacagacacagaaacacagacacacauauguguaggcagauacacagagacauaaagccacacagacagacagacagacagacagacaagcuccucacucccauaggccaacagcucaagccuuuuuacucugacccccuuucaccaauauaaguguccccauguuccugccugcugcccuagaccccacagggcucacacccucagcauccccagcaccagcugugacuuuuuagacacuucccagaaagcagagcccuccccaaggccuccuaagcauucccucaugauuagcccccagccuacagggaauauccuuuaucaagagcaggcccaucaaaagagaggggauaaggacagcauaugugggauagugaagaacgucuugcaacccacaccuaaaucuaaccaucacuuggggaacaacaggagucagaaggauagccuccacacaccaccagccugcaaccuauggaaauccagccuauaggacagacagacaaacagguuuugcuuugcuaacaaauauauggggguguggagguacacagaaagaagagauaccagccaguauguggguuugugaaccugauaugaacaaacugacuguugaguagcaaggcgaugcacucuaggauacccagcaggauccugaaauaagaggaacagugaaccacaauggucagagcaaugacccaggcagccagguugcucccuaagcaagcacuguuugaguauagcgggcaaagggaugacuucacgugggaggcguggcgaggggagaaaaggcuugauuucauuauguugcucagaacagcaagagaucugauucuagaauuuuccauuuaauauuuuuggagcagggucaaccuuagguagcugaagacuaccacaaauugauggcacggaugcugcugcuccuccucuuccucuuccuuuuuuguuuuugaggcaggguuucucugcauagcccuagcugucccggaacuuggagauccgccugccuugccucugagugcugggauuaaaggugugugccaccaugccuggcuggacacggacaucuggacuuggacguuguuucuuagcugccacuauggugugguuacuguugagaguuauauggcagggugggaauuuaguucagugauggagagcuugcccagcaaguguggggcccugggcuccauccucagcaucaagggggaaaaaaaagggggcguucuauggcugugccugggauuuucagaugaacugauguuauuaaagccauauuaugccauauucccuaccuugagucuauuugggaucucuccauaauaaaaguuaaaagaacaaaggggcuuggcugaagacucacccucugagaccccuggugggagguagugacccugggcuagaucugagccauuuccuaugugcuuuacucagcccagucacugacaggauccugagaacaaagcagccucaggcagugggugcccagggaacugaguccugauguucacauauucuuaauggaggcuggggacagcccuggugaccaggagugagaccugggcugucacacagcaugcucaccucugcaagaaaagguuacaaggaacuggucucucuccucuuccucaucccagcccuccugggaacgcagcuggcccucacugggaggcacaacaaaccccucaggaacaaugcugacuuuacacaguuggacgauguuccucagagagcaaggcucugagcugacaggcaaagacuagagggaagccaagagcgccucacacauguauuuuguuuggacugcaaaguguuuuuaaauguuugagccaacaguaaaaggucaggugauuucacauaaaaauccaaaauucaggcgucuccuguaacucugcgugaccugaccacaccagcuguguuccugaauaagacuagaggcugggugggagcugagcggcucggcaccugugggcucuaacuaccccuggacaccauucccugaugcucagacaaaugagccccacaacugucuaggucccuggagucuggcuuccugucuucugaaucuuccucugacuaggaugaaaaugcguccguccucacaccacuucagugagugcauugcuaguccuuucaugcugccaagguugccccugccaugguucucaggggccuaguuccaugucugcuggguagcagacagccagagccagaccuggacaccaggcaaugucaggacaaccacagaaaugagccaacacuuucuucacacccaggcugggccacagccagugaggacagcagccggggggacccugguagaaauccuuuuugucucuugucuaggcacaauggccaacaccugcaaccccggcacuggggaggcuaaggcaggaagauuaucaacuuggaaucagccuaggccucagagcaagacccugcuucaaaacaacagacgacuucucacccccggauggcagguaaaggccugcccgcauggcgggaggacacugcuaagguguggcccagcccagcuccucugucauuucccgacuagggcaucaucauuccuggccugccuggguucugggguggcccugugugggcgugugagcacacaccuuggcgggagaugacgcaccugggccugagugacccagcucaacccugugcccugcagucagucucaggagccucuccacacaauggaggagagaaccgaaaauagcaacucccccaggaggucauacuggguggagggaugugacaugauuaccccaaaucucugaccucacauagaguugcuguccaaggaaaacuggaacaaaagcagccugaagcucaguagauccggaacccaacuaaguuccaagcaagcugucuccugaccaccacccauguacuguggcacacaugcccacauacaucacacauacaugcauacacaauaauaaauaagaggggcuggagugauagcucaacuguuaaaagcacucacugcccuggcagaggaccuaaguucaguucccugcauccacagcuagcucuaacuccagccacaggggaucugacaccccugacguuucugauaucgaauagcuauacccacaugcagacgcacgcaucuaaauauaauuaaaaauaacaaaaaaguugucuguguauacaugcacacuaaaugacuaucacacacacacacacgccccacaacaucaagccuggggcaauggagauggccccuguaaggacacaugauucuugauuagccucucuggcuucagccucagggaauucaugcucuggauuguuacacucugucccaccagcgaaacuccacgcuggcagccuacugaaugcccccugccccaucacaagauacccacuuuggaccuacccacacugacaacccuggggaccacuaaugcuccaggugucacaugaaguacacaggggcagagaagaaagacagugaggacacaaacacauagaaacggaaauggagacucagagcugaacccagacugaaaacugaagagaggagauggaagggggaggccgggggugugguggugggagaauagacaagcuguggccugugugagcugaucagagcagucaagggagccacugagcacgugcaguagcuccaugugucccacagucucaucggucccuaagccuagaggcagugacauuugucccccagcacaccccagaaaggcccuggcaucaggcucccauucccuuccuuccccgagagcggucagcaggcugccagccuggcccuccucuuauacucagccaagugccagguagaaagcguccugaggcucuggaacccggcuuugagcccuacucccugcuccaugucuucagagccccaggcgcaaaucagagcucaauaucucucccagaaagaagaagacacuaagaaaacaacgaggaccacauaccagcuaucgcucugagucaaguguaauccaagaagcaccauccgacauuagcugugagcugcugugacggcccacaggcaugcugucugccacugcuggggacagguggccagccagagcucacacacagcaccccagccucugagcugacaccggguacaggagacagcucuccuggugcuucuaaccaaacuccuucaaccaguucugacaagaagaguaaggagcccuaaggugccaacucccauggcccaggccaggucuuggcugugaccugacagccuuucuggcaaacacuuaccucagcagugggugccagcagaggugccgggcaaggugucggaggagugggagagugggcaguggugcggcgggcaauggcccaccgccuggcagucaccacugagacacaggcaaagaacacugagcccuuccucccccugggcacagcaggccuagcauggacccggucugcuucccgggccauagcagggcgagaacccaguggggagugggcucuuuggcaggcugucggauacugugucuguagcccgccugccccaguggaguugagcuccaagagugccuaggccuacugucaccugcauggcugucauaccugcugcugugacgggcagggccaggaauucccgcuuguaccaggccacaaggcaagcaaggaugaguggccaggacucuguucugggguggccuagucaucuauugcuaaccuacaccccuuagguagaccuagcucucuccuccuauccucugccaccaagaccucaucccacggaucucccuuggggggcuggaacucucuacacugggaucaaagcagccuucaucaggagcagagucgccaaaugagcauaagccaggucucgaagccccaugucaccauucuagaagccuuuccugaccaccuaauucauagcuccugucccggguauuuggcauggauuuuuuuuaaaaaaacaauuauuuauuuuauguauaugaguacacuauagcugucuucagacacaucagaacagggcaucggauccuauuacagaugguugugagccaccaugugucugcugggaauugaacuaggaccuuuggaagagcaguuagugcucuaaccauugagccaccucuccagccccuggcauggauuuguuuguuuguuuguuuguuuguuuuugagacagugucuuguagcccaggcugaccuccaccuuacuaugaagcccaggaugaccuugaacuccuaaugcugggauuacagacgcugccagcccaccgggcacaguacuucauuuucagcagagaccgaguagggugguaaacacugaguacuacgcccaccaagauuucagaaaagagaccacagaagaaguaggugggaugucuguccgucaggagcaaggcagcagcugagcuggcgucaggcuuuagagcagcucaccauccuuccccugacuuuacugcaaaacaaacacuggaagccacuaaccgagcucaacaccccucugacccagaagaaccagggucaggggaagaagccuggcuccuacagccaagcccacaggcugcuucugucugcaaccacagaccugacccaaggcccaccaagcccaggaggaaguaggcagaagccaggcuguaucuuuacccuccuggaacucucgcugggcuuccagcacugaagaggcaggaagccagugguggccagggacucuccagcucccccagaggcacugcaauccccaguggggguggcagagacccagcauccagacugagcccgccagcacccuaacucuguucucugagcaaugcacacccucuuccaauggucuuccugugacucuuccagagugacugacugaucaguggcuccaagccuugaggagggagggggccucaagccuuggcuccugggccugcuuggugcugccgccugcaggacuugcaaacacaccacacuccuccauauuggccucucucuccugugcuacccaccuaaccacugguguuggccgguacagguuuaccggugagaaagggguuuccccacagaggccuguggaggaaguaugaagggaccagaagggcagcggcauuauguuugugucuuugacggagcagcguuuacauggacuuccugaccaccuggccugugcaagauacaaugccugccccggaugcaggcuccuuauugcccgacagacacucccuccagcccucccagcaucuuccaggccuagcauucugauuuccccaacccgccccaaccucagcuuaggcugcagggcuugauccugcagcuacucugauucucacagggcagggcugccuggggcagcaacacugagcaggcugagagggcuggagggucugagucacagcuaggucaaagaacaggaccagaaggaccagcugccacuccugaagcugggguuccaggaggagggaccaaagaaagggaggagccaguagcucccagccccacccugccacaggcuggcccugagagagcaggcccuuuguuccaggcccucgggagccacgugacaccugucacugucacugccuggaacggaggauggccacaggagcucccagagccacagagugggcucaaagggcccccugccacagggacagcgcaccaccccugccugcacaccaguguauaugauccugcccauucucucaggacgccccugucaucugcucuguucuacacaccaguggcccugggagaagguaccuggccacucacacaagccugcauggugucccuaggcccagaugcuagcgucuguggggguacuaccgcugugggagugucuucccgcccuucacagguuggggggggggcucugaagggugagagcccauuguuuauaaacaacugguagcugugacucagcugugacucagcugagugcugacucgcagagcuguuuacaacgcacagcauccugucccugaggcugacuggggacauggcucugcucuucuuuccugcugccugcugaccugacacucgggguccuaugggggagugagaggacaguuccucuccaggaacugggcccaucaucaagucaccccacacauguuccugugguccgugcuucacuggcuucuucucuggggccagggagagugcaggccucagcucuggccaaaaggccccgagcaguggugcuaucauugucuguacuccucagccccaaagcaaaauuuacccauagagggaguagauaccacaaagcccugguccccagucaggccaggcuuuuagcucuucucagugaacacaaaacauuuuccaccuagccugagacaaugcugaagccaccauaguuaucuucaugggaaagcuggggacagaagcccagagaaggcaaacaaucuccccaaggucacgaggccauggagaugcucagacccacucaggguccagggcugccugcuuucuuuuacucucaaucaaguuaaagaucagaaaauauuuaugccugguagcacugacaggugcagcaaggcugcaggguucaugucaccgagggcggcggucugccguggacaagccugggcugggauacugacuucucuuucuccuggccacugucuguaaccugcuuggugccuggagucccaacuacuaggucugaagggcaaaucuuucccacucguuccguaguuuaggucagugaccucggagagccuucacuuacaaaaaccacccaguguggacgucacugagucaccacaaugagccagggaaaaggcuucucacagccacgcagcagggccagucauccagugcugcuggcuguggcugguguccuagcugcucuucccaaaaucucuugccugccuuaaaaagaccaggaugccucuguccuugcggugucacccauggucaggaggagcaucucaggaacuccugggguuuugaagggccagagcuuccaaaugacuuaugggaagcuucauagagccauggguguuuuuuguuuuguuuuguucuguuuuuucgagacaggguuucucuguauagcucuggcuguccuggaacucacuuuguagaccaggcuagccucaaacucagaaauccaccugccucugccucccgagugcugggauuaaaggcgugugccaccacugcccggugagccaugggguuuuguugccuucuccuggcaguccagaacuggggaggccaagagcacagaagcacaugccacaccugccccagcauguggaagcugggcaaagccuaagaggaccaggagcaggcuggcagcugaggcccgccccaagcacagcaguaccucacaagagacuggcucaccacagggcuucccugugcuggcagccugcugccaggccucccaccaaccacugagucaugagauugccaagaaggggaggaccugagaauaagugcccgcccaagccacucccacuggcuuugggcccagcaggauccagcacugccaagaguuuaaggcuccucuggggguggggguggggagcagcugggauuagcucugccuccugcagccucggccugccccugggauguccggcaaguagccucccuccaacuggaaagauccaaguggcagcugugagcuaggaucuggacaaaauucuaagccaccugaugguuuugucggucuuuuucccuugcugguccuagcccacaaaaagcuaaucucugccucaggcaggcuguauguuuaaaagaaauguucaguggaaacacuugugauagggcaagaugauuuugugggccacuuguucagaagaauggcaccccaaagcugcuugggguugaucuucuuuuuuuuuguuuuguuuuuugagacaggguuucucuguguagcccuggcuguccuggaacucacucuguagaccaggcuggccucgaacucagaaauucaccugccucugccuccucagugcugggauuaaaggcgugcgccaccacgcccagcugggguugaucuucuaaccagaccuuuuugcuaauuaagagccaugacaccuggcuggagagauggcucacugcucuucugaagguccugaguucaaaucccagaaaccacaugguggcucacaaccaucuguaaugcgaucugaugcccucuuuugguguaucugaagacagcuacaguguacuuagauauuagauauaauaauaaauaaaucuuuaaaaaaauuuaaagccaugacaccuuugcaaaauguaaccaacauggugacaaaugcuacaguuucuaaaccuggucaguuuugauacuuaaaaggucaagggaucugaccaucuaggaccacagggguuccccaggcgccugaguuggugauaagcuggcaaacagagcagaugcaaacccaucucuagagcugggggacccugcucaguugacagagcgcugccuagugugcacgaggcucuggaucccaucuccagaaaugcauaaacuggacacaguggccaugccuaucaucuuggcaccugggaguuggggacaggggaagugggaauuuaagggcaucuguggcuacauauggaguuggaggccagucaggguuauaugagacccuaucucaaaaccaaaauuucacaauugccauaaaaauaucuaccucugcuccuaugacccuagggcaucauguaaacuucauguuugaaagggagaaugccuuggagggagaagagcaggguggacacagaggaggccacagcaacugucacaagccaggaagcccuaagcuucaugggcacagcagcccaguguccugcuucucaucuauguccacagcuaaagugugcuugaaggcagagaugccucacaaguauugagagcuaaggggauacacacacguauaacaguacacacaccaacacugcugugucagcuugaggccugccaggugggaugggaugggagccaggugccccuggaggacucugcucccggcauggguagguaccugacuuggcagacucaugaguaccugcauagacagguggaucugauuguccugguggcuccucuggcuuccaaauuccuggacucuagucguaauuccucaggguuacgagagcuucauggaggaggaagggugcacugucugcccaccugcuccagugaagguguugucuugccccagaggagagugaaacaaaacaccaaagcacaggaaggcaggggagguggcagccaggcuuucugggaagcaggcgcccuuuuccuuagaacaagagccaggugcuugccagaaaucaucuugcccugagaugccaagucagcucuggcucagcacaaggaccucccucuuuccuggcuggccagaagcaauuuuaggcagugggucucuggccacuggcuaacuauagguuguucuggugcagcuuggccugagcagagacacccgcaccaagggacagcggagagcugggagaggcugugggugaggggagcccacagccaggcucuugugcucagcaggccauggccauccaggguucaggaaccacaggaaucaggacaaaugggcccuuguggugcaggagacuguuugcugugccagggacacugcgugcccagagcugccaccagccugcagcucagggcugggaaguaggacugcccuuucagaaggaccucccgaguugcccugaccuaaagagggcuucagacuccaucuagaugccaggagauggcagcgcuggugccugcugcccuauuucccacagaacuuuuccaacaaggaaguuacccagccugggggcugguacugcuuugucccacccccgagcuaccugcuggcucucuacccauccugauuuuguuccuucuuuggugucuuuccagaagucaagacucucagaugcucauaucugggaaccuaacagaagagcaaacugccagucccccuuuccuguuggggccugccaggggcuaccuggucuccaugcccacaauaugauaacagaaugaccaugcacgccaggcacuguguagagcacuuccuagccacugaaaugcuggguaagcugagaaugaugaacauaugaacagaucggagaauggacacugaagcagcugagugugaaagcucaccuuccuaucccacagcuaggaugugacagcccucccugccucagcuacuugucccuucacauauacacuggcccagccaccuguaggucuguuaggucuggggacacacauuauuggaccacagaaacaagggccuggauuugcucaaaagugggcaaggguguccugaggcagggagaugucccgagccaccccagcagcaugcacacagagcacacacugaucugcaccccacacaaggcagcaaacgaugccgucuugaaggcccagagaccugggaagaggccugaaaggcacagcauuuuccccacacaacuaccccacaaggacagacugugacccgguggcucccucccucagugccuacaucuauagcuucugugcccagcaccuguuccuggcagggcugccgggagcagugcaggaagccagggcucugugaagggauuucccagcccugguugcuaggaaggaaauacucuuagaaucccaaagauguugagaauacgaaucucagccccuucccaggggacaccaccugcccacaugcucccuccagccucugguugucacucuggccacucagggcugcuccaagccaggugaaccaccuugcuuuuaaaauuaaaguccaaucuugagcauggauguucaguucagaggccugaaacuggccccggggaagcaguggaugacggcaaggccacgucagauggcucagacaauagaccccaccucccggggucugcgugggaauauuuguggauucaauucagagccugcaaguguccuugccuguugccuguucuaagagcugucccuucuggagaauccuguggcuaucugccuucagauacucccuguaccuuuggaaggccugcuuguguggugucaggugucugagcacccucauauacacuuuaagucuuuaagccugcaggggaggucaugaaggcuugggguuaaagggcuaagucaggauucucaucugccuggcuucauccuccucccuucugacuuccagacaagccagaccugcuagcaccucccccuccuugugacaaucagggcugggccacagucaggcaaggguggauuccuuugcaauggauuucuuucagguggggagaaccccaaggacucaaaaucauuucuucucugcccucccaguuugaacuuuuguuuuguuuuauuuuguuuuuugagacaggguuucucuguguaacccuggcuguccuggaauucacucuguagaccaggcuggccuugaacucagaaaucuaucugccucugccucccaagugcugggauuaaaggcaugcgccaccacugccgggcccaguuugaacuuuacugggcuaucucaccuacccccagucucuugggacaugucaccucuagggucaggauggaauccgggaagagacagaagaggagguagguuacacaggcccaccucuccucaucuccuuuggcaauaaagggccuugggcagugcucaagggcaacggcucagcccucuucaggggaacagacucuggguuucaacucagaggaggcgagcagggagaggacucaguccucucacccagccccgcaagagcaagaagccucagcuccuuaauuaugcacccagucuaagggcagggcuacaaggccaguccaggagguagccagaggccaccucuugcuagacugugucccugaacagccuucuuccagcacaggguugggcuccacaaaugaacauagcagcaccuaaggggaucuauaguuaccuauucccuugcagggaggccaggagugggaauuuccuuggagaaagggaaaggggaaggagagagaacacagacagguucugaaggaugguagcaugcaccuuuaucccagaacguaggagguaggggcaggcagaucucuaugaguucaaggccagccugaucuacauggugauauuguucuaaaaaauauacaaacaaacgaaaaaacacugacuggcuuagcaaucauuucaggauauuuaauacuaaaaccucaagcccaguguccagcugcccagacugugugcuggaauccaguuaccucaaccucaaacccuggaaucuaccagcggaggcaggcagacucagccacgugcaggcccugggcccgauuucccacaucccaugcaaguccccaaacgugacauaacuuacggggcaguauugauguuuaaaguggugagcacacagggaaagggacagaugagccagagauggagaaacaggucaagaggaauuaugcuguggucagccggcuaguuagucucaaaguugguuugagaccacagccuuguauuccaggagcuccaggggacucuuggucuuugccacaccugggaugcugccgugccccaggacuagggaguccggggcuacaggguauuuguguuguuaaaacaucgugccugucccucuggaauggccggcaccaggcuacaauugacuguacagcugauucugaaucuuucugacauucuaccacuguccaauugucacucggauaucuagaaaauggcauugguugcuaagggacuggccugaugguaggcagcugcagcuugggguaauaggaagagggaguagacugggguuucucucaguaaggauccuggggcugugggcugcuaggcccuauauggagguguggguggaucaaccacaggagguaaccacucagagcuaagagccacacacaggcggugggaaagccccuagccgggagucuuccugcagguauuuugggggacuaugguugcuaagcaacuguacuagguugccaugggaacucucccuucuucugggacuugucauuuuuauggagaugccacauuccuucccaucucuaccuccucaggcugucucagcuaccuguaaggggcccuggaggcuccccaaaccuaccuuugccuacaaggaagccaccuauccaagaaaguacuaugccucuaagacucaguuuggggguguguguguaggggauucaggucucacaguguaccucaggaugaccuugaacucauaauucuccugccucagcugggauugcagucgugcaccaccccgugacccucuaagagaggauucucuugagguucaagacccaacacagaaagcagaguugaggcccucauuagagucagggggaugaaaaaaaucugucuagcuugguuugcaucuccauuccugcuaaccaccaacucaggcucuuccugccuugacagggcucugaccacuagaagcccaguauaacuggaaggcauucuccgcccuagcccuggugccuggccccucccuggcuugucuguaaaggagugucaccuggggcuugccauuacccaaccagggguuguccccaugcccagccaaccaguguuggcagcaggccaugcuggguagacaugccuccucugggacaggcuaaggcuaaggucccugccagccauguguuguauaagcagcucaccuuucccuaaaacuacuucuuguggccugugguaauagguaggggagcugucuggaaacugcaguaggccaaggcaacuuacuggugacgagccagagggaggcaaaguccaggccccaagguguguguguuggggagagggggugggggagaagcugaggucuccucagugguuaccagcaacacccugcugcucgccugcucucauucugauuuccuucagugugugucaccaaggaugacuccugaccuguuuacaguuugcuuugucuccuggcaaccagaugagcuuuuguggaaacucgggacagggcagugcaguacugaacuuccacaccagagguuacagcgccaccugcuggugcuaccauugguggccuucaagccuuccuacacaggugaaauucugccagauccuaaggaaccuggccuucccuauaacccuccucacaggcucagcuguguccuuccaaaagcccuuggguccugcagauccaggcaacacaaggcuagacugggauggggucaggucagggcucacucucucacucucacacacucucucucucucucucucucucucucucucucacacacacacacacacacacacacacacacacacacacacacacacacacgauguccuuacaguaauggagacaaccagacacagacacacagagacacagacacacagaggcagcuguguggaggcagaggacuacagacacguuuagggggauuuaaagcuaaggacuacagccaugccagaagcugugguucagugguguugaugccuugcuuuuaggcuucuguccucuagaaccacgagagauuucuguugcacagggucauccaguauauggcauucugcuagagcagccacaggacacuaacacaacguaccaggccugucaccuuuuugucaccgucaugccuaccucgcugacucuugucucgcucccugucagcuuucugcacugcucuuccugcuuucucucguguggcugaccuaugagaugcacaagcacauggaugaauggcucuccagcucugcuacuucaccaaguucagacaaccguaaaagucagaagcuggggaaauggcucagagguuacagggccaggaccuccacgacucaggcaaaugccugauggcuguggcuauccagacagauauaaaucuagccucaaaggauagagacggaaucuccagagcaagcuggccagcaagcccagcccuauuaguugagacccugccucccucaaugaucacagcaccuaccauaugcaugugccaacacaugcaucuacgcccaguguguuggaguucccagcacucggaagaggaugucugugaguucuggggucuacacagugaguuccaggauagcuagugcuauguagagacccagucucaaaacaaaugaaccaaaacucaugcacaacauauauacacauauauguauaacacacauaccugaaaauggaagaggaaaaagucaagagacagcagcaggugugcagaugggggguggggugggguggggugacagcaaugaaggcaauagcaggugaggaagaagaugcuuccugcugcucauggccacccuggugccaggacaaccaaccucuguguuuccauaucccuggcccuucgaucucaggaggcuaaaggccaugugagucacccaucucuguccuuuguuuuccucucaaggccuaccuggucucccauaagcacaguggagacucauuccagcaccuacuugaccguguguguguguguguguguguguguguguguauguguguguaagaugacaccguaacacuuggggacugcugucagcugugacuaaaacacaaccuuaagaguuggaagaauuguggguggggauggagaguggcagggauauaaacuacagcaagccuggcucugggcagugguacagggacagucauguccucucuuggucuccucucccagccuacacacuggagggucgacagguaagcaaagucagaugugccccucuggcacacaccucccauuggccugcaugcuaacucuucugcucagcccauacaucaacccuaagccgccggccgauccccaccagcccuaaccccauccccugaagugggcuggaacugacuagcuuccaacuaacaaauaccaugaccacaaggucacggccaauguucuguuuagaaagcaucuugugucuuacuggauuucuuguuuccuccuggcccuccgucuucccuguccgacucugaggaggcggcagguucugauguuaugagccguuuuacagaaaggcagguccacauggccaagaagccagagaggucucauggucaccguggauccugccaaccacagcaggaugagcuccaaagugguucuucccagcugagccagcgugggucuuguaacaugaaauggauuauuaucaaggucugggggccguuggcugugagucaggggcagauucucacaccucggaggauaaacagaacaucugcuucuccucuuguauucuuagguguuuccuuuuuuugggggggagcaggggguucgagacaggguuucucuguguagcccuggcuauccuggaacucacucuguagaccaggcuggccucgaacucagaaauccgccugccucagcuuccgagugcugggauuaaaggcgcucgccaccacgcccggcucuuagguguuuccuaagggcaggaccuaccuacagccgucauuuuaagagccacacccaggagcaagguagccacugguuagaguucaggcacgcaaggcacuacgggaaaagacaagaggaagccagggcccuuacacccaacucacucugaggacagggaugcuaguugggggaggccugaaagaguggaacacacaacaccgaaagaaugacucuuggaacucugucccccucccccgcaguugcuccauugacuaaaaggauacugcugccccccaguggucaguaccagcacuacagcccccaggcaagaaacccugaaaacaaaacacuaccuuuuguuugcggguugucaagguagcaggucucccaggccccagcugggcaaaggaacaagaccuguauguuucagggguuaccacaaagaccucaggagccucauuucaccccucuuuccuucugauggcucugggacucuggcucacucagggggccuccucuuucagucuaggcaaugacccugaccccauuucaaauaagaaucacacauucuaacuaggguggucuuguccuuggauccuggaggaauggucuagaguuugccucccucuaguuacucuggccuuuaagucacucaaacccuaaggcugcuuagcaaguccaccagggggaaggcauuuuccuagaauuuuuaugggucauuguaggagaaccaaagccaaaagacauuccacaagccccugaaacccccgggggcggggacgagucacaagggccaagcauccuaaagugcaaaggaggaaacuaaugucuccucagcagccuccuccacacuaaggaccuccgcccugcccuccaggccagucugaggauggccccagacaagcaaaccccaggaaucuuaacaucucucgguccaucagcgccucucguacuaugggcacccccaaauguugcuaggagacuggacgccucagccccaagacagggcugccuucugccucuuccuucuuccaccucaccacaccaccuccacugucccacccuuccucggaaaccuaggaagucuguagaucuaucgagagugaguagggggugugcgcucguguuuggguagguuccacaaggaggggguuagccaguguuccccaggaccucaggagauucauuccccaagcaaacccuacgcgaagguugagcccugaccccacgggccggaagccuucccuucuccgcugguccccgcccaccuggcaugccucuuuccagaccucaguugcucgauuguacccgguuggacagguuggacgcggaacagcguuaagugcacgcucugcguggacgcucgcucuccgggugggugcgggcuucauucacacccacugguacagggccccaugucgacucaccuggcaaucuaccaucauccucagccucggcagcucaucgccagccccagggcgcggcccagggcucgcagaggccgcucgccucggcccgcgcgcggcgcagcggggcguccggcugcggggcucauggcgcggccuccgguccucgccaggcccggagcuccgcggccuucgccaaugccgcuuccauugucugcgccgcgccgcgccgcgccucgccucgccucgccucgucgcucuccuggccguuggggccucgcugcucgguuccgccggagcuccgggagcucgggacgggugggcggagacagcgcggccccgccccggccccgcccagcucgcccgcaggugcgaggggcgggccccggugcgcgagcucgaggacacgcucggccucuuuccccgccggucgcaggcgauuagaccugggacgucgg

SEQ ID NO: 725 - RNA, 1292 nt, Mus musculus
agcucacauuucuuuuuuuuuuuuuuuuuuuuuuuugggugcagcgaacuuuauugaugguauucaagagaguagggagggcucccuaggccccuccuguuauuaugggggucugggauggaaauugugagggagaugcucaguguugggggccgaguugggauagggccucucuugcucaguguccuugcuggggugggugguccaggguuucuuacuccuuggaggccauguaggccaugagguccaccacccuguugcuguagccguauucauugucauaccaggaaaugagcuugacaaaguugucauugagagcaaugccagccccggcaucgaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagauccacgacggacacauuggggguaggaacacggaaggccaugccagugagcuucccguucagcucugggaugaccuugcccacagccuuggcagcaccaguggaugcagggaugauguucugggcagccccacggccaucacgccacagcuuuccagaggggccauccacagucuucuggguggcagugauggcauggacuguggucaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcggagaugaugacccguuuggcuccacccuucaagugggccccggccuucuccaugguggugaagacaccaguagacuccacgacauacucagcaccggccucaccccauuugauguuaguggggucucgcuccuggaagauggugaugggcuucccguugaugacaagcuucccauucucggccuugacugugccguugaauuugccgugaguggagucauacuggaacauguagaccauguaguugaggucaaugaaggggucguugauggcaacaaucuccacuuugccacugcaaauggcagcccuggugaccaggcgcccaauacggccaaauccguucacaccgaccuucaccauuuugucuacgggacgaggcuggcacugcacaagaagaugcggcugucucuggaacagggaggagcagagagccaag

SEQ ID NO: 726 - RNA, 1292 nt, Mus musculus
cuuggcucucugcuccucccuguuccagagacagccgcaucuucuugugcagugccagccucgucccguagacaaaauggugaaggucggugugaacggauuuggccguauugggcgccuggucaccagggcugccauuugcaguggcaaaguggagauuguugccaucaacgaccccuucauugaccucaacuacauggucuacauguuccaguaugacuccacucacggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccggggcccacuugaaggguggagccaaacgggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaacuuuggcauuguggaagggcucaugaccacaguccaugccaucacugccacccagaagacuguggauggccccucuggaaagcuguggcgugauggccguggggcugcccagaacaucaucccugcauccacuggugcugccaaggcugugggcaaggucaucccagagcugaacgggaagcucacuggcauggccuuccguguuccuacccccaauguguccgucguggaucugacgugccgccuggagaaaccugccaaguaugaugacaucaagaagguggugaagcaggcaucugagggcccacugaagggcaucuugggcuacacugaggaccagguugucuccugcgacuucaacagcaacucccacucuuccaccuucgaugccggggcuggcauugcucucaaugacaacuuugucaagcucauuuccugguaugacaaugaauacggcuacagcaacagggugguggaccucauggccuacauggccuccaaggaguaagaaacccuggaccacccaccccagcaaggacacugagcaagagaggcccuaucccaacucggcccccaacacugagcaucucccucacaauuuccaucccagacccccauaauaacaggaggggccuagggagcccucccuacucucuugaauaccaucaauaaaguucgcugcacccaaaaaaaaaaaaaaaaaaaaaaaagaaaugugagcu

SEQ ID NO: 727 - RNA, 1340 nt, Mus musculus
gcauuuuuguuguuguuguuguuuuuaaugaaaaggauugauuuguccaaguucguauuuccaaagccguagcgauugcccggcuggagcgcaucauuccccagcuucuggguuucuggcagccgcgggaggaagcacagcccaucagucgguccagaggagcuugugggagggguugguuggcugguuugggauaugcggguugauuucggguuuguuuguuuuuuguuguuucgggggacuggucaggggacagguugaaacaaauucaaaacaaguuagcaaaagaauuuugcugucguaucccuucaaaccccccccccccaacugcgguucugaccaaggaccggccgcacgaaccacauucgggucccggucccgcugcuguaugccagcuucguucuggccgaaauuugaaagugggggaaacccagcguaaucgaccggaggacucugccagccgacacgggucacccgcagaggauacggaaagaggcgaggaugaggauggcggcgccgguggcaaggacuuuuguccccucuuugcaugccagucuggggccacaaugaucguucugggaccugccggcugcucagggguucucccagcguggaccucgucucuguagagcccggagcucaaccacagauguccagccacaauucucgguuggccgcagacucguacaagaauugcguuuggacaaucaguggcgaagccccugaguucagggccccggucccccucuggguucugccuggcuccuuaaaagcgcacaccagaucucgggagcugcguaucggaauaccucgcagaagcucggcaaucgcagcccgucccgcgguaagguggacaagccgguguccagaucccggcccugcuagggcauccccaucgccccccagcguguuuccuuccaucgcggccaagggucccuagaguaacccgcguugugucucugggcugccccagcuuggaggaauacccugucaggcccagggaaccccauuucccucuccccgcccccaggcuggguucugggaauccggaauacuggggcccgaggccgguagcaucucuugagccccgggucugggaugcuggacucgcggggcccccuccccagccuggccccgcgcacgcaccggcucaggcgcucucugcuuccuuguggcugagucgcggguggugguagccugggcagcggggagcgccggaaugugccgccgggucaccugcagcgcccagggagccggacugggagccggcgugcuggcgaggcgcagggcugaacccaagcgggcgccucuggcggcuuggggccggggcgggcuuuuag

SEQ ID NO: 728 - RNA, 3017 nt, Mus musculus
uacucucuuaaguuuuauuugauagguauuuugcccuaguauauguaaggcacuguaugugugucuuggaacguagaagagauaaugucacaucucuucacauuuuggaaacgguuucucuguguagcccugacuguucugggacucuauagaccaggcuggccuugaauucacagauccugagugcugggauuaaaaaggcauggccaccacuugcaccaccauguguuuguuuguuucuuuuucucuuuuuuaaaagguugagugucuuuauguugccugaucugaucuugaacuccucuuccagaagucucagccuccccaguagcugggacuauucaggcacacagcacacaaaccuagccuucuuuauaacuuaacauucuaacccaugccuuuuucaauguuagaaauucuucaaaaccaucauuuagacuugggcagguaauguuuccuucaggagggucuagagugguugauuccugggcaggagcucuggguugccauugcagugugucggcucugccagucacuuuggcagucagcaaaacuccacagagcaaauaaguacacuuccguccgaggcuuggccuuagcagcuuaucuaucuuucacuccuuugcaucagaauccaccucauugccuggagaucacaccaccaucuucagaaaagcuggucucggugaugcgauuaagugaccuuucuacagaagacgacgauucaggucacuguaaaaugaaccguuacgauaagaagauugacagucuaaugaacgcggucgguugucucaaaucugaggugagggagcugcuaggcugcauagcugguacccugaggacaagcagguugggcuaaacugguuagccuguggaugcuucccucaggcugccucugugagccuucccagggcaucuauuuggaguggucagcaggcagcuuaaguuuccaccaugcugggagcccucucugaauacuuggcuuuucugguacucucaguggguggccagauuugguucugguguuagcccuuguuuguuuguugugugaggcaucaucucacuauguagcgcugguggccucagaguugagcuguccucuagugccuacugggggcugcaguuuuaggagugugccgcucccuggcuuagugcuuccuuccacccagauacagugucuguaaaacagagagcacagccugugcuacugagaaaagcugaacaggaguagaggagacaaaggaaaucucucuucacacguggcagggauacuuguggggagggagaugggaauggagcuggaaacagccaacacguagaccccgacuuggaagcagggagugcuggcauuaaaagccagguccugacugcuaagguaccugcgucuuuuuaacucuccacucuacuggagguucuaagaccuggcaaaaggcccucuuaccccauagccacuguacuuuuuuugugacaucuuuccuccuguggcaugccaacugcacuacuguugcugccuggccccacccuggcuggcacgcaucacgcuuuguauucagguucuucauguaugccuggaggaggaggacaggcaauguuuguguggcuguuuacugggacaauguccagaagcucccaaacacagagcccuaucacuuuccuuaguaggguuacauguagcaauggaucuucagggacaagccaucuuuuuggcuucccuuuccuguauccccuuuccaaggucaagaugcagaaaggugaacgccaaauggccaaaagguuccuggaggagaggaaggaagagcuggaggagguggcacacgagcuugcagagacggagcaugagaacacggugcucagacacaacaucgagcguaucaaggaggagaaggacuucaccauguaagggaccaggcggagucacaccuuccugcuggcccagagcccuggaagcaaagugaagacaguggcgggaggcaacucuaguagugccuguggggagccagcacagcauauggcugucccucgagggaaagaaggucccaguggugguggugugaguaguagacagagaacuccuuuaaacgggcuguuggggaaacaggacugugggguuaggcaggcauuggaagaagaaauguggagaacauuuuguggggagacccaggguagacaucauuuauccugagcaguaggaugugggucacggcuggcugcagagggugaaagcugccacagagauugcagggcuuggagugucggcaugaguuuauauauacacacuuguaaggauagaguccacagccugaacguagcaugcuuggugcucuaccucucagccacacacaccccacccccccaggcugguugguaacaccuugaggauguggggaacauuuaaaagcugagccgugauuaggcaccgucguauauguuguagacaaaguaacaggucguagguccagcaggauugggaauucaagcccaauccuucagacauagcaaguucccaauccagccauggguauuagaaacccagacucaaacggccagagcaacugaugagaaggggugagugagcucaagaccauggaggugguccugauagucaaggccauaggucaugccgugggaccccuugguagagcuuuugcucucauccugaagcagguaugucucugggcccucauccuuccagaaggcuaccuggguaagaagggcugucuguuccucuuccucauuguuucucggcaggaaacauuucucaguguuucuugagggagucucucaggccauugugagguggacaucagagcucugggugggcugggcccuacuggcucucaggauuccuguuuuuuuuuuuuuuuuuuggccccaggcuucaaaagaaacaccuccagcaggagaaggaaugccucauguccaaacuaguggaggcugaaauggauggagcagcugcugccaagcaggucauggccuugaaggauaccaucgggaagcugaaaaccguagguggagccgau

SEQ ID NO: 729 - RNA, 3017 nt, Mus musculus
aucggcuccaccuacgguuuucagcuucccgaugguauccuucaaggccaugaccugcuuggcagcagcugcuccauccauuucagccuccacuaguuuggacaugaggcauuccuucuccugcuggagguguuucuuuugaagccuggggccaaaaaaaaaaaaaaaaaacaggaauccugagagccaguagggcccagcccacccagagcucugauguccaccucacaauggccugagagacucccucaagaaacacugagaaauguuuccugccgagaaacaaugaggaagaggaacagacagcccuucuuacccagguagccuucuggaaggaugagggcccagagacauaccugcuucaggaugagagcaaaagcucuaccaaggggucccacggcaugaccuauggccuugacuaucaggaccaccuccauggucuugagcucacucaccccuucucaucaguugcucuggccguuugagucuggguuucuaauacccauggcuggauugggaacuugcuaugucugaaggauugggcuugaauucccaauccugcuggaccuacgaccuguuacuuugucuacaacauauacgacggugccuaaucacggcucagcuuuuaaauguuccccacauccucaagguguuaccaaccagccugggggggugggguguguguggcugagagguagagcaccaagcaugcuacguucaggcuguggacucuauccuuacaaguguguauauauaaacucaugccgacacuccaagcccugcaaucucuguggcagcuuucacccucugcagccagccgugacccacauccuacugcucaggauaaaugaugucuacccugggucuccccacaaaauguucuccacauuucuucuuccaaugccugccuaaccccacaguccuguuuccccaacagcccguuuaaaggaguucucugucuacuacucacaccaccaccacugggaccuucuuucccucgagggacagccauaugcugugcuggcuccccacaggcacuacuagaguugccucccgccacugucuucacuuugcuuccagggcucugggccagcaggaaggugugacuccgccuggucccuuacauggugaaguccuucuccuccuugauacgcucgauguugugucugagcaccguguucucaugcuccgucucugcaagcucgugugccaccuccuccagcucuuccuuccucuccuccaggaaccuuuuggccauuuggcguucaccuuucugcaucuugaccuuggaaaggggauacaggaaagggaagccaaaaagauggcuugucccugaagauccauugcuacauguaacccuacuaaggaaagugauagggcucuguguuugggagcuucuggacauugucccaguaaacagccacacaaacauugccuguccuccuccuccaggcauacaugaagaaccugaauacaaagcgugaugcgugccagccaggguggggccaggcagcaacaguagugcaguuggcaugccacaggaggaaagaugucacaaaaaaaguacaguggcuaugggguaagagggccuuuugccaggucuuagaaccuccaguagaguggagaguuaaaaagacgcagguaccuuagcagucaggaccuggcuuuuaaugccagcacucccugcuuccaagucggggucuacguguuggcuguuuccagcuccauucccaucucccuccccacaaguaucccugccacgugugaagagagauuuccuuugucuccucuacuccuguucagcuuuucucaguagcacaggcugugcucucuguuuuacagacacuguaucuggguggaaggaagcacuaagccagggagcggcacacuccuaaaacugcagcccccaguaggcacuagaggacagcucaacucugaggccaccagcgcuacauagugagaugaugccucacacaacaaacaaacaagggcuaacaccagaaccaaaucuggccacccacugagaguaccagaaaagccaaguauucagagagggcucccagcaugguggaaacuuaagcugccugcugaccacuccaaauagaugcccugggaaggcucacagaggcagccugagggaagcauccacaggcuaaccaguuuagcccaaccugcuuguccucaggguaccagcuaugcagccuagcagcucccucaccucagauuugagacaaccgaccgcguucauuagacugucaaucuucuuaucguaacgguucauuuuacagugaccugaaucgucgucuucuguagaaaggucacuuaaucgcaucaccgagaccagcuuuucugaagaugguggugugaucuccaggcaaugagguggauucugaugcaaaggagugaaagauagauaagcugcuaaggccaagccucggacggaaguguacuuauuugcucuguggaguuuugcugacugccaaagugacuggcagagccgacacacugcaauggcaacccagagcuccugcccaggaaucaaccacucuagacccuccugaaggaaacauuaccugcccaagucuaaaugaugguuuugaagaauuucuaacauugaaaaaggcauggguuagaauguuaaguuauaaagaaggcuagguuugugugcugugugccugaauagucccagcuacuggggaggcugagacuucuggaagaggaguucaagaucagaucaggcaacauaaagacacucaaccuuuuaaaaaagagaaaaagaaacaaacaaacacaugguggugcaagugguggccaugccuuuuuaaucccagcacucaggaucugugaauucaaggccagccuggucuauagagucccagaacagucagggcuacacagagaaaccguuuccaaaaugugaagagaugugacauuaucucuucuacguuccaagacacacauacagugccuuacauauacuagggcaaaauaccuaucaaauaaaacuuaagagagua

SEQ ID NO: 730 - RNA, 14182 nt, Mus musculus
cuucccgggaaguuucaaguuugaaagucaggcacugagacccgggcuuccggaaccgcaguggaggagaggacuggcgggcaaggcgccauggagccggagggggcugugcgccaggugaaccaagcgcacgcagcgaccguguuugcaacucugagcacacggugcucggaucuucacacuauucuggccucucugccugagcccuggguuaagacgcucuggugcccagguccccgaagugacggagauccagcccggcagcacgccuguuaccguggaauaugccaccggggguggggguggggguaagauaggucaaguucccuaaaauucgaucuucuagagacuugcaggaaggugggaauuugccaggagcgcaaagguuggaguauacagccuuccaagaggacugggggagcggggaggggguggggggagcggagggacggggaacggggacaagauugugcgcgcagugggcguuguccccaauacaccacacccacaggcuagaacaaguuggccacuagagggauuuggcucagcauugugcaaggaacucuuggguccaacgagggguccacaauguggagagguucggguuagaugugucacuuaagcaggagagagagauacuguucuaugccaggacaguuaaaggugaggugagauguuuauguagaagauaacacccuagugucaagucaggacuugaggggaaggugaagugcaguagacuggagcaccgcagcccucaggcagccugaaaggcuggaucucaccccucccaguacccuuccuccggagauccuucucggccugucuagcuuauacacauuuuccgauuuccugugagccuccgcccugcagcagcggcagcgaggugacucaggaccccgguggccagcaggcccccagcucuguaagagcuuuguuugcucaggccuuuggcucuggcccuccugcuuggggcagccaaaggauuuccugagccucgcccuugcccucugacaguuaaggcaggacgaucaaccuagcugaggccuggggccccuaaacagaguagccauucuuucauggggcuuaggagauggaacaccgaaagguaaggauaaaauaguguggcuuccaggauccuggggauaggaagggggucagcaggaguugcucuggaauaaggucagccuccgagaaguuuucucucccugccuuugauggugccucuaaucuggugaacagcuguagcuccugcuugccacuucugccacagcaccugucugccacacuauguaaggcaaaagaaauaaguugugguguuuugggccacuggcugucuccugcaggggaccuagagugaauucuuugccuacauuaccucccagguuccgguugcuucucagaccuagggagagcaguguggcaggcugggagaaaaugggaucacacugucccucgauccacaguggccacuccucuguguugccugugugagcaagccaccuaacucuucuuucuuuguugcuccuguauaaaauaggaaugagagcuaagcaugugggucugugucagagcucuuguuuagcacgcuccaggcuguggcuucuuuccccaggaccacaaaagagcgacuacuaccaaggagaagggaauuuaguguguuguuagaguguaaaccucaguacccagaaggcacugggcgaaccuggucuguuuucucucucccuucuuugaaagggagacaggagcuagacacugcaggguucugagacacucuggggcucugccuuuuguaucuguucccucuuugcuguggagcaggguaggcuaagacuucucugcccuuugcagccugggacuggccagagagcccccaaggaugagaaagagaugguccgccgagccauccagaaggagcugaagaucaaggagggcauggagaacaugcggcgcguggccacagaccgacgccaccugggucaugugcagcaacugcuuagggccuccaaccgccgccuggagcagcugcauggcgagcuucgggagcugcaugcccaaguucugcugccagccucagccggugagcgaggagucugaauaaaccugggaacgggagacucacgaacacaauccuggccuuggcuuugaccacccuauaucauccacauguugucuauacggaagggaagggaaaaaggcaagcgcugcuuccccggggucugaacucuagccuuguguugcagagccagugaccucggaaccccagccgcgggcggagcaguccagggcucggcucucggaggcuuuacauaggcagcugcagguagagcuaaagguaaagcagggggcugagaauaugauucacacgugugccagcggcacccccaagguaagggcuggcgucugaugaagagggguaggccuggcuucucaucuaccugaugggagagacguagcucucagguauaaggaucacaaagccagccagacccugugccaacagggaaaugcuacccuggcccagcuccucaccuaaugcuagaaguacagguaggugggugaggcaagucucugacccacacugucagcaaagcccaacaacagaaggcuagcggaagauccagccggcugcccguccagcucuuggcaaccuacccucucuucuccaucugacagaauccuuacuacuuagcuugucaaacugaugagugucagguuccgcucaccccgccagccuccaccccccauuaccuaguucaacaagggaggcuugccuguaguaucuuccuuguaggagcuugaaccuugguauaacaggggaggcucagccccacccaggcccugguggucugccguaagccccuucugauggggcgagugucaccuccccaggagaggaagcuccuggcggcugcccagcagauguuaaaggacagucaacugaagguggcccugcuccggaugaagauaagcagccuggaguccaguggcucuccagagccaggugaggccucucaggucagggaggguggcccucgauggccgaggcuaaggguucaccuccgcccugcaggccccgacuugcuggcagaggagcugcagcaccgacuucgaguagaggcugcuguggcugcaggugccaagaauguggugaagcugcuugguggccagaggaugcaggaccgaaaggcacuggccgaggucaggcuguguccccggcucacugcugucucuacagcucuguuugggucuauccacaugcaguggggccugcacccaggguugcugccuguggaggguaguagugaauacccaugagguguggccugaccccuuuaacccauaccugguguuugugucuccuugguaggcccaggcccagcuccaggaauccucccagaagcuggaccuccuacggcuggcccuggaauugcugcuggagagguugccucccacccacucucuacguagcagggugacccaagaacuuuggauggcaaugcuugggaacccccaaccuuuggggacacuugugaaaccuauugccuugacagguagguagcaaggauucccuuucacgucagagggucccuuaccuuuuagagaggacgcugaagcauuugggagagaguucaguccugcugugugaccuuggaucccucauguucccacucugauucuugguuuauccaucuguaacauagauucaauaguagugacccagcaugauggcgcacgccuuuaaucccagcacucgggaggcagaggcagggggaugucugugaguuccaaccuggucuuuagagugaguucgaggccagccagagagacaugggagagacccuaaguaaacaaaggguggaagugcucuccugauccacaagauaguuuuguaaacccaaaaguuucugauguucagaacacacuuggagccuggccagcguggaugggauuuaaaugcccggccuucgguagggaguagauugacaaucaguccacucccuggcagccuuggggccugggcagcuuggacuaccuguaaguucuuucaugaggucuguucuuguagcagcagcugacuggcagucaacagaucaugggagcugcaagcuagagcccggcuggugccugcuucagaacacaauagauagggcuagacagagcucuguuacuauuaucuuggauaaucaaggagggcuccuuagaacaggggggagucugagcuuggccuuggagggcucucgggagugcugauggccaagccagcaaguccggcaagacaaaaggagccucuuguuuaaaggcaaagaauuggggacacguugauaaaguucuuucuuacugcguaugagguccuggguucagucccagcaccaaauuaacuggguaugguagcacacaccuacaacccaacccccugggaagugaggcaggaggaucaggaguucaagggcaucuuuagcuacauagugaguuugaggccaacuugggcuaacaagauccugcuuuuaaacaaaaacauuugcuaguuuguagccgaacuuccauuuccuaagacaaguguauugccugggccgcccuugguauuucuguaaggucuccaaguauuaccuccagacccagccuaguaaaaugguguccucagagccgguuuaugcccucaggagcuccuggguaucugcugcuuccuccucuuguccucuacccuuggagacaaaacucucagugaucuuagacaaaacauguuuuguccccauugggggcucucccucgcugaucaggugggaaggaauagggcaggcagcuagagugaugcucgggugccugccccugugcacuugagaccauggugcccaccagacccugagcucaagguagcaguuucccucauccuguggcuuuacaaagcuugggagaaguccuguucuuacauuccugcuguguucugccacugcauaggcacucaggaaggagagcuagccgggcugcuaaggaugcugggugguaacuaagugugguagguaggguuuagaucggcugcuccuagcucugacccuccuagagcagguggugucccucugggguuccauuggugguggcugcugacagagggcucucuugacucccaaccagggacacugcagguucgccuccugggcugcaaagaucugcugguagcugugccuggacggucucccauggcuguccuggcagguagcccuucugaaagcuggcuccgaacaaggucccggcagcagcgugguggaggcgaacuggccagugaguagggagaaaccaugggagguggugaggcccccugcucuggccaugcccuaaauccaagcccuggcacuacaggugagguacuggcuguguugaagguugacaaucguguugugggccagacaggauggggacugguggcugagaaauccugggaccagaguuuuaucaucuccuuggaccgaguaggcuggccuuugugugguuaggguuagcugugggguacgggggggggcacucaggugagggcugagccugaucuuuuccacauaggcucgcgagcuggagauugggguucacuggcgggacuggcgacaguugugugguguggcguuucugaagcuugaggacuuccuggacaaugccugucaccagcuuucucucagucuggugccucaggggcggcucuuugcccagguuccuacugaccccugaccucuaacaggggaucuuuaggacugacauuuuggguuggggugauggcucaguggguaaaguguuuacuguggaagcaugaggaccugaguucaaauccccaggaucuguguaaaaaccauguguggcuuggugugucucuaaguucauggcuggccguacagagacauggguucuccagacucgcuggccagccaagucuagcugaaacagugaauuccagguucagugagaaacccugucucaaaaauaagguggaagggcagauacccaguguggugucaaccucugccuacaucagugaguacaacucugugugugugugugugugugugugugugugugugugugugugugugcaucugugugauaaaaacugguaauccauguacuaugggacuugagagauggagacagguucacagacaggccuacagggaggcucacaucucuacacugagcuuguccugccucauaugucaucuugaauacguaaaugugucuccucugggccucaguuucuccccuggcccccgugaggauacgguaucgugucuagguccucugaguuuugcuucauaucagcuuugccucauuguuccgauaaaacaccggccaaagcaacugaaggcagggaaggggugauuucaauuuacagauuuacagccaacccccucccuacucuucucccacccccccccaccccccaccgccuucuuuauuuuuucugagauaggguuucucuugcagcccuggcuguccuggaacucacucuguagaccaggcuggccuccaauucacggagauccaccugcuucugccuccucagagcugggauuaauggugugcuccaccaccgcccaguuuacagccuaucuuuacgggagccaaggcagaaacuuaauaagcaggaacugaaagcagaaacuggggaggaaccguuugcuggcuugcucucugccucucucccaagcucaugcuuggcuagcuuucuuauauagcccaguaccacuugucuagggaauggugccucuaacagugugcuagauccuccuacaucaauuaacaaucaagacccccccccagacaugcccacgagccauguaaucuaggcagucccucucggaugggucauauggaaaguuagcacuaacuagaauacccccauggcugagauugggagcuggcgcugggggugggggaguggggauggggguggggacggggacgauccagcagggugaaaggcggccagucuccaggucuucagcuuucuucaugucccuuuaggucaccuucugcgagccugucauugaaaggaggccucggcugcagaggcagagaugcauuuucucuaagcggagagguguggagcauacggacugugugaggagagggcugggcugaccaauggggaugcugggacugagccccgccugccuccucuaggccgggauuucaugagagcuucccagaugaaccucagcauggcagccugggggcgucuggucaugagcuugcugccccccugcagcucaccaaacacagccagucccccuaaagggcgcccuucaacagcggucugugggacccccagugcugcuuccccgaggugagccgccuggugcagacucugagacacuuuucaggcucugucucuucagguucugagugcugucuuuugccuccucaaccucugagcccucuguccuuucacauggccgcgccccucaccccccccccccccuaaugugucugggcugagacaucuccuucuuacaguaacuuccugcccaugaagacgcucucaaaagaagacacgaagccuccucccaagcccccgcgccucuaucuccaagaaccagccccagggacuccuguaagggauucuggaggucagggcugccaggagggaaagagggucaguaacugcuguccugaagccaucuguccccacaguguaccaagcgcccccacauggacccuagaccugcaguagugcccgcccuggcagccuuauccacaagguacucacuggcuuccauucauuuagagacuuuugucuuguuuuguuuuguuuuuuaaaaaucuaaauauauauuuaugugugugugccuucgugugcacacagacccaugcugaagcacaauuuuauagugacuccauuuuauuucacguuccuugguguuuugccugcaugugugucuguaugagugagucaggugcucuggaaguugugagccacugugugaaugcugggaguugaaccugggguccucuggaagagcagccagugcucuuuuuuuuuuuuaaagauuuauuuauuuauuauauguaaguacacuguagcugucuucagacaucccagaagagagcuucagaucucauuacagaugguugugagccaccaugugguugcuaggauuugaacucacgacuuucagaagagcaguuggcacuguuaaccgcugagccaucucuccagcccccagccagugcucuuaacccugagccaucucuucuuuguuuuuuuauuuccuccuuccuccuccugcuccuccuccuccuccucuuccuccuccucauucucuuucuccuccuccuuucucuguguagcucucucgcugcccaggaacucccuauguagaccagguuggccucgaacucagaaauccgccuaccucugccucccaagugcugggaucaaagacgugugccaccacggcccugcuugcauccaacuuuucuaaaguuggucugggcauggaacgcaagccauuucccugccugagacucuuuuuaaaaauuaaggucuuacaguguaacccaggcugguugaacuuaugauuuuccugcuucugcagccugggugcugggauuacaagugugcaccaucgcuccuuguauauauugauugacaccucacuccauugcuccuccauuauacaaacugccuugcucaaugucuuuuugugcugaaugcagcuuuaaaauucuagauguggggagacagccuaggcccuuccucucuugcaggaaaccccccagacuucaagacuuccgauguuuggcugugcugggucggggacacuuugggaagguagguaguugagugggugggcaagcauugucucagcacauuagcuggagaugcugggauggagggaauguguggggagaugaaggcucucuguccuucguaccuggaguccaacuuuuucuggucccuagguccuccugguccaguacaaaggaacagggaaauacuacgcuaucaaggcguugaagaagcaggaagugcuaggccgggaugagauugacagguguauauauuugagaaguaucugaucuuggaucugggguggccaaccugggcucccaagguagcucgagaucccaaggguccguuucagguugucuuuuuggcccugggcaagcccucuugucuuuuaguaccccggggaacucgucuauaaauaggacugugguacuuuggcagguuugaagccuuccccaugugugaaccaucaacuugccuccuuagcucuccucagccagccagagguguuguaugggugucagggcacagcucauggggguuccauuccauguccucccuugcagccuauacugugagaagcggauccuggagacuguggggcguacagggcaccccuuccugcucucucuccuugccugucugcagaccuccagccaugccugcuuuguuacugaguuucugcccggaggagaccucauggcgcagauucaugaggaugucuuuccugagccccaggccugguggguucucuggcuacuuggugcuugcuccuuggggguaggggaguacccagcagacaaauagcaugggauugugaggagucuuggugggacauuacaacacaugaggacuucauuugcauagccguggaugaaaucugucaucaugacuuugcaaguuuguugcagggaugagagucauguuugcuacuugccuaccgcaggauagaagcagggucugccuacccagcuccaguugcugcucugcuuacaacagucugacuccgcacaucagcccucacccuagugugugacccugagucaaaucucagauccucauuucacugcguguauguguggcuguucauggccaccugcaauugaguacagagcccucagccaccagaagagggcacacaucaccugaagcaggaguggcuggauaucuaccugauagaggaacucuugucuaggaguggguaguggggcagagaauaguacuuccuauuaaaugccaggccaucucuccagccucucagauccagacuugagucaaagucaugaugacuaucccccgaggcugcugggaagauguccauacugagcuuugauccuagggcuuagugugagccagacucuaucacugagcuacaucuccagcccuuuaugguuccuuuucuguuuauuuguguuauguuuuuuaguuguuguuguuguuuuuuuuuuuagauuuauuuauuuauuacauguaaguacacuguagcugucuucagacccuccagaagagggagucagaucucauuacggaugguugugagccaccaugugguugcugggauuugaacuucggaccuucggaagaacagucgggugcucuuacccacugagccaucucaccagcccguguuaugguuuuuugagaggguuucucuguauaguccuggcuuuucuggaacuugcucuauaaaccaggcuggccuugaacucagagaucugccugcuuuugccucccgagugcugggauuaaaggcgugugccgccgccaccgccaccaggcuuuuguuugcuuuuugaaaacuauauagaccagucuggccucaaauuugcuauccuccugccucagccucccaaguagcugggauuauaggccuauacuacuagacccaguagcucugccauagcugagcacaggaaggauaggucauuaauacauagcaagacuggaauauuuugggcuucuccaguauuaguuuguuuagucccauccaugccugagucuggccaggaccuuuugguaccuuucagugccaggccugaacucucccuguaccucccucagcuucuaccuggccugugugguucuggggcugcaguuccuacacgagaagaggaucauuuacagguagucuuugcccaagagaugcugggugggccugggagcuuuccuucugcugaugcugggccccaggccucagccccucucaaccccuuugaucuucaucacuccaccaucagggaucugaaauuggauaaucugcuacuggaugcccaggguuuccucaagauugcagacuuuggacuaugcaaggaagguggggcccccugucuuguaaucacauccucuugucuugccuagaccagccagaaaucucuccacucaugguguccagcccuggccuucauuccugacccuuguuuaggggaacagcugagaauacccuaauuuguaguuggccagagaagcuaugaugaccuuggcacacaaguucaucagaaacaacucucaaacagucacuggcugcacaaucaccuuggccuagagagucuaggggauacaguaaaccuuguuauuuggugucauaaagacgggcaccaagcuggguggugguggugcacgccuuuaaucccagcacucaggaggcagaggcaggcggauuucugaguucaaggccagccuggucuacagagugaguuccaggacagccagggcuauacagagaaacccugucaugaaaaaaaaaaguguguguauguaugguauauaucacauacacacauauauguauauauauauauauauauauauauauaugcauauguauauguauguauauauguauuuuauugcuggguuuugacccauggucucacauguacuaggcaaguguucuaccuccaccuuuggccuugguuuuuuaaacuguauuguauauguauaggugguuugcagcauguaugccuaguauguguagugccuauggaggccagaaggggacuucagguaccuugaaauuggaguuagacauucacaagcuaccauguggguccugggaaucaaaccuggguccauccuuaaccagugagccaucucuucagguccauuccugauucuucuuuguggauuuuuuuuguuguugguuuuuuuuuuuuuucuuuuuuuuuuugagacaagaguuucucuguguaguccuggcuguccuggaacucacucuguagaccaggcugacuucgaacucagaaaucugccugucucugccuccugagugcugggauuaaaggugugcaccaccaugucuggcucccccauugauucuuauaaccagaacuacggugugugugccacacccagcaggcacugguguggauguugguuugcaggaauuggcuuuggugaccggaccagcacguucuguggcaccccggaguuccuggcccccgagguuuugacucaggaggcuuacacgcgugcuguggacuggugggggcugggugugcugcucuaugagauguuagugggugagguaagugcuagagcggggcuuccagggucucugggguggggacagugggauagccugcaucgccugcugaaccccaauuuccacaguguccauucccgggggacacagaagaggagguauuugaaugcaucgucagugcugaugucccauguccccacuuucugucagugcaagggcucgaacucauucagaaggugagacccaagguccagggcagcugcuugugacuuggguguacccugccucuacccuguggcucucuagcauagcuuaagucggguaccuguagggcagccagcaccuggaguggcaugcccucagguucacauccugcccugcuuccugccagcuccuccagaaguccccagagaagcgucuaggggcaggagaacgggacgccgaggagaucaagguucaaccauucuucaggguaauuacgaagccagaacccagcaguccccauuuccuggggagguggggaggcuggggggccucuggggucugcgguucccacauucuuauauuccuguaccuuguucagaccaccaacuggcaggccuugcuggcccgcaccguccagccucccuucgugccuacucucuguggcccugcagaccuucguuacuucgagggagaguucaccagccugccuccaacccugaccccaccagucucccagagcucccucacugcucgccaacaggcugccuuccgggacuuugacuucgugucugagcaguuccuggaguccugagggucuccuggcacuucagccagacugcaggaagccuccacguaaccaugugccugggccgaaguauuuaaugagugugugggaguccaggcaguggccguccguggggcugccguugcaggcuuuuccuucgugucccugcugugucuauaacucuguccuucuauuucucgguagaccccagaccaggaaagaguccacggcagcauggguggcuuuucuuuuuaauacuugacuuuauauagagcauuaaauuaauaaaacuguacacucgagguagccaggccagggguuguguagugucuagguucucuuuuaacaccccucccccaacuuauuuccuuuucuucuaugucuuccuuuagggguggcaggggggguucugucuacuucucuccugagggcuggaagcccuaggaagacguaaaggccuuaggcugagugggcugaucccuagcuggcacagccucuggcuuuuaggcacaacagcagccuucucuccagcaacccuagacaaccuggcugcugccuucuuccucuuccucagccgagagagucucccagggcccagagggccaaccacagaaaaagugggccagguuucgagucggcccucggucaaagggguugcuggugcgcuggcggagguaggcgauucggugugaagauaugaacucccagguagucguguuccuggcuaccagguagaggugggaggccaggagcagggcaaccacuaacgcgaagaaggagagcagcaggaagguggugaacaggagcccaguggaccggagccacagcccccagggcuggaagaacugaaggccagaccuagaggauggagagcuagggcugggcacugcagggucccagugacuccuguucccugaguaccugugugcaugcugucugugcucccccagguaccuaccaugccaggcacaggccccacagcagaacuaccagcugcagugccagguaggccacaaagagcgggugguugcguucacccacacaguucuccauccagggacaguggugaucauagcgccgaacacagcggcggcaaucacgacagugccgggcacgcaggggcugcuguggguacagagcgcaguuuaggcuuagu

SEQ ID NO: 731 - RNA, 14182 nt, Mus musculus
acuaagccuaaacugcgcucuguacccacagcagccccugcgugcccggcacugucgugauugccgccgcuguguucggcgcuaugaucaccacugucccuggauggagaacugugugggugaacgcaaccacccgcucuuuguggccuaccuggcacugcagcugguaguucugcuguggggccugugccuggcaugguagguaccugggggagcacagacagcaugcacacagguacucagggaacaggagucacugggacccugcagugcccagcccuagcucuccauccucuaggucuggccuucaguucuuccagcccugggggcuguggcuccgguccacugggcuccuguucaccaccuuccugcugcucuccuucuucgcguuagugguugcccugcuccuggccucccaccucuaccugguagccaggaacacgacuaccugggaguucauaucuucacaccgaaucgccuaccuccgccagcgcaccagcaaccccuuugaccgagggccgacucgaaaccuggcccacuuuuucugugguuggcccucugggcccugggagacucucucggcugaggaagaggaagaaggcagcagccagguugucuaggguugcuggagagaaggcugcuguugugccuaaaagccagaggcugugccagcuagggaucagcccacucagccuaaggccuuuacgucuuccuagggcuuccagcccucaggagagaaguagacagaacccccccugccaccccuaaaggaagacauagaagaaaaggaaauaaguugggggagggguguuaaaagagaaccuagacacuacacaaccccuggccuggcuaccucgaguguacaguuuuauuaauuuaaugcucuauauaaagucaaguauuaaaaagaaaagccacccaugcugccguggacucuuuccuggucuggggucuaccgagaaauagaaggacagaguuauagacacagcagggacacgaaggaaaagccugcaacggcagccccacggacggccacugccuggacucccacacacucauuaaauacuucggcccaggcacaugguuacguggaggcuuccugcagucuggcugaagugccaggagacccucaggacuccaggaacugcucagacacgaagucaaagucccggaaggcagccuguuggcgagcagugagggagcucugggagacugguggggucaggguuggaggcaggcuggugaacucucccucgaaguaacgaaggucugcagggccacagagaguaggcacgaagggaggcuggacggugcgggccagcaaggccugccaguugguggucugaacaagguacaggaauauaagaaugugggaaccgcagaccccagaggccccccagccuccccaccuccccaggaaauggggacugcuggguucuggcuucguaauuacccugaagaaugguugaaccuugaucuccucggcgucccguucuccugccccuagacgcuucucuggggacuucuggaggagcuggcaggaagcagggcaggaugugaaccugagggcaugccacuccaggugcuggcugcccuacagguacccgacuuaagcuaugcuagagagccacaggguagaggcaggguacacccaagucacaagcagcugcccuggaccuugggucucaccuucugaaugaguucgagcccuugcacugacagaaaguggggacaugggacaucagcacugacgaugcauucaaauaccuccucuucugugucccccgggaauggacacuguggaaauugggguucagcaggcgaugcaggcuaucccacuguccccaccccagagacccuggaagccccgcucuagcacuuaccucacccacuaacaucucauagagcagcacacccagcccccaccaguccacagcacgcguguaagccuccugagucaaaaccucgggggccaggaacuccggggugccacagaacgugcugguccggucaccaaagccaauuccugcaaaccaacauccacaccagugccugcuggguguggcacacacaccguaguucugguuauaagaaucaaugggggagccagacaugguggugcacaccuuuaaucccagcacucaggaggcagagacaggcagauuucugaguucgaagucagccuggucuacagagugaguuccaggacagccaggacuacacagagaaacucuugucucaaaaaaaaaaagaaaaaaaaaaaaaaccaacaacaaaaaaaauccacaaagaagaaucaggaauggaccugaagagauggcucacugguuaaggauggacccagguuugauucccaggacccacaugguagcuugugaaugucuaacuccaauuucaagguaccugaaguccccuucuggccuccauaggcacuacacauacuaggcauacaugcugcaaaccaccuauacauauacaauacaguuuaaaaaaccaaggccaaagguggagguagaacacuugccuaguacaugugagaccaugggucaaaacccagcaauaaaauacauauauacauacauauacauaugcauauauauauauauauauauauauauauacauauauguguguaugugauauauaccauacauacacacacuuuuuuuuuucaugacaggguuucucuguauagcccuggcuguccuggaacucacucuguagaccaggcuggccuugaacucagaaauccgccugccucugccuccugagugcugggauuaaaggcgugcaccaccaccacccagcuuggugcccgucuuuaugacaccaaauaacaagguuuacuguauccccuagacucucuaggccaaggugauugugcagccagugacuguuugagaguuguuucugaugaacuugugugccaaggucaucauagcuucucuggccaacuacaaauuaggguauucucagcuguuccccuaaacaagggucaggaaugaaggccagggcuggacaccaugaguggagagauuucuggcuggucuaggcaagacaagaggaugugauuacaagacagggggccccaccuuccuugcauaguccaaagucugcaaucuugaggaaacccugggcauccaguagcagauuauccaauuucagaucccugaugguggagugaugaagaucaaagggguugagaggggcugaggccuggggcccagcaucagcagaaggaaagcucccaggcccacccagcaucucuugggcaaagacuaccuguaaaugauccucuucucguguaggaacugcagccccagaaccacacaggccagguagaagcugagggagguacagggagaguucaggccuggcacugaaagguaccaaaagguccuggccagacucaggcauggaugggacuaaacaaacuaauacuggagaagcccaaaauauuccagucuugcuauguauuaaugaccuauccuuccugugcucagcuauggcagagcuacugggucuaguaguauaggccuauaaucccagcuacuugggaggcugaggcaggaggauagcaaauuugaggccagacuggucuauauaguuuucaaaaagcaaacaaaagccugguggcgguggcggcggcacacgccuuuaaucccagcacucgggaggcaaaagcaggcagaucucugaguucaaggccagccugguuuauagagcaaguuccagaaaagccaggacuauacagagaaacccucucaaaaaaccauaacacgggcuggugagauggcucaguggguaagagcacccgacuguucuuccgaagguccgaaguucaaaucccagcaaccacaugguggcucacaaccauccguaaugagaucugacucccucuucuggagggucugaagacagcuacaguguacuuacauguaauaaauaaauaaaucuaaaaaaaaaaacaacaacaacaacuaaaaaacauaacacaaauaaacagaaaaggaaccauaaagggcuggagauguagcucagugauagagucuggcucacacuaagcccuaggaucaaagcucaguauggacaucuucccagcagccucgggggauagucaucaugacuuugacucaagucuggaucugagaggcuggagagauggccuggcauuuaauaggaaguacuauucucugccccacuacccacuccuagacaagaguuccucuaucagguagauauccagccacuccugcuucaggugaugugugcccucuucugguggcugagggcucuguacucaauugcagguggccaugaacagccacacauacacgcagugaaaugaggaucugagauuugacucagggucacacacuagggugagggcugaugugcggagucagacuguuguaagcagagcagcaacuggagcuggguaggcagacccugcuucuauccugcgguaggcaaguagcaaacaugacucucaucccugcaacaaacuugcaaagucaugaugacagauuucauccacggcuaugcaaaugaaguccucauguguuguaaugucccaccaagacuccucacaaucccaugcuauuugucugcuggguacuccccuacccccaaggagcaagcaccaaguagccagagaacccaccaggccuggggcucaggaaagacauccucaugaaucugcgccaugaggucuccuccgggcagaaacucaguaacaaagcaggcauggcuggaggucugcagacaggcaaggagagagagcaggaaggggugcccuguacgccccacagucuccaggauccgcuucucacaguauaggcugcaagggaggacauggaauggaacccccaugagcugugcccugacacccauacaacaccucuggcuggcugaggagagcuaaggaggcaaguugaugguucacacauggggaaggcuucaaaccugccaaaguaccacaguccuauuuauagacgaguuccccgggguacuaaaagacaagagggcuugcccagggccaaaaagacaaccugaaacggacccuugggaucucgagcuaccuugggagcccagguuggccaccccagauccaagaucagauacuucucaaauauauacaccugucaaucucaucccggccuagcacuuccugcuucuucaacgccuugauagcguaguauuucccuguuccuuuguacuggaccaggaggaccuagggaccagaaaaaguuggacuccagguacgaaggacagagagccuucaucuccccacacauucccuccaucccagcaucuccagcuaaugugcugagacaaugcuugcccacccacucaacuaccuaccuucccaaaguguccccgacccagcacagccaaacaucggaagucuugaagucugggggguuuccugcaagagaggaagggccuaggcugucuccccacaucuagaauuuuaaagcugcauucagcacaaaaagacauugagcaaggcaguuuguauaauggaggagcaauggagugaggugucaaucaauauauacaaggagcgauggugcacacuuguaaucccagcacccaggcugcagaagcaggaaaaucauaaguucaaccagccuggguuacacuguaagaccuuaauuuuuaaaaagagucucaggcagggaaauggcuugcguuccaugcccagaccaacuuuagaaaaguuggaugcaagcagggccgugguggcacacgucuuugaucccagcacuugggaggcagagguaggcggauuucugaguucgaggccaaccuggucuacauagggaguuccugggcagcgagagagcuacacagagaaaggaggaggagaaagagaaugaggaggaggaagaggaggaggaggaggagcaggaggaggaaggaggaaauaaaaaaacaaagaagagauggcucaggguuaagagcacuggcugggggcuggagagauggcucagcgguuaacagugccaacugcucuucugaaagucgugaguucaaauccuagcaaccacaugguggcucacaaccaucuguaaugagaucugaagcucucuucugggaugucugaagacagcuacaguguacuuacauauaauaaauaaauaaaucuuuaaaaaaaaaaaagagcacuggcugcucuuccagaggaccccagguucaacucccagcauucacacaguggcucacaacuuccagagcaccugacucacucauacagacacacaugcaggcaaaacaccaaggaacgugaaauaaaauggagucacuauaaaauugugcuucagcaugggucugugugcacacgaaggcacacacacauaaauauauauuuagauuuuuaaaaaacaaaacaaaacaagacaaaagucucuaaaugaauggaagccagugaguaccuuguggauaaggcugccagggcgggcacuacugcaggucuaggguccaugugggggcgcuugguacacuguggggacagauggcuucaggacagcaguuacugacccucuuucccuccuggcagcccugaccuccagaaucccuuacaggagucccuggggcugguucuuggagauagaggcgcgggggcuugggaggaggcuucgugucuucuuuugagagcgucuucaugggcaggaaguuacuguaagaaggagaugucucagcccagacacauuaggggggggggggggugaggggcgcggccaugugaaaggacagagggcucagagguugaggaggcaaaagacagcacucagaaccugaagagacagagccugaaaagugucucagagucugcaccaggcggcucaccucggggaagcagcacugggggucccacagaccgcuguugaagggcgcccuuuagggggacuggcuguguuuggugagcugcaggggggcagcaagcucaugaccagacgcccccaggcugccaugcugagguucaucugggaagcucucaugaaaucccggccuagaggaggcaggcggggcucagucccagcauccccauuggucagcccagcccucuccucacacaguccguaugcuccacaccucuccgcuuagagaaaaugcaucucugccucugcagccgaggccuccuuucaaugacaggcucgcagaaggugaccuaaagggacaugaagaaagcugaagaccuggagacuggccgccuuucacccugcuggaucguccccguccccacccccauccccacucccccacccccagcgccagcucccaaucucagccauggggguauucuaguuagugcuaacuuuccauaugacccauccgagagggacugccuagauuacauggcucgugggcaugucugggggggggucuugauuguuaauugauguaggaggaucuagcacacuguuagaggcaccauucccuagacaagugguacugggcuauauaagaaagcuagccaagcaugagcuugggagagaggcagagagcaagccagcaaacgguuccuccccaguuucugcuuucaguuccugcuuauuaaguuucugccuuggcucccguaaagauaggcuguaaacugggcggugguggagcacaccauuaaucccagcucugaggaggcagaagcagguggaucuccgugaauuggaggccagccuggucuacagagugaguuccaggacagccagggcugcaagagaaacccuaucucagaaaaaauaaagaaggcgguggggggugggggggggugggagaagaguagggaggggguuggcuguaaaucuguaaauugaaaucaccccuucccugccuucaguugcuuuggccgguguuuuaucggaacaaugaggcaaagcugauaugaagcaaaacucagaggaccuagacacgauaccguauccucacgggggccaggggagaaacugaggcccagaggagacacauuuacguauucaagaugacauaugaggcaggacaagcucaguguagagaugugagccucccuguaggccugucugugaaccugucuccaucucucaagucccauaguacauggauuaccaguuuuuaucacacagaugcacacacacacacacacacacacacacacacacacacacacacacagaguuguacucacugauguaggcagagguugacaccacacuggguaucugcccuuccaccuuauuuuugagacaggguuucucacugaaccuggaauucacuguuucagcuagacuuggcuggccagcgagucuggagaacccaugucucuguacggccagccaugaacuuagagacacaccaagccacacaugguuuuuacacagauccuggggauuugaacucagguccucaugcuuccacaguaaacacuuuacccacugagccaucaccccaacccaaaaugucaguccuaaagauccccuguuagaggucaggggucaguaggaaccugggcaaagagccgccccugaggcaccagacugagagaaagcuggugacaggcauuguccaggaaguccucaagcuucagaaacgccacaccacacaacugucgccagucccgccagugaaccccaaucuccagcucgcgagccuauguggaaaagaucaggcucagcccucaccugagugcccccccccguaccccacagcuaacccuaaccacacaaaggccagccuacucgguccaaggagaugauaaaacucuggucccaggauuucucagccaccaguccccauccugucuggcccacaacacgauugucaaccuucaacacagccaguaccucaccuguagugccagggcuuggauuuagggcauggccagagcagggggccucaccaccucccaugguuucucccuacucacuggccaguucgccuccaccacgcugcugccgggaccuuguucggagccagcuuucagaagggcuaccugccaggacagccaugggagaccguccaggcacagcuaccagcagaucuuugcagcccaggaggcgaaccugcagugucccugguugggagucaagagagcccucugucagcagccaccaccaauggaaccccagagggacaccaccugcucuaggagggucagagcuaggagcagccgaucuaaacccuaccuaccacacuuaguuaccacccagcauccuuagcagcccggcuagcucuccuuccugagugccuaugcaguggcagaacacagcaggaauguaagaacaggacuucucccaagcuuuguaaagccacaggaugagggaaacugcuaccuugagcucagggucuggugggcaccauggucucaagugcacaggggcaggcacccgagcaucacucuagcugccugcccuauuccuucccaccugaucagcgagggagagcccccaauggggacaaaacauguuuugucuaagaucacugagaguuuugucuccaaggguagaggacaagaggaggaagcagcagauacccaggagcuccugagggcauaaaccggcucugaggacaccauuuuacuaggcugggucuggagguaauacuuggagaccuuacagaaauaccaagggcggcccaggcaauacacuugucuuaggaaauggaaguucggcuacaaacuagcaaauguuuuuguuuaaaagcaggaucuuguuagcccaaguuggccucaaacucacuauguagcuaaagaugcccuugaacuccugauccuccugccucacuucccaggggguuggguuguaggugugugcuaccauacccaguuaauuuggugcugggacugaacccaggaccucauacgcaguaagaaagaacuuuaucaacguguccccaauucuuugccuuuaaacaagaggcuccuuuugucuugccggacuugcuggcuuggccaucagcacucccgagagcccuccaaggccaagcucagacuccccccuguucuaaggagcccuccuugauuauccaagauaauaguaacagagcucugucuagcccuaucuauuguguucugaagcaggcaccagccgggcucuagcuugcagcucccaugaucuguugacugccagucagcugcugcuacaagaacagaccucaugaaagaacuuacagguaguccaagcugcccaggccccaaggcugccagggaguggacugauugucaaucuacucccuaccgaaggccgggcauuuaaaucccauccacgcuggccaggcuccaaguguguucugaacaucagaaacuuuuggguuuacaaaacuaucuuguggaucaggagagcacuuccacccuuuguuuacuuagggucucucccaugucucucuggcuggccucgaacucacucuaaagaccagguuggaacucacagacaucccccugccucugccucccgagugcugggauuaaaggcgugcgccaucaugcugggucacuacuauugaaucuauguuacagauggauaaaccaagaaucagagugggaacaugagggauccaaggucacacagcaggacugaacucucucccaaaugcuucagcguccucucuaaaagguaagggacccucugacgugaaagggaauccuugcuaccuaccugucaaggcaauagguuucacaaguguccccaaagguuggggguucccaagcauugccauccaaaguucuugggucacccugcuacguagagagugggugggaggcaaccucuccagcagcaauuccagggccagccguaggagguccagcuucugggaggauuccuggagcugggccugggccuaccaaggagacacaaacaccagguauggguuaaaggggucaggccacaccucauggguauucacuacuacccuccacaggcagcaacccugggugcaggccccacugcauguggauagacccaaacagagcuguagagacagcagugagccggggacacagccugaccucggccagugccuuucgguccugcauccucuggccaccaagcagcuucaccacauucuuggcaccugcagccacagcagccucuacucgaagucggugcugcagcuccucugccagcaagucggggccugcagggcggaggugaacccuuagccucggccaucgagggccacccucccugaccugagaggccucaccuggcucuggagagccacuggacuccaggcugcuuaucuucauccggagcagggccaccuucaguugacuguccuuuaacaucugcugggcagccgccaggagcuuccucuccuggggaggugacacucgccccaucagaaggggcuuacggcagaccaccagggccuggguggggcugagccuccccuguuauaccaagguucaagcuccuacaaggaagauacuacaggcaagccucccuuguugaacuagguaaugggggguggaggcuggcggggugagcggaaccugacacucaucaguuugacaagcuaaguaguaaggauucugucagauggagaagagaggguagguugccaagagcuggacgggcagccggcuggaucuuccgcuagccuucuguuguugggcuuugcugacagugugggucagagacuugccucacccaccuaccuguacuucuagcauuaggugaggagcugggccaggguagcauuucccuguuggcacagggucuggcuggcuuugugauccuuauaccugagagcuacgucucucccaucagguagaugagaagccaggccuaccccucuucaucagacgccagcccuuaccuugggggugccgcuggcacacgugugaaucauauucucagcccccugcuuuaccuuuagcucuaccugcagcugccuauguaaagccuccgagagccgagcccuggacugcuccgcccgcggcugggguuccgaggucacuggcucugcaacacaaggcuagaguucagaccccggggaagcagcgcuugccuuuuucccuucccuuccguauagacaacauguggaugauauaggguggucaaagccaaggccaggauuguguucgugagucucccguucccagguuuauucagacuccucgcucaccggcugaggcuggcagcagaacuugggcaugcagcucccgaagcucgccaugcagcugcuccaggcggcgguuggaggcccuaagcaguugcugcacaugacccagguggcgucggucuguggccacgcgccgcauguucuccaugcccuccuugaucuucagcuccuucuggauggcucggcggaccaucucuuucucauccuugggggcucucuggccagucccaggcugcaaagggcagagaagucuuagccuacccugcuccacagcaaagagggaacagauacaaaaggcagagccccagagugucucagaacccugcagugucuagcuccugucucccuuucaaagaagggagagagaaaacagaccagguucgcccagugccuucuggguacugagguuuacacucuaacaacacacuaaauucccuucuccuugguaguagucgcucuuuugugguccuggggaaagaagccacagccuggagcgugcuaaacaagagcucugacacagacccacaugcuuagcucucauuccuauuuuauacaggagcaacaaagaaagaagaguuagguggcuugcucacacaggcaacacagaggaguggccacuguggaucgagggacagugugaucccauuuucucccagccugccacacugcucucccuaggucugagaagcaaccggaaccugggagguaauguaggcaaagaauucacucuagguccccugcaggagacagccaguggcccaaaacaccacaacuuauuucuuuugccuuacauaguguggcagacaggugcuguggcagaaguggcaagcaggagcuacagcuguucaccagauuagaggcaccaucaaaggcagggagagaaaacuucucggaggcugaccuuauuccagagcaacuccugcugacccccuuccuauccccaggauccuggaagccacacuauuuuauccuuaccuuucgguguuccaucuccuaagccccaugaaagaauggcuacucuguuuaggggccccaggccucagcuagguugaucguccugccuuaacugucagagggcaagggcgaggcucaggaaauccuuuggcugccccaagcaggagggccagagccaaaggccugagcaaacaaagcucuuacagagcugggggccugcuggccaccgggguccugagucaccucgcugccgcugcugcagggcggaggcucacaggaaaucggaaaauguguauaagcuagacaggccgagaaggaucuccggaggaaggguacugggaggggugagauccagccuuucaggcugccugagggcugcggugcuccagucuacugcacuucaccuuccccucaaguccugacuugacacuaggguguuaucuucuacauaaacaucucaccucaccuuuaacuguccuggcauagaacaguaucucucucuccugcuuaagugacacaucuaacccgaaccucuccacauuguggaccccucguuggacccaagaguuccuugcacaaugcugagccaaaucccucuaguggccaacuuguucuagccugugggugugguguauuggggacaacgcccacugcgcgcacaaucuuguccccguuccccgucccuccgcuccccccacccccuccccgcucccccaguccucuuggaaggcuguauacuccaaccuuugcgcuccuggcaaauucccaccuuccugcaagucucuagaagaucgaauuuuagggaacuugaccuaucuuacccccacccccacccccgguggcauauuccacgguaacaggcgugcugccgggcuggaucuccgucacuucggggaccugggcaccagagcgucuuaacccagggcucaggcagagaggccagaauagugugaagauccgagcaccgugugcucagaguugcaaacacggucgcugcgugcgcuugguucaccuggcgcacagcccccuccggcuccauggcgccuugcccgccaguccucuccuccacugcgguuccggaagcccgggucucagugccugacuuucaaacuugaaacuucccgggaag

SEQ ID NO: 732 - RNA, 2707 nt, Mus musculus
auggguggcuuuucuuuuuaauacuugacuuuauauagagcauuaaauuaauaaaacuguacacucgagguagccaggccagggguuguguagugucuagguucucuuuuaacaccccucccccaacuuauuuccuuuucuucuaugucuuccuuuagggguggcaggggggguucugucuacuucucuccugagggcuggaagcccuaggaagacguaaaggccuuaggcugagugggcugaucccuagcuggcacagccucuggcuuuuaggcacaacagcagccuucucuccagcaacccuagacaaccuggcugcugccuucuuccucuuccucagccgagagagucucccagggcccagagggccaaccacagaaaaagugggccagguuucgagucggcccucggucaaagggguugcuggugcgcuggcggagguaggcgauucggugugaagauaugaacucccagguagucguguuccuggcuaccagguagaggugggaggccaggagcagggcaaccacuaacgcgaagaaggagagcagcaggaagguggugaacaggagcccaguggaccggagccacagcccccagggcuggaagaacugaaggccagaccuagaggauggagagcuagggcugggcacugcagggucccagugacuccuguucccugaguaccugugugcaugcugucugugcucccccagguaccuaccaugccaggcacaggccccacagcagaacuaccagcugcagugccagguaggccacaaagagcgggugguugcguucacccacacaguucuccauccagggacaguggugaucauagcgccgaacacagcggcggcaaucacgacagugccgggcacgcaggggcugcuguggguacagagcgcaguuuaggcuuagugcugccucccccgugaguccuccuuuggggagaaugcucaaggccauagucagguccuaaauuugggaggcaggguuaaggauggccugacugcccccacaagaguauguguguaucaccuaccagcaccagacagugucugcagcgccggagugggacggccugaggaaccauggcugccuguuccuccuugggcucgcccugaaaacgaaacaaagauuaugagauuggggguucuccuaccuugggaggcagacgaugcuggggccaucucucuaggugccaccgguccccauugugcaggacuuggggcccaucucauguagaggggacgcaugcacauggcagcauacuagacgucuggugaccuuuguaagacaguuguccccacaugggucuugggugaugucaucauuguaggagcaaaaacacagggguaggcaagaggcuucaucaagaugcccccacacugagugcagcucagggcucagcauugaggucucacuccccuguuggccuucgaggucccugcuugcuuaccugaggcuggggcugaguagucacauagccgggguccaugagugacacagccagauaaagcagcagggagcuuagcaccaggagcaggaaugugaggggcaggagcagcuccccuugcucuucccauuggcguagcucuggggaggccagaggacagugagaaccauagcaaaagggaagggcaggaggcgguggggguagaaagaaaguagcuggaggugauauggaggcuagaccugagggaggcaggaggaagggggcuccccaggggaagagucagcccuggaagaggguggagccagccaggagcuccagcuaggaaggugccagccagccuguuuaagcccauggcagugaaggaggauuauggagaggagggagggcuaagaagugauggacguggugacaccagacagcugagcguaggcaacucugguacccuugggugaaagagagccaaggagguuuugaagguggcugacuccugguguggaagccugaggacaaagggcaaaagcgauggaggagggcuacagaggaagccucuggugggcucuguuccuucuggaagggaaaccuaggagggggcaggaagggggugaagggaaugauggggaaaggagaugcuaccaggcgaaggugggaaaccugcuccucgcuauaguggcgucccuugggguaguuagucggcucauaggauuuggggaguggaccggaaagccaaguccuuaagucuagcggauuucuuaaucuuauuuagggagggguugggaggcaauuucugggaaggacagguagagcccagggaugggagagauggggccucuaguugguccucugaugggcucugguggucuuuggauggauggacaucuaucgaugacagaaaauuacugggauuaauuaggguccaacuugggaaucaggcggagagaggaugauccccggaccgacauaggagaaagacgcuugaggaacuggugggagauagaaauggagauuucaaugugucugaggauuagggggaccccgguauacccacgcgugaucgggugggcucgggguggcgcgguguccggcucaccggugucgugcaggaagagcaccagagugauuccccaggucagcacggugugcccaguccgcaccagcaucccagaguuaagcggcggccaaagagccauggccuuggcccccgcccgagcccacccggaagaagcgcgcagaagguggggccgcggggca

SEQ ID NO: 733 - RNA, 2707 nt, Mus musculus
ugccccgcggccccaccuucugcgcgcuucuuccgggugggcucgggcgggggccaaggccauggcucuuuggccgccgcuuaacucugggaugcuggugcggacugggcacaccgugcugaccuggggaaucacucuggugcucuuccugcacgacaccggugagccggacaccgcgccaccccgagcccacccgaucacgcguggguauaccggggucccccuaauccucagacacauugaaaucuccauuucuaucucccaccaguuccucaagcgucuuucuccuaugucgguccggggaucauccucucuccgccugauucccaaguuggacccuaauuaaucccaguaauuuucugucaucgauagauguccauccauccaaagaccaccagagcccaucagaggaccaacuagaggccccaucucucccaucccugggcucuaccuguccuucccagaaauugccucccaaccccucccuaaauaagauuaagaaauccgcuagacuuaaggacuuggcuuuccgguccacuccccaaauccuaugagccgacuaacuaccccaagggacgccacuauagcgaggagcagguuucccaccuucgccugguagcaucuccuuuccccaucauucccuucacccccuuccugcccccuccuagguuucccuuccagaaggaacagagcccaccagaggcuuccucuguagcccuccuccaucgcuuuugcccuuuguccucaggcuuccacaccaggagucagccaccuucaaaaccuccuuggcucucuuucacccaaggguaccagaguugccuacgcucagcugucuggugucaccacguccaucacuucuuagcccucccuccucuccauaauccuccuucacugccaugggcuuaaacaggcuggcuggcaccuuccuagcuggagcuccuggcuggcuccacccucuuccagggcugacucuuccccuggggagcccccuuccuccugccucccucaggucuagccuccauaucaccuccagcuacuuucuuucuacccccaccgccuccugcccuucccuuuugcuaugguucucacuguccucuggccuccccagagcuacgccaaugggaagagcaaggggagcugcuccugccccucacauuccugcuccuggugcuaagcucccugcugcuuuaucuggcugugucacucauggaccccggcuaugugacuacucagccccagccucagguaagcaagcagggaccucgaaggccaacaggggagugagaccucaaugcugagcccugagcugcacucagugugggggcaucuugaugaagccucuugccuaccccuguguuuuugcuccuacaaugaugacaucacccaagacccauguggggacaacugucuuacaaaggucaccagacgucuaguaugcugccaugugcaugcguccccucuacaugagaugggccccaaguccugcacaauggggaccgguggcaccuagagagauggccccagcaucgucugccucccaagguaggagaacccccaaucucauaaucuuuguuucguuuucagggcgagcccaaggaggaacaggcagccaugguuccucaggccgucccacuccggcgcugcagacacugucuggugcugguaggugauacacacauacucuugugggggcagucaggccauccuuaacccugccucccaaauuuaggaccugacuauggccuugagcauucuccccaaaggaggacucacgggggaggcagcacuaagccuaaacugcgcucuguacccacagcagccccugcgugcccggcacugucgugauugccgccgcuguguucggcgcuaugaucaccacugucccuggauggagaacugugugggugaacgcaaccacccgcucuuuguggccuaccuggcacugcagcugguaguucugcuguggggccugugccuggcaugguagguaccugggggagcacagacagcaugcacacagguacucagggaacaggagucacugggacccugcagugcccagcccuagcucuccauccucuaggucuggccuucaguucuuccagcccugggggcuguggcuccgguccacugggcuccuguucaccaccuuccugcugcucuccuucuucgcguuagugguugcccugcuccuggccucccaccucuaccugguagccaggaacacgacuaccugggaguucauaucuucacaccgaaucgccuaccuccgccagcgcaccagcaaccccuuugaccgagggccgacucgaaaccuggcccacuuuuucugugguuggcccucugggcccugggagacucucucggcugaggaagaggaagaaggcagcagccagguugucuaggguugcuggagagaaggcugcuguugugccuaaaagccagaggcugugccagcuagggaucagcccacucagccuaaggccuuuacgucuuccuagggcuuccagcccucaggagagaaguagacagaacccccccugccaccccuaaaggaagacauagaagaaaaggaaauaaguugggggagggguguuaaaagagaaccuagacacuacacaaccccuggccuggcuaccucgaguguacaguuuuauuaauuuaaugcucuauauaaagucaaguauuaaaaagaaaagccacccau

SEQ ID NO: 734 - RNA, 18271 nt, Mus musculus
acgcaugguaaagagcacaguuuauuaaggacgacucaucaacagcccuggccugcugagcucccgggagcugcaggagcucaggcucgggguucccccuuaagaaucaagggcagauccuucccucaggcagcguccaacugcggagccacccuacccaagacaaagucuccauguccuuggccuucaucucaaggaccaaguggugggcacaggaugcaggucucccacagaaacaaaucagaugcagugauuccaguagcauggucccaggaaacggggcaagggguggggugggggaggcaggcaagaaggaaugaaugcauccgcguccugggcagcauuugcugcgucccagucaacaaagggagcaguacuggggcugagcuaccagcuaccaaguccuaggucugggggcggucaagauggcgggaguguauauggccucccuuauacucggcucuaggguaaagcuggcagcccucucaggcaggaacggggagaggaugucaggguuaaccuuggggaauaagacaauccauauuugaauucuccaacuccuuuagcauccuggccacuccuccccaggucacuugccacucugcaauaaauagcuagccuguguccaaauaaauaguaaaauacgucccagguguuguguauugagagagaagguaguaaaaaggcagguagagucccagcagcacucaacccaaccuggcuaaagcaauggccugggaaggaggcagcccugcccucugcucucaggaaggcuucaggugccagcuacuggagccucacuccugcuggccagucucuggagaagguuaagagcccuugcugccaaccugccuucaggacucaagccaccugaccuccggaagaaacauggucagaaaagucuauaggguucagggaacccagccccaaagucagaagauagaucaagcacaugaccaggaaggccagcaccuccgaagccucccccccccccccccccccccgccgccuccccgcuccgccucccaugggggcagauggcagagguagcccucugguacugugaagcuccaggccuuccaguuuagccacccuggacccagagaagcuuucuuuggucccuugcccuugaugagaacuacacacaccagaugggaacauggccaucaaagagaugacaucacuccugaaauggcaacucccaggcacacagcagccaggguaucuuacucuccaacugaaggcucuccccaucccuccuuucuccauucuugaguagaaaaugggcgagaggcucaaagcaucacaggcugccauuggagcagguacuggggauuccugcucugacauagaggaccuggaggccucaggcuggggaugggaacaggaugccaauaaaguuggccuccagggcuuucucacuaagcuacacuccugaaugcuggccucagggagcagaggggaggagagcgccaggguaaagaggacagacaaaagaaagacagcaggagccacacacgccucuggcaaaggaagaaaagggacaggcagagguagacacagaggggaagcagggccuuagaggguucccacauacccucaccccacugccagggcaugugugaacacacauguauacauacauacacacacacauacacacacacacacacacacacacacacacacacacaaagcagagaccugggagacaacccuaccggccacaagcaaacacaccggacagggacaaacgguggcccuagaacuggcagucacucagcucuucuggggugcuuccccaggcagucugagcaccaacacucagaaguuguuucuggcccauuagcuaauugccuccccugaccaggacucagggaagaugaaagcacaggggugaggagcuacugggcagaggcauggcaggacccugucagccuccuaggccccaaauggccccagccccaggaagccaguucaggagcuccggcccugcugagcagucuggguggagggucccagggcugaggugcagggaguguggcagggcugagcacugggaaggagcgcaucgcggcgugcuccaggagcacccuggaccaugggaaccaggcugggaagaccuggagcuggccaggacuguagcuucccuucaggcuggcuuucucacaggcuccuuuguguccccaaaacaaggguguggagcaagcgcaguggcugcucuuccaaagcugggacccugcuaccacguuacuucgagucuuggaguuccuuggcuuucuguaggaucuggcagacgucugugaugggguaauccuggaaagcggaaagcgaaagcaaggucaugcuccuggagcagcagccacuuugcuccacuugccacacccaccaccuucccagagacucguuaccauggaauggcaccagggccagggaccaugguguaccagacacccagaguagccugccccaaacacugcaagucacuaagguucugcgucccaaggcccaaagggucucacagccuguauuagaaccaggguacccaaaggccucagcccucacgucugacacagaagcuggagccacaccuaugaacagcauguugcuagcucaggcaacauagcccuugguuuucuagucaccucaggaggcucaaggagggguacugugauuauggccgucuuacagaccuagcuagugagguuauuggaaaccaacccuaggccagguguuggagacgcacuaaggccuagagacaaagucacuuggcucaagucacaugagaagcagagcagaacagauauggacguuaggcuggcugucagaccugacacacaccucucuggccuaagacaaaucaauaacuuccauacacuacacucaaggucugugaggaccaggacucaacucaggcccaaaccggaugcgcuccaggggucuggacccugaaugcgcaguauguguuccuguuucuggccccagccugccagugucugagacugggcucgugccaccaaccaguaccugcagaagccgcauguugacagugaagucccccuccaguaacugcucccggaucagucugcagggaaacaaggagccacagugcuggacccugggugcgccccggguguacucuagcuguggaggguggccccugcucaccacucaggucuggguacucccccaccuccaccccccagcuucucuuaaggauggccccacucacaugagcauagcacagcagaccaggaggaggaaaucgaaucgguugccaucagcaaagagggagucccagauacggaugacaucaggcagcaagaacuccugggacagcagcaaugucagccaucggaaggcaaagaacugaggcuugauacucugcucuugcugggggacagagggugugugucagggagcgcacgucagcuauuuaaauaaacaagacacagccuaggcgcaagcccuguucagggcccucagaggggccguacagagccuggguccacuaacagggcaauuccagccaauguuguuauuucugcaaggcacacuaaaacuccugaaucuuacacuagucuuuccauuuggagaagaugucaacucaugcaucuccccccuugguucuguggagcagcaugaaggccaguaccaggcacuguaccugugcucagcucacagaaccacagaacaacccuauagaggagggauccgcaagagaacagcacccugugagccacacggggugguaacaaaguauacagcacacaguaaaaaacagaacucuuaaaaaaaaaaaaaaccaaccaaaaaaagcuggguguuaguggcacacacgccuuuaaucccagcagaggcaggcggauuucugaguucgaggccagccuggucuacagagugaguuccaggacagccagggcuacacagagaaacccugucuuggaaaacaaacaaacaaaugcaagcuucagcugggagguggcagcgcgccccuucagucucagcacuuggaaagcagaggccaccagaccucugaaugugcuggccuuggccuucagcaccuucaccugcuccaccaucuugccggcaacacucuuuucuuccuuuuuuuuuuuuuuucauggcaggguuucucuguggaucccuggcuggccuggaacucagagauccaccuacuccugccucucaaggcuggauuuguuuuuugagacaaggucucauuacguacuccuggcuugcaaggcugaaagcaugcaccaucacguucagccuguaaguaccauucuuaacuucacacucccagccuacuuaaugucuucuacgcucagcugccaggccucccaggccugucucagcacaugggucagugcucccuggagcugggccagcccaacauugcucaacuacagccacuuccagcccccacauucaaggcagaacuacugugucccuggccugugcguccuguccaugagucagguccucaccagcuucagguagagcucuacauccuuauccuucaagguggaguacaccuuuuccaucuuguaggugauaccgcacugggagucauccaggcucuugaugaaguugucccggaucucagccaugagguuggugaagcagaaaaagguaucugcuucagcgugcucugggacagacagacagcagcagggugugaguggacaaaggaacgugagcuguucuugagucccgccucaccucucacccauaagacauuugccccacuuaugagugucaccaaacugccccuggcagcuggaaugaguccuuggccuuggcuccuguccaccccuaaugccuucggcacuuuggccucaccuaggcacaggguccacucagcagccuacaugcgcugugguaauggaccccaccucucagugcauccugaccaucuacucuaccgcaagucaaaggcgucaacagauccguaagaagcagaacucagaaaggcagagcuggaaagggucucagaugcaaucccgccagccucuguucugacaugagcagagauguauaaaagcggaugaggcuucagagccccauacagccuaucggucaguccagccccauuuccuuucucuagggagccagcaaggggagauugcgguagcuaagagcuugucuaccuuuccacucgcuguuagggucaguggcaaaaguguaguagagggggcccacgaucucauucaugcccugcacguaagcgaugccaggguugagcuuggcauagaugaacaggaugcgcuccaccaccucccagugggcuucgcagccauuggguagcaccucauacucguucagggcugauggcgcacuguucuugugcggggagcucaucuggagagaagggagagccuguuagcaggacaauuguuuccgguaagcccagcuugacaguauccuagcuuaugggcaagaaagggcaggaggaacauguccagcccaaggaacaggcaggccaguggagcaggaggagauuuccaguuacacuaggcuaaaagcagaggucacaacagacaugauagaacacaguuccugcugucccaguacuugagaagcagaggcaagcagaacucugagagucugaggccagccaaggcuaucuuaaaaucaaaccaaacuaaaccaaccaaacaacaaaauagagguuauaccggguggugacggugcccaucuuuaaucccagcacucaggaggcagaggcagguggaucucggaguuugauaccugccuggucuacagagagaguuccaggacagccagagagguuguauagaaaaaccgucuugaaaaacaaaagcaaaauaaacagagguggaggaagggagagaaagaacuuccugcagugagaaauucuacacuagacgggugguuacgcacagguguaacuuauacacaugcauguauauauuuagcauaucuagcuauauacauaaaauguaugguuuucuguuuuuugggcuuuuuuuuuuaacuucaguuguggggcuggugagauggcucagcgguuaagagcacugacugcucuuccgaagguccugaguucaaaucccagaaaccacaugguggcucacaaccacccguaaugagauuugaugcucucuuuuggugcaucucaagucagcuacaguguaccuauguauaauaauaaaucuuggggaacgccagggccaaaaagggggaguggguggguaggggaauggggggguggguaugggggacuuuugguauagcauuggaaauguaaaugagcuaaauaccuaauaaaaaaugaaaaauaaauaaauaaaucuuugggcuggagcaagcagggacugagcaagcagaguugaccggauugagcagaaguccuaaaaauucaauucccaacaaccacacgaaggcucacagccaucuguacagcucaguguacucauauacauaaaauaaauaaaucuuuaacaaaacaaaacaaaacaaacuucauuuggaaacaaacuucaguuguaacgagaauaaagacuuggcuguauguaguggugcagacccguaaaucccagcacugggaggcagaagccggagucucaggaguucaaaaccagccucagcuauguaugagaguucuaggccaaccuggacgacacaaaaaccagcugaaaacaagagaaggguccgaaaccucugcugcucuguagaaucucagaaaacucaggggauucugaugccucagcugucccuggccugugccagcaguggcuacagagcugggggacugcaggggacacccccacagagacugugagucuuagaacagaggacagggaguccgagcuaccuccacauucacagcacacauauaagacagaaacacacgcgccucaggagcagaccacacuccuccaacaguccuacacacuucucaaagccaucuucuuuuucuuuucuuuucuuuucuuuuuucuuuucuucuuuaaacagaguugggcauagcccaagcuggacuucaaacucgucauacagcugagggugacccugagcugauccuccuaccucacauuacaggcuuagagccaugacacuaccuuugaauauuucaagaggagaaaacugaggcucacauagaccugagccuggacuggcuagcucaaagacuuuggccaagccacuggagcaggaugucucccaggaaggcccagugcucccagcuuuccaagaaccuacuuuccgugaccucauuuccuccugcaguuccacagaaaugaucauauccagauuacagagaggaaaaagaccagagucacacagaaggucacccuaccacaggucuagagucccagggaugaagcuuggguggauccuggacugugagaccaguuccaaagguaaaaugggaagagucugacccucauauacaaagcuacagcaaaagaaucaauagagcugggccuuuauccagcauccacgcaagacagaugcacaagugagccacgguuccuucaccaagccaacgcucugcacaacuccugugaaucccaacccugcagcaggugcaugggaccaggagagaugguaccugcucugauacugcucugaugguagcaacucagagagaucugugcaguccuccauucccugcuggggaggcuucagagcagggccuucccauugaagaaagccagugacaugugggaacaagucacugcuacaggucccagagcaauggguuuucauguagaaauaaggucauacaccucauuuuggggaguggagauggggugcauaccaucugccacaaguggcaggaucugcuagaucuuggagcucaacagcaccuucccucacaucucacugcuucuagccaaaggggcccucuuuuuuuuuuuuuccaugauacaaaugauaaauuaagcuuuuguugugagauguugagcugagugauaugguggugaaggagaugccaguggcuaugucccuacagacaguccuagccuggcugcuccugcugugugaggauggacuuugucaugaguugugcuaugguggccagggcgcuguuuggaaccucccccugucucaggauugaagugugggguuggaagcugucggggaacacuggagaaacccugaugcgguaauggcaccuuuggcacauucauggccaucagaaugggcacaggacguuaaucagggcagagcaggccugcuauaucucuacuuccuauccagaucccuuguacaauaauagauuuugguuuugguuguuuuuuuuguuuuucauuuuuugguuuugguuuuuccgagacaggguuucucuguguagcccuggcuguccucgaacucagaaaucugccugccucuguuucucaagugcugggauuaaaggcgugcgccaccaugcccggcaaaguuuuguuuuuugagacgagguuucucuggauguccuagaacucauucuguagaucaggcugguaugaaauucagagaucugcuugccucugcccuccaaauguugggacuaaaugcauggucuaccacagcccagcauuuuugugagugacuuccuccaggguguccaggaggggcaugguggcacaugugcagcaugguggguaacgggauggccuguuggaaaaggaggaggcccaguggucacuggaggcucagucagagagcuuuugucucugcagcagaaucacuagcccagccccacucuggaacauuuggcacucacucucucguaucugaggacuuggcacaugccuuccauaauacucaggcagcucuucugcucuguccuucaccuccugcugucuagauccgcugcagccgcugaggcccacaccuggauggauggcuagcugucccacugcugcucgcaccacaaugggacaucccucaggacugucuccacucuaccucuagcagaagcgccugagaugaggacagugccuggccuguagcucucaugcccggcuggaacuacaacaaaaggccucugacagcaaccuucagaaagcacccagugcccuguggccagugcaccaaaggagacaggaagggacagccugucaggaaaagccccaugggcuggagagagauggauggcucaguggguaagagcacuggcugcuuuuccagagguccugaguucaauucccagcaaggacaagguagcuuacaacuauguauaauaaaaucugaugcccucuucuggcaugcaggcaaacaagcagauagaauacucacaaauaaauaaaucuuaaaggggggaggggggagacaagaccgcagggagcuggaaagauggcucaacaggaaagagcacuuguucuuguacaggaccagaguucgauucccagcacagcacucacaaccauccaugacuccaguuccaggagaucugaugccuuuuuugaccucuauaggcacuagacauguacacagugcaugcacacacacacacacacacacacacacacacacacacacacacgcacgcacgcacgcacacacacacaggcaaacauucaaacagaauaaauaaaucuuaaaaaagaaaacuaucucagauccccaacuggcucuuacauuuguaaccccgcuucgauuccuggccaccgucugagacuucagugucgucugcuccacccgcuuacgaagggucucaaacucauuuugcggguccaggaugagcaggcagggguacucaguggcucuuuggaagaaagauauaucugggcacaaccuccuauuggaauggaaaaaaugcuaucacucaggguggagguuccagccaggcagccccagguauccuaagaaaugguugaucuacuuauuuuacagugcugaggacuaaccuagguccacacuagacaagugcucuaccacuaagcuuaccccuucaacgguuugcuuguuuguaauuguaacaucacagcuggguaugguggcucacacauguaaccaaguacuugggaggucuaaggcaggaggauugcccugaguucaaggccagcuucagcuacaaagugagcuccagaccacacagugugagacuuugucucaaaaaacuaaaauaauaauaguuuucccaagagaaccaguuuuuaaaaaggcaguagaaauggcaucugcacaguuacuucauaugugucugugaaaaggaacacguguaaauauuuuaaguguuucuauggcacacagccaaauucucacagaccacagacacuucuugagacuucuuguguggagcugaggaugccacuugguggcagagcacucgccuggcauguguggaucuaagggucaaguccugaguucaauccccaacaagagaaucaucuauuuccacccaucugucucuagauguaugcaauguauaaggccugccuguggucauuuaucacagaacguccucugcuggcauggagagaugcauggaacauuaggagggcggcuuggaucuggagugugacagggcaggcaugcacauguacuccucaaagcuccuaggcccagcacacugcuuccuggcccuugggaaaccuuaacaaccuacugccaucaccaauaagacagaaccugagccccuaauuccuccacaaaacuacuacaggaugggacucuugaccuaaaccuggcccagaucauauuacgggcagggcuacuccaacgccagucugagcagaaaggcagcaagagccuggugacugcccccuggcauccagagguuaucuggaagggaucuggacagagaaguggcacucagaaagcuaaaggagaggauuccuggacgguaccccaagccucaggguacuccugcaucaguuccuuaggcuagaaagcucuucccauucuccucaugaccggcacauccugcaaggucaccuccucuaaacugaggcuccuauucucucagagcaccagcuuuucuuccccacagcacugggaaccuuugcaaucccauagguguugccagguugacuaucugacuccucacauaagccuccagccuuccucacaugggugcaauuggccugugccacugcaggcagaauugggccugagagagauuccgugaaaugcugcugagucugcucugcaugacuuuccugucuaaacaaggagugugugccagagaggacucaggcaggcagcucagugaggagagggacuggcucccagggccuuucuucaaaggccgcuguccuguguuauagccagcauaacauuccuauauugcacacacccuuaaccugagcuaugucacuucuacuuccagauaaaucaugcaugagagccugggucaccugcacaaagucaaauaguugaggggaggcuacaacuaaaccagacaaauagguuccagcacauuguggcacaaaccccacagagccuucccccaguccccgcagcaggcccccagcagcagaagccccugggagccucuuaccugacaucuuugucaaucuggaguagcaccucguuguccuuaaaauauguguuccaccugcugucaggguuuggguucagaggcugugaagagagggaaaagcagaugcuguguccaagaacuaggcaggguugcagcucaggggccucagaccaagugccuuuagcccuggcuuugaucuaaagacaagcucaguccacccagaggacacagcaagcacaggcuucccaaugcuucccagguacuguggcaacacuuccauacugcacagucagccacaagccuugcagccugcucugaacacaugcuggguggcagacagugcacuuggcagugccccagcuacaagugugucuauggcaaucccucacugagcacuguugaaagguugacugaggccgggcggugguggugcacaccuuuaaucccagcacucgggagacaaaggcaggcagauuucugaguucgaggccagccuggucuacaaugugaguuccaggacagccagggcuauacagagaaacccuguccccccccaaaaaaaaaacaaccaacaaacaaacaaacaaacaaaaacaacaacagcaaaacaaaaaacaaaaacaaacaaaaaaaaaagaaagaaagguugacugaaugaaugaacaccgucucauuuucuaccagagcuuugaguagucaauuccaacuugggaggauggcucugaggccagcccagcuccacuucuuguccuguaaagucuacagaaaggagcuuguuauaagaagaggagacaggcuggggccuagcaaacacagaaguggaugcucacagucaacuauuggauggaucacagggcccccaauggaggagcuagagaaaguauccaaggagcuaaagagaucugcaacccuaucggaggaacaacauuaugaacuaaccaguaccccagagcucuugacucuagcugcauauguaucaaaagaugaccuagucggccaucacuggaaagagaggcccauuggucaggcaaacguuauaugccccaguacagggaaaugccagggccaaaaaaugggaauggguggguaggggaguggggggggggggacuuuugggauagcauuggaaauguaauugaagaaaauacguaauaaaaaaaaaaaggaaaaaaaaaaaaaaaagaagaggagacaggaguuucuccaggccucagacaggcacuucaucuccaugucugcccagcucuuucuuuaacuauacaagcauaggaccacaaacgagaacuguauagcuccggagaaaugauugcuuaccacccuggagauccuuugcuuagucuccaaggucauaaaaagguuaacaaacauuuagccagagggaaagccuggaccuuuucaagggaacaaagcacgaaggcugcaaguuugaaagccugagcuacauagcaagauccugucucaaaacaaacaaacaaacaaacaaacaaacaaacccauuuccagucugcaagauggcuuggugguuaaagaagccaacugcacaagcauaaagaccuaaguucaguccccaacucaaaguuguccucucaccucuaugcaugcaccaugacaugugcccacccuggcauccauacaaauacuaacaauuuuuuuuuguuuguuuguuuuuucaagacaggguuucucauuguagcccuggcuguccuggcacucacuuuguagaccaggcuggccuugaacucagaaaucugcccgucucugccucucaagugcugggguuaaagacgugugccaccacgcccggcuuaacaauuuuuuaaaaaauguuucaaguucagugucacucuuggcuauaaauugaguuccagagccaggugauaguaucagacaccauuaaccccaguacuuagggagacagaggcagguggaucucugugacaaccucucugaggccagucuggucuauagagcaaguugcaagacagcuagggcuauacagagaaaccccaucucaaaaaacaaacaaaacaaaacaaacaaacaaaagacaaaaaaacuccaagucucaggccagcacaaaauacauaagagucugucuuaaaaagacuagagagauuaaugagucuuuaaaagcauguacuauuuauguagucaguuagguuuuuugagacagaguuucuguguagcccagguuguccuggaacucacuugccucugucuccugaguggaagaauuaaggucgugcaccaccacauauagugugacgcauguacuaccacucuuuuuuuguuuuuuguuuuugguuuuucgagacaggguuucucuguguagcccuggcuguccuagaacucacuuuguagaccaggcuggccucgaacucagaaauccgccugccucugccucccaagugcugggauucaaggugugcgccaccacgcccagcuauguacugccacucuuaacaaaggaccucagaacccagcaccacccaguagcucacaaccaucuguaacucuaguuccaggggauaugacaccaucgccugaucaagcaugcauguagugcacauauacacauguaagcaaaaugcucauauacauaaaauaaaugaagcuagaaaaauuuuuuuaaauuagccuuuuauuuaaaaaaaaacaaaaacaaaaacgagccaaguggugguuggugaugcacaccuuaaaucucagagcucaggaggcagaggcaaguggucugagggcaaauuccaggacagcuaggcuuacacacagaacccugccucauaaaaaccaagagacagacagacagacacauagacacagacagacagacagacagacagacauacacacacacucucucucucucucucacucacucuuggacuagucagguuuccagagaccaugcccuaggagguccuggugcagagcaacucucacagcacucucaggacuauagucauugccuacguuaugaacuaggccugggcuccugugguucccuugugucuagugcaagcagggagacaccacuguuuccaagugggggcaagccgaugcagaagggaggacgacgcacacaggaaugcaggccaggcugcaccuguccuccagcaagggguccugguugauucaagccucugcccccaccuaugcucagcucagcccaugcuuacaugaacccuacuuacaugguccucaaaggucacauccucccugaauacacccauguuggccuuggcaaugccaggcuggauaaucaucucucucaggaacugcgaauagagcccccugcaggagagacacgcagagaaaagaugcuuggugaccccaccagagaggcacucacgggaggcuccaugugagguugcuccucaucauaggucucaccucugcuuggccaggauggaaguccacgaggcucucuccagagggagguaguucaggaggaucugcacagagaacagcacagcucuggcgacaugccuguccccauccuggacaguggccucccuccuccuagcccagcucagccccguccucugcuuuccucagacuguucuacaugagaagagaacuugguacugacgggcugguaacccggaacggaggcugccaccaccucagcucugaggguggcuucccugguaccaaugaguggaaaucuuuacuggcauaaugaaguaguccauccccaaaggaguccuggaggggaagccaagagaacacaaaaccccacaacuuucagaaagacuuccucggacaagccaggaaaauagcaaagaggagaggccgggaggagguccaugcaagacccaacggagucagaaacaagaagccccgcccgaggcacacccaccuuccagcagaggcaccgcaguccgcccucacaggggaugccuguggacacagcaggcaaaggucaccccaagccagaguuccagaaccccccagaccucuaugccuuggagccagcuggcagggaguggagugggcaggaaacacuucaggaaccauucucuaccaaagaaaugucuaagcaagccgggcaugguggcauacgccuuugaucccagcacuugggaggcagaggcaggcggauuucugaguuugaugcuagccuggucuacaaagugagcuccaggacagccaggacuauacagagaaacccugucucgaaccccccaccccacaaaaaaagaaaugucuaagcagaugcuaacucuaccuucuauacugucuacagcccuguccccagcccagaacugcgucuguacucugaaccuucucaucuuugauauuccuuccucaaagggcccuuaccaacuaaccauucuuuucaaagucaggcucuucuuuuaggggagggacagagucucauauagccuaagcuggucuccaaguuacuguggaacugagacggaacuucugauccuccugccucagccuccucaguggcaggauuacaaguggguuuugccaucacgucuaauauauagggugcugagaguggaaaguggggcgcuagguaaacgcucuauaaacugagcuauaugcccagccacaggcucuuuucauuuuguuuuuugagacagggucucacuauguagcccugccugagcuagaacucacuauguagaccaccaggcuggccuugaacucacaaagauucaccugccuuuaccucuugcucuaggauuaaaggugugaaucacuaugcugggcaggcauuaaugucgcggugcugcuuauaaacaauggcucucugguuucuccauagcacccauagaaacuggaauuacauaaagaccugaguaugacuuuaaguucucaggcaggcaaaagcuuaucuauuuguugaugccccugugucuguguccugugcuagacauaagcaauggcucuguggcuuccccacauugguccuguugagggcucugugccagacaaccaccauuucauucaauucccaguuuagcuccaguaaggauggaggauuagcugcaucguccucacuuacagauaaagacacggaucuguagacagagcaaccaggauuaagacaggugugaugugcaguccgagcucugcacaaucagcacaggcagcuuccccucuggggccuccacaccacuccagaaugggaaggccaacuucugcaaugcugucaggaguucagaagaauggcucugaggguggcuucccugacaaugagccaauuaaccaccccaccccaccccaaucugcacgacacaggcgacuuaaauucuuucuuugaaaaguuacuaggcaguaccacaggagcucuacaaacaucuugggauguuuuuacagacgggguaaaaauccagcuauugcugugcuggaacauuaaccauguggggggcaaagucaaaugugguggaaguucaauuccuuaaaauuggugcucuacggcuugaguuuuaacacuaaccaaaggucacucucagcucugauccacagccaaguagagaacccgggaaccacccugcaacuuccuuaacucaagaaacgagcugagaaaugcugagaggccuucccuaggcacaaaggguuaccaccggugcagucuucaggccacuucaagggauuugggggaucaccccccccccccagcuaagggccagcuuucugccggcaggcagguuuccagggaaacccugaguaaaagugcaucuuaccacuaaaacugaguucucgaagcuuuuccaacacaauggagggcuccuucaggacauccuggaaaucugcaauccuucaagggcagaaaaggaaacgccaagguaacaggcuuaaugaccacucuugcagccagcccaaagaucuuucacucccaacggucuccaacuaccagcuuagggaaguggacaauacaaguuucuuccucuaagaucugccaugucaacgaaaagccaugagagguauucuaauccaaaggguuugaagugagaacuuaacauuaagcacuguccacuguuagcgagcuggcauuuccugggcacuugcugcggccaagcccagcccacagcacaccacuacccgaauucacacaaccaagcuuccugcaaccaggaguaauuggauccacagacaacagacuuguacaaucuccccauggcucccgaagcucuuggcuggguaaaggggagggggcacagacuucucgggccugcccucaggcaaagacaaaagacuaaaaauuaguccuggagugaccagaauuuagcgggcguugcaagaugugccugggguggggguaggagguggauuuaagaggccagauuggagaaccuggauccccugguguuucucaugagcauggagcacagggacaggggcauuugggggcgggggaaggugcgaauccuagagcgaggaagcggggaggguaauagggggcuggacaagggagacacuagggaaaggggucccgagugagagagaaagaaaggugacacugagguaagagaagcaucucugcuucucgccucugccacacaggcaaugagaccguaagggggcucgccgccgggggagggggcuguucuuggccgcacaugcgcugagcagcucucucugugcgaaggcccggccuggacggagcggucugggugcagucuugaccucaggucuccuuaccggcucuugugcagacucgacaugguguugacuuccggacucccgagcugcuucugcagccccagcugccgccaccgccaccgccccccucccuccggggacacggggcgcugggcaaaagccuccggcaggaagcagaacuuggagcgugcgcguuccgcgggggcg

SEQ ID NO: 735 - RNA, 5020 nt, Mus musculus
aggcuaacuggcaggcgcgcggugggccuggaaacauggcggagcgcccgaggaagcguccgugugguccgguaugugcggaccgauggguuccgggcuaggccuggaaucugcagcgugucacaguggugucggcccgggucuucugcucucuccucuccccucgccccucucccguagccugagcuugcagaguuagcugguccgaucuacauucauucgcggggcgacggugucuugaguccucuccuggcuuauuuucugauuccuagggcgacuuuauggccauaccugucuuccccuugucucgguuucuucuuuugcccaauggggauucauuccucagcuucccggaucugaucccaggcuuugugcacggcgagucccuguguacuucuacccugguuugagagagucagauggcgggaggcccgaugggaugcgccccuccuaugugugaccggucagccucucaaucuuccuccuuacuugcagggugaacauggccaaaggguugaauggcgaaaauggaaacagcagaguaaguaaaaagcugaggccggguugggcaagcgcacugagcccucccuuuccacaaaccagcuaauggcccgacgagcccucuuugggucucaguguauccaagugagugguggcagccucuccagagccuaggcuagcccagcgagaaggaacucuccuccccaugucaaguccuuucccuccaauaauucuccagaaaaagaggagaaaaagaaguggaaggaccucaagauaaugaagaaacuggagcggcagcgugcccaagaggaagaggcuaaacgccaggaagaggaggaagaggcggcggcccagaggagcaaccaagguaagcagcugggucgugagguaaguugaaucucugagccauggggacaugcaagggagggaagguccacagccugucaggcugacaggaacauccccugucccugcuaggacggccuuacacucugaguguggcccugccaggcuccauccuggacaaugcccagucaccugagcuccgcaccuaccuggcuggccagaucgccagagccugcaccaucuucuguguggaugagauugugguguucgaugaggagggccaagauaccaagugagagucucuggggaguggggaggaccagcagggguggccauggcuuuguccugcuccuugucaccugccuggcugccuggaaggagcucucaaaggcagcugcagacucacuuuuucucacccuuggugcuagagaguggacucaggguuuugcccauggucugugcugaggcucagcacuuggaugguuuggguuguguuuagcauuucuuuauggugcuuguguacaaacaccagugugguucuggagaccagaaggccacuugagcugagcagugguggcacacgccuuucaucccagcacucaggaggcagaggcagguggaucucugagaguucagugccagucuggucuacagagcaaggucugggacugccagggcuaugccaagaaacccuguccccaaaaacaaaugaaaaagaaagaaaauaaaaaaaaaaguauaauaagcccagcacuuggaucuugaggucugucuuaaucuuuccaggaguguggaaggagaauucaggggaguuggcaagaaagggcaggcauguguccagcuggcccgcauccuacaguaccuggaguguccacaguaagugugaggugagggcaguggcugggaggcagccuccccaggauggaccugacagaugcauuccucccuagguaccugagaaaggcguucuuccccaagcaccaagaucugcaguuugcagguacagcuagugugccugccccauuucccaugacucagccuuaggcaccaagauggauccaggugggaacacaggcuagggguagagccugguccuaucaucaccuccuguucccugcccaggaauccucaaccccuuggacagcccucaccacaugcgucaggacgaagagucugaguuucgagaaggcgucgugguggaccggcccaccaaggcaggccauggcucuuuggucaacuguggaaugaagaagguaggauugggaaggugggcugugguacacuuggggacacuugcuagcuauaaaagguaaggacacaugaaugaggagaccugaacuccaggccugcugagaaacacuaguuaucccaaaguagggcucaagcuaugagccccucgaggauggagaggugacucaguuuaaagagcacuggcuacucuugcagaggacccacauucagugcccagcacccacauggcgguuaacaucaggugguuucagggaaucuggugcccucuuguggccuccauggacccuggacggggcaggcugaccuggguuaucugacaacguguccccuucacgguguggcacucacucacucccucuagcuucucuucaggaggugaagauugacaagaaacuggacccuggacuucgggugaccgugcgacugaaccagcagcagcucccagguagggggagcuuccugggcccuuagagcugccuggcucagagccucuuccaagccgccucuaccuaccaguuuccuuggucuucauagccuguuuuguuucccagaaugcaagacauacaaaggaacaguugugucaucacaggacccccgcaccaaagcuggucucuacuggggcuacacuguccggcuggccucuugccucaguaagagcugaauucccuucccugaauguccaucugucccacuugugagacccacaagucagaucagggucucuguccuacccaacuguguguauguuuaggaggugccuccucuagccucuggucacaucucugguacccuagucucccugaacaucucugugaaugcuaagaaaucugagaacaggaugugcuuggcccccauccuguugcagucucagcacuagggaggccagcacaggaaucucacugucugucugagaccagcuuagauaugucagagcgagaccuugcagucucaagacaaguaucauggcugcugaauguugucuggggcuugggagcuccuucugccuaccacagccaaggucaacuucccaagagcaguaggugucuucuuuaccugagccugccccacucccaggcgcuguguuugcugaggcucccuuccaggauggguacgaccugaccauugggacaucagaacguggcuccgacguggccucugcccagcugcccagcuucaggugugugcugucuagaauaggaacugggcccugcucuacagaggguuagggacuuaaagcucuggagccugcauccaguggagccuugaagucagugucccccucucugggucccaggcaugcccuugugguguuuggaggccuccaagggcuagaagcugcaguggaugcugacccgaaccuugaaguggcugaccccaguguccucuucgacuucuaugucaacacaugccuuagccagggcagccguaccauccgcaccgaggugagccgcagcccgaguucuugcagcccaccuugcgugccuuuucuaaaauuuacuuaugaauguuuugucugcgugugcuugugcacaugaggagagggcaucggaucccaugagacuacaggugucaauaguuaugaacuguuauguggauucugagaauugaacucaagacuucccggagagcagccaguacuccuaacccaucucuccagccccagccuaaagagcuuuucugaagcugggaucuuuaccacagccaacuaguagcagggacugaacacaagagcaauuaagaguugcaguccuggcccugugcccugugguagcccuguguucuuagguugagggacccaggugaucugucugucugucccucugcagggcuucuugcuuccgcuuccuugguuguauccuaggucccucuggguguugggggaaagugugccacaagcucugagcauccacaggaucuaugcacccauccuggagacuagcaugggauucagugccuguggauauuaugggggaggcucuguugcugucagccucaggggcagugacuaugcagacgggcagccccagucucccugucucugaagucuugcccauaucacuaauuacuguuccaccaguaucccuccugacccugagguaggucucacauggggccugaaaacaagcagcugggaaggcugccuggcuuccuggucccaaccaacuucuuuucuuccaggaggccauacucaucucgcuggcugcucugcagccuggucucacccaggugggaucgaggcccgccuccccgcuuucuggacccaggauguagaggaagcagcaggacaggaggaucaugggaguagagauggucaagucuucucuccaaaaauaacugccuuuaaugugagucagcccaucuccccaggggcuccagugaguccuccaccaucacuugcugccagcagugauagccuugagguuuccagcucgagccagaauauugggcacgaagagcaaucccgaggcccgcucgaugcucucgaugggcaccaggaaccgcuccagagggauggucucauccacgggggcauugggcaucacguaggaacguagcucgaucugcccaccggcugccuccaggaucagcaccuugaagaagugugugggcacugccacgugguucuucccaauaaccugguacuucacauaggacuucccaucagccucgguccuguggauagacccgggcgcauggccaagaggccugguuacauacaaggucaccucuuccaggaagccuuccuaacuuccaacaagcaagaaguuugugcugggccuggugccuccuugggucugggaacuauguaagguggggaccaaugcuuaaccucugcuuuucugcccaauacugcuucagacagaaugggaggcaauaaacgcagcuagaggaaugagcucucuagacccugaugcucaccuau

SEQ ID NO: 736 - RNA, 4599 nt, Mus musculus
uaugcgcaccaaugagaucugcagggaggaacgggugaugguaagagucgcauaucccucucuucagaaccuuuuugagaacugguguggauggagaaggcauuaggcagagcgugucuuugccuagcgcuggccugcugacccugcagugcagucugcacaacauacugugaaaggaucgcaggaucguuugccaaagcuugagcaguggucucuguccagugcugacccacauacaagcugaagcaacaugcucaacccaccaugaaggaagcugaggcuguagauagaacucagcuccucuaacugucugggucugguccucuguucuugccucagucccccaaccuccaucucugccucagcuuuuccugaaggaaugcaagaggccccagcauugccccagaaugguggugugugccuauaaucccaggacugggagacugaagcaggaagaucaggaguucaaggccaaccucagauacacacugaguuuugggaaguaacuugaagguagaaugcuugucuaucuaacaccugugaggcucugggcucaaccgucacuacuaaaauagaacccaaaacaccaaagcagagggagcgggcaccacuccaaugcccuggauccuaugcacaucaaaggacuaugaaaauggaggugugaucaugcuaucugccugggagaggcaguacagacagucuggagagagcuuacccugagaugacucugcuaucuuuguguuggcuguuggugcugaggcuggucccugucuggaugcacagggcccugacauuccuuuugcuccauggacgcugcugcugcccuaugagaaagggagagcuacaaucaauaggcacguuuguggcucuuaaagauacauauauuguuuuacagaguuuuuuuuuagggagccugucccacagauccugguucuccaaagaguccucaaggcagcuuuuucaaucuggaggcaaggcucugcuagggacucaggcuuagggaccaaagggguuaguacaguuucuuagaagaaaagguaucuggugaccccugggugugaggaguagaaggauccaggcaggaggcauagcacaggcaggggagaagaggugggcaauaugcugcaagcuacucuuuggucacagcuagucccggauaugggagauggccagagaggaaugacaagggcugaaccagaccagacaaggacuuucucugaaacauaaggacagacucuccacagugagcaagugcucaacuacugacaggcaccaugcucugcacugcuuaccaaagauaagguggcugugugagagagaagugugggcaccgcuccagacuuggaagacagcaacaauagccggagaugggaguguggcccagcuaugagggaguuagagcaauauagcaguaguuaaccaggaaggaagcagcagacagcaggaccugggagguggagugucuaggaggggcugggaagcagcugucacacuuguggagaugucggcucugguaaaggauggaggccaaacucagucccccaagccacaggaagacaagacaggcaggcuauacgugaccaugcagcaaagcaccagaggccauccaguccaccucugccccacccucugucucagacaggacuggaacacuguugauacugaacaguuacuugucuacuucacagccagggcugaaguaggacucuggacucacugacucuucuagucccuucuugaaggacauguacucuggauagccugcucaaugaccaagacucccuccucucuccucugggcugcuucaggaccacuguagucuauauuuauuuaaugucugcauuuauuccuucugaguuaucaagaggucuucacuggucagccugcccuucaaugucucuguaaaaaccuggaaaaucuacagucucaggacagugaccuaggaacaggcugguuccaggcagcaagcggggguucugccccauuaggcugacccucagaagcccaugcccuccacaaaggccauucagauuugcaaggaaacuccauccuagcaaaugugccuuagguauggagaacaggaaugugaggcugacuccugggugugggagguauugucaauugcuucucuggucccugcuuuguacaccaucccccaaacaauguggagcuucagaccccagaaaaucuccaggaagcuguccuccaacacugcucaccugcccuugccugcccaugacagcuggaggagagcccgaccuucaucaaggaaacagcaggaugaacggccuagcccacuggcaccaccccugagccucugaauauacccccucuccuacccucaauggucaacuuauucuuccugcacuggccauuuucucuacuucagaggacauaacacagauggcagaguuaaagagaccacugacacacuugcaaggcaggaaaagacuuuguagccucuggcuacucauuucugucuccaaaauucagcagacaaguguccccauccucacaaagacucucuccccuccacaccucauccuuaaagcugucccuguccuagcuagggcagcguuagaggagguuguacaagaguggcuguccuagaacuaccacuaugucagcccaguucccaucaagaaaaagcuaaugcucacucaauguguucuuucaaaacaagacaacaacuguaucaagcagaaccagcccaucuugacucacuccaguccagugcauggcagguucaagaacccuggucucaaacagagguuagaggcccacgucucuacccagcacucaggaaccagacaggugaaucuccgugagcucgaggccagccagccugguuuacagagagaguuugaggacagucaaggcuacauaguugagacccuaucucaaaaaacaagcccccacccccugccacugucaucccgaacucugcuguuccuucagcuuggggucgccuuugcugaccuccagcucaccaacaaccuccuguacuugucacuccugcccaagagaugcacaaaacagggacagaacgaaacagacucucauaucaggagucggucguucagggagccccagucugaggucccaaaagccugugcucccuuccccauagcaggggacaguccgggagaucaggaagagggaguggucuaaagagaagccggcgccgggaagcccacggccaagaacuguaagagcuggugggggagcugucaagagaaccccggguggaaccucugggaagggggcgcgugcgccaaggggcgcggaucugcggggaccagcgcggcaagugcggccugaggaccgcggcggaaacucgggugagaggcgcgcggagaacagggugcccgggagggggcucgcgcgccgccgcacggccuggaggguggagaccggagccggcgcccgcgggaggcagggcggagcgaagcccagcgcggggccaggguggccggcgccccugggcagcgagagccccgcagaacuugaaggggcggagcgcgcguccgaggagagcgucccgugcggugacagcgcgcgucucaucccccacccgacccgcucaccugggcucuccgcucgcagccgcccgcaggcagcccgggcccuccaccucccaguccggccgcccgccgccgcgcuccuccagcgccuccuuuuguuugucccucacugcaccacucugccucccccgccccggaagugacgucacggccggacgcacccgcggcaucccggccgucgccaugucuguuaaggggaaagcuugaggcggcuucacccuacucccguccacgugccugcgccaagccacuucggggcggaaguaacgggacagaacuaagcccccuuaaagggacagggaucccugcaacuuaagggaugcguuacucuggccagagcggccaagugacccaagcugacgcaaguauccgcucaccuccuuuguucggguuccgaucgccauugggccagcguccucauaccuuuagugcugcucguuagcugacucgcugcccaaacucuucaggugcccgcaaauguaacugcccugcugaugcugacgcgcgccucgacacguccggcuugcgacgguugucccugaaaagccgcauaauuccgaguuaacugaauggcuucuccgccgccgcugcaauaaacacaguugaacuaaauuuaaagguuucuugggcgauuagucgcgccccggcgaguucacugucucacacuaggagaucuuugaagucguuggacuggacuggguuaggaacuuuuuguagaagaggggagagagguagugccgugcuugagaagguauuggaguuuaggaaucugguagguguguccugaguccaguggucacuuugaaacuaaguaucugcuuuauccaguauuuugcuccgacuuuuguaagcaagggcuucugguggggaucucuuuguccgguuccccggcuucuggcuggagauagaggauuggcagagggugugaggggaauucucuaucgggaaaccuccagccuaacguuagcagcgaauuuugagcugagcugaggauaaaaccacaucuucagaacca

SEQ ID NO: 737 - RNA, 48642 nt, Mus musculus
aaggaggcgcuggaggagcgcggcggcgggcggccggacugggagguggagggcccgggcugccugcgggcggcugcgagcggagagcccaggugagcgggucgggugggggaugagacgcgcgcugucaccgcacgggacgcucuccucggacgcgcgcuccgccccuucaaguucugcggggcucucgcugcccaggggcgccggccacccuggccccgcgcugggcuucgcuccgcccugccucccgcgggcgccggcuccggucuccacccuccaggccgugcggcggcgcgcgagcccccucccgggcacccuguucuccgcgcgccucucacccgaguuuccgccgcgguccucaggccgcacuugccgcgcugguccccgcagauccgcgccccuuggcgcacgcgcccccuucccagagguuccacccgggguucucuugacagcucccccaccagcucuuacaguucuuggccgugggcuucccggcgccggcuucucuuuagaccacucccucuuccugaucucccggacuguccccugcuauggggaagggagcacaggcuuuugggaccucagacuggggcucccugaacgaccgacuccugauaugagagucuguuucguucugucccuguuuugugcaucucuugggcaggagugacaaguacaggagguuguuggugagcuggaggucagcaaaggcgaccccaagcugaaggaacagcagaguucgggaugacaguggcagggggugggggcuuguuuuuugagauagggucucaacuauguagccuugacuguccucaaacucucucuguaaaccaggcuggcuggccucgagcucacggagauucaccugucugguuccugagugcuggguagagacgugggccucuaaccucuguuugagaccaggguucuugaaccugccaugcacuggacuggagugagucaagaugggcugguucugcuugauacaguuguugucuuguuuugaaagaacacauugagugagcauuagcuuuuucuugaugggaacugggcugacauagugguaguucuaggacagccacucuuguacaaccuccucuaacgcugcccuagcuaggacagggacagcuuuaaggaugagguguggaggggagagagucuuugugaggauggggacacuugucugcugaauuuuggagacagaaaugaguagccagaggcuacaaagucuuuuccugccuugcaagugugucaguggucucuuuaacucugccaucuguguuauguccucugaaguagagaaaauggccagugcaggaagaauaaguugaccauugaggguaggagaggggguauauucagaggcucagggguggugccagugggcuaggccguucauccugcuguuuccuugaugaaggucgggcucuccuccagcugucaugggcaggcaagggcaggugagcaguguuggaggacagcuuccuggagauuuucuggggucugaagcuccacauuguuugggggaugguguacaaagcagggaccagagaagcaauugacaauaccucccacacccaggagucagccucacauuccuguucuccauaccuaaggcacauuugcuaggauggaguuuccuugcaaaucugaauggccuuuguggagggcaugggcuucugagggucagccuaauggggcagaacccccgcuugcugccuggaaccagccuguuccuaggucacuguccugagacuguagauuuuccagguuuuuacagagacauugaagggcaggcugaccagugaagaccucuugauaacucagaaggaauaaaugcagacauuaaauaaauauagacuacagugguccugaagcagcccagaggagagaggagggagucuuggucauugagcaggcuauccagaguacauguccuucaagaagggacuagaagagucagugaguccagaguccuacuucagcccuggcugugaaguagacaaguaacuguucaguaucaacaguguuccaguccugucugagacagaggguggggcagagguggacuggauggccucuggugcuuugcugcauggucacguauagccugccugucuugucuuccuguggcuugggggacugaguuuggccuccauccuuuaccagagccgacaucuccacaagugugacagcugcuucccagccccuccuagacacuccaccucccagguccugcugucugcugcuuccuuccugguuaacuacugcuauauugcucuaacucccucauagcugggccacacucccaucuccggcuauuguugcugucuuccaagucuggagcggugcccacacuucucucucacacagccaccuuaucuuugguaagcagugcagagcauggugccugucaguaguugagcacuugcucacuguggagagucuguccuuauguuucagagaaaguccuugucuggucugguucagcccuugucauuccucucuggccaucucccauauccgggacuagcugugaccaaagaguagcuugcagcauauugcccaccucuucuccccugccugugcuaugccuccugccuggauccuucuacuccucacacccaggggucaccagauaccuuuucuucuaagaaacuguacuaaccccuuuggucccuaagccugagucccuagcagagccuugccuccagauugaaaaagcugccuugaggacucuuuggagaaccaggaucugugggacaggcucccuaaaaaaaaacucuguaaaacaauauauguaucuuuaagagccacaaacgugccuauugauuguagcucucccuuucucauagggcagcagcagcguccauggagcaaaaggaaugucagggcccugugcauccagacagggaccagccucagcaccaacagccaacacaaagauagcagagucaucucaggguaagcucucuccagacugucuguacugccucucccaggcagauagcaugaucacaccuccauuuucauaguccuuugaugugcauaggauccagggcauuggaguggugcccgcucccucugcuuugguguuuuggguucuauuuuaguagugacgguugagcccagagccucacagguguuagauagacaagcauucuaccuucaaguuacuucccaaaacucaguguguaucugagguuggccuugaacuccugaucuuccugcuucagucucccaguccugggauuauaggcacacaccaccauucuggggcaaugcuggggccucuugcauuccuucaggaaaagcugaggcagagauggagguugggggacugaggcaagaacagaggaccagacccagacaguuagaggagcugaguucuaucuacagccucagcuuccuucaugguggguugagcauguugcuucagcuuguaugugggucagcacuggacagagaccacugcucaagcuuuggcaaacgauccugcgauccuuucacaguauguugugcagacugcacugcagggucagcaggccagcgcuaggcaaagacacgcucugccuaaugccuucuccauccacaccaguucucaaaaagguucugaagagagggauaugcgacucuuaccaucacccguuccucccugcagaucucauuggugcgcauagcuagaaaugcugcugccugugacacauuucccaagaggugucccuuggucacugaaguuagggaacugugguuguuccaggacuugucagagccuuggaagcguguuccugagcacgacgagugggagcagccuucacacuggcguggucccacgcagcucucuuggagauaggagccuuuauacucuguauaguuugccuuuucucugcuuuuugaggcaaggucucuuguaccugggguggcggcuacuacuuucaaaaucuauguaguggcugccuacuccugagcuagccucaaacaacaacuacuacugcuauuacuacuaugacuucuuuuuccuuuucuuccucuaccgucuucucuaguauuuuuuaaaauugcuuauuuauuuuuauuuuauguacacuggugguuugagugcacgcaugucugugugagggugucagauccccuagaacaggaguuacagacaggcaguugugagcugcugugugggugcuggguauugaaccccagguccucuggaagugcagacaguguuccuaaccacugagccaucucuccagccccucuucucuaguuuuauuucauuauguguaugagugauaaacuguuuugccugcauggugucuguacaccauggggguaccugguauccuugaagcucagaagauagcuuuagauucccuugaacuggaguuagagacaauuaugagcuguuggaaauugaaccagggucuucuccaagagcaauaaauguuucuaacuccugagccaucucuucagcccugguuucaaacuugugauccuuuuaccucagccucuagagggcuagaaguacagaugugccccuccauauuguuuagaguuugacaucagagaaacgguaaaguccugaccccaucuucucuuggacaccuauuucaugaaagucaggucacuuuggggcuaccugcuuuuguuuguuuuugguuuuuguguguguguuuugguuuuuugagacagaguuuuucuguguagcccuggcuguccuggagcucacucaguagaccaggcuguccuggaacucagaaauccaccugccucugccucccaagugcugggauuaaaggcgugcgccaccacugccuggcugggcuaugugcuuuuuagcgcuuuuguuucuuggaagggcagccugugucuggcucagacaggcugcggaggcuggcagacagaacagaaggcacauuccuccugcagcaccccuggggcccuacugggccuuucugacuguguggggcauugacaucagagagggagguggaaaacgccugguguguggugcugucauacucuuuuguuuaugggaacaaggucagcagugacugcccugcccugugggagcuuccuguugguuguugaggaacucugucccuggggagaguuggcuugaacugaagcuugccuuucugggcaguggagaacaggaaaccagaggaagugccuaugugagaugggaauuccuucucugcuuguaaacaguagaguccaucaugcuggggugaggugugaccucugcugucugccugagcuagggcccaggugcagcucagggagaaguguaacauuugaguggaauuggauugcuguauaugccugaguuugucacgugacuguuuguccuuacaguaccucuaggucaguuuuguauuggucgcagagaguuucagacagaaaucccacagguugguuggaagacaaggaaaagggcuucccaguuguuugagucuacagagccacugauaggcacaauuaaauaucaguagguuuuuacagauuuauuuauuuaguuuauguauaugaguacgcuguagcugucuucagucacagcagauucauggaacugagacucuggaaggcugugaccccacugcagauguccugagaucuccugguaaguuuuuuuucugucucuugagagcuugaaaucucaaaauuaaauugcuugcugcauuacagccucacacucccucuagaguaaaaguggcuguaaaauuccaugguuucacaugugacccccaucuccgaggcgcaucugccaaaccugugcccucucugacacucagaugacaaaugugugcccaguuagguggcauggcagaacccuggccgggggcaccgugcauuccccagcuggguccuuagguucugauuuggggaguggauaggcagcuugccuuuagcuggguccccuugccugcuuguccaggccagcaccuguuccccuggucccacagcaaaugguucugcagccuguccagggugcuuacaccuacauuucuuaaccaaucucagaagacacagcagauguucauagcaggucaugaccagucuucaaggcuacuuuguucccaggggugcagacccaaaauugggcuccaguuuccuuaacaccuggagugcuagaggccccugaguaugaccugcuuacaaaggccucauuucuguccaugccucgucaagaggaggcucuuccuaagaagcaccucgaaaggcaguggagguggcgaggcuguggaggcagcgaggcuguggaggcagcgaggcuguggaggcagcgaggcugaggaggcagcgaggcugaggaggcagcgaggcuguggaggcagcgaggcugaggaggcagcgaggccuguggaggcagcgaggcugaauaggcagcgaggcugaggaggcggcgaggcuguggagguggcaaggcugaggaggcagaccugucgucuuaggacugcuuggcacaguagcaagucggaucuaggucugucgugccacccgauccuauaacaucaaauccguucaccucuccggaccucaagcucuucauauuguaagggacuuucagcccuccuguucugagagcagcagugugccuggaguccaggcugcuuuagcuggacaggaggagcucaugaguuuacagaggcagccugggcaacaucucaaacaaccccuaauaaaaacuauaguaaacauuuuuacugcauagaaaugauccaaaagcuuuuuggggaccacuucauuugggggacccccugcaacccuccaaaagaaacaaauauuacagcuguuuuacagaugagauggaauucuuuucccaagucacucacuggugagguugggagccaccaaaugguuugccaugauguuggaagcugaggggcaagcagaacugggcacauagcaagggcaguggcugggucuaagcuauaacggcuaagcuguauacuggauuccaguggccaguggggguaguccaggaggucgcccuugccuguuaccuuuuaccagaacacagccgcaccccuauguguuugcagaggacagaccuguuugggaagcccugcccuagugccaaagcaguucagguacuuuaacccuucugcuccagccugccggcuucccugggcuaugucccaggaggugaggguaagucccaagcccacagucucuuacgcauuccagcugggcuuaggagucuggccaggauagggggcugggucccaaaugagggugagaccucccaccuccuggccuaguacacgaggaagcauaaacccugggacagagucauaggcuugagccacucagucucacugggccucuagugaccaacccuuccccuuccccaggaacauuuuagccucucucuaccugcagggaaguuuccccuuagguucuguuugugcuucaacaaagggcucucugugcucuguaugcucugcggcugagagggccuguagcccaggugcaggagcugcccgagucucuggacaugcauguuuugguggucucucuccagauggaaggggcagcauguaaucucucucucuccccgugagaguguguguguguguguguguguguguguguguguguguguguguguauaggaaguaucaacaggggcucagugguuaagagcacugacugcucuuccugaggucuucaguucaauuuccaacagccacaugguggcuuacaaccaucuguaauaggaucugaugcccucuucuggugugccugaggacagcuauaguauacucauauaaauacaauaaauaaaucuuuuaaaaaaaaaagaucaacagaaaauuaggagcagugcacacugcuguaguuccagucacucagauagcugaggcuagcuagaggauugcccauaucagggcuucagagccaccugagcaacauagacuccucgugaggaaagagaagagguguaagaggggagggugaggaaaggaggaggaaggaugggaaaggggggcccugagcaguggccuuuccugagcccuggaagcagaaagaugggaggaacagcagaacugugggaggguuucaaacagguguagcaccugucuucaguuccuacaguggcacucugacuagccaccgucccaccuuauaguugagauagcauggccgaauggcacuugcucuccaagcucuuccuaccauguguguaccccuuagauuagaguuacuguggcugggguguguuacagggugggggagcacacgcugaccuuuccucacagguccuuggugguuuaguuacaguccccagcaggcugaaggcuuuuucuuacguguguuuccuauuuaaaagcacaugauacguaaaucacaagguauagaagagacaaccccaugaccuuaccuaaccucugacguaaucucacggaguuuaugugcguuuccauacaugcaguagggaggggguuuguuucauuuuguuuuguuuuuaagcugauggacuguuuucuaacaagaacagguuuaugguagguugccacagcucauguggucagucuuacgccgcggugcaguuguucucaaccuuccuaguguugccauccuuuaauacagguguggugacccccaaccauacgauuacuuuguugcugcuucauaacuaugauuuuguuauuguuauggauuguaauguaaauuccugauauguaggaaauaugauauuugacugaugugaaaaggucuuucaaucucaaggggucucaagccucaggcugagaucacugcuguagugauauuuuuuagaaggcaggugaacaagaugggccaggaacuaagccugacaacugaacucacuccucaguugcuauuugaugggaggagagugcagacucucccucaaguuguucucugaccugcacuugcucugugguguguguucccacaugcgcacaggcacacgcacacgcgcacacgcacacgcgcacauugaguaaaggggaguaguucacuacagcuggaaagauugggcagcucacucuugagucuucuagcugcagagaguuuuugguuuuguuuuuuguuuuuaaaauaaacucuguucccuugccuuucucucuuccucuuuucuuuuguuuuucgagacaggguuucucuguguagcccuggcuguccugaaacucaguuuguagaccaggcuggccuuaaacucagaaaucugccugccucugccucccaagugcugggauuaaaggugugagccaccacacuuaccucuugccuuucucaauaaaauaaaauaaaauaaaauaaauaauaaacaaaaauuuaaaggcuucaaaaaaguagacuugaaggugaggagguacaaaaauaaagagugggcucauacuucgucuuuguuuuuauuguaugacccacauguaacauaagauccuuguucucacuguguugggcgcaggcuggugccucaggucaagguugcuggaugucagggguggugguggaugcgcuccucccuguacagaagucaccuccucuaucugagaaagguucaucuugcaaaauagaaacuuuguccccaucccacagcccacuccgcggggacugaauaugaugaccccuuggaacuguaguuggugucacccugcagcaguagcccuguccugacugauugcuuuuggggaucacacuccucauccuugucagcagcuucuuauuuaggcugguaucuugggggacaguaucugggucauuguauacagauuuaugaagcgggaacacuccuauuacagaguuacaacaacagauguuuaaguuaaauuacgugcuugggccaagaguauaucaugcuggggauggauuugaaaucauuugucuccuauuccuccucugccgucugucugucugccaccuccaccuaggggagagcaguggcucucaggguugcugccuguuugacccuucugcucuugugugugugugugugugugugugugugugugugugugugugugugugucuggggaugaggcaggaucuggcaaggauggagcugucccgaguucagcugugggauaguguuuuugggcagaguguacugcuuggaagggggcgugcucacuaccaugguaaccuguacagcagccacugcugcccgaugggcccucacaagugugagcaugggagaggaccagccccugggggcaacuuuuguauaaugaaguaggucaggcacacaggaagggaagugucaagguugcaucggaccuccauucucuccuuccaccaugugagucccagaaaucugacagaaggacagauggacagaguucaacaaagugugagaucugggaaugucacaugugacaguguuaccucuacagcuccaaggggaaagaacggggccucaaagcugugccagccucaagugucacagcaacaaauuccgggaaauuaaagaccugaagcaagggggcuggagagauggcucaacagguaucucucugcuggcuguucuugcagagacuuuaauucccagcaaucacaugguggcucaaaauuauuuguaauggaaucuguuucccucuugugugcaugaagacggagcacucauauacauaagaguaaagaaaucuuuaaaaacacacaaaaagccaaagcaaagcuuggaaaugcucagucugggagguaggucagugcacagcacacaccuaugacaugugcaguucaguucucaguaccagagagacaaucuuaacacgucugccaacuaagcucagacgcugcacacucauggacuccaugugccagagccucuucagacauagaggugccucaaguccucccagccuccuggguaaaaaugccaucucugaaagucuuucaacaaaagaaagucaacaggaaagaggacugcagcaagguagcucgucaggcacaggcuguugcuaaggcugaccugacuucauuacccacaucuacaugguagaaggagagaccaaagccugcaguugaccucugaccuccacacauaccucucuccaaagaaacgaaucuaauaagaaugaacuguuuccccuuaauuaucgauuauaaugugcuuauaauaaaaagaggucauccuggggugagaaagcguagcgcaagcagguguccucuuguuaccaggguuacaguuagcagacuuugaaucuguccucgugucaaguguuuuuguacaaaugcacuuuuauuugcuguauaguauuuuguccucugaucguguaacagcuauuucauguguccccccacagcaggugcuuguuuuccugauccuuaggcccacuguguggacacuccugggcugggucugaccccacuguguggacacuccugggccaugucugauccuuaggcccacugugcgaauacuccugggcugggucuguccugcaguuugaacaggcacuggccugccuuuguuuucucugcucagucugcuugagaaacucauauuccaccuuccacaccccaaauucuacacaggggccugggaugauguguaaugguccauguuauacagaauucccagccuuuucucucuccucaggcaucuccugcccacuugugagcauuuugagagauacucagccuccaggccugggacauagucuccagaggacauugacucaucuuugcuagagccagauggggcuggggaugggacucagucgguggagcugccuggcacgcgugagggccuggauccccaguacucuguaaacuggguguaaugcuaccugccuacuauccagcacuggagcaguggaggcaggaggaccagaaacugaaggccauccucagccacagagcaguguucagggcaacuuggauuauaugaagcccuuuccuacaaauaaacaaagcgguggcuauaguguggcagggcacagagggcacagccucuuccgccuucccuucgucuauuucacccccuuucauccuuguucuccauuuaggagugucuccaagcucugcaccucuuggggcagagacccgaccugaccuauuucccuguugccuucugaacuccgucucagagcucuguagaacaccugauccucacaccugacugccagcuguucccuuuccuucuuuaaggcuguaauguauuuuggaucuuaugcucugagguuuuuggugcucagaauggaacccagggcuuggccaaauacuugcccuuugagccaugaccaugggcuccauaaaaaauuuuguuuguuuuuaagauuuauuuauuuuuauuauaugugcacugguguuuugacuacauguaugucuguaugagguugucagauccccugaaacuggaguuacagucaucugugagcugcccugugggugcugggaauugaacccagguccucucaaagaguagccaguucucuuaacugcugagccaucuuuccaggcccuccauauaguuuucuaaccaagaagaaaguguauauugauuagaaaccuaagcuuccauuuuaguucucugccuccucuuuuccauggagagccucgcugcgguugguacagaggagcacacuuucauauccuuccgugcucugggccagcuuuuccuugacagugcccauuccuucccauuccacuggccacuugcccaucuccuaugugcuggacccugucucucucucacccuagucucuuacucuguucaucuccucugugacugcgcccacagacuuuucuuuucaguagcaagugcuggagagcuuacuacacuggguggggugucuauucguuccccuuccccucacccccagccccaggcucuggccuaaaacguggcacuaugucaggaaggagucagggcucagaaagggaaagccaucugccuagcucacucuccuagagagcagcagagccagccuggccccagucuauugcuccucugcagagcucagggccuuagucccaccauauuuucaugguagccugacuguguuaggaaacugagguaguauuuuucccacugcagucuuguugaauggucuggggaggggcagaagacuggguucugucacuugccuuucagauccuuuacccauauuuuacacucccuggcacauucccuggagucuguacuccuuccagacagagaagcuagacagccugcagagaaagguccuccucucaugcaccucucucauccuuccacugcucucccuucucacucaggcacguccaggacagcugccagguaggucuccucauuggaauggcccggguguggauuggcugggcugcacugugccuggguguguagucugucuugagcauguaugcccguguguaaaaugggcauggcggguaauauugaaccuuagggaagaagcagagugugugcugcauaccuacagucccagcauuuaggaaacugaagcaggaggauugcugaguuaaggucaaucugaacuauauagugaaaccaugucucaaaaagaaaagaaaggcccggcggugguggcacacaccuuuaaucccagcacuugugaggcagaagcagguggguuucugaguuccaggccagccuggucuacagagugaguuccaggacacccagggcuauacagagaaacccugucuugaaaaaccgaaaagaaagaaaaagaaaaaaggaaaaaaaaagaaaagaaagauggaaauggccuaguggcuaaggcucuugcgccuucauuugguucccauaugaagugacuuacaaccgccuguuacuccaguguccucuuaagcagggcagugcuguaugaucccagagagacuuagaaccaugggguccauggagaugggcaggcacuuaaugacaaaguuucuguuguguaagacaaaaaggcugugcaguagcuaguggggacaucugagccacagcucuaccucacagcacuggccagacacaggaguuacacaaugguuacauuuaugguaguuaucucaucauaucucaaagcuagccgagaacgccaugggcagcacaguggagucuggacugggccgguucccagccucugcauggagagcugcucccagugugggugcuuacuucucuugcccccugggcugcuggaggguacagcaccucaccacucccuguagcuccagucccucccugaggcaggaagugggaggggccacccugcuggcucuacccaagccacauccaccugaaacugcugguuuaccacacccagauccacacccaucccugcccacucccacccuucucuuugugagagugccucuguuucuuacucacugugugcuguggacugugugcuagagaagcaucuggucuggcucaggagggggaggggagcagaccaugccaguucaaacugcgccuguaauaccccugcuguuaggguuguccucuacacaagccacucucaggcccaggccuccucugggaucagcccacaccuggccugaggugggguacacuuuggauguucauuacccucacagagcccagcuaagggcuacauagcacccagaaugugcuuugagaugggaugggagcagguggauaccgugaauggauaggagcgucuccuuuccaagggagcuaccaggucuuacugcucagagccugggcugcuuccucugcgucuugggcccugaccacuacuuugcugggcagcacagcugagcucgucuuucgauaggaggcuggauauauuucaugaacugacaggcucaacuuuccaccagaaaucaaaguuaaaaaguacugugaaauggaagucacagccagaaacugacuugauccuaguugucugucugucugucacaaccagucaccugucucacaccucccaggagugagacaggguaucucauucccuuagguccuaaaucuuuccuguccccuucuccagucuuuggcuaccuuggaugaggccuuggagccaggaaaaauaguucccugcugaaagucagcugugugauucagccagcccuccccaccgcacgccugugccccucucucccaggagugugggugguguacagagccagcuggucauuagggggcuggggccuuccugugagguaggcacucauccuggcccaagaauccaggccucaccaggagagcuagcuggcuugguggcugcuggccuagggcagguguuagugucugcuggcccugaggcgaccuaaacaaugggaaccuaggaguggggacccugaauacuugcaauagucucuuaaacaccacaaguauccggcaccuccugugcaugggaccucaggcaggaggagggcaaacucaauagagcagugaagccuaagcuuagcuaggagugggcugaugucuuacuugauaaaacgugacauugggcagguguuuggccucccagaaucucuguuuuucuguccacgaaaucgguuaaagaagacagcagagagugcacuagagccggugugggaggagccugcccugugcuguggcuauugccacuuguacuaaaugcacagggccuccaaccucacacaggugaccucgagagacugguggggagcccuuggccuuugcggagaggaucaccacggagaaccugucccuacugccaucaucaagaucagugugaaaacacaggaggucccuggcagggugcuccacuccucucugagagaaugagaccuaucugacacgauacguaacauucggugugagaacuagauucugaucauaaaagcucaauuucacuuuuuaaaaugggguggugaugcagcuccugugcagcaugcaggaagucuguggccugguccucagcagcacauaaacugagugugguggauuagggaguagacaggaccagaagcuuaaggucaccguuggcaccguaugugcuggaugagucugaggccagccugaugcuagagacccuaucucagauggcgaaccagaagucggugaaaaagcugagagcagccgcguuagcagggccauggguuucccuccaucucaugcauuuuauauuuucccagaugcucucuagugaacuucuggggauagacacuuccuauaucccacucacuacagauuuguagagcaguguaagcuuaggcuccuuggcagaaugucaaggggcuccagggacuccccuuacauucguguuuguggcacaggcaagcucuuccuaaagcagccccuguuccagcguuucucacacuaggcagaagccacuguuagaccagguucccaggcuuccaguccagccagacaagcucucuggggaggcgguccuugacuugcuguuuaccgcucucuuccccacaccacaguuauccacaggaaguuacccauaaccucccucgugcaccccuacccccaggagucccuaacuagaccugcugucucuccauagcccugucuacaccuaguguguagaaauauggagauguguuuuggucucuuuuguuuuugagauagagucuauguagcccuggccagucuagaauucucuauguagaccaggcuggccucaaacacacagagaugugccagcuucugcugguacuaaagguguagccagccgggcugguggcccacgccuuuaaucccagcacuugggaggcagaggcaggcggauuucugaguucaaggccagccugauggacagagugaguuccaggauagccagggcuacacagagaaacccugucuugacaaacaaacaaaaaaaaccuaaaguugugugccgucacaccugacuacauuguagauguuuuuuagacuucacaguuuguuuuaucagaaugaguuucggagggcuggaggaucagcaguugagaaugcuggcugcucuuucagaggaccuggguucaauuucuggcaccgacauuguccugcaaccuucuguaacuucagcuccaugggauucagacucccuauuuguccucugugggcaccagacuuguacuggugcacagucauacaugcaugccagacaccauauguauaaaaaaguaauuuaaaaguuguuuugccaagcaugagagugcauaucucuaaucccugcacuuaggagcagagggaggcagaucuuuguaaauucaaggccagccuggucuacagaguuccaggccagccagggcuacauggacuaucucaaaaaaacaaagaacaaaacauacaaacaaaaaagacugaguucuuggucuuccucacugcuucuugugaggaaauuaucuguguagcucuggcuggucuugaacuuacucuauacagaccaggcuggccuggaacucggaacccugccucugccuccugaguacugggauuaaagcauguaugucucacuacaccuaacuuguaggauggaauuucuggccauuggugggguucuuauauucuucccucauucuugggguccagacuugagagacugccuugugauaaaccccucuccuggucccuuucagguuaaaccaugauuccggugacagagcuccgcuacuuugcggacacacagccagcauaccggauccugaagccuuggugggauguguucacugauuacaucuccaucgucaugcugaugauugcugucuuuggagggacgcugcaagucacccaggacaagaugaucugccuaccuuguaagugggucaccaaagacuccugcaacgacuccuuccggggcugggcagccuccagcccagagcccacuuaccccaacuccacaguccugccgacgccugacacaggccccacagguaucaaguaugaccuagaucgacaccaguacaacuacguggaugcggugugcuacgagaaccgccugcauugguuugccaaguacuuccccuaccucgugcuucugcacacccucaucuuccuggccuguagcaacuucugguucaaguuuccacgcaccaguucgaagcuggaacacuuugugucuauccugcucaagugcuucgacucaccguggaccacacgggcccugucggagacagugguggaggagagugaccccaagccagccuucagcaagaugaacggguccauggacaagaagucaucuacagucagcgaggauguggaggccaccgugcccaugcugcagcggaccaagucacggauugagcagggcaucguggaccgaucggagacgggcguacuggacaagaaggaaggggagcaggcgaaggcccuguuugagaaggugaagaaguuccggacucacguggaggagggggacauuguguaccgccuguacaugcggcagaccaucaucaaggugaucaaguucgcccucaucaucugcuacaccgucuacuaugugcacaacaucaaguucgacguggacugcaccguggacaucgagagccugacaggcuaccgcaccuaccgcugugcccacccccuggccacgcucuucaagaucuuggcauccuucuacaucagcuuggucaucuucuauggccucaucugcauguacacacugugguggaugcugcggcgcucccucaagaaguacucguucgagucgauccgagaggagagcagcuacagugacauccccgacgucaagaacgacuuugccuucauguugcaccucaucgaccaguaugacccucucuacucaaagcgcuucgccgucuuccugucugaggugagugaaaacaagcugcgccagcugaaccucaacaacgaguggacgcuggacaagcugcgccagcgccucaccaagaacgcccaggacaagcuggagcugcaccuguucaugcucagcggcaucccggacacuguguuugaccugguugagcucgagguccugaagcuggagcugauacccgacgugaccaucccgcccagcaucgcccagcucacaggccucaaggagcuguggcuguaccacacggcagccaagaucgaggcuccugcccuggccuuccugcgggagaaccugcgggcccugcacaucaaguucacggacaucaaggagaucccgcuguggaucuacagccugaagacgcuggaggagcugcaccugacgggcaaccugagugcagagaacaaccgcuacaucgucauugacgggcugcgggagcucaaacgccucaaggugcugcgacucaagagcaaccugagcaagcugccgcagguggucacggaugugggcgugcaccugcagaagcuguccaucaacaaugagggcaccaagcucauuguccucaacagccucaagaagaugguuaaccugacggagcuagagcugauccgcugugaccuggagcgcaucccucacuccaucuuuagccuccacaaccugcaggagauugaccugaaggacaacaaccucaagaccauugaggagaucaucagcuuccagcaccugcaccgccucaccugccuuaagcugugguacaaccacauugccuacauccccauccagaucggcaaccucaccaaccucgagcgccucuaccugaaccgcaacaaaaucgagaaaauccccacccagcucuucuacugccgcaagcugcgcuaccuggaccucagccacaacaaccugaccuuccuccccgccgacauuggccuccugcagaaccuccagaaccuggccgucacagccaauagggugaguggccugcuacaggugcucagaggccuagugucucuggacaguugaugcucuggguucuagaaacagugaggguucaggagucagacccauaggccacauugcagguuugcuaaaucacaaucugggcugagucugucuuugucacagaggaucaguguuguguauaaaacacaggaauccuagcaccaagguucuuuuaaaauggguggugggaggcacgucuuaacuuggaguuugugguaucugucucccaacaacauuuugagccaagagaccagccuguguguccccagcaagagaaacuguggguggcuaugcuggcugaggugaagccuguggucucuguagcuccaccauggccaucccccucccuucucugcaucagaguggugaagaacaaagucgggcuuagaugggugggcucauccccacugcuuuucuggagaggaaauugagggccaaaacuguggaaagcaacacccuugaaguguagguggccccugugcaccagcucugugugugacugcaaagcccccaccaagagguaaugggguaguuagacgggcugagggcagagcacuuguguggcuuguggucaggggaaaccagcugcagucacuggauguugccucggagguucccuugaccucaaggcuuacagaugucuucuucuaaaaggugggggagccuaagguuagggcucaggagacagaguuagagugccaacagccaccaccucugugccuccauuaauccaguccuuaaaguaagcaggcauugcuggcucuugagugggaguugugguggccuucagcaggcgugacacuccugcugccagcagcucuuucugccagccucaggugugagggcaauggauagaucuagcuggggacucagcuuugcauggcccagaaugugcuuccgacugcugucccugggccccuucaguguaggccagccuggguccuccaugucaucgggauuggaacaaucucuauuuguuuugguuucuguacauuugagaaugcucaaggcugaugguccaacucggguuguuucuguuagagugggagccucugaaaagaggacuuggagguccaugaagaagaaaaacaauguuugggaagcacggcacaggccaguccugucuuuuuggugggggugggaggugggggugcuaaagaguguuggaggcugguuaccucagggaguugggauagacuguccaucgcacacccugaagugcuugcugugccccaggugcugggcugggcucaggaaggugugggcuagcuuucagccuugucuuauccugucccucacccccagguucucauaccaggcuugccuguuagugucaugccuauuggcugaggucaccccuuagggaaggagcuggcggaggcauguuguccuguacuagaggaaggggacccuccgacacccuguuuagcacauugcuuagucacauccugucuccaccccuacaagaacccagaugccuuuuuuagggaaaaaugugcuuggaccaguuagcagacagacuggacagggcccucauggauuugagaccacagucgggugggcggugaggugggaggcuugaacuggacaaggcugcuagagacagaaaugaagaugagucugggaggaagugugggguucucagguuucuuacaccccgagccaggaccugagagaaggugugggucuucagagggaugaucaguugugcaucuguguugggcucucagggaauuguccugagacucucaguccccuuacugugcuacuggaugaagaggggucuuugguguaaccauccaggagaagggagagcgggagagacaaggaucugucaugaccuuucgagugaaaaguaaggcuggcuuggagcauguggcugcucguuuguggggcuucagcgcaagaacagauguggauggagcuugugacuggccugcagcaaggcugguggaagggcagcuugggugugugagcucagagaugacagugcucuagauggcuuggucaggaagguugaggagccuuagaggaggcaacauccuagaggcuccuggaagacucguccuuauugaagaccaugugaccauuucuacacuaaucagggagagacagcagaggugagguucaaggcaaugggaaacagcuuucauccuucaguggacccgggacccaggggcaaaggauauguguggcuaugucaaggagccaggcuagcaaaguaccuucacuuccuccgaggccuagggacuacuugguagccgagugaugguggugagguucuggggagaggaucaucaagaaggcaucuguagaggugcggacugacugaguggaccccaccacucacuggccagaacuaucucugcuaccuuugacuuuaucguuacaggagaucauaggaugggggcaguggugggggcagcgggagugggggcagggaggcagcauggcuauucugggaaggcuuugcuuccuggguccugcagagcccacuugacuuuuauauccgugaacuucagacucuauaggcacguuaucccaucucuggcagcuggccacagcgggggagacauauugaacaagucaguuaaacucaugugaucaggcuguagccacacuugcuucccugaucauugcguccaacacugagaaagaguucugacuuaggaaugcuggagaugaguguuucuaguccaagcuuuguuucaaaaauggggaaacugaggcccaagagggcaagaggcuuccuuccuguucuugaacagggcauuguauuuggcagaaugagaaugugugaaugguggcaagaaacaaagccugcauccugucaccauaaugggcaugcaaccucagccggugcgugucaccucuccauaccaggagaauagggacagugguggaguuccugagagugggcguugugcagcucuacccguucccugugacuugccccuugcuuuuuuguuuauuuguuuuuguuguuguuuuuguuuuuuuuucaagaccggguuucucuguguagcccuggcugcccuggaacucacuuuguagcccaggcuggccucaaacucagaaauccgccugccucugccucccaagugcugggauuaaaggcgugugccaccaugcccggcugccccuugcuuuauagacacagaacauuacugcugaaccaggcucaaauugugaugucuucaguaugugagacagucacagagcauccacuaacacugagugaguugacagugucugugcugagggcuagagagaugacucaguaguuaggagacucuucuagagcacaugaguucaguucccagcaccugcaucaggcagcucacaacuaccuguagcugcaguucuaaggaugccagcacccuauucacacaagugacuccccauauagugaugccccauagauauagauauauagauauagauauagccuggaaagcuggcuucucaguuaccagugcuugcugcuccugcuaaggacuugaguucaguuccaaacaccuguauggccggccacucccaacugugucuagcacccucuuuuggccuuugugggcacuaggcauuauugugguauguagacacauacacaggcaagcacucauaaccuaagaaauccauccugccaggcguggcggcgcacgccuuuaaucccagcacuugggaggcagaggcaggcggauuucugaauucgaggccagccugggcuacacagagaaacucugucucgaaaaaacaaaacaaaacaaaaaagaaauccauccuuagaggcuggauugcuggcuuggagguuguaagcacuuguugccgagaaccugagcuuaguuaccaguauccacaugacuacuuaaaaccauuuguuaacuccagcuccagaagaucugaugcccucuucuggcccuccacuagacaugcacaugguuguacauagcauacuugcaggcaaggacucagacacauaaaaauacguaaauuuauaagacaacaaaacaaaacccaaaacaguaucugugcucagaguaaggcuaccuuguggucugauagcugaggaaggccuguucuggaaggagaagggcucuagcugggauucuggccccucucaaugaacucucuccaguuuccagaaauugcugccuuacauucagaaacugcuguuaagcuaggcaggaccaagagccuggcccugggcucuggaggugugugggauaagcauagcugccagguugauaugucucugagggcagguacuggguagagcccacugcccaaaagaugacagagggauuagcauaauggaugcugugagacccauccuggaggcagucaugauggcuuccuggagaaaguaagugaauaacuguugggcaguuuggggccuacgguaaggacugucagcauccagaggaacugaugugaaagcccuguccagccaugcaccucacccuagcccuuugcucccuccugcagauugaagcgcuccccccagagcucuuccagugucggaagcuacgggcucuacaccugggcaacaauguacugcagucgcugcccucgagagugggcgagcugaccaaccugacgcagaucgagcuucggggcaaccggcuggaaugccugcccguggagcugggagagugcccccuacucaagcgcagcggccuggugguggaagaggacuuguucagcacacugccaccugaggugaaggagcggcucuggagagcugacaaggagcaggccugagcacagccuggagcagcagcaacgagccuccgcacacccucaggccagaugggcagcccagcucucccaggacugcgacagccagcuggguccagccagaccagaaagcagggacugaggggcuggucccuuuccucccgcugggacauggacacccaggacaggcacuugcuggagaccagaaccucugagacuagucucagagugcaguauuuggacaaucagggucuucacacuggaggccaucucugccucagaggccgagccagcaccagaggcccaggaacaguaacuuagaucuggguauuuauuuuuuccacuucccaucuuuucccuccagauaacuuacacauucccaagaagguccggcucugugggaaguguuuagcacccuggcaguguucaccuuuuucuuuuuaggugaugcugacagaaucaagugcccacccagacuugggcagaguuggguagggugagccagccguaggacaguugccuuauuggcacugggcuaggcucuggcagcaaagcuuguggaagaccaggccuccagguggaagggucaggccuagggcuugccccaucagguuuugaagcaauuuuagauuuuuuuuuuaagugaguuuuuuuguuugguugguuuuuuuuuuuuuuuuuuuuuuuuuuuuuuuuuuuuaagcuuugaaaaugaugguuuggguauuaaaaaaaauuaaaaaaaaaaaaaagacacuaaggccagugaguuacagucucagggugggugguguuucccccuugagcaaagcagcaagacauugaacagaauuuccugucuuuggggugugggccaggaugucuucccaauauguccugaccgugguccagaagugccgugcucuucucuccuggggcaggcuuuuauuuuuguuugcuuuuaaggugguuuuuuuuuuguuguuguuuuuuuuuuugguguccuguuuuuuuguuguuuuuuucuccuccaugggucuuggcaggcacccuuuucauggcugucagccaaaaggaaggcucuggagcugccaagaaagggggagacuuaggcuggcuaauucccagaugaacggugcuccauuccccucccuacccccacaaugccccuccacacacacaguguuaaggagcccagagcagcugcuuccccucccccaacucuguccccacaucauggguuugcucagugccaccccucaccucuucugcuuacauuagcucugucaccaucugguccaucgugaagagcugacauuuagaggcagauugggcaugagaggucagcacugggagggcaggcuccccaguuuuaggguuccaggacaguuuguacugggcaccugguuugcacacaguacaguuuagcgucuaguggcgguaagccacucugcuuuagaucaaucacuaggguccccacuuagaaggguccucgccuuagaucaaucacauggacacuaaggcacguuuuagcgucucuugucuuaaugauuaugucugucucuccguccauuuguguuuucugcgucgugucauggauguaacccuuggaaauacugcacacuagccuuugacaaccaugaagcaauccguuacacgugggucugacuuguagacucaguucagauaucaaauaaaucuauaacacaguugccuuuggaggucuccaugccauagaacucggggugucccuucacuucucugggguguuuugguccugcuugacuaguuuauugagggaccacugcucaggcucugcucacuuuucugcccugugaaacuugagcauuguggaggcaguugccagauguggugagccagucagagcaccuguaagcuccgggcguggucaaccaugucagcuccugacgaggggucuauggccagcacauuuucuguugucccaggcacuuguuauuuaggcccucacgagcuuugauuggucagggcuagaagaagaaucuacaauaggagccagcagccagaaguccugguuccaguccaguugucuugugcugagcccaucuccccucuuguggccucuauauccccaucugugccuugggcgucucuacccuuuuuucagaagaugcuugggguuccaacucccaacgcuucaugguucugcaaagguaaggcuggcagucaaccacugggaggccucccuggcuccaagccccuucuagggucaagggcagaggcucugagagagcagauuccaguuccuuuaauuuuuuuuugucugcuuaccaccuccugcauuggaauaauaauggcacgggcaggcuuauuuaaaggggcuguaguuauacaguaguauguaagaaagguguauagauuggguggacaggaggcguugcuaugaauagagccuaagaccuugaacaugcugaacaggcauucuguucuucugcugagcuacaaccccuaacuucugggugaucuacggaggagcgcuuccuuagguucagaagcuggaaguucaggaucugacagcuguacccagugaggaauacaugcuacuucugaacaucacaggaauugggagcuugagggcuagccuggccucaggaaggguaauccuuuugugaggguggaccaaacacuucccacuaugcccugccucccugagguguugaauuuaauuaugcgucuaaacccaguguacuccaggcacacccguaaguucagaagccuggaaauauagucgggaagauggccagaagccaaagccaguuacggacuacacaguuucccaggcagaccuacaggagaagcagagagggccauuugauggucuaucaaaacagcuggaacgaaguuuccaguggauggauuugggcuuacaggucaagccauagcauucagaagucuccccgcagccuucuggacuaugugccuaugaggagccccuccuucacaaguauuuaggugaggaagaggccaaagugugaucaaagaggacaccugagcuccacaggcacugauuccucagaccugagucgucucugucccuguggacugcuugcagauagggaggauggacagagggcuucacucacagaaagacccucuuacauaccuccaguccaggaacuuccuguccugucuggucuggucuaauccaguuccacugccccuaccccacccaggaguaggaguggggguugggagagacuuucuggccucugccccagaccuguagaauucagucuggaacugguuagcuucugaggaaaaaaaggagaugugggaacaccacccacccucccccugaggccagcagagugaauagaacagaggccccuuagccugcccauccacccaggccucaccacccuaccuaaaaccacagugugggccuaaucccuaccuucaagaacaacuuagaaaauuuggagaaacugaagaaauaaguuuuauuuccacccacucaugcucacccuguagcauugggugaagcagugggaaggcacuuccuagaugcuaaucccaggcugcuuaucagcagugaguaguacuugcuguucacccuggccuguuagacacccacugcagagaaaguaaaggaccaccugucuggcugagccuccccccccccccugguuuggugagguccccaggccauugcuggcucagcagcgggggccuucucugcucuuuguuccuggaacuugguagagugucuguuuuugcucagcgguugcaucagaaaggacaaguucugccugcccugccuugugacuuucccgggucugucuccaagccuucuccagccugacccgagagaauuuccaucagcccuaggggccaguggccacagcccucacuggcucucuugaggccuggacagcccagacaaagcaguagcucccacuguuauggcccagaaaaacacuuggucaggagccaaggcucuugacagcugagcaguauguccccuugcugacuccugagacacucuguccccuggcuguacaaagcaccauuucugggaaggccagugagcagcuuuucagagcucacugugguucuggccacccugccaccccaccguagacaccagucugagggucugaggcuggagagcagaaaacaucucuaucuuuccucaucccgaggccccuggcucuguuccccaggacgcucaucugccuuuccuuagcaccucuucauagacuuucuuccagcauccagaggcuccagaucaaagcugaagaagcacacaaaguuaucuuccuaggacccuuuggccuucacaguccaaagccacucagggcccaagcccugcagucuaacagaugucccucuaggguaaacuuagauccugcgacuggggacuuucuagccuuuuccuuccucgugcuagugcugacucaaacauccuggcagucuccugccagcccacacuagacacacuaguacugcccgggagugaauuuuagagaaagacuugagggaucaagccagccuaugaaagaaaacagguaaaagcuaauccuggauuaacuggaggcugggccagggcugagacugggcccaccuccaaggucagaaaugggggaggagcaaggggagggacugggcccuggguggaaggcacagacuggauuuguuuggaaggguggagcaugggguugaauauuuucuggguagguaagaguuaaauccuucugggccucagucacuggucuuucuccccuccugaacuuucuccucuccagcccuggagccaucgagcugagccagcugaguccugcaguauuccccauggccugccugagucccucacaacucaagaagguaggggcccgugguuuggagggugcagaccucuagugaccuuugaacuaccucugacauuucacaaaggagagaaagaucccugcauaucaacccuaauuucugcgaacaaagcccaagagggccaggucacaacaccaccuccccaggugccaucuccccggucagauacaguggggguuggggcuaggagguagagaaaccacaauucagauuaucuaauccagcuagccccaggggccuguugaugaaggccuggauagggcaggccaguagcuaggucagcucauuaugaaagccuaccauacaggggguggacuacgcacacuuuaaguuaaccacccccaaucucauaugccaggacuguuaauguauuagaucuagccgaggaucuuuguuucaaagucccuccuggagcugugguuggggcuuagcaguugagugcuugcuuuaggcuccaagauuugaucccaacacucacaacacauacagaaacacacaccaccaccacacacaccccacacacacacacauaccacacacaccauaugcauaccacauacacaucaaaacacauacacaaacacaucacacauaucaccacacauaaacacggcacacuccacaauacauaaacacacacauacaaacagacuacacacacaccaacacacauacauauaccacuauuaccaccaccacacacaccacacaucaugcauacacagacacucacaccacacacacacacaccauacucacacacacaucccauacaaaugcacacacacauaccgcacacacucacauacaaacacauacauaugcaugcacacaccacacacacacacucacacacaaaugcacccaugugcacauacacacagagacacauacauaaaagcacacacauaccacacagacaaacacucaucacccaacccacacgcacucacacagaccuacucucuuuugacagcugccacugcugccacaguucccaaauuugucugugacuaaauauguaguggaagucugucugucuuuuccuucugucucacaggcuaucuuuugagggacaaagccccaugucaguauuuuuuuguacaguuugugcugaacuuuuguucaguuuuuaugauuucaagcauggagggccucccuguguuaacccugagugaugguuuguugcucuggccuagaacucagucuguagagcagacugcccuucagcucacagagcucugucugccucugcuuccuaagugcugggguuaaaggcaugggccaccaugccuggccacgcuuacauccuugcuuucugucccuuacuguguugguucuguuuguuuucagugcugggaacaggagccaguccuuguacaugcuagcaagcagucagcuucugagaggcgacccagucacacacguaaugugccucagcaccuuaggcuagccucagaauaaagagacuuggggcaaagucagaaucaggcaucuguguucacagccccuagccuuccccacacucacucaggagaaagaaagccagcaagguccugcgacuggggacuuucuagccuuguccuuccuagugcuggugcugacucaagcguccuggcaguccccugccggcccacacugaguaacacaauggaaauaaaauuuccaaugcauggguuugggguuacaggacaagccauagcaugggcaaauucacucucccuucugucugcuccccuggcuauccuccccucacccugugcuccagcccuucccaauuucccagucguccagugcccacaggcuuuguacuuccuguucucugucuuuaaugcucuuuccuaucucuuugcuucccaauguucugcucuuccuuuaaccccacuuccuccaagcugcccauugaccccuucaccucguagauucuuugccuuuaauucucaaaacccugcccuugucucccuguaagucagugugaugugggaugguauguuugucugaugguaagggaugcaugggucuccuucacuggacuauaaauugugugaguguggaggguggcugguucauaaucacauguccaucugcugaagcugucucguacucgcaaugcuuagucgggauuggaauagccuccaaagccagcauuagaaggcugaggcaggaggaucuugaguuugaggccucccugucuucaaacaaauaaaaacaaaacaagggaguuaggcggggucggugguuaagagugcuucugcaagcaugaagaucagaguucaaaucucagcacccacuccaugagcugcacacaccugcagcucagaucgccagggcucacaggcugccagucuaaugaagaaaacagccuagguucaaggagagccucagaaauagaaaguggaagaggggcaccguauguccucuccugaugccccugcacaugcgcaccugcaguucucacacauguucuacacucacaccugcacuuuaacacacaaaugagcaaauguuuccguaugucccaaacccauuggagggcaagagcagaggcagcugccacuuccccuuccucgauaagaugcaagcagccaguacugacggcuccucacuaagcacuggaugcccauguccaggguggggggcagagccaugagcaggacacuugaucuugguucgaguuugugguccaacauggauauaaggaaugagcgagggcggaaggagccugagucuugucccugcugcaguuccaggaggacggguuucugcuguuggaaggauucuucacagcggaugaguguguggccaugcagcagaggaucggugagauuguagcugagauggaugucccucugcacugccggacagaauuuuccacccaggaagaugagcaacuucaaacccaggcagguaccuggggcgcugagggugggcgucugguuuuggugggugcucagucuuaggcagcagucuggacuggacgggaggacccuaaggccacacacagacuucugacaagggaucagaccucagccaucuguaugccggguaccaggcuaaagagcugugcuguauuccuccacacuaugaauuuauaagguggcuauuauuauucucgcuuggcaaugggaaaagcggggcuuuucucuggguaauauugugcugcuccaaccacacaguuuguaacugauagagacuugaauccaccucucugauaucaaaugaugcuggucguugaccugcugcaguuucucaaauucucuggucacaaagaacucucugugaccagagugagcccugugauaggccacucuugggugagucaucucccaaccagacuaggaaggccucuugcuuccucagacucaacacaguuuggcaggauaggugguucuuccaaccaguucccuuaacccuucuuagucugaauuuuuuagugguucaggcaacagggcucaccuuauacugaugccaaggggcuucugccaucugguggacauaaauagaauuacagcagccagaaacugcuuucucccagagaggggaggaggaaggauggaggcuucagaagaagacacauaacagacugagaauuuuuccaacuagcaggacagacacacucuaaggaaugagggggccgaacccugucccucucccuaguuacuuaccgagaagacucuaacaguccggugguugcagagguaggaauguugaaagaagaaagggugauguuagagauauggcucauugguugagcauacuggcugcacuuccagaggaccaagguucaauucccagcucccaguucccacaugguagcucauguacuuccaguuccaggggcccaauacucauacagauauacacgugggcaaaacaccaaugcacacaacacaggacacagaggcaggugaaucucagugaguucuaggcuggucacucuacaaggugaguucuaggauagccagauacagaggaauuguguugaaaaaaaaaaucaaaaacaaaugaagaagaggaggaggaagaagaagaaguggagaugguggugugguuuggggugcuggaauugaaccuggguucuuuuuuuuuuuuuuuuucuuuccuuuuuuuuuuuuuuuugguuuuucuuuuuuuuuuuuuuuuaaagacuuauuuauuuauuauauguaaguacacuguagcugucuucagacacuccagaagagggcgucagaucuuguuacagaugguugugagccaccaugugguugcugggauuugaacuccugaccuucggaagagcagucgggugcucuuacccacugagccaucucaccagcccuuuuuugguuguuucgagacaggguuucucuguagagcccuggcuauccuggaacucacucuguagaccaggcuggccucgaaccagaaaucugccugccucugccucccgagugcugggauuaaaggcaugugccaccaugcccggcuugaaccuggguucuuaaaagagcucacugagccaucuucccagcccuaagaagcaaugaccuugcacuuaaacuuugcucuuuuccccggcaauacagcugcagugcugggcggagacagggagaggcaccuucuguaggagacacagcaagguuuuguaauguauguauugcuagcacuguucagauagaauauuugcuuguuuguuuugagacagggucuuauuuuauagccuuguuuguccuggaacuugcuguguagcccaggcuggccucaaucacacagagaucugucggccacaauugugucauuuuuagcucaggacuccacacaccaccuaagauacugaauauaaaauaggcacaaccgccaggcgugguggcacaugccuuuaaucccagcacuugugaggcagaggcagguggauuucugaguucuaggccagccuggucuacagagugaguuccaggacagccagggcuacacagagaaacccugucuugagaaaaaaaaaaauaggcacaaccaccugcuaauguaaguugguuuuuuuuuaagauuuauuuuauuuauuauauguaaguacacuguagcugucuucagacaccagaggagggaaucaggucuuguuacagaugguugugagccaccaugugguugcuggggaccucuggaagagcagucagugcucuuuaccacugagccaugucuccagccccguaaguuuucuucauauguuuaaggcuagguaaagcuguucaaccagcagguguaacagugacuucuugcugugacaaaacuuggccaucagaaggaggauugguuuauugggcucccuguuucagaugguucaguccauggucacuuggcuuugccgcagaauauuuaaucacaguguaaacccggagauuguguuguuuacuggggaaaaaaccuauuucuaguugugaugucgcucagcccuuagcacacagcuuuaaucccucugacuagaauauagacacgcccuuaauacacaccuuuaaucccccaagaugaagguauaguuaguuuguagaaggaaguacccauauuugaaagugaugucuaauugaguagcagacaaagugaugaaucagagaaagauuagacagagcagaauaugcacaacucucacgaggacaggcugcuuaggagcgagcagcacagagagaagaaggaagcagguuuuuguuguuuuuuuguuuuguuuuucgagacaggguuucucuguguagcccuggcuguccuggaacucauucuguagaccaggcuggccuggaacucagaaaucugccugccucugccucccaaaugcugggauuaaaggcgugcgccaccaccgcucagcugaaggaggcaguuuugggaugaagagagaacaagccagacacaggugaagacaggagagccagacaguaagaaggagcuggaagauucgaaccuauugccaaagcuaguaugaggucaagcagagcaauucagucaaaggccaagggaggagccagauugaaucggucagcuuggcaaggcguuaauucggcugaguugagccagccagagcucagagagaacaagaaaggcugaucuuauucagcagcaagucucagaggcucaaaacauccuaggccuagaucagauugcauggcggcuagaggcuucugggacuaggccuaggugagcagauauagaggagcaaaccucugagaugacaguuauuuuaggcgaauaaaagcuacuuuuauuauggcuucaugaccuugggccuggggugagacagcguuguggcagaggggucaugaugaggcagagguguucaccucacagcagcugguaagcagagagggugcagaggaaggguucuguggcaagacgaccccuuccuucaaagccucagcccagugaccuacugccuccaaacaggcccaagcucccaagaaugccccagccgugagcucaucaaaggacuaaugcagcaaccaaguuaguaucuuccuauguagugaucaccacagcuggggaccaagccuccaauacgugacucuuuugggaagacacuuuuguguauacgcuguaagaacugcuuagauguauuaaaagcauuuuguucuuguuggcccagucaguaaacugcuugccaaacuaggauggagacuugaauucaauccccaagaccccacuuaaaaaccacugggguguaccccuguaguccuacugcuggagacggggaggcagauggauucuuagggcuuccuggcuggcuagccuagccuacuuagugaaucuugggucaguaagagacccuguuucaaugaaagcaguguagauggcccuggaagaaugucaccuaagguuguccucugccccauaccaguacauauacaaaaggcauuauuuuuuugugguggugggguguuucaagacaggguuuuucuauagcccuggcuguccuggaacucacuuuguagacuaggcuggucucaaacucagaaauccgccugccucugccucccaagugcugggauuaaaggcgugugcuaccaugcccgguuuacaaaagccauucuugaucuacaaaauuuucaauuuagggguuagggagaugguucaguggguaagagcacugacuacucuucugaagguccugaguucaaaucccagcaaccacaagguggcuuacaaccaucuguaaauggaucugaugcccucuucugcugugucugaagacagcuacgguguacuuacauauaauaauaauaaauaaaucuuaaaaaagaaaacaaagauuucaacuuagauaaauguauccuguccaagcuccaugguaacuuaaggagcaucuguaagaagagauguucaggaaauuccagauuguggcuuuaggcaccuggaauucuagcugacugucuguacuacaguggccauguuugagaagcccccaggaggcaucuguaguccuguguggguagguagcuccugauccugcccugcucugucacucagcucuucucuuguaccuccuaugcccccuccauagggcaagacagacuacuucuugagcagcggugacaagauccgauucuucuuugaaaaaggcguuuuugaugagaaagguuuggggacaugaggguuagugggcugggucaggguggcuaacuccugaggcugggagaagcugagaucagcugccugauggaagccggaucccaggucuucugccuuuguuuguuuuuuauaccacaggaaauuucuuggucccuccugagaaaucuaucaacaaaauuggccaugguaagcaggggccugggagugcagaaaagcaagcagaguagccgagaucugaagaguuuaggagacuuaggaccaaaugcuaccauaagauggcaguuaggugggugguagugguucucaggacacaaaggcagacagaucucugaguucaaggccagccuggucuauagagagaguuccaggacaacuagggccacauagagaaacccugugucaacaaaacaaaacaaaauaaaaagaugguuuugaccacauggcucuggccacaggcucuccucugccucagucuucugcgucccuugauguugaucacuggugagccccagcugagaaauggguccacuuguguggcucccaagaugggcagugcaggcucuucuacuuucuacugccugcucugggaaugaucccuagccacugggguucuggcuccagguacuuccuagaguuucuugcucucucuuuuuuaaaggauguauguauuuauuuuauguauaugaguacacuguagcuauagagaugguugugagccaucaugugguugcuaggaauugaacucaggaccucugcuugcucugguccagcuugcucuggcccaaagauugauugauugauugauugauugauugauuuauauguaaguacacuguagcugacuucagacaccccagaagagggugucagaucccauuacagaugguugugagccacuaugugguugcugggguuugaacucaggaccuuuagaagaguagucagugcucuuaaccccugagccaucucuccagcccuccuuagacucuuuuuguuuguuuguuuguuuucguuuuuucaagacaggguuucucuguguagcccugacuguccuggaacucacuuuguagaccaggcuggccuugaacucagaaauccaccugccucugccuccugagugcugggauuaaaggcgugcaccaccucgccuggcuuagacucuuuuuuaaauuaaacaucuauuuagucuucccccccucccugcucccugcguguguguugagaacuggcuagagugggaguguguccgcaugagugugccguggagugggaguguguccgcaugagugugccguggagugggaguguguccgcaugagugugccguggagugggaguguguccgcaugagugugccguggagugggaguguguccccaugagugugcuguggagugggaguguguccccaugaguguccuguggagugggaguguguccgcaugagugugcuguggaggauguguggaggucugaggacaaccuggaggggacauuucuuucucugugauugugaacuuggguugucaggcuuggcggcagguacauuuacccacugagucaucucacuggcucucuguuuugguuugccuuucuguuuuuucuuugucuaauccaggcuagccuggaacucacaaaccuacugcuucagccucccuaguguggggacuauuagauauucaccauaauaccuaguucaucauuagcauuucaaaauauauaauucagggucauuaaauauguucaacuuuuuguuuuguaauagcaguugcagaugcuuaugauaagggaucaucuugguaggaucugggcugcugucgcacacuccuuagcccacugugcccuagagcaucucuggggacacagcuguucuucucaccccacuuuauagagaggagacugaggcuugcagggagaacugucaucuggguucucacagccucagugacaguccugagauugcuauaagagacaguccuucugacucuaugagguauggggagucagggcuggaaugaguuuuccaggugcccagauggucccgaauaaggacacaggcagaccagagauauagcucaguugguggaguguuuguauaguacacauaaaggccaggcuuuaaucccuagcauaguaugaacuaugguggacuguggcuucaauggcagcacucagggguuggaggcaggaggacaggaaguucaaggucaucuucuaguacagaguaaguucaagcuauccugggcaacaugagacccuguugaaaaagcauaauaaaagaagaaaggaauaaggcccuggacagaguaaggucaaggugucuguguccccuuuacuuagcuauaaacaagcauaaaguuucaaauaugugagaauuccaaauugaggccugacuuuaguguccagggugugggagggauacacaggugcugaggcuagcucaugaacccaucucugguccauagcucugcaugcccaugacccugucuucaggagcaucacacauucucccaaggugcaggugagugggugcuggaggugaggguggggaggugugaggggcacauacgaaugggaucaggcugguggcauguggcuuucaucuucuaggcuuugguuagaagucugggccuccagaugccagugguggugcagagcauguauaucuuuaaggugagcuccgcagccuucucuaacucaguuucccccuguaagauggaagacuguucauacacagcuuuaucuuacaauagaccaggaacugcuggaguugacuagguuguggggagggcacguaggcuggccucuggcuaaggugcugagugcugcacagaugcucaggaaaaccuguuuaaaagaagccaagggaacccugcgcucccuguucugcucucagcucucaagggccaccucagugcuaccuugucaaagaaacuaccuaaaucucuaugcugcccuccuagacugagcgcacaguagguacucagucgaugggugcucgugcaguguuggaggaccuacaagacucagauccagcccugucugcucuccucuccucucaccacauccuugcccucucuugcagcaaccucacuuuggcggcgaaggugagcugagacuaggccccugugcugugggggccaucaaaggccucgggcuggagaugggacaucaguggccauccgguguuugaaaggaggaaaaacacuucucucagggucugugggaugggcaagaaccugacccaggaaggaauaaccaccuuccaucccugccaguagauuguggaagggucccuagaacccuuggcacagugcucccaauuccaauggcaaacuuagcugguuauaaccagaacccucaguccucccugagauauucuuguuuuuguuugagaaaggguuucucugaggccagccuggucuacagagugaauuccaggacagcuagggcuacacagagaaacccugucuugaaagaacaaaaaccaaccaaccaaccaaccaaccaaccaagaacaaacaagccaguguuacuuuugccugaggugguggcgcacuccuuucaccccagcaccacagcacuccaggagacagagacauuuauguauguauguauguauguauguauguauguauguauguauguauguauguauuuauuuauuuauuuauuuauuuauuuauugguuuuucgagacaggguuucucuguauagcccuggcuguccugucagaaauccgccugccucugccucccaagugcugggauuaaaggcgugugccaccaccgcccggcccgagacauuuauuuuugauaacacuguuucccagaucacucagcaugugauugcagauagaaggaguuucggggcuccaccguggguauucugcucagaugccucugcugccccacucacauggagcccugugcuuggcacaagcucaguucugacuccuugugaccagccuuccacacagcaccaaagggccccucccaggguaacauuggggauuucaaagucccuauggaugcuuauaagaaugaaggugauacuuguuacuguagacugagcuccucucuccuggggcaucuccauccagcauuggacuggcaucaucacagggggcuuuaaacaguggaugcaaauggacaggggcugugucuccugacuuguaagagaggauacuagugccugugacaagccuauaaucccagcuucucaggagucacuagcauuggcaacuuacugagaagacccuaucucaaaacaaggguaaagaaggcuagggcuauaugucagugcgagaacaccuaccuagcaugcaaauaugggugcugucagggucuaguggcacaaaacuguagucccaguauccaggaggaugaaacaggauugugaguuucaggcuaaacugagcuacauggcuagacccugucacaaaacaaaacagagggaagaaauguaguggcuuggucauucauaguuggugccacugcucugcuuauguucccagcuuauccugggggugggccguuguugauucaaaccugcuuaccccugguuaacggaggcuuuagcagggcagugguggugugcgccuuuaaucccagcacucaggagacaagaggauggaggauuucugaguucagggcagccagagcuacacagagaaagaaauccugucuccgaaaagcagauaagaaugauggucuccaugauguggcugguuaaacuuagcuaccuuuuuuuuuuaaagcauuacaagguuggccuugugcugagcaacuuuuaaaaagauuauauaugggguuggagagauggcucagcaguuaagagcaccaacuucucuuccagagguccugaguucaauucccagcaacuacaugguggcucacaaccaucuguaaugggauccgaugcccucucugguaugucugaagacagcuacaguguacuuauauaaauaaaauauuuguuaagauuauauauguuuuauguauaugugugcucugucugcauguacuucugcacaccagaagagggcaucagaucccauuacagaugauugugagccaccaugugguuucugggaauugaacucaggaccucugggcagccugugccuauaccaucaagucaaaucuccagcugucuguccuguacuagguaauuuuagcaggucauccaacugaucucuagcaggccuuugaagcagguuggaaccacucuacagugaagagauggaaaccuucagaggugcagucuuugcuuagagcuuauaggccaggcaguggugagacucuugacuggagauggauaggcuaacccuggaaggacauggaaugagagccuggccagggugaggugaggccuggccaaaggccuuguaccuuacuccugggugggucuccuagucuccccucaccaggaugcuaccuuccucuacacggagccccuaggccgaguguugggccuguggauugcgauggaggaugccaugcuggagaacgguugccucugguucaucccuggcucccauacccgugaggacacuauuuaugccuuuccacccaucuccagggagagggacauacacaaagagugaauaaaggcuccauguugguccacagguggggugucaagaaggaugauucgagccccuucagacucugggccuggcaccagcuuccucgggucagauccagccugggcuagcaaccucuuugugccuuugccagugaggagagguaggugaggugcagguggccaugcauaguguucuauauuugccccacucccugcauacaaaggcuccccguggugccugccaucugagggccuugaaauuggagaaugguuggugguggcacaguauggggcuuggaugucagcagaggugugcuuccaguagguuuuuuaaggucagacuaaaguucuugacggaccauuucuugaaguagacguuugccccuuugacccuuaguguucccagguagaaggcaaucaaugcagguugauuacagggaacguaugaggugcaguguuccuuguguguuggcagguagugccugguuuuccuuaugguaaggggauacuugaugccaacucagucuaucuagggaaggggagccccccacccccagcuuuugaggcaugguuucccgccugccucugccuuccaagugcugggauugauuaaggacuugcccugccacaccuggccugcaaaggcccuucauaacgcuucccacggcaggucacuguggaaaagacuugacaucacaggaaccucuaacagcauggccucagcuccgggagggagcacgagugacagcccgaguuccuaaggauaggaacggacacuucucccuuugcggaaggagggcuauguuccuuauucccuugggaagaagacugguugcuacgggguugguggggacuugcugguaacugugugguguuccccaagggggucugguucugauccauggagaaguggugcauaagagugagcagaaccauuccgaccacucccgccaggccuacacuguccaccucauggaggcugccggcacugucuggagcccagggaauugguagguaccaagguugguaugugccccagagagccucccaagaagacccuuuaggcuaggcacagugaggcagaggcaggcagauuucugaguucgaggccagccuggucuacagagugaguuucagaacugccagggauacacagagaagcccugucucuaacaaacaaacaaacaaacaaacacacacacaaagaagaagaaaaucacaaauuagauaucuuuuuuuuuucuuuuuuuuuuuucaaagauuuauuuauuauuauauguaaguacacuguagcugucuucagacacaccagaagagggagucaguucuuguuacggaugguugugagccaccaugugguugcugggauuugaacucuggaccuuuggaagagcagucgggugcucuuacccacugagccaucucgccaucccccaaauuagauaucuugauggugaagaucaaacuugcuccaaggaacuugauuagcuaaucagcaggaaguaauuuaaugauaaggucacccauuuuccccuauuuuuuuccuccuauguaguguuaggggguuaggguggacauggguggaagaaagaacucacaaaguagccaaaguccagcugcagcaccuuuugcacucucuccaggcuccagcccacgcccgagcugcccuucccaccacucuacagcuaaaggcccuggcaggacagggcagguccccaagggaugcugacaacaccaggcuaucuggcugcaacucaagggcacgucuuccucuaugggcuuucuuucugauggugucugugaccuugguccagcagacagggagccaagaaguaaaaaugagggcaggagcccaggcugcacaagggucuucuuccaaaauuuucucucuauauaccuuucugucccaacccagcuuucugaaguggcugcuuaaccaugcaaggauuguguuugagucucacuuuucucuuggauggauguuacuguguaaggcacugaauaaaaacgacuuaaaauauauuuuauauguacggguacuuuguauauaugucugcaccacauguuugcagugccugugaaggucagaagagggcuuuggauccccuagagcuggaguugcagguggugugagcugccuggugccugcugggaacugagcacuugucuguaagagcagccaguguucuuaacugcugaggccucuuuggcucacaaaaugacuuucucuauccaucauucucucacuaaagcccugcagaaagccaucaagggcacuccacugugcuugguguggugacacauaacaauagugagcaacguucuguugaacucaccgcucagcuuuaucucccaguccuuacaaggaaagggucucugcaauguguaugcauccaggacuagagaccagcaaaggacaagugaccugcucaggucacacaaauacccaguccccuccaggccugagugucuaaccuccaaccucuuucuccucuuuaggaaaggagaaagaacccuggagcuaggaauccaggcucuggucuuucugggucuggaucucaggccagggccuuccuuucuuagggccuugucauacuguuuaacaaagucaaugaaggccugccggucaccucccucucucccuccuuucuuacugacuuaggagaccuagcacagaucuguguccccauuuguuggucaaccacuucuauagcccaggucuagcccucuaccaacuguaaagcccagcagaguguuuuacagggagcugaugggcaacuuucuccuacauugggccaccuccuuucaaacagagaggggagccugugaagauagggcuuguuacuuuccugcuguuaucuucucaggauggcaacuguucauuugucuagucaaugucuaccaaguucuugccccgggccaggcucugugugaacccugggagauguggagacucaggcaugggacuagacagcuugcacccacaccuacauggaacuguuacaaauucuccagaaaguccccagccuuuauggaucuguacucugcaccagaagagauuaauacagguuuggacaggucuggauugugaggauuguuggguucauccuaacuauuuuugacuccucucuggguagcagaggcaggguggggccagcuuucuucagccuuucuauggacacaagcugaccuauggccucccuucuguucuuccuaggcaaagcaggcaacacuuggugcauucaguucuuucccucuugggcuuuuccucugagugaggccacgagaggaaaggucacucuggcuuccaaguacgcucagcuaucuuccuccuaucuuggcuagcuuuuugcugagacaagauuacucuuggguaauaaugacacuuucucauacugacccaucaugggugggucacagugugaacacuuaaaauuauuauuauuauuagcauaugugggugugacaccuguggaggugugcaugagccgauaugcccauguggauguugaaagaccaagccuguagucucaggucucuccuuucaccuuugugugaguucuagguacugaucucagguccucagccuuguuuugcaaguacuuuuacccacugagccaucucacugacacccaggcugaauacuuuagacacuuuacacauuuccucucaauagacuuccaguauccagucaggcugacauuauucucaucuuacagauagaacaauugaggcuuagacucuuuuuugagacaggguuucucuguguagcccuggcuauccuggaacucacucuguagaccaggcuguccucaaacucagaaaucuuccugccucugccucccaagugcugggauuaaaggcgugcaccaccacugccagaugaggcuuagacuuucuuaaggccacacaguuaaucuguauggccaaggauucuaaccagauuugucugacaugaacaccuaagcauuaugcuuucuguugaugccugcaggguguacucuagccaugcucuacccagauuuuaaaaugggggcucugcagcauauucaaguuccuugaauugguguaugccuuuaagccuuuuuuuuuuuuuuuuuuuguauuuuaaauaucagcaaaaauaaaaccaggagagcuuugcuucuuuauuuuaagucugaaacaacuuucuggcuucaucuuccuggaugaagcaaaaucugcuuuccaucucuugauucuugguguccagguggcuagcugcuguggggaccauucauucuauuucccuguuuccccaucacagcugcuacugguacuaggccaucagcaauaucaguagguagagaggcaacaggagauugucuaucugaguaguguacgcuuccagaagggauacagugcugauggaccccaaaauccaggcauaacuguaguucaggucuacuccacugucaaagauuaagauuagagcuacagagaugauuugugcaaauauagaugucauaguccccucgaagguuuucuuaguuccaggccagcggaucucucccauggugcugccaaauauggaggccacaguaucacccacacccacagccaagaccccagcauaggggaccagggcucuugcuccuuccaggcuguccuucuguguacagggucuggggaucagccaaauaggaagagacaugcccagaagcagguagauguguguuaggauaagggguccacugucucguucauccaggaagagggacagaaggcuucgcagagugugacccaagggcuuuauucggaaauagcgcacauacuccaggaagaugaagacugccaggcacacaguggcggccacauacagcaguggccggucaaagaugaugcccgggauauaaguggcuaccacaaugaaguggaaauacuuucuuguaaugguaggcgcccugugcuucuuggacucagaagacgaccgcuuagcauucugguacagcaccaccaggcaggccacagaggccagcaaagaccaauaggcaaggagguagaugcgaguuucaguguagaagaggaacugaagaagccaaagcaggggguuccuacgaaugagccagugcagccagggcagaaccacaccaaggcccagcacacaggucaugagguggaagaagauggaagaggcccaggugccugaauccaugaagacaaagagggugcugaaaaagacacccaugagcaccaucccuaccaccaccaccaacaggaagaaguccacugggucccccuggcuuucagucagagagcgcuugaugaguugguuaaggacgaagcuaaugccacccaauaccagcagugccuccccaggagugaagcaucggggcagcagguacagcaggaucauguugagauaaacaaauauuagcaggacuuccaggaccucgaucaccucgccuacacugagcgagugccucauaauauaaaugauaacgccuccagccaaaccagagauggcacaaguauuggugggcaccgggcgaguaaugcccagugccaacacggaggagaagagggccacugccaugccaguagcugcaaccacaaugccgaagcgcucgaaguauggguucccugcagucuggcagcgcuccuucaugacuagcccaagcaaaggcaugaccauggaggccggcaguaagccgcuguucgcggacauccggaacuggaaaacggcauugcccugcuggagcagccggucccacuuguacuggacguagaaggccugcaccgcgagggccaccgcgcaccaggaguaucggucccacacugcagcguggaugcucaacaccacggcgaacaccacugcagccuccgccagcaccgacccgcucagcgcagccccagacuccuggggagggcacugucgggucaugucucuaggucuggcgcucuugggagaagaaguuuggugacuagggacgccuuggccucuggggcccucaacccgccaagcagaggggcagcaauuucacccagccagcaaccuucuccagcuuccaaaaggguguuccaccacgggccacucugaggccugggagccggcgcccagucacccgccuccgcugucaaccuacgguguagcagauguuugcccucuucaccgcucacagucuccaccgccuccaccgcggacuccccucgcaccagggcagcgccaucuugacagccccaucuugaccacgcccaccaucacgug

SEQ ID NO: 738 - RNA, 48642 nt, Mus musculus
cacgugauggugggcguggucaagauggggcugucaagauggcgcugcccuggugcgaggggaguccgcgguggaggcgguggagacugugagcggugaagagggcaaacaucugcuacaccguagguugacagcggaggcgggugacugggcgccggcucccaggccucagaguggcccgugguggaacacccuuuuggaagcuggagaagguugcuggcugggugaaauugcugccccucugcuuggcggguugagggccccagaggccaaggcgucccuagucaccaaacuucuucucccaagagcgccagaccuagagacaugacccgacagugcccuccccaggagucuggggcugcgcugagcgggucggugcuggcggaggcugcagugguguucgccgugguguugagcauccacgcugcagugugggaccgauacuccuggugcgcgguggcccucgcggugcaggccuucuacguccaguacaagugggaccggcugcuccagcagggcaaugccguuuuccaguuccggauguccgcgaacagcggcuuacugccggccuccauggucaugccuuugcuugggcuagucaugaaggagcgcugccagacugcagggaacccauacuucgagcgcuucggcauugugguugcagcuacuggcauggcaguggcccucuucuccuccguguuggcacugggcauuacucgcccggugcccaccaauacuugugccaucucugguuuggcuggaggcguuaucauuuauauuaugaggcacucgcucaguguaggcgaggugaucgagguccuggaaguccugcuaauauuuguuuaucucaacaugauccugcuguaccugcugccccgaugcuucacuccuggggaggcacugcugguauuggguggcauuagcuucguccuuaaccaacucaucaagcgcucucugacugaaagccagggggacccaguggacuucuuccuguuggugguggugguagggauggugcucaugggugucuuuuucagcacccucuuugucuucauggauucaggcaccugggccucuuccaucuucuuccaccucaugaccugugugcugggccuuggugugguucugcccuggcugcacuggcucauucguaggaacccccugcuuuggcuucuucaguuccucuucuacacugaaacucgcaucuaccuccuugccuauuggucuuugcuggccucuguggccugccugguggugcuguaccagaaugcuaagcggucgucuucugaguccaagaagcacagggcgccuaccauuacaagaaaguauuuccacuucauugugguagccacuuauaucccgggcaucaucuuugaccggccacugcuguauguggccgccacugugugccuggcagucuucaucuuccuggaguaugugcgcuauuuccgaauaaagcccuugggucacacucugcgaagccuucugucccucuuccuggaugaacgagacaguggaccccuuauccuaacacacaucuaccugcuucugggcaugucucuuccuauuuggcugauccccagacccuguacacagaaggacagccuggaaggagcaagagcccugguccccuaugcuggggucuuggcugugggugugggugauacuguggccuccauauuuggcagcaccaugggagagauccgcuggccuggaacuaagaaaaccuucgaggggacuaugacaucuauauuugcacaaaucaucucuguagcucuaaucuuaaucuuugacaguggaguagaccugaacuacaguuaugccuggauuuugggguccaucagcacuguaucccuucuggaagcguacacuacucagauagacaaucuccuguugccucucuaccuacugauauugcugauggccuaguaccaguagcagcugugauggggaaacagggaaauagaaugaaugguccccacagcagcuagccaccuggacaccaagaaucaagagauggaaagcagauuuugcuucauccaggaagaugaagccagaaaguuguuucagacuuaaaauaaagaagcaaagcucuccugguuuuauuuuugcugauauuuaaaauacaaaaaaaaaaaaaaaaaaaggcuuaaaggcauacaccaauucaaggaacuugaauaugcugcagagcccccauuuuaaaaucuggguagagcauggcuagaguacacccugcaggcaucaacagaaagcauaaugcuuagguguucaugucagacaaaucugguuagaauccuuggccauacagauuaacuguguggccuuaagaaagucuaagccucaucuggcagugguggugcacgccuuuaaucccagcacuugggaggcagaggcaggaagauuucugaguuugaggacagccuggucuacagagugaguuccaggauagccagggcuacacagagaaacccugucucaaaaaagagucuaagccucaauuguucuaucuguaagaugagaauaaugucagccugacuggauacuggaagucuauugagaggaaauguguaaagugucuaaaguauucagccugggugucagugagauggcucaguggguaaaaguacuugcaaaacaaggcugaggaccugagaucaguaccuagaacucacacaaaggugaaaggagagaccugagacuacaggcuuggucuuucaacauccacaugggcauaucggcucaugcacaccuccacaggugucacacccacauaugcuaauaauaauaauaauuuuaaguguucacacugugacccacccaugaugggucaguaugagaaagugucauuauuacccaagaguaaucuugucucagcaaaaagcuagccaagauaggaggaagauagcugagcguacuuggaagccagagugaccuuuccucucguggccucacucagaggaaaagcccaagagggaaagaacugaaugcaccaaguguugccugcuuugccuaggaagaacagaagggaggccauaggucagcuuguguccauagaaaggcugaagaaagcuggccccacccugccucugcuacccagagaggagucaaaaauaguuaggaugaacccaacaauccucacaauccagaccuguccaaaccuguauuaaucucuucuggugcagaguacagauccauaaaggcuggggacuuucuggagaauuuguaacaguuccauguaggugugggugcaagcugucuagucccaugccugagucuccacaucucccaggguucacacagagccuggcccggggcaagaacuugguagacauugacuagacaaaugaacaguugccauccugagaagauaacagcaggaaaguaacaagcccuaucuucacaggcuccccucucuguuugaaaggagguggcccaauguaggagaaaguugcccaucagcucccuguaaaacacucugcugggcuuuacaguugguagagggcuagaccugggcuauagaagugguugaccaacaaauggggacacagaucugugcuaggucuccuaagucaguaagaaaggagggagagagggaggugaccggcaggccuucauugacuuuguuaaacaguaugacaaggcccuaagaaaggaaggcccuggccugagauccagacccagaaagaccagagccuggauuccuagcuccaggguucuuucuccuuuccuaaagaggagaaagagguuggagguuagacacucaggccuggaggggacuggguauuugugugaccugagcaggucacuuguccuuugcuggucucuaguccuggaugcauacacauugcagagacccuuuccuuguaaggacugggagauaaagcugagcggugaguucaacagaacguugcucacuauuguuaugugucaccacaccaagcacaguggagugcccuugauggcuuucugcagggcuuuagugagagaaugauggauagagaaagucauuuugugagccaaagaggccucagcaguuaagaacacuggcugcucuuacagacaagugcucaguucccagcaggcaccaggcagcucacaccaccugcaacuccagcucuaggggauccaaagcccucuucugaccuucacaggcacugcaaacauguggugcagacauauauacaaaguacccguacauauaaaauauauuuuaagucguuuuuauucagugccuuacacaguaacauccauccaagagaaaagugagacucaaacacaauccuugcaugguuaagcagccacuucagaaagcuggguugggacagaaagguauauagagagaaaauuuuggaagaagacccuugugcagccugggcuccugcccucauuuuuacuucuuggcucccugucugcuggaccaaggucacagacaccaucagaaagaaagcccauagaggaagacgugcccuugaguugcagccagauagccugguguugucagcaucccuuggggaccugcccuguccugccagggccuuuagcuguagaguggugggaagggcagcucgggcgugggcuggagccuggagagagugcaaaaggugcugcagcuggacuuuggcuacuuugugaguucuuucuuccacccauguccacccuaacccccuaacacuacauaggaggaaaaaaauaggggaaaaugggugaccuuaucauuaaauuacuuccugcugauuagcuaaucaaguuccuuggagcaaguuugaucuucaccaucaagauaucuaauuugggggauggcgagauggcucaguggguaagagcacccgacugcucuuccaaagguccagaguucaaaucccagcaaccacaugguggcucacaaccauccguaacaagaacugacucccucuucuggugugucugaagacagcuacaguguacuuacauauaauaauaaauaaaucuuugaaaaaaaaaaaagaaaaaaaaaagauaucuaauuugugauuuucuucuucuuuguguguguguuuguuuguuuguuuguuuguuagagacagggcuucucuguguaucccuggcaguucugaaacucacucuguagaccaggcuggccucgaacucagaaaucugccugccucugccucacugugccuagccuaaagggucuucuugggaggcucucuggggcacauaccaaccuugguaccuaccaauucccugggcuccagacagugccggcagccuccaugagguggacaguguaggccuggcgggaguggucggaaugguucugcucacucuuaugcaccacuucuccauggaucagaaccagacccccuuggggaacaccacacaguuaccagcaaguccccaccaaccccguagcaaccagucuucuucccaagggaauaaggaacauagcccuccuuccgcaaagggagaaguguccguuccuauccuuaggaacucgggcugucacucgugcucccucccggagcugaggccaugcuguuagagguuccugugaugucaagucuuuuccacagugaccugccgugggaagcguuaugaagggccuuugcaggccagguguggcagggcaaguccuuaaucaaucccagcacuuggaaggcagaggcaggcgggaaaccaugccucaaaagcuggggguggggggcuccccuucccuagauagacugaguuggcaucaaguauccccuuaccauaaggaaaaccaggcacuaccugccaacacacaaggaacacugcaccucauacguucccuguaaucaaccugcauugauugccuucuaccugggaacacuaagggucaaaggggcaaacgucuacuucaagaaaugguccgucaagaacuuuagucugaccuuaaaaaaccuacuggaagcacaccucugcugacauccaagccccauacugugccaccaccaaccauucuccaauuucaaggcccucagauggcaggcaccacggggagccuuuguaugcagggaguggggcaaauauagaacacuaugcauggccaccugcaccucaccuaccucuccucacuggcaaaggcacaaagagguugcuagcccaggcuggaucugacccgaggaagcuggugccaggcccagagucugaaggggcucgaaucauccuucuugacaccccaccuguggaccaacauggagccuuuauucacucuuuguguaugucccucucccuggagauggguggaaaggcauaaauaguguccucacggguaugggagccagggaugaaccagaggcaaccguucuccagcauggcauccuccaucgcaauccacaggcccaacacucggccuaggggcuccguguagaggaagguagcauccuggugaggggagacuaggagacccacccaggaguaagguacaaggccuuuggccaggccucaccucacccuggccaggcucucauuccauguccuuccaggguuagccuauccaucuccagucaagagucucaccacugccuggccuauaagcucuaagcaaagacugcaccucugaagguuuccaucucuucacuguagagugguuccaaccugcuucaaaggccugcuagagaucaguuggaugaccugcuaaaauuaccuaguacaggacagacagcuggagauuugacuugaugguauaggcacaggcugcccagagguccugaguucaauucccagaaaccacaugguggcucacaaucaucuguaaugggaucugaugcccucuucuggugugcagaaguacaugcagacagagcacacauauacauaaaacauauauaaucuuaacaaauauuuuauuuauauaaguacacuguagcugucuucagacauaccagagagggcaucggaucccauuacagaugguugugagccaccauguaguugcugggaauugaacucaggaccucuggaagagaaguuggugcucuuaacugcugagccaucucuccaaccccauauauaaucuuuuuaaaaguugcucagcacaaggccaaccuuguaaugcuuuaaaaaaaaaagguagcuaaguuuaaccagccacaucauggagaccaucauucuuaucugcuuuucggagacaggauuucuuucucuguguagcucuggcugcccugaacucagaaauccuccauccucuugucuccugagugcugggauuaaaggcgcacaccaccacugcccugcuaaagccuccguuaaccagggguaagcagguuugaaucaacaacggcccacccccaggauaagcugggaacauaagcagagcaguggcaccaacuaugaaugaccaagccacuacauuucuucccucuguuuuguuuugugacagggucuagccauguagcucaguuuagccugaaacucacaauccuguuucauccuccuggauacugggacuacaguuuugugccacuagacccugacagcacccauauuugcaugcuagguagguguucucgcacugacauauagcccuagccuucuuuacccuuguuuugagauagggucuucucaguaaguugccaaugcuagugacuccugagaagcugggauuauaggcuugucacaggcacuaguauccucucuuacaagucaggagacacagccccuguccauuugcauccacuguuuaaagcccccugugaugaugccaguccaaugcuggauggagaugccccaggagagaggagcucagucuacaguaacaaguaucaccuucauucuuauaagcauccauagggacuuugaaauccccaauguuacccugggaggggcccuuuggugcuguguggaaggcuggucacaaggagucagaacugagcuugugccaagcacagggcuccaugugaguggggcagcagaggcaucugagcagaauacccacgguggagccccgaaacuccuucuaucugcaaucacaugcugagugaucugggaaacaguguuaucaaaaauaaaugucucgggccgggcggugguggcacacgccuuuaaucccagcacuugggaggcagaggcaggcggauuucugacaggacagccagggcuauacagagaaacccugucucgaaaaaccaauaaauaaauaaauaaauaaauaaauaaauacauacauacauacauacauacauacauacauacauacauacauacauacauaaaugucucugucuccuggagugcuguggugcuggggugaaaggagugcgccaccaccucaggcaaaaguaacacuggcuuguuuguucuugguugguugguugguugguugguugguuuuuguucuuucaagacaggguuucucuguguagcccuagcuguccuggaauucacucuguagaccaggcuggccucagagaaacccuuucucaaacaaaaacaagaauaucucagggaggacugaggguucugguuauaaccagcuaaguuugccauuggaauugggagcacugugccaaggguucuagggacccuuccacaaucuacuggcagggauggaaggugguuauuccuuccugggucagguucuugcccaucccacagacccugagagaaguguuuuuccuccuuucaaacaccggauggccacugaugucccaucuccagcccgaggccuuugauggcccccacagcacaggggccuagucucagcucaccuucgccgccaaagugagguugcugcaagagagggcaaggauguggugagaggagaggagagcagacagggcuggaucugagucuuguagguccuccaacacugcacgagcacccaucgacugaguaccuacugugcgcucagucuaggagggcagcauagagauuuagguaguuucuuugacaagguagcacugagguggcccuugagagcugagagcagaacagggagcgcaggguucccuuggcuucuuuuaaacagguuuuccugagcaucugugcagcacucagcaccuuagccagaggccagccuacgugcccuccccacaaccuagucaacuccagcaguuccuggucuauuguaagauaaagcuguguaugaacagucuuccaucuuacagggggaaacugaguuagagaaggcugcggagcucaccuuaaagauauacaugcucugcaccaccacuggcaucuggaggcccagacuucuaaccaaagccuagaagaugaaagccacaugccaccagccugaucccauucguaugugccccucacaccuccccacccucaccuccagcacccacucaccugcaccuugggagaaugugugaugcuccugaagacagggucaugggcaugcagagcuauggaccagagauggguucaugagcuagccucagcaccuguguaucccucccacacccuggacacuaaagucaggccucaauuuggaauucucacauauuugaaacuuuaugcuuguuuauagcuaaguaaaggggacacagacaccuugaccuuacucuguccagggccuuauuccuuucuucuuuuauuaugcuuuuucaacagggucucauguugcccaggauagcuugaacuuacucuguacuagaagaugaccuugaacuuccuguccuccugccuccaaccccugagugcugccauugaagccacaguccaccauaguucauacuaugcuagggauuaaagccuggccuuuauguguacuauacaaacacuccaccaacugagcuauaucucuggucugccuguguccuuauucgggaccaucugggcaccuggaaaacucauuccagcccugacuccccauaccucauagagucagaaggacugucucuuauagcaaucucaggacugucacugaggcugugagaacccagaugacaguucucccugcaagccucagucuccucucuauaaaguggggugagaagaacagcuguguccccagagaugcucuagggcacagugggcuaaggagugugcgacagcagcccagauccuaccaagaugaucccuuaucauaagcaucugcaacugcuauuacaaaacaaaaaguugaacauauuuaaugacccugaauuauauauuuugaaaugcuaaugaugaacuagguauuauggugaauaucuaauaguccccacacuagggaggcugaagcaguagguuugugaguuccaggcuagccuggauuagacaaagaaaaaacagaaaggcaaaccaaaacagagagccagugagaugacucaguggguaaauguaccugccgccaagccugacaacccaaguucacaaucacagagaaagaaauguccccuccagguuguccucagaccuccacacauccuccacagcacacucaugcggacacacucccacuccacaggacacucauggggacacacucccacuccacagcacacucauggggacacacucccacuccacggcacacucaugcggacacacucccacuccacggcacacucaugcggacacacucccacuccacggcacacucaugcggacacacucccacuccacggcacacucaugcggacacacucccacucuagccaguucucaacacacacgcagggagcagggagggggggaagacuaaauagauguuuaauuuaaaaaagagucuaagccaggcgagguggugcacgccuuuaaucccagcacucaggaggcagaggcagguggauuucugaguucaaggccagccuggucuacaaagugaguuccaggacagucagggcuacacagagaaacccugucuugaaaaaacgaaaacaaacaaacaaacaaaaagagucuaaggagggcuggagagauggcucagggguuaagagcacugacuacucuucuaaagguccugaguucaaaccccagcaaccacauaguggcucacaaccaucuguaaugggaucugacacccucuucuggggugucugaagucagcuacaguguacuuacauauaaaucaaucaaucaaucaaucaaucaaucaaucuuugggccagagcaagcuggaccagagcaagcagagguccugaguucaauuccuagcaaccacaugauggcucacaaccaucucuauagcuacaguguacucauauacauaaaauaaauacauacauccuuuaaaaaagagagagcaagaaacucuaggaaguaccuggagccagaaccccaguggcuagggaucauucccagagcaggcaguagaaaguagaagagccugcacugcccaucuugggagccacacaaguggacccauuucucagcuggggcucaccagugaucaacaucaagggacgcagaagacugaggcagaggagagccuguggccagagccauguggucaaaaccaucuuuuuauuuuguuuuguuuuguugacacaggguuucucuauguggcccuaguuguccuggaacucucucuauagaccaggcuggccuugaacucagagaucugucugccuuuguguccugagaaccacuaccacccaccuaacugccaucuuaugguagcauuugguccuaagucuccuaaacucuucagaucucggcuacucugcuugcuuuucugcacucccaggccccugcuuaccauggccaauuuuguugauagauuucucaggagggaccaagaaauuuccugugguauaaaaaacaaacaaaggcagaagaccugggauccggcuuccaucaggcagcugaucucagcuucucccagccucaggaguuagccacccugacccagcccacuaacccucauguccccaaaccuuucucaucaaaaacgccuuuuucaaagaagaaucggaucuugucaccgcugcucaagaaguagucugucuugcccuauggagggggcauaggagguacaagagaagagcugagugacagagcagggcaggaucaggagcuaccuacccacacaggacuacagaugccuccugggggcuucucaaacauggccacuguaguacagacagucagcuagaauuccaggugccuaaagccacaaucuggaauuuccugaacaucucuucuuacagaugcuccuuaaguuaccauggagcuuggacaggauacauuuaucuaaguugaaaucuuuguuuucuuuuuuaagauuuauuuauuauuauuauauguaaguacaccguagcugucuucagacacagcagaagagggcaucagauccauuuacagaugguuguaagccaccuugugguugcugggauuugaacucaggaccuucagaagaguagucagugcucuuacccacugaaccaucucccuaaccccuaaauugaaaauuuuguagaucaagaauggcuuuuguaaaccgggcaugguagcacacgccuuuaaucccagcacuugggaggcagaggcaggcggauuucugaguuugagaccagccuagucuacaaagugaguuccaggacagccagggcuauagaaaaacccugucuugaaacaccccaccaccacaaaaaaauaaugccuuuuguauauguacugguauggggcagaggacaaccuuaggugacauucuuccagggccaucuacacugcuuucauugaaacagggucucuuacugacccaagauucacuaaguaggcuaggcuagccagccaggaagcccuaagaauccaucugccuccccgucuccagcaguaggacuacagggguacaccccagugguuuuuaaguggggucuuggggauugaauucaagucuccauccuaguuuggcaagcaguuuacugacugggccaacaagaacaaaaugcuuuuaauacaucuaagcaguucuuacagcguauacacaaaagugucuucccaaaagagucacguauuggaggcuugguccccagcuguggugaucacuacauaggaagauacuaacuugguugcugcauuaguccuuugaugagcucacggcuggggcauucuugggagcuugggccuguuuggaggcaguaggucacugggcugaggcuuugaaggaaggggucgucuugccacagaacccuuccucugcacccucucugcuuaccagcugcugugaggugaacaccucugccucaucaugaccccucugccacaacgcugucucaccccaggcccaaggucaugaagccauaauaaaaguagcuuuuauucgccuaaaauaacugucaucucagagguuugcuccucuauaucugcucaccuaggccuagucccagaagccucuagccgccaugcaaucugaucuaggccuaggauguuuugagccucugagacuugcugcugaauaagaucagccuuucuuguucucucugagcucuggcuggcucaacucagccgaauuaacgccuugccaagcugaccgauucaaucuggcuccucccuuggccuuugacugaauugcucugcuugaccucauacuagcuuuggcaauagguucgaaucuuccagcuccuucuuacugucuggcucuccugucuucaccugugucuggcuuguucucucuucaucccaaaacugccuccuucagcugagcggugguggcgcacgccuuuaaucccagcauuugggaggcagaggcaggcagauuucugaguuccaggccagccuggucuacagaaugaguuccaggacagccagggcuacacagagaaacccugucucgaaaaacaaaacaaaaaaacaacaaaaaccugcuuccuucuucucucugugcugcucgcuccuaagcagccuguccucgugagaguugugcauauucugcucugucuaaucuuucucugauucaucacuuugucugcuacucaauuagacaucacuuucaaauauggguacuuccuucuacaaacuaacuauaccuucaucuugggggauuaaagguguguauuaagggcgugucuauauucuagucagagggauuaaagcugugugcuaagggcugagcgacaucacaacuagaaauagguuuuuuccccaguaaacaacacaaucuccggguuuacacugugauuaaauauucugcggcaaagccaagugaccauggacugaaccaucugaaacagggagcccaauaaaccaauccuccuucugauggccaaguuuugucacagcaagaagucacuguuacaccugcugguugaacagcuuuaccuagccuuaaacauaugaagaaaacuuacggggcuggagacauggcucagugguaaagagcacugacugcucuuccagagguccccagcaaccacaugguggcucacaaccaucuguaacaagaccugauucccuccucuggugucugaagacagcuacaguguacuuacauauaauaaauaaaauaaaucuuaaaaaaaaaccaacuuacauuagcaggugguugugccuauuuuuuuuuuucucaagacaggguuucucuguguagcccuggcuguccuggaacucacucuguagaccaggcuggccuagaacucagaaauccaccugccucugccucacaagugcugggauuaaaggcaugugccaccacgccuggcgguugugccuauuuuauauucaguaucuuaggugguguguggaguccugagcuaaaaaugacacaauuguggccgacagaucucugugugauugaggccagccugggcuacacagcaaguuccaggacaaacaaggcuauaaaauaagacccugucucaaaacaaacaagcaaauauucuaucugaacagugcuagcaauacauacauuacaaaaccuugcugugucuccuacagaaggugccucucccugucuccgcccagcacugcagcuguauugccggggaaaagagcaaaguuuaagugcaaggucauugcuucuuagggcugggaagauggcucagugagcucuuuuaagaacccagguucaagccgggcaugguggcacaugccuuuaaucccagcacucgggaggcagaggcaggcagauuucugguucgaggccagccuggucuacagagugaguuccaggauagccagggcucuacagagaaacccugucucgaaacaaccaaaaaagggcuggugagauggcucaguggguaagagcacccgacugcucuuccgaaggucaggaguucaaaucccagcaaccacaugguggcucacaaccaucuguaacaagaucugacgcccucuucuggagugucugaagacagcuacaguguacuuacauauaauaaauaaauaagucuuuaaaaaaaaaaaaaaaagaaaaaccaaaaaaaaaaaaaaaaggaaagaaaaaaaaaaaaaaaaagaacccagguucaauuccagcaccccaaaccacaccaccaucuccacuucuucuucuuccuccuccucuucuucauuuguuuuugauuuuuuuuuucaacacaauuccucuguaucuggcuauccuagaacucaccuuguagagugaccagccuagaacucacugagauucaccugccucuguguccuguguugugugcauugguguuuugcccacguguauaucuguaugaguauugggccccuggaacuggaaguacaugagcuaccaugugggaacugggagcugggaauugaaccuugguccucuggaagugcagccaguaugcucaaccaaugagccauaucucuaacaucacccuuucuucuuucaacauuccuaccucugcaaccaccggacuguuagagucuucucgguaaguaacuagggagagggacaggguucggcccccucauuccuuagagugugucuguccugcuaguuggaaaaauucucagucuguuaugugucuucuucugaagccuccauccuuccuccuccccucucugggagaaagcaguuucuggcugcuguaauucuauuuauguccaccagauggcagaagccccuuggcaucaguauaaggugagcccuguugccugaaccacuaaaaaauucagacuaagaaggguuaagggaacugguuggaagaaccaccuauccugccaaacuguguugagucugaggaagcaagaggccuuccuagucugguugggagaugacucacccaagaguggccuaucacagggcucacucuggucacagagaguucuuugugaccagagaauuugagaaacugcagcaggucaacgaccagcaucauuugauaucagagagguggauucaagucucuaucaguuacaaacugugugguuggagcagcacaauauuacccagagaaaagccccgcuuuucccauugccaagcgagaauaauaauagccaccuuauaaauucauaguguggaggaauacagcacagcucuuuagccugguacccggcauacagauggcugaggucugaucccuugucagaagucuguguguggccuuaggguccucccguccaguccagacugcugccuaagacugagcacccaccaaaaccagacgcccacccucagcgccccagguaccugccuggguuugaaguugcucaucuuccuggguggaaaauucuguccggcagugcagagggacauccaucucagcuacaaucucaccgauccucugcugcauggccacacacucauccgcugugaagaauccuuccaacagcagaaacccguccuccuggaacugcagcagggacaagacucaggcuccuuccgcccucgcucauuccuuauauccauguuggaccacaaacucgaaccaagaucaaguguccugcucauggcucugccccccacccuggacaugggcauccagugcuuagugaggagccgucaguacuggcugcuugcaucuuaucgaggaaggggaaguggcagcugccucugcucuugcccuccaauggguuugggacauacggaaacauuugcucauuuguguguuaaagugcaggugugaguguagaacaugugugagaacugcaggugcgcaugugcaggggcaucaggagaggacauacggugccccucuuccacuuucuauuucugaggcucuccuugaaccuaggcuguuuucuucauuagacuggcagccugugagcccuggcgaucugagcugcaggugugugcagcucauggagugggugcugagauuugaacucugaucuucaugcuugcagaagcacucuuaaccaccgaccccgccuaacucccuuguuuuguuuuuauuuguuugaagacagggaggccucaaacucaagauccuccugccucagccuucuaaugcuggcuuuggaggcuauuccaaucccgacuaagcauugcgaguacgagacagcuucagcagauggacaugugauuaugaaccagccacccuccacacucacacaauuuauaguccagugaaggagacccaugcaucccuuaccaucagacaaacauaccaucccacaucacacugacuuacagggagacaagggcaggguuuugagaauuaaaggcaaagaaucuacgaggugaaggggucaaugggcagcuuggaggaagugggguuaaaggaagagcagaacauugggaagcaaagagauaggaaagagcauuaaagacagagaacaggaaguacaaagccugugggcacuggacgacugggaaauugggaagggcuggagcacagggugaggggaggauagccaggggagcagacagaagggagagugaauuugcccaugcuauggcuuguccuguaaccccaaacccaugcauuggaaauuuuauuuccauuguguuacucagugugggccggcaggggacugccaggacgcuugagucagcaccagcacuaggaaggacaaggcuagaaaguccccagucgcaggaccuugcuggcuuucuuucuccugagugaguguggggaaggcuaggggcugugaacacagaugccugauucugacuuugccccaagucucuuuauucugaggcuagccuaaggugcugaggcacauuacgugugugacugggucgccucucagaagcugacugcuugcuagcauguacaaggacuggcuccuguucccagcacugaaaacaaacagaaccaacacaguaagggacagaaagcaaggauguaagcguggccaggcaugguggcccaugccuuuaaccccagcacuuaggaagcagaggcagacagagcucugugagcugaagggcagucugcucuacagacugaguucuaggccagagcaacaaaccaucacucaggguuaacacagggaggcccuccaugcuugaaaucauaaaaacugaacaaaaguucagcacaaacuguacaaaaaaauacugacauggggcuuugucccucaaaagauagccugugagacagaaggaaaagacagacagacuuccacuacauauuuagucacagacaaauuugggaacuguggcagcaguggcagcugucaaaagagaguaggucugugugagugcguguggguugggugaugaguguuugucugugugguaugugugugcuuuuauguaugugucucuguguguaugugcacaugggugcauuugugugugaguguguguguguggugugugcaugcauauguauguguuuguaugugagugugugcgguaugugugugugcauuuguaugggaugugugugugaguaugguguguguguguguggugugagugucuguguaugcaugauguguggugugugugguggugguaauagugguauauguauguguguugguguguguguagucuguuuguauguguguguuuauguauuguggagugugccguguuuauguguggugauaugugugauguguuuguguauguguuuugauguguaugugguaugcauauggugugugugguauguguguguguguggggugugugugguggugguguguguuucuguauguguugugaguguugggaucaaaucuuggagccuaaagcaagcacucaacugcuaagccccaaccacagcuccaggagggacuuugaaacaaagauccucggcuagaucuaauacauuaacaguccuggcauaugagauugggggugguuaacuuaaagugugcguaguccacccccuguaugguaggcuuucauaaugagcugaccuagcuacuggccugcccuauccaggccuucaucaacaggccccuggggcuagcuggauuagauaaucugaauugugguuucucuaccuccuagccccaacccccacuguaucugaccggggagauggcaccuggggaggugguguugugaccuggcccucuugggcuuuguucgcagaaauuaggguugauaugcagggaucuuucucuccuuugugaaaugucagagguaguucaaaggucacuagaggucugcacccuccaaaccacgggccccuaccuucuugaguugugagggacucaggcaggccauggggaauacugcaggacucagcuggcucagcucgauggcuccagggcuggagaggagaaaguucaggaggggagaaagaccagugacugaggcccagaaggauuuaacucuuaccuacccagaaaauauucaaccccaugcuccacccuuccaaacaaauccagucugugccuuccacccagggcccagucccuccccuugcuccucccccauuucugaccuuggaggugggcccagucucagcccuggcccagccuccaguuaauccaggauuagcuuuuaccuguuuucuuucauaggcuggcuugaucccucaagucuuucucuaaaauucacucccgggcaguacuagugugucuagugugggcuggcaggagacugccaggauguuugagucagcacuagcacgaggaaggaaaaggcuagaaaguccccagucgcaggaucuaaguuuacccuagagggacaucuguuagacugcagggcuugggcccugaguggcuuuggacugugaaggccaaaggguccuaggaagauaacuuugugugcuucuucagcuuugaucuggagccucuggaugcuggaagaaagucuaugaagaggugcuaaggaaaggcagaugagcguccuggggaacagagccaggggccucgggaugaggaaagauagagauguuuucugcucuccagccucagacccucagacuggugucuacggugggguggcaggguggccagaaccacagugagcucugaaaagcugcucacuggccuucccagaaauggugcuuuguacagccaggggacagagugucucaggagucagcaaggggacauacugcucagcugucaagagccuuggcuccugaccaaguguuuuucugggccauaacagugggagcuacugcuuugucugggcuguccaggccucaagagagccagugagggcuguggccacuggccccuagggcugauggaaauucucucgggucaggcuggagaaggcuuggagacagacccgggaaagucacaaggcagggcaggcagaacuuguccuuucugaugcaaccgcugagcaaaaacagacacucuaccaaguuccaggaacaaagagcagagaaggcccccgcugcugagccagcaauggccuggggaccucaccaaaccaggggggggggggaggcucagccagacaggugguccuuuacuuucucugcagugggugucuaacaggccagggugaacagcaaguacuacucacugcugauaagcagccugggauuagcaucuaggaagugccuucccacugcuucacccaaugcuacagggugagcaugaguggguggaaauaaaacuuauuucuucaguuucuccaaauuuucuaaguuguucuugaagguagggauuaggcccacacugugguuuuagguaggguggugaggccuggguggaugggcaggcuaaggggccucuguucuauucacucugcuggccucagggggagggugggugguguucccacaucuccuuuuuuuccucagaagcuaaccaguuccagacugaauucuacaggucuggggcagaggccagaaagucucucccaacccccacuccuacuccugggugggguaggggcaguggaacuggauuagaccagaccagacaggacaggaaguuccuggacuggagguauguaagagggucuuucugugagugaagcccucuguccauccucccuaucugcaagcaguccacagggacagagacgacucaggucugaggaaucagugccuguggagcucagguguccucuuugaucacacuuuggccucuuccucaccuaaauacuugugaaggaggggcuccucauaggcacauaguccagaaggcugcggggagacuucugaaugcuauggcuugaccuguaagcccaaauccauccacuggaaacuucguuccagcuguuuugauagaccaucaaauggcccucucugcuucuccuguaggucugccugggaaacuguguaguccguaacuggcuuuggcuucuggccaucuucccgacuauauuuccaggcuucugaacuuacgggugugccuggaguacacuggguuuagacgcauaauuaaauucaacaccucagggaggcagggcauagugggaaguguuugguccacccucacaaaaggauuacccuuccugaggccaggcuagcccucaagcucccaauuccugugauguucagaaguagcauguauuccucacuggguacagcugucagauccugaacuuccagcuucugaaccuaaggaagcgcuccuccguagaucacccagaaguuagggguuguagcucagcagaagaacagaaugccuguucagcauguucaaggucuuaggcucuauucauagcaacgccuccuguccacccaaucuauacaccuuucuuacauacuacuguauaacuacagccccuuuaaauaagccugcccgugccauuauuauuccaaugcaggaggugguaagcagacaaaaaaaaauuaaaggaacuggaaucugcucucucagagccucugcccuugacccuagaaggggcuuggagccagggaggccucccagugguugacugccagccuuaccuuugcagaaccaugaagcguugggaguuggaaccccaagcaucuucugaaaaaaggguagagacgcccaaggcacagauggggauauagaggccacaagaggggagaugggcucagcacaagacaacuggacuggaaccaggacuucuggcugcuggcuccuauuguagauucuucuucuagcccugaccaaucaaagcucgugagggccuaaauaacaagugccugggacaacagaaaaugugcuggccauagaccccucgucaggagcugacaugguugaccacgcccggagcuuacaggugcucugacuggcucaccacaucuggcaacugccuccacaaugcucaaguuucacagggcagaaaagugagcagagccugagcaguggucccucaauaaacuagucaagcaggaccaaaacaccccagagaagugaagggacaccccgaguucuauggcauggagaccuccaaaggcaacuguguuauagauuuauuugauaucugaacugagucuacaagucagacccacguguaacggauugcuucaugguugucaaaggcuagugugcaguauuuccaaggguuacauccaugacacgacgcagaaaacacaaauggacggagagacagacauaaucauuaagacaagagacgcuaaaacgugccuuaguguccaugugauugaucuaaggcgaggacccuucuaaguggggacccuagugauugaucuaaagcagaguggcuuaccgccacuagacgcuaaacuguacugugugcaaaccaggugcccaguacaaacuguccuggaacccuaaaacuggggagccugcccucccagugcugaccucucaugcccaaucugccucuaaaugucagcucuucacgauggaccagauggugacagagcuaauguaagcagaagaggugagggguggcacugagcaaacccaugauguggggacagaguugggggaggggaagcagcugcucugggcuccuuaacacuguguguguggaggggcauuguggggguagggaggggaauggagcaccguucaucugggaauuagccagccuaagucucccccuuucuuggcagcuccagagccuuccuuuuggcugacagccaugaaaagggugccugccaagacccauggaggagaaaaaaacaacaaaaaaacaggacaccaaaaaaaaaaacaacaacaaaaaaaaaaccaccuuaaaagcaaacaaaaauaaaagccugccccaggagagaagagcacggcacuucuggaccacggucaggacauauugggaagacauccuggcccacaccccaaagacaggaaauucuguucaaugucuugcugcuuugcucaagggggaaacaccacccacccugagacuguaacucacuggccuuagugucuuuuuuuuuuuuuuaauuuuuuuuaauacccaaaccaucauuuucaaagcuuaaaaaaaaaaaaaaaaaaaaaaaaaaaaaaaaaaaaccaaccaaacaaaaaaacucacuuaaaaaaaaaaucuaaaauugcuucaaaaccugauggggcaagcccuaggccugacccuuccaccuggaggccuggucuuccacaagcuuugcugccagagccuagcccagugccaauaaggcaacuguccuacggcuggcucacccuacccaacucugcccaagucugggugggcacuugauucugucagcaucaccuaaaaagaaaaaggugaacacugccagggugcuaaacacuucccacagagccggaccuucuugggaauguguaaguuaucuggagggaaaagaugggaaguggaaaaaauaaauacccagaucuaaguuacuguuccugggccucuggugcuggcucggccucugaggcagagauggccuccagugugaagacccugauuguccaaauacugcacucugagacuagucucagagguucuggucuccagcaagugccuguccuggguguccaugucccagcgggaggaaagggaccagccccucagucccugcuuucuggucuggcuggacccagcuggcugucgcaguccugggagagcugggcugcccaucuggccugagggugugcggaggcucguugcugcugcuccaggcugugcucaggccugcuccuugucagcucuccagagccgcuccuucaccucagguggcagugugcugaacaaguccucuuccaccaccaggccgcugcgcuugaguagggggcacucucccagcuccacgggcaggcauuccagccgguugccccgaagcucgaucugcgucagguuggucagcucgcccacucucgagggcagcgacugcaguacauuguugcccagguguagagcccguagcuuccgacacuggaagagcucuggggggagcgcuucaaucugcaggagggagcaaagggcuagggugaggugcauggcuggacagggcuuucacaucaguuccucuggaugcugacaguccuuaccguaggccccaaacugcccaacaguuauucacuuacuuucuccaggaagccaucaugacugccuccaggaugggucucacagcauccauuaugcuaaucccucugucaucuuuugggcagugggcucuacccaguaccugcccucagagacauaucaaccuggcagcuaugcuuaucccacacaccuccagagcccagggccaggcucuugguccugccuagcuuaacagcaguuucugaauguaaggcagcaauuucuggaaacuggagagaguucauugagaggggccagaaucccagcuagagcccuucuccuuccagaacaggccuuccucagcuaucagaccacaagguagccuuacucugagcacagauacuguuuuggguuuuguuuuguugucuuauaaauuuacguauuuuuaugugucugaguccuugccugcaaguaugcuauguacaaccaugugcaugucuaguggagggccagaagagggcaucagaucuucuggagcuggaguuaacaaaugguuuuaaguagucauguggauacugguaacuaagcucagguucucggcaacaagugcuuacaaccuccaagccagcaauccagccucuaaggauggauuucuuuuuuguuuuguuuuguuuuuucgagacagaguuucucuguguagcccaggcuggccucgaauucagaaauccgccugccucugccucccaagugcugggauuaaaggcgugcgccgccacgccuggcaggauggauuucuuagguuaugagugcuugccuguguaugugucuacauaccacaauaaugccuagugcccacaaaggccaaaagagggugcuagacacaguugggaguggccggccauacagguguuuggaacugaacucaaguccuuagcaggagcagcaagcacugguaacugagaagccagcuuuccaggcuauaucuauaucuauauaucuauaucuauggggcaucacuauauggggagucacuugugugaauagggugcuggcauccuuagaacugcagcuacagguaguugugagcugccugaugcaggugcugggaacugaacucaugugcucuagaagagucuccuaacuacugagucaucucucuagcccucagcacagacacugucaacucacucaguguuaguggaugcucugugacugucucacauacugaagacaucacaauuugagccugguucagcaguaauguucugugucuauaaagcaaggggcagccgggcaugguggcacacgccuuuaaucccagcacuugggaggcagaggcaggcggauuucugaguuugaggccagccugggcuacaaagugaguuccagggcagccagggcuacacagagaaacccggucuugaaaaaaaaacaaaaacaacaacaaaaacaaauaaacaaaaaagcaaggggcaagucacagggaacggguagagcugcacaacgcccacucucaggaacuccaccacugucccuauucuccugguauggagaggugacacgcaccggcugagguugcaugcccauuauggugacaggaugcaggcuuuguuucuugccaccauucacacauucucauucugccaaauacaaugcccuguucaagaacaggaaggaagccucuugcccucuugggccucaguuuccccauuuuugaaacaaagcuuggacuagaaacacucaucuccagcauuccuaagucagaacucuuucucaguguuggacgcaaugaucagggaagcaaguguggcuacagccugaucacaugaguuuaacugacuuguucaauaugucucccccgcuguggccagcugccagagaugggauaacgugccuauagagucugaaguucacggauauaaaagucaagugggcucugcaggacccaggaagcaaagccuucccagaauagccaugcugccucccugcccccacucccgcugcccccaccacugcccccauccuaugaucuccuguaacgauaaagucaaagguagcagagauaguucuggccagugaguggugggguccacucagucaguccgcaccucuacagaugccuucuugaugauccucuccccagaaccucaccaccaucacucggcuaccaaguagucccuaggccucggaggaagugaagguacuuugcuagccuggcuccuugacauagccacacauauccuuugccccugggucccggguccacugaaggaugaaagcuguuucccauugccuugaaccucaccucugcugucucucccugauuaguguagaaauggucacauggucuucaauaaggacgagucuuccaggagccucuaggauguugccuccucuaaggcuccucaaccuuccugaccaagccaucuagagcacugucaucucugagcucacacacccaagcugcccuuccaccagccuugcugcaggccagucacaagcuccauccacaucuguucuugcgcugaagccccacaaacgagcagccacaugcuccaagccagccuuacuuuucacucgaaaggucaugacagauccuugucucucccgcucucccuucuccuggaugguuacaccaaagaccccucuucauccaguagcacaguaaggggacugagagucucaggacaauucccugagagcccaacacagaugcacaacugaucaucccucugaagacccacaccuucucucagguccuggcucgggguguaagaaaccugagaaccccacacuuccucccagacucaucuucauuucugucucuagcagccuuguccaguucaagccucccaccucaccgcccacccgacuguggucucaaauccaugagggcccuguccagucugucugcuaacugguccaagcacauuuuucccuaaaaaaggcaucuggguucuuguagggguggagacaggaugugacuaagcaaugugcuaaacagggugucggaggguccccuuccucuaguacaggacaacaugccuccgccagcuccuucccuaaggggugaccucagccaauaggcaugacacuaacaggcaagccugguaugagaaccugggggugagggacaggauaagacaaggcugaaagcuagcccacaccuuccugagcccagcccagcaccuggggcacagcaagcacuucagggugugcgauggacagucuaucccaacucccugagguaaccagccuccaacacucuuuagcacccccaccucccacccccaccaaaaagacaggacuggccugugccgugcuucccaaacauuguuuuucuucuucauggaccuccaaguccucuuuucagaggcucccacucuaacagaaacaacccgaguuggaccaucagccuugagcauucucaaauguacagaaaccaaaacaaauagagauuguuccaaucccgaugacauggaggacccaggcuggccuacacugaaggggcccagggacagcagucggaagcacauucugggccaugcaaagcugaguccccagcuagaucuauccauugcccucacaccugaggcuggcagaaagagcugcuggcagcaggagugucacgccugcugaaggccaccacaacucccacucaagagccagcaaugccugcuuacuuuaaggacuggauuaauggaggcacagaggugguggcuguuggcacucuaacucugucuccugagcccuaaccuuaggcucccccaccuuuuagaagaagacaucuguaagccuugaggucaagggaaccuccgaggcaacauccagugacugcagcugguuuccccugaccacaagccacacaagugcucugcccucagcccgucuaacuaccccauuaccucuuggugggggcuuugcagucacacacagagcuggugcacaggggccaccuacacuucaaggguguugcuuuccacaguuuuggcccucaauuuccucuccagaaaagcaguggggaugagcccacccaucuaagcccgacuuuguucuucaccacucugaugcagagaagggagggggauggccaugguggagcuacagagaccacaggcuucaccucagccagcauagccacccacaguuucucuugcuggggacacacaggcuggucucuuggcucaaaauguuguugggagacagauaccacaaacuccaaguuaagacgugccucccaccacccauuuuaaaagaaccuuggugcuaggauuccuguguuuuauacacaacacugauccucugugacaaagacagacucagcccagauugugauuuagcaaaccugcaauguggccuaugggucugacuccugaacccucacuguuucuagaacccagagcaucaacuguccagagacacuaggccucugagcaccuguagcaggccacucacccuauuggcugugacggccagguucuggagguucugcaggaggccaaugucggcggggaggaaggucagguuguuguggcugagguccagguagcgcagcuugcggcaguagaagagcuggguggggauuuucucgauuuuguugcgguucagguagaggcgcucgagguuggugagguugccgaucuggauggggauguaggcaaugugguuguaccacagcuuaaggcaggugaggcggugcaggugcuggaagcugaugaucuccucaauggucuugagguuguuguccuucaggucaaucuccugcagguuguggaggcuaaagauggagugagggaugcgcuccaggucacagcggaucagcucuagcuccgucagguuaaccaucuucuugaggcuguugaggacaaugagcuuggugcccucauuguugauggacagcuucugcaggugcacgcccacauccgugaccaccugcggcagcuugcucagguugcucuugagucgcagcaccuugaggcguuugagcucccgcagcccgucaaugacgauguagcgguuguucucugcacucagguugcccgucaggugcagcuccuccagcgucuucaggcuguagauccacagcgggaucuccuugauguccgugaacuugaugugcagggcccgcagguucucccgcaggaaggccagggcaggagccucgaucuuggcugccgugugguacagccacagcuccuugaggccugugagcugggcgaugcugggcgggauggucacgucggguaucagcuccagcuucaggaccucgagcucaaccaggucaaacacaguguccgggaugccgcugagcaugaacaggugcagcuccagcuuguccugggcguucuuggugaggcgcuggcgcagcuuguccagcguccacucguuguugagguucagcuggcgcagcuuguuuucacucaccucagacaggaagacggcgaagcgcuuugaguagagagggucauacuggucgaugaggugcaacaugaaggcaaagucguucuugacgucggggaugucacuguagcugcucuccucucggaucgacucgaacgaguacuucuugagggagcgccgcagcauccaccacaguguguacaugcagaugaggccauagaagaugaccaagcugauguagaaggaugccaagaucuugaagagcguggccagggggugggcacagcgguaggugcgguagccugucaggcucucgauguccacggugcaguccacgucgaacuugauguugugcacauaguagacgguguagcagaugaugagggcgaacuugaucaccuugaugauggucugccgcauguacaggcgguacacaaugucccccuccuccacgugaguccggaacuucuucaccuucucaaacagggccuucgccugcuccccuuccuucuuguccaguacgcccgucuccgaucgguccacgaugcccugcucaauccgugacuugguccgcugcagcaugggcacgguggccuccacauccucgcugacuguagaugacuucuuguccauggacccguucaucuugcugaaggcuggcuuggggucacucuccuccaccacugucuccgacagggcccgugugguccacggugagucgaagcacuugagcaggauagacacaaaguguuccagcuucgaacuggugcguggaaacuugaaccagaaguugcuacaggccaggaagaugagggugugcagaagcacgagguaggggaaguacuuggcaaaccaaugcaggcgguucucguagcacaccgcauccacguaguuguacuggugucgaucuaggucauacuugauaccuguggggccugugucaggcgucggcaggacuguggaguugggguaagugggcucugggcuggaggcugcccagccccggaaggagucguugcaggagucuuuggugacccacuuacaagguaggcagaucaucuuguccugggugacuugcagcgucccuccaaagacagcaaucaucagcaugacgauggagauguaaucagugaacacaucccaccaaggcuucaggauccgguaugcuggcuguguguccgcaaaguagcggagcucugucaccggaaucaugguuuaaccugaaagggaccaggagagggguuuaucacaaggcagucucucaagucuggaccccaagaaugagggaagaauauaagaaccccaccaauggccagaaauuccauccuacaaguuagguguagugagacauacaugcuuuaaucccaguacucaggaggcagaggcaggguuccgaguuccaggccagccuggucuguauagaguaaguucaagaccagccagagcuacacagauaauuuccucacaagaagcagugaggaagaccaagaacucagucuuuuuuguuuguauguuuuguucuuuguuuuuuugagauaguccauguagcccuggcuggccuggaacucuguagaccaggcuggccuugaauuuacaaagaucugccucccucugcuccuaagugcagggauuagagauaugcacucucaugcuuggcaaaacaacuuuuaaauuacuuuuuuauacauauggugucuggcaugcauguaugacugugcaccaguacaagucuggugcccacagaggacaaauagggagucugaaucccauggagcugaaguuacagaagguugcaggacaaugucggugccagaaauugaacccagguccucugaaagagcagccagcauucucaacugcugauccuccagcccuccgaaacucauucugauaaaacaaacugugaagucuaaaaaacaucuacaauguagucaggugugacggcacacaacuuuagguuuuuuuuguuuguuugucaagacaggguuucucuguguagcccuggcuauccuggaacucacucuguccaucaggcuggccuugaacucagaaauccgccugccucugccucccaagugcugggauuaaaggcgugggccaccagcccggcuggcuacaccuuuaguaccagcagaagcuggcacaucucuguguguuugaggccagccuggucuacauagagaauucuagacuggccagggcuacauagacucuaucucaaaaacaaaagagaccaaaacacaucuccauauuucuacacacuagguguagacagggcuauggagagacagcaggucuaguuagggacuccuggggguaggggugcacgagggagguuauggguaacuuccuguggauaacugugguguggggaagagagcgguaaacagcaagucaaggaccgccuccccagagagcuugucuggcuggacuggaagccugggaaccuggucuaacaguggcuucugccuagugugagaaacgcuggaacaggggcugcuuuaggaagagcuugccugugccacaaacacgaauguaaggggagucccuggagccccuugacauucugccaaggagccuaagcuuacacugcucuacaaaucuguagugagugggauauaggaagugucuauccccagaaguucacuagagagcaucugggaaaauauaaaaugcaugagauggagggaaacccauggcccugcuaacgcggcugcucucagcuuuuucaccgacuucugguucgccaucugagauagggucucuagcaucaggcuggccucagacucauccagcacauacggugccaacggugaccuuaagcuucugguccugucuacucccuaauccaccacacucaguuuaugugcugcugaggaccaggccacagacuuccugcaugcugcacaggagcugcaucaccaccccauuuuaaaaagugaaauugagcuuuuaugaucagaaucuaguucucacaccgaauguuacguaucgugucagauaggucucauucucucagagaggaguggagcacccugccagggaccuccuguguuuucacacugaucuugaugauggcaguagggacagguucuccguggugauccucuccgcaaaggccaagggcuccccaccagucucucgaggucaccugugugagguuggaggcccugugcauuuaguacaaguggcaauagccacagcacagggcaggcuccucccacaccggcucuagugcacucucugcugucuucuuuaaccgauuucguggacagaaaaacagagauucugggaggccaaacaccugcccaaugucacguuuuaucaaguaagacaucagcccacuccuagcuaagcuuaggcuucacugcucuauugaguuugcccuccuccugccugaggucccaugcacaggaggugccggauacuugugguguuuaagagacuauugcaaguauucaggguccccacuccuagguucccauuguuuaggucgccucagggccagcagacacuaacaccugcccuaggccagcagccaccaagccagcuagcucuccuggugaggccuggauucuugggccaggaugagugccuaccucacaggaaggccccagcccccuaaugaccagcuggcucuguacaccacccacacuccugggagagaggggcacaggcgugcgguggggagggcuggcugaaucacacagcugacuuucagcagggaacuauuuuuccuggcuccaaggccucauccaagguagccaaagacuggagaaggggacaggaaagauuuaggaccuaagggaaugagauacccugucucacuccugggaggugugagacaggugacugguugugacagacagacagacaacuaggaucaagucaguuucuggcugugacuuccauuucacaguacuuuuuaacuuugauuucugguggaaaguugagccugucaguucaugaaauauauccagccuccuaucgaaagacgagcucagcugugcugcccagcaaaguaguggucagggcccaagacgcagaggaagcagcccaggcucugagcaguaagaccugguagcucccuuggaaaggagacgcuccuauccauucacgguauccaccugcucccaucccaucucaaagcacauucugggugcuauguagcccuuagcugggcucugugaggguaaugaacauccaaaguguaccccaccucaggccaggugugggcugaucccagaggaggccugggccugagaguggcuuguguagaggacaacccuaacagcagggguauuacaggcgcaguuugaacuggcauggucugcuccccucccccuccugagccagaccagaugcuucucuagcacacaguccacagcacacagugaguaagaaacagaggcacucucacaaagagaagggugggagugggcagggauggguguggaucugggugugguaaaccagcaguuucagguggauguggcuuggguagagccagcaggguggccccucccacuuccugccucagggagggacuggagcuacagggaguggugaggugcuguacccuccagcagcccagggggcaagagaaguaagcacccacacugggagcagcucuccaugcagaggcugggaaccggcccaguccagacuccacugugcugcccauggcguucucggcuagcuuugagauaugaugagauaacuaccauaaauguaaccauuguguaacuccugugucuggccagugcugugagguagagcuguggcucagauguccccacuagcuacugcacagccuuuuugucuuacacaacagaaacuuugucauuaagugccugcccaucuccauggaccccaugguucuaagucucucugggaucauacagcacugcccugcuuaagaggacacuggaguaacaggcgguuguaagucacuucauaugggaaccaaaugaaggcgcaagagccuuagccacuaggccauuuccaucuuucuuuucuuuuuuuuuccuuuuuucuuuuucuuucuuuucgguuuuucaagacaggguuucucuguauagcccuggguguccuggaacucacucuguagaccaggcuggccuggaacucagaaacccaccugcuucugccucacaagugcugggauuaaaggugugugccaccaccgccgggccuuucuuuucuuuuugagacaugguuucacuauauaguucagauugaccuuaacucagcaauccuccugcuucaguuuccuaaaugcugggacuguagguaugcagcacacacucugcuucuucccuaagguucaauauuacccgccaugcccauuuuacacacgggcauacaugcucaagacagacuacacacccaggcacagugcagcccagccaauccacacccgggccauuccaaugaggagaccuaccuggcagcuguccuggacgugccugagugagaagggagagcaguggaaggaugagagaggugcaugagaggaggaccuuucucugcaggcugucuagcuucucugucuggaaggaguacagacuccagggaaugugccagggaguguaaaauauggguaaaggaucugaaaggcaagugacagaacccagucuucugccccuccccagaccauucaacaagacugcagugggaaaaauacuaccucaguuuccuaacacagucaggcuaccaugaaaauauggugggacuaaggcccugagcucugcagaggagcaauagacuggggccaggcuggcucugcugcucucuaggagagugagcuaggcagauggcuuucccuuucugagcccugacuccuuccugacauagugccacguuuuaggccagagccuggggcugggggugaggggaaggggaacgaauagacaccccacccaguguaguaagcucuccagcacuugcuacugaaaagaaaagucugugggcgcagucacagaggagaugaacagaguaagagacuagggugagagagagacaggguccagcacauaggagaugggcaaguggccaguggaaugggaaggaaugggcacugucaaggaaaagcuggcccagagcacggaaggauaugaaagugugcuccucuguaccaaccgcagcgaggcucuccauggaaaagaggaggcagagaacuaaaauggaagcuuagguuucuaaucaauauacacuuucuucuugguuagaaaacuauauggagggccuggaaagauggcucagcaguuaagagaacuggcuacucuuugagaggaccuggguucaauucccagcacccacagggcagcucacagaugacuguaacuccaguuucaggggaucugacaaccucauacagacauacauguagucaaaacaccagugcacauauaauaaaaauaaauaaaucuuaaaaacaaacaaaauuuuuuauggagcccauggucauggcucaaagggcaaguauuuggccaagcccuggguuccauucugagcaccaaaaaccucagagcauaagauccaaaauacauuacagccuuaaagaaggaaagggaacagcuggcagucaggugugaggaucagguguucuacagagcucugagacggaguucagaaggcaacagggaaauaggucaggucgggucucugccccaagaggugcagagcuuggagacacuccuaaauggagaacaaggaugaaagggggugaaauagacgaagggaaggcggaagaggcugugcccucugugcccugccacacuauagccaccgcuuuguuuauuuguaggaaagggcuucauauaauccaaguugcccugaacacugcucuguggcugaggauggccuucaguuucugguccuccugccuccacugcuccagugcuggauaguaggcagguagcauuacacccaguuuacagaguacuggggauccaggcccucacgcgugccaggcagcuccaccgacugagucccauccccagccccaucuggcucuagcaaagaugagucaauguccucuggagacuaugucccaggccuggaggcugaguaucucucaaaaugcucacaagugggcaggagaugccugaggagagagaaaaggcugggaauucuguauaacauggaccauuacacaucaucccaggccccuguguagaauuugggguguggaagguggaauaugaguuucucaagcagacugagcagagaaaacaaaggcaggccagugccuguucaaacugcaggacagacccagcccaggaguauucgcacagugggccuaaggaucagacauggcccaggaguguccacacaguggggucagacccagcccaggaguguccacacagugggccuaaggaucaggaaaacaagcaccugcuguggggggacacaugaaauagcuguuacacgaucagaggacaaaauacuauacagcaaauaaaagugcauuuguacaaaaacacuugacacgaggacagauucaaagucugcuaacuguaacccugguaacaagaggacaccugcuugcgcuacgcuuucucaccccaggaugaccucuuuuuauuauaagcacauuauaaucgauaauuaaggggaaacaguucauucuuauuagauucguuucuuuggagagagguauguguggaggucagaggucaacugcaggcuuuggucucuccuucuaccauguagauguggguaaugaagucaggucagccuuagcaacagccugugccugacgagcuaccuugcugcaguccucuuuccuguugacuuucuuuuguugaaagacuuucagagauggcauuuuuacccaggaggcugggaggacuugaggcaccucuaugucugaagaggcucuggcacauggaguccaugagugugcagcgucugagcuuaguuggcagacguguuaagauugucucucugguacugagaacugaacugcacaugucauaggugugugcugugcacugaccuaccucccagacugagcauuuccaagcuuugcuuuggcuuuuuguguguuuuuaaagauuucuuuacucuuauguauaugagugcuccgucuucaugcacacaagagggaaacagauuccauuacaaauaauuuugagccaccaugugauugcugggaauuaaagucucugcaagaacagccagcagagagauaccuguugagccaucucuccagcccccuugcuucaggucuuuaauuucccggaauuuguugcugugacacuugaggcuggcacagcuuugaggccccguucuuuccccuuggagcuguagagguaacacugucacaugugacauucccagaucucacacuuuguugaacucuguccaucuguccuucugucagauuucugggacucacaugguggaaggagagaauggagguccgaugcaaccuugacacuucccuuccugugugccugaccuacuucauuauacaaaaguugcccccaggggcugguccucucccaugcucacacuugugagggcccaucgggcagcaguggcugcuguacagguuaccaugguagugagcacgcccccuuccaagcaguacacucugcccaaaaacacuaucccacagcugaacucgggacagcuccauccuugccagauccugccucauccccagacacacacacacacacacacacacacacacacacacacacacacacacaagagcagaagggucaaacaggcagcaacccugagagccacugcucuccccuagguggagguggcagacagacagacggcagaggaggaauaggagacaaaugauuucaaauccauccccagcaugauauacucuuggcccaagcacguaauuuaacuuaaacaucuguuguuguaacucuguaauaggaguguucccgcuucauaaaucuguauacaaugacccagauacugucccccaagauaccagccuaaauaagaagcugcugacaaggaugaggagugugauccccaaaagcaaucagucaggacagggcuacugcugcagggugacaccaacuacaguuccaaggggucaucauauucaguccccgcggagugggcugugggauggggacaaaguuucuauuuugcaagaugaaccuuucucagauagaggaggugacuucuguacagggaggagcgcauccaccaccaccccugacauccagcaaccuugaccugaggcaccagccugcgcccaacacagugagaacaaggaucuuauguuacaugugggucauacaauaaaaacaaagacgaaguaugagcccacucuuuauuuuuguaccuccucaccuucaagucuacuuuuuugaagccuuuaaauuuuuguuuauuauuuauuuuauuuuauuuuauuuuauugagaaaggcaagagguaagugugguggcucacaccuuuaaucccagcacuugggaggcagaggcaggcagauuucugaguuuaaggccagccuggucuacaaacugaguuucaggacagccagggcuacacagagaaacccugucucgaaaaacaaaagaaaagaggaagagagaaaggcaagggaacagaguuuauuuuaaaaacaaaaaacaaaaccaaaaacucucugcagcuagaagacucaagagugagcugcccaaucuuuccagcuguagugaacuacuccccuuuacucaaugugcgcgugugcgugugcgcgugugcgugugccugugcgcaugugggaacacacaccacagagcaagugcaggucagagaacaacuugagggagagucugcacucuccucccaucaaauagcaacugaggagugaguucaguugucaggcuuaguuccuggcccaucuuguucaccugccuucuaaaaaauaucacuacagcagugaucucagccugaggcuugagaccccuugagauugaaagaccuuuucacaucagucaaauaucauauuuccuacauaucaggaauuuacauuacaauccauaacaauaacaaaaucauaguuaugaagcagcaacaaaguaaucguaugguugggggucaccacaccuguauuaaaggauggcaacacuaggaagguugagaacaacugcaccgcggcguaagacugaccacaugagcuguggcaaccuaccauaaaccuguucuuguuagaaaacaguccaucagcuuaaaaacaaaacaaaaugaaacaaacccccucccuacugcauguauggaaacgcacauaaacuccgugagauuacgucagagguuagguaaggucaugggguugucucuucuauaccuugugauuuacguaucaugugcuuuuaaauaggaaacacacguaagaaaaagccuucagccugcuggggacuguaacuaaaccaccaaggaccugugaggaaaggucagcgugugcucccccacccuguaacacaccccagccacaguaacucuaaucuaagggguacacacaugguaggaagagcuuggagagcaagugccauucggccaugcuaucucaacuauaaggugggacgguggcuagucagagugccacuguaggaacugaagacaggugcuacaccuguuugaaacccucccacaguucugcuguuccucccaucuuucugcuuccagggcucaggaaaggccacugcucagggccccccuuucccauccuuccuccuccuuuccucacccuccccucuuacaccucuucucuuuccucacgaggagucuauguugcucagguggcucugaagcccugauaugggcaauccucuagcuagccucagcuaucugagugacuggaacuacagcagugugcacugcuccuaauuuucuguugaucuuuuuuuuuuaaaagauuuauuuauuguauuuauaugaguauacuauagcuguccucaggcacaccagaagagggcaucagauccuauuacagaugguuguaagccaccauguggcuguuggaaauugaacugaagaccucaggaagagcagucagugcucuuaaccacugagccccuguugauacuuccuauacacacacacacacacacacacacacacacacacacacacacacacucucacggggagagagagagauuacaugcugccccuuccaucuggagagagaccaccaaaacaugcauguccagagacucgggcagcuccugcaccugggcuacaggcccucucagccgcagagcauacagagcacagagagcccuuuguugaagcacaaacagaaccuaaggggaaacuucccugcagguagagagaggcuaaaauguuccuggggaaggggaaggguuggucacuagaggcccagugagacugaguggcucaagccuaugacucugucccaggguuuaugcuuccucguguacuaggccaggaggugggaggucucacccucauuugggacccagcccccuauccuggccagacuccuaagcccagcuggaaugcguaagagacugugggcuugggacuuacccucaccuccugggacauagcccagggaagccggcaggcuggagcagaaggguuaaaguaccugaacugcuuuggcacuagggcagggcuucccaaacaggucuguccucugcaaacacauaggggugcggcuguguucugguaaaagguaacaggcaagggcgaccuccuggacuacccccacuggccacuggaauccaguauacagcuuagccguuauagcuuagacccagccacugcccuugcuaugugcccaguucugcuugccccucagcuuccaacaucauggcaaaccauuugguggcucccaaccucaccagugagugacuugggaaaagaauuccaucucaucuguaaaacagcuguaauauuuguuucuuuuggaggguugcagggggucccccaaaugaagugguccccaaaaagcuuuuggaucauuucuaugcaguaaaaauguuuacuauaguuuuuauuagggguuguuugagauguugcccaggcugccucuguaaacucaugagcuccuccuguccagcuaaagcagccuggacuccaggcacacugcugcucucagaacaggagggcugaaagucccuuacaauaugaagagcuugagguccggagaggugaacggauuugauguuauaggaucggguggcacgacagaccuagauccgacuugcuacugugccaagcaguccuaagacgacaggucugccuccucagccuugccaccuccacagccucgccgccuccucagccucgcugccuauucagccucgcugccuccacaggccucgcugccuccucagccucgcugccuccacagccucgcugccuccucagccucgcugccuccucagccucgcugccuccacagccucgcugccuccacagccucgcugccuccacagccucgccaccuccacugccuuucgaggugcuucuuaggaagagccuccucuugacgaggcauggacagaaaugaggccuuuguaagcaggucauacucaggggccucuagcacuccagguguuaaggaaacuggagcccaauuuugggucugcaccccugggaacaaaguagccuugaagacuggucaugaccugcuaugaacaucugcugugucuucugagauugguuaagaaauguagguguaagcacccuggacaggcugcagaaccauuugcugugggaccaggggaacaggugcuggccuggacaagcaggcaaggggacccagcuaaaggcaagcugccuauccacuccccaaaucagaaccuaaggacccagcuggggaaugcacggugcccccggccaggguucugccaugccaccuaacugggcacacauuugucaucugagugucagagagggcacagguuuggcagaugcgccucggagaugggggucacaugugaaaccauggaauuuuacagccacuuuuacucuagagggagugugaggcuguaaugcagcaagcaauuuaauuuugagauuucaagcucucaagagacagaaaaaaaacuuaccaggagaucucaggacaucugcaguggggucacagccuuccagagucucaguuccaugaaucugcugugacugaagacagcuacagcguacucauauacauaaacuaaauaaauaaaucuguaaaaaccuacugauauuuaauugugccuaucaguggcucuguagacucaaacaacugggaagcccuuuuccuugucuuccaaccaaccugugggauuucugucugaaacucucugcgaccaauacaaaacugaccuagagguacuguaaggacaaacagucacgugacaaacucaggcauauacagcaauccaauuccacucaaauguuacacuucucccugagcugcaccugggcccuagcucaggcagacagcagaggucacaccucaccccagcaugauggacucuacuguuuacaagcagagaaggaauucccaucucacauaggcacuuccucugguuuccuguucuccacugcccagaaaggcaagcuucaguucaagccaacucuccccagggacagaguuccucaacaaccaacaggaagcucccacagggcagggcagucacugcugaccuuguucccauaaacaaaagaguaugacagcaccacacaccaggcguuuuccaccucccucucugaugucaaugccccacacagucagaaaggcccaguagggccccaggggugcugcaggaggaaugugccuucuguucugucugccagccuccgcagccugucugagccagacacaggcugcccuuccaagaaacaaaagcgcuaaaaagcacauagcccagccaggcagugguggcgcacgccuuuaaucccagcacuugggaggcagaggcagguggauuucugaguuccaggacagccuggucuacugagugagcuccaggacagccagggcuacacagaaaaacucugucucaaaaaaccaaaacacacacacaaaaaccaaaaacaaacaaaagcagguagccccaaagugaccugacuuucaugaaauagguguccaagagaagauggggucaggacuuuaccguuucucugaugucaaacucuaaacaauauggaggggcacaucuguacuucuagcccucuagaggcugagguaaaaggaucacaaguuugaaaccagggcugaagagauggcucaggaguuagaaacauuuauugcucuuggagaagacccugguucaauuuccaacagcucauaauugucucuaacuccaguucaagggaaucuaaagcuaucuucugagcuucaaggauaccagguacccccaugguguacagacaccaugcaggcaaaacaguuuaucacucauacacauaaugaaauaaaacuagagaagaggggcuggagagauggcucagugguuaggaacacugucugcacuuccagaggaccugggguucaauacccagcacccacacagcagcucacaacugccugucuguaacuccuguucuaggggaucugacacccucacacagacaugcgugcacucaaaccaccaguguacauaaaauaaaaauaaauaagcaauuuuaaaaaauacuagagaagacgguagaggaagaaaaggaaaaagaagucauaguaguaauagcaguaguaguuguuguuugaggcuagcucaggaguaggcagccacuacauagauuuugaaaguaguagccgccaccccagguacaagagaccuugccucaaaaagcagagaaaaggcaaacuauacagaguauaaaggcuccuaucuccaagagagcugcgugggaccacgccagugugaaggcugcucccacucgucgugcucaggaacacgcuuccaaggcucugacaaguccuggaacaaccacaguucccuaacuucagugaccaagggacaccucuugggaaaugugucacaggcagcagcauuucuagcuaugcgcaccaaugagaucugcagggaggaacgggugaugguaagagucgcauaucccucucuucagaaccuuuuugagaacugguguggauggagaaggcauuaggcagagcgugucuuugccuagcgcuggccugcugacccugcagugcagucugcacaacauacugugaaaggaucgcaggaucguuugccaaagcuugagcaguggucucuguccagugcugacccacauacaagcugaagcaacaugcucaacccaccaugaaggaagcugaggcuguagauagaacucagcuccucuaacugucugggucugguccucuguucuugccucagucccccaaccuccaucucugccucagcuuuuccugaaggaaugcaagaggccccagcauugccccagaaugguggugugugccuauaaucccaggacugggagacugaagcaggaagaucaggaguucaaggccaaccucagauacacacugaguuuugggaaguaacuugaagguagaaugcuugucuaucuaacaccugugaggcucugggcucaaccgucacuacuaaaauagaacccaaaacaccaaagcagagggagcgggcaccacuccaaugcccuggauccuaugcacaucaaaggacuaugaaaauggaggugugaucaugcuaucugccugggagaggcaguacagacagucuggagagagcuuacccugagaugacucugcuaucuuuguguuggcuguuggugcugaggcuggucccugucuggaugcacagggcccugacauuccuuuugcuccauggacgcugcugcugcccuaugagaaagggagagcuacaaucaauaggcacguuuguggcucuuaaagauacauauauuguuuuacagaguuuuuuuuuagggagccugucccacagauccugguucuccaaagaguccucaaggcagcuuuuucaaucuggaggcaaggcucugcuagggacucaggcuuagggaccaaagggguuaguacaguuucuuagaagaaaagguaucuggugaccccugggugugaggaguagaaggauccaggcaggaggcauagcacaggcaggggagaagaggugggcaauaugcugcaagcuacucuuuggucacagcuagucccggauaugggagauggccagagaggaaugacaagggcugaaccagaccagacaaggacuuucucugaaacauaaggacagacucuccacagugagcaagugcucaacuacugacaggcaccaugcucugcacugcuuaccaaagauaagguggcugugugagagagaagugugggcaccgcuccagacuuggaagacagcaacaauagccggagaugggaguguggcccagcuaugagggaguuagagcaauauagcaguaguuaaccaggaaggaagcagcagacagcaggaccugggagguggagugucuaggaggggcugggaagcagcugucacacuuguggagaugucggcucugguaaaggauggaggccaaacucagucccccaagccacaggaagacaagacaggcaggcuauacgugaccaugcagcaaagcaccagaggccauccaguccaccucugccccacccucugucucagacaggacuggaacacuguugauacugaacaguuacuugucuacuucacagccagggcugaaguaggacucuggacucacugacucuucuagucccuucuugaaggacauguacucuggauagccugcucaaugaccaagacucccuccucucuccucugggcugcuucaggaccacuguagucuauauuuauuuaaugucugcauuuauuccuucugaguuaucaagaggucuucacuggucagccugcccuucaaugucucuguaaaaaccuggaaaaucuacagucucaggacagugaccuaggaacaggcugguuccaggcagcaagcggggguucugccccauuaggcugacccucagaagcccaugcccuccacaaaggccauucagauuugcaaggaaacuccauccuagcaaaugugccuuagguauggagaacaggaaugugaggcugacuccugggugugggagguauugucaauugcuucucuggucccugcuuuguacaccaucccccaaacaauguggagcuucagaccccagaaaaucuccaggaagcuguccuccaacacugcucaccugcccuugccugcccaugacagcuggaggagagcccgaccuucaucaaggaaacagcaggaugaacggccuagcccacuggcaccaccccugagccucugaauauacccccucuccuacccucaauggucaacuuauucuuccugcacuggccauuuucucuacuucagaggacauaacacagauggcagaguuaaagagaccacugacacacuugcaaggcaggaaaagacuuuguagccucuggcuacucauuucugucuccaaaauucagcagacaaguguccccauccucacaaagacucucuccccuccacaccucauccuuaaagcugucccuguccuagcuagggcagcguuagaggagguuguacaagaguggcuguccuagaacuaccacuaugucagcccaguucccaucaagaaaaagcuaaugcucacucaauguguucuuucaaaacaagacaacaacuguaucaagcagaaccagcccaucuugacucacuccaguccagugcauggcagguucaagaacccuggucucaaacagagguuagaggcccacgucucuacccagcacucaggaaccagacaggugaaucuccgugagcucgaggccagccagccugguuuacagagagaguuugaggacagucaaggcuacauaguugagacccuaucucaaaaaacaagcccccacccccugccacugucaucccgaacucugcuguuccuucagcuuggggucgccuuugcugaccuccagcucaccaacaaccuccuguacuugucacuccugcccaagagaugcacaaaacagggacagaacgaaacagacucucauaucaggagucggucguucagggagccccagucugaggucccaaaagccugugcucccuuccccauagcaggggacaguccgggagaucaggaagagggaguggucuaaagagaagccggcgccgggaagcccacggccaagaacuguaagagcuggugggggagcugucaagagaaccccggguggaaccucugggaagggggcgcgugcgccaaggggcgcggaucugcggggaccagcgcggcaagugcggccugaggaccgcggcggaaacucgggugagaggcgcgcggagaacagggugcccgggagggggcucgcgcgccgccgcacggccuggaggguggagaccggagccggcgcccgcgggaggcagggcggagcgaagcccagcgcggggccaggguggccggcgccccugggcagcgagagccccgcagaacuugaaggggcggagcgcgcguccgaggagagcgucccgugcggugacagcgcgcgucucaucccccacccgacccgcucaccugggcucuccgcucgcagccgcccgcaggcagcccgggcccuccaccucccaguccggccgcccgccgccgcgcuccuccagcgccuccuu

SEQ ID NO: 739 - RNA, 57872 nt, Mus musculus
uggguacggcgcaugggggcggggcugggccgcgcgcgcgaagauggcggcugccgcuggugggccgugugugaggugcggaguggggcgcggcaggggguggccgugaagcgcgggcugggagcugggcgggaguugggaccggggcucagccgcaguggcagagacgagccccggcuggguggacggacacuugccggggaggcgguuagguccaaaccguucccgcucgcggggcugaggacacuuuuggagcgggccugccgcucucccuucucucuccguggucccugagccuccgguaguccccauacacccacgcuugcuccaccacguugccuguaggcacugcgggacauuucggggucgccuggaagacccaccccacugcgaucccuuccuugcugucccugcgcccugcucccccucgggugugccuugcccacgccgcgauuucuucccgcgggcauccuuaguucccgccuucuuuuauuuuuggcuaaugccgauauugaugcaaucagcaggcaugccuucaucuuccaugcgauuccggguuuugugccaggcuucggacacaagaugaauuaccccgaaacaaauauacaguucucacuuaaaagagugcuuuuguuuguuuguuuguuuguuuguuucuuuuuugagguaaggucucuugccucucgggcaggccuugaacuccuuguugucuugccuuugccuucuuggugcggaaauuacagacaugaauuucgagcccugcuugccuuuaaagagcgcuuacuagcgccagacccugggaaagugccgugcaggccuuaccucauucauuucucacgacuaggagaggcgccuccuguuccacaggacucagaaguccaguucauacauaggcaguccccccuugucagcccucgagauaauccccgugagccuucagauggaaggcucuaaagccuuaaccagaccucuguauguauccacauuauagaucagaaagggucuucacugcccuuccuccccuuaaauguaaacauucccugucagucaccuggaauugacucugccaguuuuauuuggucuuguuuccuguggaaaccugaaacgcccagacagacauguaauuaucacacacauugcugaucuuucucuccauuagccucuucaccuuccagggguaacauuuucuuuggaguuuccuguggauaaagugugguccuugcaagggccgguuuguuucaugccagaccuuguauccacagcuauggauaaauacuuguaugaaaacuguaaaaaaaugaauuuuuucaaaaggaaaggaaaguuuuggcuugccagcaggcuuugagcuuucuguggaacuuagcaaacccaucguugagggaggacuuuaacugacucuaggguuuucauuuuacuuuuguuuugagguccuaggggucaaacccagggccucaggaaugcuaggcaagcccucuaguauugagucacaaccuguggcccgggcgccuagcaguaggguucuaggugcugccuugcucugucaggacagugccuuuuagugcugaaaagcaugcuucuuagcaguugggaguagagggcuguauuugaaaagcuugagaccuggggcaagaaaccguccauccugguuuuuguaccuagugcuuuuuugugguuagucuuagaagucaccugaccauuuugagcuccuacuuuuccaaaugggaauccuuuucaucuuugugcacaggugaacagguagacaguggcagcguuaguuucuguguagacuauaacugccucucagacagacuguagucaugagaauaacucagguagcucaggguuauuuuccauccaaaagucuuucaaauguuuuuucuugaacauuuuauuuauuguuuccaugucuaugaguauuuuuccugucugucugucugucuguguaucaccuuuguguagugcccuggaucugaguuacagaagguuguaaguuaccuuguggugcuggaaauugaaccuggauucucuuugcgagcagccaaguguagccccucccgccccaaaguuucacccagauggaugucucuaagggggggauguucaguguccaauaugcuuuacuuauuuuuaaauuuuauuuuauuuauguaugugcgugugcgucagcaagaauuuaugugcaccaggugugcuuguggccacagaggccagaagaagguguugauuuucuagaacuggaguuacaggcaguugugagcugcuaaaugugggugcugggaaccaaacucugguccucuuuuuuuuuuuuuuuuuuuuuuuuuuuuuuuugguuuuucgagacaggguuucucuguguagcccuggcuguccuggaacucacucuauagaccaggcuggccugaaacucagaaauccaccugccucugccucccgagugcugggauuaaaggugugcaccaccacugccuggcuucugguccuauuuaauagcacucaucucccccgcgcccgccugccuuucuuucuuucuuucuuucuuucuuucuuucuuucuuucuuucuuucuuucuuucuuucugccauggugugugugugugucagagaauagcccccaaaauucuguucucuccuuccauaguuucugguuuuucaagauucaagacaggguuucuguggguagcguuggcuaucuuggaccucacucuguagacugagcuggccuugaacucacugagaucugccugccucugccucacaagugcugggguuaacugugugcaccaccaccucacagccucuccuuucaucuuaguguggguucaaggguugaguucaggucuccaggcuugaguaggauuagcaaguauuuguguccacugagccaaagcuggcccuuugccucuuagaaauaaaauaaaguucuauauuguuuccuagaacuuuagauuaaugaucuauaugguuuuuuuaaaauuuauuuauuguuauauguaaguacacuguagcugucuucagacacaccaaaagagggcggcagaucucacuacagauggcugugagccaccaugugguugcugggauuugaacucaggaccuuuggaagaacagucagccccuaaccgccgcugagccaucucuccagccccuguuuguuuauuuuuacaccuauguauuuauuguauguauguuguuguguguuugcuaaggagugcaugugaaggucagggacaaccugccagaauuuguuuuuuccuuucacuguguggggggguccuggagauuuaauucuucaggcuuagugguaagcaaauggguaaccuuuacccauugaguaaucuuguuaguccaucaaaaaaacaaaaacaaaaacaaaaacaaaauuagugugugucgggcuggggagauggcucagcggguaagagcacugacugcucuuccaaagguccugaguucaaaucccagcaaccacaugguggcucacagccauccguaaugagauuugacgcccucuucuggugugccugaagauagcuaccguguacuuacauauaauaaauaaacaaaucuuuaaaaaaaaaaaauuagugugugucucuguguaagggagcaugagugugauaccauggcaggugaccaggggacacaucuaagucagcugucugugugcucugggguuaagaaaagcuugcaaggcuuuugcggcaagagcugcaccaccuugcaggcccagucaguauauuuuuaagaaucugaccuuugaagcugcauccuugauuucagugcuuuagguucucuccugugcacguaguucagaugugguccccgcaggauaaaggcaggagcuguuuccuuucugagccuuucgguuggccuuugcgagcaagcaccagccucguucguucugucugcacauccuucccuugccugugggugggagucuuucuucuugagguaguuucuagcacccucugauuccggcaugucggugugugucucucuggggucugucauugugucagccuauagugcuuccuuuuggcagauuauguaauaugcuguugugugacagacuuuuccuggggagaugcaacacauacaccucuacucggcgagaaggggagccacauaagaccaaagcucugaggguaccagugguggguguaagauuacuuacaagguccugggauaaugcagaauccucuucaaagccaggugugguggcacacggcuuuaauccuagcucuuaggaggcagagacagacggaucucuuaaauucaaggcaagccuggucuucaaaguaaauuacaggauagccagggcuacacagaguaacucuguaucaagcaguuugauacaguagcugcaucagcagaaagcccaccucaucagggugacaacugaaggcugcagcacagcucuucuccaggcacuguagcuagucagggucuaccccagcaacuguuggguaggggcccucccugacaagugaccccuugugaucaugguuuccuccuaugccuucuaagccucccuuucugauggagggcauguugugcccagaggaacaugcccuguaacugugccuucccagcuuguaagcagaaucaaguuuuagaucaauuuacagggucucaucuccaucauucacagacaagugcaggguguagggaccauuaacacuuaauucaauaacgauucuauucuucauaauguaccauuuccucuuccauccugccucuuggugguuuuuuuuguuuuguuuuuuuauuuauuuauuuuauuacauguaaguacacuguagcugucuucagacccuccagaagagggagucagauccgagaucugacucccucggaugucaacggaugguugugagccaccaugugguugcugggauuugaacuucggaccuucagaagagcagucgggugcucuuacccacugagccaucucaccagccccccuccugguguuuuuaacuuguuuuucuguuccaaguaguuuagagucuagaagggacuuacaucauucuccucugacaggcuuucauucagcucauauuguaauuaaaauucauuuuauuuguauguauguauguaugcaugcauguauguauguguguauauauguguguguuugcaugugccguaagcauguguauauggguaugugugugugugugcaugugccgaaaguguguguaugcaugugccauguggguguguguauguguaugcaugugccguaagcacaugugugcagaucagaggacaaccugagagagcugcuuugcuucucuccuuugaccauguaggucucacagguagaauugaaguccccagguuuagugacaagagccaucucacaggccccucagcauguaauggugcauauacuuguuauggccucuugcauggcugcuacuguauuaaaguaauggcuggccacuaggaacuggaagcuucacugccguccauauauuugcuaguuugcaggaugagucguuuuucugagacagggucucaucuagcccaggguagccugggaacucgcuguguaauagaggcaggcugcucuuaaauuccugaucauucugauuccaccucccaaagcuauagaguuauaacuggagccaccaaaucuagcacaugaugaauuuuuuuuucuuuuuauucauguauuuuauguaugugagugcccuaucuucaugcgugccagaagagggcaucagaucccauuacagaagguugugagccaccaugugguugcugggaauugaacugaggaccccuguaagaacagccaguccuugaccgcugaguucucucuccacccucugaaaaugaaucuugauugcaacuugaguauugugguggcccagcucaggcauggcuaguguacaccugcuugcacuguguguuaucccgugacuuuaggccaguuauuagccucugaguccucuauuuccugauacuauaauaauagugucugcuucauagagguguguguagacauguuccaccucagguguguggaagucagaagacaacuugcagaauuugguuuuaccauguggguuccagagaucaaauuuaggucaucggguuuagaaacaaguuccuuuccugcugagccuucuugcuugucaaaaucuuggcuucuuaaaaauagauagauagauagauagauagauagauagauagauagauaaaaauuucacuuuguggcugggguguggaccaguggugguuaaugguguugagaccuuuagguaaauccuucacacacggauuuauucagugagugaucacucaguggcuuaagaacacuggcugucccagaggacccagauuugauugauuucuagcaucuucacggauguucauaaccuuuuuuuuucuuaguuuuauuuuauguacauagguaugagggugucagauccccuggaacuggaguuacgaacaguugugagcugccaugugggugcugggaauugaaccaccaaaauaucuuuccagcccugcucguaacuuuuguaacuagauuuccaggggaucuaacacuugcuccaggcuuccuuggguugcauucaaguggcgcauagacuuacaugaaggcaaaacccaguacaugucacuaaagagaaaaauaaaugucacaaacacacauauauacacacaaacccaagaagaaaaaaagaauucaacaucgauuuguuuggaaaaguaaagaagaaaguaaguuuuauuaaacacuccuuuuugagaccagcucuggcucccugccucucccucccaugugcugggaucacaggugugcaugcccagccagaacaucauuuuugauaccuaacaaaaugaucauagugugguuuuuuauaguugagagugucaucuguguuuucuuuucauguuuguuuuuaauuuucuauuuagcuuuacuuaaggaauaaauaucgaaaauuacauauacuuagaauguacaacauguuuuuauauuucucuauaugccgagcaaagugauauuuccuucucucucuuugguaaggucucacuuuguggccaggccagccuugaacuugaacuugccacagcuugcugcguguugggauuauaagcauuugcuuuuaugccuagccugagaauuauaauuuauuuuuaaaagaauuacuuaguuuacauaugugaauauacuguaguugucuucagacacaucagaagagggcaucagaucccauuacagaugguugugagccaccaugugauugcuaggaauggaacucaggaccucuggaagggcagucaaugcucuuaaccacugagccaucucuacagccccaaaauuuaauuuuuuaaauguauuuaaaauuuuuuaaauuuuauguguaugugugcgccuguguaugccagcaugaugggugucuucagaagccagguaguuccugaagcuagaguugcaggcaguugugagcugcuugacaugggucaugggacccaguguaggcccucaggaagagcagcaagcacacuuaauugugcagucaucucuccagccccacuuguuuucuauuacaugguccuugaacuuguuauguagcugaggaugaccuggaacuccccauccuccugccucccccuuccagcacuaggaucacagggguagugccaucuggucugauuuuuguagugcuagagauggaaccaagggcuugugcuuguugagcaagcacccugucaacugagcuacaguuucugcaacagagcauuagaauucucaaacaaacacuaaacccacagccucaugcguucuagacacacagcaauuaccauuuuagauaaggcccucauguuuccauuugcuaaauccaagcgugucaaauaaguaaggcaacgggaagcaugccuugacagccggugugaugacauucaggacacugaaucucuuuauguccuugccucugggucauuaucugaggcugcuuuauuaucagcauagagaggaaauuuuguuccaauaacuggcucuaaucucccaauuauuuuuggacugugaauguuauccuguuaucagaaaaagauuauauauaguccagugcaguggugugggaguugguagcuauggauuuaauagaaucaaaguuguuuuuguagaugcauuaacuguuagcaaagacauaauuuuuagguguguuuaugucucugaugggaaauuccugaugacagcucugguguacauagcucuaacauuuuguguuuuagucuuuuuuuuccuucucucucuuuuaacauuacauuuuguuuguuuauuguacacaggaguugggguauguaugccauagucaggugugaagcucagaggguaauuugaaggaguuggucucuacuuccaugugggucccaggaguuaaacucagguugugaggcuugguggcaaguaacuucacccacugagccaucuugcuggcccuuguguuuuagucuuuguaaaaaagauuuauuuauuuuauuuaucaugaguacacuguagcugucuucagacacaccaggaaagggcauuggaucccauuaccgaugguugugagccaccaggugguugcugggaauugaaauccucuggaagagcagucagugcucuuaaccacugagccaucucuccagccccuguguuuuaguauuaaugggaaaaaguuuucaguuuauuuuuuuucuuuggauuuugccugugguguggaucugugcauugaaugcauguuuggcaugugugcacaggcuuguauggaggccuuagacugauaggaacuucuuugauugugcuccacuuuauucauugaugcagaauccgagauaaaucuagacacaucaguaaugcaugucuaguaaugccagccagcuuguuccagggacccuuucuuguuucucucaucugagugcuggaauuguaggucucucucugucucucucucucacacauacacgagcacacauacaacacacauacacgcacacacacauacacgcacgcacacacacacacgcgcacacacacacagcuuguuccagggauccuuucuuguuucucucaucugaaugcuggaauuguaggucucucucugucucucucucucacacacgcacgugugcacgcacacacacacacacacacacacacacacacacacacaccuuguuccagggacccuuucuuguuucugucaucugaaugcuggaauuguaggucucucucugucucuguuucugucucucucucucucucuaucucucucucucucucccucucucucucucucucacaugcacgugcgugcgcgcacauacacacgcacacacacacagcuuuuacauugguucugggaucugaagucccauucuuaugcuugggcagcagguguuuuauccucuugccagcccaaguuuuuaaauuuuaaaauuuuuuuacauuuauuuguaugugugaaugaucuuacuggcccuuagguuuuguuuuucaucccaaaaucuccuguuucccaaggacauuaaacuuguucucuaacucccaagugcugggauuacaugugagaaccaucacaccuguuucuauagugcugaggccuuguacaugccuugugcaugccuuguacaugccaggugaguacuuuaccaacggagguacauuuacgccucuguaaaaaccuuuuagauuauaaguaucuauuuuguaugcauguauguauguauguauguauguauguauguaugaacaacuuguggaguuccucuucuuccacuguauggguuccugguauugacaauccuuagcagcaagcacaguuuuaagagaugauauucuccuauagcucaggcuggccugaauucuaugggaucagcuguuuuuuauauacuguguggcuuaagcuaauaucuuauacuuuuagaccaaguacaaugauucauucuuguauuccuagcacuuagaaagcugagacaggaggauugcuuuaaguuuaagaacaggauguacuaaguaauaaauuucauucuccuugggcuaggguaugagaccugguaugguaugguaugguaugguaugguaugguaucaaaaagccuacuaauaauagaaauaagaagauauuuuaaaauccuauguucuuccauuuuauguuuaauuugaauaucaaauuucuuuaauuuguuuuuuuuuuuuuaauuagaagagcaaaauuaugucuguguuuucuuuuuuucaggagcaguagagaacucuggacaauucuacuugggaggucagcucuuagagaauuggugaguuuuagggcuauagacccauuuuuuuuuuuuuuuuuuuuuuagauuuuuuuuuuuaauuuacauuucaaauguuaucccuuuccuaguuuccccucuaaaaauccucuauccucuccccccaaaccccugcuccccagcccacccacuccuacuucccagcccagccauuccccuauacuggaccauagauaugcccucaucugauaaugcugcuucuagaauggauccuuagagaaggacucugaguguucucuugcaaaucugggcacaguccacacuguaaucccaguacacagaggcuggaguaagaucucaggcuuauaccagcuuagacugcuuaguaauauuaucuaaagaaaacaaagaccagauaauaacuacagggcaaauguuuguuuaucgauuuuuauuuuauguaugugaguguucugcuucauguauguauauacaccacauucaugucugaugucaaggaggccagaagagggcguuugauagccuggacugcagucacagacaguugcuggcugccauguagguaguaggagcugaacuuuaucuucugcaagagcaaucagugcuuuagucucucagugucuugaguggcugccuuaaucuaguucauugcaauaaagugauuuuauauuuuauuuaauaaugacuuguuuuuaugcacaugggguuuugccuguguguauaucuguaugaggguguuggauucccuggaauuggaguuacagacaguugugaaucaccauguggguguuugggauaagaccuggguucucuggaagagcagcagugcuguuaaacugcuaagccaucuuuccaguccaaugaagugauugaauuaaaaccaaccaaaccaaccaaccaaccaacccaaccaacccaaccaaacuaaccaaccaacuaacccaaccaacccaaccaaccaaccaacccaaccaacccaaccaaacuaaccaaccaacuaacccaaccaacccaaccaaccaacccaaccaacccaaccaaacuaaccaaccaacuaacccaaccaaccaaccaaaaaccaccuucuggaguugcaucuagcauuuuagaagaaugacagucaugaucugcuauuuaguaaaauaguuggaaaaccacuuuauaaauauuuccauaaaugguacuacagcauuaaucaaagaaaacauuacaaaauucuguauucagaaugcuuuaaaccagugguucucaaacuuccuauugcugugacccuguaauacaguaauacaguuccucauguuguggugaccccccaaccauaaaauuauauuuacuugcuacuguuaugaauuauaaugcaaaaauaucuauuuccugccgggcgguggugguacacgccuuuaaucccagcacuugggaggcagaggcagguggauuucugaguucgaggccagccuggucuacaaagugaguuccaggacagccagggcuacacagagaaacccugucucaaccccccccccaaaaauauauauauuucccagugguucuaggaagccccuguggaagcguugugugacccccccccccccccaggcguugugaccuaaagguuuagaaauggugcuuuaaaccacagugggaacauuucagacagacaccaagcaaugugcgugugaacccgaagucugccucagguugcgcuugugugauugccuucuucuuuugcagaaucagauugaggcggaacugaauaaauauuggcagcgguuguuagaagggcuuucuuacuacaaaccucccagguauggcuaugucucgugaugccagucccuccccucaucccccaagacuucagcauggcgaccaaacugcccugugggcuuuacaaauuacugagcaguuuggcgaucuguugaaaggaagaguaauuuccuccacaguaauccaguugucugucauccucccugagacaguuucucucaaauucugccucuccugggacucacucuguaguccaggcugguugggggcuucuugagugcagccgacaaaaaggguacgaauaguugaugcuuacauagugcuuauaguguggcaucucuuuuucgagcauuuccuuccuuucuuucuuucuuucuuucuuucuuucuuucuuucuuucuuuuuuuuuuuuuuuaaagauuuguuggggcuggugacauagcucagcagguaagagugcugacugcucuucugaagguccugagcucagcaaccacaugguagcucacauacauaaaauaaacgaaucuuuaaaaaaaaagauuuauuuauuauuuuacauaaguacacuguagcugucuucagaugcgccagaagagggcgucagcucucauuacaggugguugugagccaccaugugguugcugggaauugaacucaggaccucuggaagagcagucagugccuuuaaccucugagccgucucuccagcccuuccaagcauuuuucauaaauuaguuagacgguggauucgugugguaagaaagucagcgggaggcuggacauacuacucagugguagaaugcuggcauacucaaggcucucaguucaaacucuagcaccacacacacacacacacacacacacacacacacacaaaguaacauguauauucaucacacauuuuaaaaaugauuuuuauuuauuuuucccucauauacuauucccugacugcagucccccuccucccucucaguccuuucaccucauuauccugcaucauuuaaucuuucuuugguaaggggguguugagauagcuucucuauguagcccuggcuguccuggaacucacucuguagaccaggcuggccucaaacuuagagcucugccugccucugccuccugagcucugggaguaaaagcaugcgccaccucugccuggaaaguggucuuuuguguggcuuguauucuccaauguguacuggagaaaauaaugcagucacccaaagaauacaggcaaguucaagaucccaguuccaggggauuugaugcccucuucuggccuuuggaggcaacagaaacacaugcacgccaaacacucauacacauaaaggggaguuuagagaaagaaaugauuuuauacaauaacauggcauuugaagucuaguaaaauuuuuguuuguguuuugagacaggguuucaaaaaagcugucuguacuauaaguuacuauguagauuagauuagccucgaauuuaaagaucccugcagcaucugucuaucaagugcugggagugaagguuaugacccuuugccuugaugccuccacaccuccacacccagcuaaacccguuuuuuuuuuuuucaauagcugaaauuaaacucuagacucuagacuuuacugucauuuagccuuuuugucuuuucaagcucugggugaacugaagagccucucacaggcgcucugccagcugaccuucaucccuagcaucccuaggccugaguguccucucugguguuguacuccccuccagggccacguguugcauuuaguugucaugugucccugucuggacucugcugugacugugcucaacugucaccgcgucucaguuuuuuuccuugcuuucaugacuuugagcaguucugaguagaguggccuaguauuuuauacaguguccuucacuuggacuugucugauguccuucucauuauggacuugaggucugggcuuuucagaggggaaaugccauucuuauauccuuucagcgucuaugugcuagacccauagaacaaguggugaugguaccauuggucacucuacugaggaguuggaggacaaggacuucugacauggaccucuggccccacauauacugcccuccaacauguuuaaauaauuuaacauagcaaaagagaucuacaaauaacacuauuauaacuaguuuauaaggcacaugccuggucuuguuacauaggcauagucaguucuguguuacaaaguuuauagacgugaauguguauuuuacagacacuaaaggaaaaaggaaggccagugccauugaguguuuuuuaauuuuauacccuugggggccauugugaaugaggaaauaacugaguguuuuucucauaguccaaguucagcugaaagagugaaagcuaauaaagacguagcgucaccucugaaggagcugggccuaagagucagcaaguucuuggugaguaaaaauuagcccagggucagcauaugcuucuguggaugccgguggcuccauugguaaugacguuaguacacguuccaagcuucaguggcuguugcucacuucaugcuucuugcuuuagggucuugaugaagagcagagugugcaguuacugcaguguuaccuucaggaggauuacagggguacucgggacucacuaaagguuuguggcucugcccaucucccauugaccuuucuuucuuguagaguuugggcccuugcccuuuauagaagaaaauaaagauauacagguauaaagaaagacuuauuuauuuggguuuuuuagacaggguuucucuguguagcccuguuguccaggaacugccuuucagagauccaccugccucugucuuccaagugcugggauuaaaacggugcaucaccacgccuggcuaggcaagacuuuuaaaggcuggaaagagauaucccuuuuuuuuuuccccaauuuuuuucaauuuuuuuauuaggcauuugcuucauuuacauuucaaaugcuaucccgaacuucccccuugaaaccuccccccacccugcuccccuacccacccauucccacuuuuugucccuggcauuuccuguacuggggcauauaaaguuugcaauaccaaguggccucucuucccagugauggccaacuaggccaucuucuacuacauaugcagcuagagacacgagcucugggguacuggucaguuaauauuguugcagaccuauaggguugcagaccccuucagcuccuuggguacuuucucuagcuccuccacccuauguauguuuaagaagacaccugucuucauccgugcagggguugaaauaucaaagaaucacaugcaagugagagaucugagagaacauccagccugcugggcuucagucuuuuguauagagagagagcagagcagagcagagggaaggauuugagcaacaguuugguuagacuuggcuuaaacauaagguagaaauguuuacagaaacaaacuagaagggcagucacgaaggguguggugcaucuuuuucuuugccaguugaauucuccuuguaagacagcuucuugacugcccuguuuuccuucagacaguccugcaagaugagaggcagagccaggccuuaacccugaagguaaguacugauugcugacucauucuuugguggacacuugugaggcagcuucuuggcuuccugucucauccuguccggucccaucccgcccccccccuccccuccccuccccuccucuccuuuugagccagggucuuacuguguauccuuggacagccuggaacucacuaugagccaccaugugguugccgggaauugaacucaggaccucuggaagagcagucagugcuuuuaaccucugagccaucucuccagcuugcuggaacucacuuuuuagacugccucacuauauagauccaccucccucugcuccucaguacuggguaauaaaggcaugugagacacauccucaccuugcuucagcuuuuaggucuuagcugaggcuuuuauuuuuuuuccgagacaggguuucucuguguagcccuggcuguccuggaacucacucuguagaccaggcuggccucaaacuuagaaauccaccugccucugccucucauguuugggauuaaaggcgugcgccaccacaccuggcuagcugaggcuucuuaagcccaugauccagcugaggaauuucucccagagugccuucugcugcuuuaggaaagacugcucuccuaggcucgguuaacuugacauuuucaguggagagaaaucucagugcuucaaggaugcugagccuaucacccacugagcccccuucucagucuuuuuagguuaaauuuagcagcauugguuuauaucccuauaugcauugucucuccugcagccuucucacuucagggcuguccuagggauuugaauauuugaaauauucuggaauauuuccuguugacacucagggcagauuaaguacguugcuugcaacaugguugaacauguauguaguccugggagcuguacguuuguuuuauguauuugacccgccaguuuuuaucuucuguauuauuuggacccuuugagaacuccuucuagaaaauuguagaaggaauuagaaauuuuugcuugcccacauaaaagacacauaguccagguauuuuauuuagcuauaagucuagauugggcagguuuggagcuguucuaacucauuucccagccauaaugucccuuguuccuugcugguuuuuauggcugugugcucaggguccaucuucucucaugguggccuccuccagucucuguauccuuccuucuuuucuccugccucuaccagcuaccccagccaaguaaaugaaacuucugccuuuugcccaauuucaggcuuugcucuauuuuugaucaauuaacuuggggagcaagguuacauagcaucacuugguguucgugauaaucucucugaugggggcaaccaguucuugggggccagaauuuagcauuugaguacaagcaacaucauaucaauccacuagagaaaaaauugguuuuuggaaauuugcuuggauuauuaaguaauaauuccuuuaaucuuccuuggcauaugauuguggagguucuugauucaauguguuugcauuucugugguugcugauauucgcuagauuuuucuguucaugucuaaaaauguuauuuugggccugggaguggcucaaugguucagaguacuugcuucucuuccaggggccuucguuggguuccuggcacccguggcagcucaggaaugccuuaccucuggcuccagaucccuccuugcccuucuucuucuggccuugguaggcaccuguacacaugugguauacacaaacaaaaauaaaaugaagugaauuuuaaacuacuuguuucuuguguauaccuccagaggucagagaacagcuuguggaaguuggcucucuccuuccaccauguggguccuagagcuugaaccagggugccagguguguugaccuuuacccacugggccaucuuugcugccugccaaucacaguuuugaaggaucugauuauaggcaguuguaaaggugacuuuucuuuuuuuaagacugagugagugauuuugaaauuguguguuuucccucuagauugcagauuauuauuaugaagaaagaaccugcauucuucguugugucuuacaccuucugacauauuuccaagaugaacgccauccauacaggguaagccuugguuuucuuuguucuccaucccauguccuucagauugaaauuucaugucacucauguucaccugaauguuuacauuuuauucuacacauucuuuuuauaaguuacuauguucugauauuuaaggcggaauaugcugacuguguugacaaacuggagaaggaacuaguuuuaaaguaccggcagcaguuugaggagcuguauagaacagaagcaccaaccugggagacgcauggcaaccucaugguauguagugcgugugcuuagcucuugcuccacagaguaacaugccuuguucagggagcccugguggaguuacauaccugagcauauguguaggaaugggucagaacaaaacuuugauuaauggucccuaauucugagccuuuccuugguucauauuaucuuuuuuuucuuuauucauuuguguuaggauuauaguguuaaaacccacccaacccucuuugguuuuuauuucauuuccuaaaauauucucuuagcaguugauggaauucuaaacccacaauucaucuuuucuuuuuuuggggggaaguccugcgguagccugagggagcauagggucucacucugucccacgcaggcugccugccugccucacggcauccuccugccuuggccauguacauccauuucauuucucugaucuuuuccuaccaugugugauacuggacugcuccuuuuauucuaaaugcuaaacuaacugcuggauagaucauaguaucacuucuugcuuuuguuugcagacagaacuugauacaggguagccgcaaacucccuacauagccaaggcuagucucaagugccuaaucuuucuguucccaccuccugagagcugagauuuauaggcaacaccaccacaccaggauacuuucuuauuaacauuaaaacauugucugcaugagggugcuauucaaugguagcaaacuuuccuaaugugguugagcagcaaaacaaacagaaacuucaacauaaacaagugcuaccaauuuaaaauauaugcgauaaggaaaguacccaagccuggcuuaauguuacaggucugaagcccaaguuauuuaguauagcuggaguuucuuggaccugccagucucugaauaauuacagagacauauuaauuuuauuauacccuaggccuuagcuuagaccauuacccaauuaucucaucuaacuuaaccugacuauccuuguccagguccagucacuggcccauuacccacacccucuguccaugugcagcuccuggaucucccagagagccucucucagaccagacgucccuccuaccauauccgcacaacucuugaccauuagcuccuuaguaagccacuccgugaguuaggaagguguacauuuauaaaauacugagaaagguuaccauaagaccauaagaguaacaguaccaagcuccagccagucuucuucucucugcuguuacaaaauuaacaauuggauaauacaaagacagccuucccacgauguacaaagggucaccacagcaauuuaggaggcagaaggaucauuguuaguucaagggccagucugggcuagagauugaguuuaaggccaaccugaagagcuuaacaagauccuguuucagugguagaacacuuggcuagcagagaccugagggcccaccccuauguuucccaacacuguccccaggaugaugaaaaguugaagagaguguucugcaggaagaaguacuucuugugucuucuagagggccuggguucuguuccgagcaccaagguggguggcucacagccaccuguaauuccagguccaaggaaucacaacguuuucuucugaccuccaagggcacguacacauauguggaauauauauaaagauacauaugcauaaauaaaaauguaagaaacagacccauuuacagugcaaugcauagaauuuuacugucuccuuagaaaauuuacaguaaaacauaaaaugguaaugaaaacaggaucccgaaaaggaagcuuaaugaaaccuaaaguucagcugcuacaugcuguuccagucuuauagcauggagagcuaaggucucugacuagugugccauggucucugauuacuuccugccgugggauugguuugguaacugccguguucauguuuacuuaaauagcgcgcgcuugacagucauggggugcgguggcugcuugagguuguccagggcuuuuguuugcugauuuuuuuccccagauuguccuguagguguuguaauaugauuauguuagcaaagauugauaauaagcuggaaguggugcacacuuagcacuugggagaacagcaaaaggaugggguaggaugggguagugaguucaaggacaacaugagacucuccuaaggccccccccccccauguucuuccaaguggacuccaaaauuacaaauuuauaugcagggaaauucuaugcaacauuaaaaagacguaacuagcgaaauacuagcaaaucugcuuaaugcuucucugaaaaggaguggaaauacacgguuggaaggggggcaucccuagauagcguuaaauaaagggaaguggcuaagacauuacuguacacgcuguucuguuuagagaaagaauguaggcugaaucacaauaaguuuuuacauuuggcacauugcugaaaaaagaccggaauccaagaccgaaguguaggugaagccgggcgugguggugcacgccuuuaaucccagcacuugggaggcagaggcagguggauuucugaguucgaggccagccuggucuaaaagugaguucaaggauagccagugcuauacagagagacccugucuccaaaaacaaaacaaaacaaaaaaagaaguguaguugacugggcaauagaaauaacaagagauagcauuuuuuacucuacacuuuauuugugguuuuuguuuuuguuuuucgagacaggguuucucuguauagccuuggcuguccuggagcucacuuuguagaccaggcuggccucgaacuuagaaaucugccugccucugccucccgagugcugggauuaaaggcaugcgccaccacgcccggcuauuuguguauuuuuaaacuuuuauuauggcuauguuauccauuaaaguagcauuuugggggauggacgucaugguacacuuuuuuaguuccagcacuggguggugguggugggggaacucacuauucuagcaccugggaggcauauacaggaucccugagucugaggucagccuugucuacauagcugguuccaggcucugcaggacuacucggcgagacccuauguauaaaaaaaagaaagaaguuuacuuguuuucuaaucuaacuguuuuucucucccauuuucucucugugugugcagacugagcgucaggugucgcggugguugguucagugccuccgggaacaguccaugcuguuagaaauuauuuuccuuuauuaugcauacuucgagauggcaccaagugaccuauugguacuaaccaagauguucaaggagcaaggguuugguaguaggcagaccagcaggcaccuuguggguggaaccauggauccuuuuguagaucgcauugggugagucugaguggauauugcuuuaugaacugucuauggaguugguauugcagugguucugugacuggauggagaagggagauguaccauuguuuagugggcggggaaguagguguaugugucugcauggccuguaccuguaagaaguauagucuggaauuaaggggacuuuuugugugugugugugugugugugugugugugugugugugugugugugugugugugagugcaugugcgugcgcacgguauuuguguaccugcugucauuggaggacagcaaauagcauugaguccccuguaugccacugugugggugcugguaacugaauaggauccacugcaagaauagcgaaugcuuuuaguacuuagccaucucuuuagccucaaagacauucugccuuuucguuguuuuucaagauaggguuucucuguguagcccuggcugucuuggaacucacucuguagaccaugcuggccuggaacugaaagauuugccugccucugccucccaagugcugggauuaaacuuguguugcaaccucccaacaaacuggggagucuuuaucuuaaucuaggagguuggucgacucaucaacuaggcacagugcagggaccaugguggcacugaagagcaccauguuuagucucugcucauuuugaggucauugucuauagucuuugaaauuauuuuuucuauacugacggcuauggauauagcuacguggugaugccuuuuauccuaggagcaaagaaaugcauuugaggccaggcaaugguggcgcacaccuuuaaucccagcacuugggaggcagauuucugaguucaaggccagccuggucuacagagugaguucuaggacagccagggcuacacagggaaacccuguaucagaaaaccuuuaaaaaaaaaaaaaaagaaaaagaaaaagacauuugaggagugaaagcugggucagguguaaguuauagcuauggaaaacuugaguguuaguucuaaguugucuugaaugaugcacacagcuaugagucagugucaaguacgugacauuaagaugugcuggaagcaagaaaaugaaauacauuccaaggucucagagccagcugugaaggaguacaugcuugucacacauggguccuggguuugguccucagcaucacaaaacuucauguuuaaaagcgcagcaggagcugggugauggaggugcacgccuuuaaucccagcauugggaggcagaggcaggaggaucucugugaguuugaggccagccuggucuacagagugaguuccaagacagccagggcuauacagagaaacccuguuuuacaaaacaaagagacaaaccaacaacaagaagccaggcccagugggaaugagagugaaaaugcucaugaguaaccuuugauggggagagcccuauggcuuccguuaguuugagcccagcucagaacagcaugacugagacugugcugugggcuccaauccagguacuucagugcccucauccugguggaagggauggacaucgagucccugcacaaguacgccuuggaugacaggcgagagcugcaccaguuugcucaggauggccucaucugccaggugagcuugcgagagccuuucccuuaaccucucucucaacaacccugaugcucacaaguuuuaguucuguguauuuacuuaggccugcagaaugcaacguuauuuguacagagcugauaauugaagcuaaaaggaaguagacacacuagcagagguggucugagggcagcuccuuuggaguuaugggcaucuguaggaagaaaacaaggggugaaugaacccugaguuagagugauuagaaagacagagagggagaggucaugaaacguucaagaaggaucagccugauaacagcucuaaagucuuaacaugucuuuuacaguuuaaacuaagaucauauaaaaucaggaaaaaaaaauguggaccacaguaagaguguuggguuccuagcaagguggucgaggugaagaugcaggcacugcuggugugggagagccaggaucucuaggugauagacuugguugagaugcugacgugccuggcugaagccaguccuuuccuuuccuuuccuuuucauagacauaagugcuuucucccucauuaggacauggaccgagcgauguugaccuugggagacauuccgcaccacgccccugugcuuuuagccugggcucuccuccgucacacacugagcccagaagagaccagcaguguggucaggaagauagggggcacggccauccagcugaauguguuucaguacuugacucgacugcuucggucacuugccaguggaggaaaugauguaagguuuuauuuguugguaguuggcaugacggcaagcccuagagaacagugagaccugagguggugacuugguucauuguagguuuuuguuuuuuaauuguuuauuuauuuuauguauaugcgcacauucuagcugucuucaggcacaccggaagacggcaucagagcccauuacagaugguuaugaggcaccaugugguuccugggaauugaacuuaggaccucuggaagagcagucagugcucuuaaccucugagccaucucuccagccacucauugugguuuuucuucuuuacugggauaagaucuuagucuguagcccuagccggccuugaacucuuaauccuccugcccuagccucugaaggccuggaagcgcagguaugugccacugugccagcuuugugaugaugucuucacuggcuuuguaggguggucagacagcauucuuagcacuccccaaugguaucuuacuugucugggaccagcuaucuuacaucuuagaaagcugaaacccagcaauacuuaguaagugguaaaguuugaacuggugauaaggcugacuccuguucuagagcaagcaguucucauccuuuggguugugaccccuuugggguugaacgacccuuucacaggggucacugucaggaaacagauauuuacauuacaauucauaacauuggaaaauuacaguuuugaaauagcaaugaaacaguuuuuauggauggggucaccacagcaugaguauuaaagggucgcagcauuaggaagguugagagcacugcucuagagggcgaaucuuggacaugugacugagaacuuguucgccuguaacaauaagugagacacuccucugagucucugcuugaggcuugaguuugccugguuauuuaguuagcucauguugauguacgaaagugaaauaccaggagcaggcucaguggucagauuuuuaccuagcauacauggggccugagaauuaaucuucugugccauagccgccccccccccccaaaaaaaaaaaaaaggaggagaagaaaagguugguuucccugcugagcagaagacugugcuccuacaagagccucuucccagauagcuccucuucguagccucacucuuguccuaagcaccuucacggugcccgaauggagaguuuggaauguccugugggagcucgaaguaaacaucaggcagugcaauguuacucaccguuuagaaaucaacaggucagugugguggcacaccccuuuaaucuuagcacucaggagacagaaccaggcagaucucugaguucaaggucagccuggacuacagagcaaguuccaggacagccagggcuguacagagaaauccuggcuggaaaaaagaagaaaagaaaggggaagaagaaaaagaaauggacuaugaaucccugagaaaacauggaagagagcuguagauacaauuugguuaugcagcauucccccagcauacaugaagcccuggauugauucccaguucccgcuccaaacccucuccacccccucacccccugaaaaaaaugguaggagaauccugaugcauauuacuaaguaaaggaaguaaauuuaagaggccacauagugugugguuccaccagugugacacucaaaagagcagcugcugccaaggaagaguugggaaagcgagaugaguaagccaaauaggauuuguaggacagcaggacaacuuugucugaugucagccugaagcugcucugaaaacuacucuuuggggcuagaaauuaagcucagugucagaguaagagccuagauguuuucucaggagaccuuggccucaaacccacucccacaucaaguuuuuuuuuuuuuuuuuuuuuuuuuaagauuuuauuuauuuauuuauuuacuuauuauauguaaguacacugucgcugucuucagacacuccagaagagggagucagauuucguuacggaugguugugagccaccaugugguugcugggauuugaacucuggaccuucagaagagcagucgggugcucuuacccacugagccaucucaccagccccacaucaaguuuuccagagagauuuaaaacagaauccucugcugagaggcagacacuucucuguacaacgaguugaugagugucucauuuggauuaggucgaguguguauccagucgcuuggcuggagguaguuuuguguguuuguuuguuuguuuguugucuugagacagaguuucucuguguagcccuggcuuccaggcugagaguaaaguugugcaccaucaugguccagcuuuaguuuucuuuuccucuacaaaaacuuuggucauuucgagauuaguuccauugguuuuauuccuguguuguaauguuuguuaguucuuccuucuaaucuuauaacuaaauuaggaaaauaaugagggauuacuuuugguuuguuuuuuuaaggacucuaaauaugauggcugaaucuuggagagagucgcguugcucagacuuaaccgcguauugcuuugucauugcagugcaccacgagcaccgccugcaugugugucuauggucuucucuccuuugcccucaccucacuggagcugcacacacugggcaaccagcaggucaguacauggcugucuuuacagucagguuaccccucaguuauaguccagccaccacaaugccccucagauuuguuucuugcuauuucuuuucuuuuuuuuuuuuaauauuuauuuauuauauguaaguacacuguaguugucuucagacacaccagaagagggcaucagauuuuguuacggaugguuaugaccauuugguugcugggauuugaacucaggaccuauggaagaguagucggugcucuuaaccacugagccaucuaaccagcccugcuauuucuuuucuaauuuguguguuuauaguuuuuaaagacaaaguuucucuguguagccuaggcugucauggagcucaauuuauagacuaagguuagccuagaucucaaaggucuucuugccucuaccuccugagugcuggauuaaaggugugcaccaccacuguuuggcuuuuguaaugauuaguauuuuauaaauugaugaaaauaagauaguugucaauugaaagacucagauuuccugcccugucauuuggagcauagaaagugugaaagccuauguaaaauaucaaggccuagguacaguguuaaggccuugguaacuguuacuagcuagcuugccauuugugcuguuacuaauauuauaagggaacuuucuuauacguuguuucugcuguuacuaggaaacuuucucauguugauuucauauuguuauauucucugccuuggaaagcaaucacaacaguuagaacuacuuuauauauauauagcuagcuacaguaagcccagacccaaaucagccacccagcagcucuuccugcaucuguguaugagcuuuugugguguuugcauuuauaagcugccugggauggaccccaacauaagagagacacaccugcaucuaaaacaagacuucuauuuugaguagggguugaguaaaguuuaaguucccaagaccucccugggaacugacauccuacuuagcagaaagagacaugcauguggaacggacuuucugguuggaaaguuaagacaugacuguuaggccagacaagucccauccugcuugacaacacaugaauauuaggcaacaguugaauaccccagccaauggggcagggcaagugcacagcaaaagccuguuccuaagaagccccugcuccuaaaccccgauugagaagagcuuggcacagaugauugugggucucaggcuuagaaauccuguagacucuuaacccagugucaugguucagcuccugucugaaccauggcccugcuugauuaguacugcucaauaaacucuccugucagacauugguguuuaugugguuugucaggccacuccuguagacaacuacccuugcuuacuccuggaccccaacagaaaccuuuaacgguaaaguucuugugacugcagcuuuuaccuuuuacuuuuagguugauuaggaagaccuggcauguggauagaaaguguucagccaguugugaugcacaccuuuaauccuagaauguagaggcaggaggaucucugaguuaaaggcagccuggucuacauaguaaguuccaggauagccagagcuucauacagagacacugccuuuaagaaaagaaauaaaggaagaaaauguccucgggcuggggcuggagaguuaagagcacuugcuucucaucuagggaaacugaguuugguuuccagaauccaugucauaguucacaacugccuguauccuauuuccaugggaucggaugcccucccucuuuugaccuccaugggcuuaugcauacuugugauauauccccccugcccccucucccauucacucaguauuccuuaaagugacuggcagaugucaagugugcuaagcuaagugcugaggacacaguaaauuagaagauacuguuucugacuuaagagcuuggucaaccuaaccauaacaacacuagucuuuuaugugugagacagguuaugucaaaacacaguauuaccagcuuuuaucauuuccauucuacagaugugcauuuacagaucaagaaguugaauuugguggcccaggauuguggugugcgucuuuaauuccaacacuaaggaagcagaggcaggccuggucuacauaauguguuccaggccagccagggcuacacagagaaacccuggcucagcaaaaaauaaaaaauaaaaaaggaaggugaauuuaugaaucuguccgcagauaagacuugcaugccucagcuucucaaguaguucuagaaccauaggcuugcagcaguaugccagggcugcaaacugugcaggguugugccaugacuguaagccagaguucuugccaugcugugcaacauguuccuuggaguccuuaugguaauggaguaacauacaaaagauaaagggguucauugccagaaagacaaaaugcuuccuucucuucacaggaugucauugacacagcaugugaaguccuggcagacccuucccuuccagagcuguucuggggaacaguaaguaugucagaaggacuuguucuguaccucucucuagagcagugcucucacccuuccugaugcuguggcccuuuagaacaguucuucaugauguggugacaccacaugaaguuacuccguuccuacuucacaacucuucauuuggcugcuggucggaaucauauuguggauacuguguuuucuaaugucuuuggugacuccugugaaugggugcucuaccuccgcaggguucacaacuccaaguugaaaacugcuugcucuggaguaaggagaaggggcuggagagauggcucaggaguuaagaggucaugaguucaauucucagcaacuacaugguagcucacaaccaucuguaauuggauccagugcccucuucgaacaaaaucaaucaaucaaucaaucaaucagucaaucaaucaauuuuuuuuuuuuuuaaauaaggagaaugaucaagcauuucugagagauuuuagcgguaacauuuaacaguucaggucccagcuggucagcccuuucguuguaucccggcuggaacaaugugcuuagauagcuuuucacucccucuggagaugcuucugguuucugcagaggccuacagaucccugggagaagcuguuacaagauauuuuagauugggcaucuauugcuuguaugugcuggcuaagcauuggcaugauuuuggggguaguucucacuuuaauagaggcauuuacuggaaggaauuauauuguuugccucuacaaaggguggccaggaggaaggcaauggauagacaguauaucauuuuucaguucaaugcgaauaucuuaaauuauuaggaaacguauuuaugucuauguaaaggagaacuguauuucuaguuuuucucuuaaauauaugagcuuuuaaaaaauauuucuucuaauggguggaggugguguacaccuuuaaaucccagcacuuuggaugcagaggcaagcagaucucagaguuugagaccagccucaucuacaaagugaguuccacagagaaacccugucucgaaaaccaaaacaaaagaauaaagaaaauaaauacuuaucuuuauuuucauuuauguguguggauauaaagucugugcacaugugaaugcagugcccauagaggccagaagaggcauacuggaguugggaguuacagacaguugugagcugcucugugggagcuggguccucugaagagcagucagugacuuccggcugagccaucucugcagccuguugcuaguuuuucugaggauuucugagcacugcgaagggggaugacuucuuccuuucuacuuuaggagccaaccucuggucucgggaucauucuggacagugugugugggauguuuccccaucuccuuuccccacuucugcaauugcuccgagcccucgugucagggaaguccacugccaaaaaagugaguuguuuggucagauuccuaaaaaguagagggaggggcuggggcugccugaggugucaguggcacuccugugugcaucugcagugccagugcauugccaggauggaguuaucuggaggugagugaaagaugcccauuggaagguguccccucagugcuguauaggcacguugagaucuuccugcuaaggaccuauuguaggugcugugagacuuagugugacguugccugguacugucuuaggacgggacaguaaacuuaaacgagugacacucugagggugugcuguguaguuaguggcuccccagugucugcagggcccuggguuugauucccagcauuggacagggugguaggugggagaaaggagaggcaagccgagagccaacucuguguagaguaaggggagcaugggucaggugcagaauggugaggccuaacugagaagagcaugagcaguagucugguaggagguuguagacaggcacagacagcuggcugaaaaagcaaaagcucuuugugcggcccacgagugcauguaugacuggguuucuugcuggguguuggcagguguacagcuuccuggauaaaaugucuuucuacaacgaacuccauaagcacaagccccaugaugugcucucucaugaagauggaacucuguggcggaggcaaacacccaaacuccuguacccucuagguaagaagggcuguuucaaggggucuuuucauaggaagugccugugaggcccuucccccucuucucaggacuuguugaccacugacugcugagcagcaggcucagagcagugugacgagcagugagugcuccccagcugaguagcacucgcucuucuccuucuccuccucuccuuuuuucuuucuucuuuuuuuucuuuuuguuguuuguuuguuugcuuguuuguuuuugguuuuucgagacaggguuucucuguagcccugucuguccuggaacucacuuuguagaccaggcuggccuugaacucagaaauccaccuaccucugccuccugaguacugggauuaaagguguacaccaccacucccgacugcuugauuguuuugagagcaucuuguuuugcuguuagcccacgcuggcucagaauacaugauuuuccuacuucauacugagcuucugccuuuuuuuucuuuuuuuuuaaaugaauguuuuugcaucacuaguuucccuuacuguguuacuguugugcuguaacaagguaaacagggcagaggucugcgucacugaugagugaagugugugaugugcauccuuccacauagcuauguuuagagugcaugggccuuuucucuugcuaacugucuaguguuucuguugcugugaugagcauacaaccagagcaacuuggggaggcaagggcugguuuucucuuccaguucauuaucaaaggaagugacacggagaccauggagaaacucugcuuacugguuggcuccucuuggcuugcucagccugcauucucauaccugcccagggcugagaccacucacagugggcugggccuuccagaucaauuguuaguccaaaaaaugccucacagacuuaccuacgggccaggcuagagggguauugucucaguugagaugcuugcuguaugacuccagcuugugucaaguugacaguguuaguagcaggcacacuaaccccaaagguuuugugagcauguucucuuaugcuaggacacucacugcuugguuucugaaggaaagcccugcugaggacaugggagcaugugcgcgcaagugugugcgcgcgcgugugugugugugcguguguguguuuauucugacuuaaugacuuuucaccccuuaaacacuggagguuucagguuuccuauuuaaacauuuuucccacagagucuaugcaguaugagauaggauccagcccuaaaguguucuucagagcacccaucuuuuuauauacauauaauucaaauaucaaacuagaagaaaaacaguuuugcuguuuucuguauguacauguugauacuagugaaauauuccuauauuguguuuaguuuuaguauuuuuuuuaagauauauuuauuucauguaugugaauacaugaguagcugucuucagacacaccagaagagggcauuggauaccauuacagaugguugugagccuccauguuguugcugggauuugaacuuaggacuucuggaagaguggucagugcuuuuaaccacugagccaucucucaagcccaaguuuuuuuguuuuguuuuguuuuuuuguuuguuuguuuuuuuuuuuuuuuuuugagacaggguuucucuguauagcccuggcuguccuggaacucaguuuguagaccaggcuggccucaaacucugaaauccaccugccucugccucccgaguucugggauuaaaggcgugcgccaccaugcccagcucaagcccaaguuuuagcacuucaaauuugauuuaaaaucuuuuuuggauggguuguuuuauguguguguguguguguguguguguguguguguguguguguguguguguguguguugagacagugucuguuuguuuacauagcccuagcuaucauagaacuuacacuauagaccaggcuggccucaaacucagagauccuauagacccucccuccugagugcuagaaguuaaaggugugcaccaaagugcccuccucaguuuuaguguucacacaaguccuuguagaaaucacggacggaauaaugcacauuuucuucugauacugucagaugugcuuucuauacgcucccuggaagcuccaccuuguggagagacuuuggggauuguuugcuuagugaugucagaguuaaaguaagugaaaguccauugcugauuacacugacuuccugcccaagucauguguggcccaugaacugaugugcaguguggguuuggagggucaccucugcuccagugcuguaguuuaucucgggugacacaccaaaaaggagaugggucucacuugucaccauuacacauuauuuggugucauauuauaaaucagacuuaaaaguuaauagguuugccgggcaugguggcacaugccuuuaaucccagcacuugggaggcagaggcaggcggauuucugaguucaaggccagccuggucuacagagugaguuccaggacagccagggcuacacagagaaacccugucucaaaaacaaacaaacaaacaaacaaaaaaaguuaguaggcucaaagauguagaaaauagauaauccuucuaaugaccuguuuugugugaaugguuguuaagauuuaaauugggcugacagugguagagacagagacaggcagaguacaagaccaaccuggucuacacagcaaguucuaggauagccaggguuaaauauugagacccugucucaaaaggacgaagacuggauuagcaagcugcaugaaaaggaccaccaucauaggaucaccaucugcacuacagugggaauucugucagacacuguugacucuguacauugcuugcucuacccaguagagucuuguugcuucuuccacuccgucucaguggaauaguauucuuuauacagagagcagugguccaguguacagcuguggugagaacagcuuguacagcaauguagacggcuaagauuuggaaagacucaaacauuauuuugccaguuuaguucuccucgcuuuuagaauauuccacaaagcuaagucaaaaugguagucuuuauggucugccuuaaaauauuuaaagaucgccgggcaguggugguacacgccuuuaaucccaccacuccggacgcagaggcaggcagauuucugaguucaaggccaaccuggucuacagagugaguuccaggacagccagagcuacacagagaaacccugucucaaaaaaaaaaaaaaauugaaagaugaacgugcucuguaaaccuuccuggcaccagggugaugacugcuuggcuaaccauacgugccacuuuugcagagcauacuucaguacuacagagaaaggggcauagccuacuguccuggcugugugcccucugcugcugucuccuacaaggaccagcaacuaccucgcucaucccuuugguccucugcaaucauuaugcaucagcgucaggccuucauacauaauacugcauugaacaugugaacucuuaggaacuagcgugucauuuucauaaccacaguccucaacaagagaugguugggaaaaggcuguguauaaaauaaaaguuuucgaguggauauuugagagguaaaugaacaugugcuauauguguaaagaggaaugccacuccaucuuaaagagaaacuguuaucuuagagcaugcuguguugauagcuuguagucucauauagauuaugucacauauaaacccugcagguggcuugccagucacaaaaacacaaacuguuuuuugguuuugagacuagucuuaacuuuguagcccacacuagcuuucaccucagccucccaagugagcacugggauuaaaugggaaccagcccuacagcacacaguucuguuaauaauacgagaaauuugauguuaaguguauuugaaaccaggcuugguagcacacaguucuagaacccagcuacuugaaagauuugagacugaaagaucacuugagccugugaguucacuaccaaccugaauagaacugugagaucuuguguacaaaauaaauacauaaauacauaaaauaauaaaaaugacuaucuaguuugugugcauacacuuaaguauauuuauggagguuagaggacaacuuuugggaauugguucucuccuuccaccaugugaggucccaggugucagaguuggcucauuaugcuuggcagcaagugccuuuaucuguugacccuguuuggguuuuuuuuuuccuguuuguuuguuuuguuuuuuucaacuuggaaaagucaggugugguggcacacaucuuccuuuaauccuaguacuagagaggcagaggcagaggcaggugagucuuugugcguuaguuagaguccagcccagucuacacagugacacccuuucuagaaaaaaagaagacaaaauuuugggggcaagaugucaguucucagggugggauuaaagcauuccucugccucagccucaaaugucugagguugcaggugugugccagcacguccaacuuuagcauuuuucauguaaagguuguaggaguggugucugccaggagguccuccucccagauuuguaggaggaucacaggcauuucucuuccauagggggucagaccaaccuucgcauuccucagggcacugugggccaagucaugcuggaugacagggcuuaccuuguccgcugggaguacucuuacagcagcuggacccucuucaccugcgagauugaaaugcugcuccacguugucuccacagcagguaaggagggcucugcagagcaagcacuaggcagagagggugugcuugcaggauugggagcaaacacccaacuugaaggugaaguuggaagccauccagcuuggggucugagaagucacaggcuguauuccccacagaugugauccagcauugccagcgggucaagcccaucauugauuugguucauaaggucaucagcacagacuuguccauagcagacugccugcugcccaucacaucccgcaucuacaugcuguugcagcggugagucuuugugguugggagcuugcagcagugacuguugcuucccaggagccugcccugagcucugugggaggccuuuaccagugguucucuagccaagggcucucccguuccucagagcacuguggugagcacuggaaagucuuguuccuuauucccugggcacagcgcuuugcucucuauccaggcugacgacggugaucuccccuccuguaaacgucauugcuucuugugucaacugcuuaacugucuuggcugcucgaaacccagcaaaggugaggugacaagucucuguagcagcucaguagcaucacauucgguguaaucaccugggaggacgugcacaccaaaagccuucuucuuccuucuuaggucuggacugaucuucgucacacagguuuuuugccauucguggcccacccugucuccaacaugacucagaugauuaggugagccaggcccugaguggguagaccuuacuccuugcuaugacccauuccuggucuuguccagccugccuuuauucauuuuaaagaaccuucagucuucauggacuugaggguuggggaggaugagauggagaaggggcacagagcugcucuccuugacacacugcugcuucacagggguuaauucugguuugaagauagggcuucaccauguagcucuggcuggccuggaacuugcuauguagaccaggcuagucuugaauucauagaaaucugccugccucugcuucugaguccuggaugguucacaguuuuaaacuuuucagagguagaaugggacuuuucucauguagcucagcuacaguagcugugugggcauucauguuuccgcugagugaguccagggguguuugauccagagacuugguguccuauucucaagcacagacagugugcugcuucuccaaucaggguacgugagccaggccaggacugaaacccaggccccgucuuacugccugagcaugcucauuucacucugcuuccguggcaggaguuucccuggugacucaugggauugucacgcuagcccuccuggaguuuccaucaguaaagcauaagccuaccuuuucuucccuggcuauaaaacugccuacauuugauucuucccuuugaagagcuuuggugucugugcugacgaaaaugcuguagucuaucuucaaaccuugaacauugcucacgguuuuaucccucugccucugucugucccuagugcggagggaaugaaugcuggaggguauggcagccuucugaugaacagugagcagccccagggcgaauauggggucaccauugccuuucugcgccuggucaccacgcuugucaagguaccaucugaugagacauuucuggagcagcuccccuguuaccugcuccuguagucacuuucuucgggacauccuuugcaggacaucuguucugaagucauggcauauuagcuucuguguguugagagucuggccaguauguuccuuagugcuagcuuaauugugggaguuuguuuaguagucagaaggcuuguggugagagcugagaacucuggcuccugcguguuaaguuaugaaacugucauccacguguacuucaugccuucuccuaucgugugccugugcaugcuucauggaucuggcuuugugguugucauacaggcuaugcgcacuguaugucgugccccaguaugugucugcauguacccuccauggucugguuucagguuguaguauuuaccucauagaagguacugugacccugcuugcucaauuuucucaucuuucuuaagcagauuguagcuaugagcugguaauacuagaucaggacucuggaaaacuaguguauaguuaagaacaagaauuuuggaauuggagugaaguaggguggaacuuggaauuuauuacuggcuacuuggauuuuuuugacccugggcaguugaguuucugagagcaucuauggcaugaaguaggucucacugacggaguuuagagccucacacacaggaguuccacagccagcgugggguuccaggaccaauccuggcuucucaggagcccaacacaaaagagcagguuuaaggucuucuugggcuauugaguaaggucaggccuggagacuggaguucagugguaguacuuucuucuauggcugaggaccggauuuaauggaacuauuacuguacacacacacucagcaccuugcacauauccuuccuguagaaauaagggagggcuuagagagaaauugugugcugagucaaagugagaguccaguuuaagauacagacauuggaaauaaucagcacuauuaaaagagagaguuugggugccgggcgugguggcgcacgccuuuaaucccagcacucgggaggcagaggcagaggcaggcagauuucugaguucgaggcuagccuggucuacaaagugaguuccaggacagccagggguauacagagaaacccugucucggaaaaccgagagagagagagagagagagagagagagagagagagagugagugagugugugugagagugugagugagugaguuuggggcaucaguccucucugcucccaugcuccauaauaaugggacuucagguuugggugacagucacugacggugagugacuuuccuuguuguugacaguccuauaucuggugauuagggaaccacuguccugucagauuaacuguccuccugcuccuccaugucaacaccuuuggugauauugucacauugccuucuuaguuguuucucugucuaucgaaugguuggguugaaguaggaauuucugaugucugcuucuguucuuggucaagguguuccugguucuccuuuggaucugucuacgcuuuugagguuaaaucuugaguaauaaaggaugccuccuuacauggccaaggcccucacagaaugcucucccacaggggcagcuugguaguacccagagccaaggccuggugccuugugugauguucguguugaaggagaugcuucccagcuaccacaaauggcgcuacaacucucauggcgugcgagagcugauagguaaugacagcgugggcugaacaccccagaauuucugcucucugaagaucuuucccucucuuuuuugaggcaggucauuaacacaaggcugcauuguccaucacaugucuuuuuuggagucuagguugccuaauucuggagcugauucaugcaauacugaaccugugccaagagacagagcugcauagcaggugaugggggguuguggggcucagcagggaaaacauguauugguugcuucuaguccccuuguuucuucccaccaugucaccuuaguugaauccugucuuagcuagaauuucuacugcugugauaaaagaccauguucagagccacguggugaagaaaauguucacauuauagucuaucacugaggagagucaggcuaggaaccuggaggcaggagcugaagaaacacugguuacuggcuugcucaaaaucguauauaccccaguaccaccugcccgggcaugacacaacccacaacaggcugggcccuccuauauuaaucacugacuaaauaagacauaacccaugggccagucugcuggggcauuuucucaguugaaguccccucuucucaaaggacuagccuuugucaaguugacaaaaauuaacuaacauaaacccaaaacuuacaauuuccuggccacuggcuugguugucauucuucccuauggacagaaaggacagaugaaggugcauguacacacaaacacacacgcguaaucauucguuaugauaauuauaaaaaaaaugcugccuguccaucagaaagucuggugugagagacaccuuuagcaagucaguacagguucuagaccuuucuacuccaugaacucccuugcucuguuacuugauuuugugcccucccuuguuuuuauauuucuguauauuacaugaauagguuaauccugaauuauuuaaguaauuauucauccauuaauugaugguauuuagauaacugucaggguggucuuuaggaccaagucugagaaaaguguucagaauaucuuccuuccacagacaguuggcaaggcgaauggggcugcuccuucugguuaagagcuccuagugacugagaacccucucuguuuccagccacacacccagccugccuucccucugcaucugcagccuggcuuauaccgaagcuggacagaccgucauuagcaucaugggaauugguguagacaccauagacauggugauggcugcucagccccgcagguagggccuccuuugugcccaucccguugaccuucagaccccaucuuagcuuaacuuguaguugcuuuguuuguuuuuccaucuuuuuaaaauuaaaauauaauuacaucauuuuccuccuucccuuuccucccuucaucuccuuccacaccauccccuuguacuccuucaaauugauguguaguuaaauacacacaugccuacacacauacacaugcccaguaugugugcauaaaucuauaaacacaaccagcucuguacauuugguguaccuucuguacauaugguuucagggccgagccauugguguuaguuaauaaauccgagcucuggguucugggcucuuggcucucagcacuccuuauucaccugcaguucuuuguuuaagccuggagccacagugagcuuuccccauuccucucuagcaugacuguugguauuauguuccuucaggucuuguuuaggcagccguguugauagaguaucaugggugaagcuucauuuuuuuaaaagacuaucuuauaacagcuuuccugguccuugcaguugcuuuuuaaaaauaacuuuguggccagguggugguggcaggccuuuaaucccagcacuugggaggcagaggcagguggauuucugaguucgaggccagccuggucuacagagugaguuccaggacagccagggcuacacagagaaacccugucucuaaacacaaaaacaaaaaacuccuuguauuuccuagcuaguggcugcugcauagcuuccuuccuuuccuagucugaauugggcuucuacuguagucggcucgugagagcacauccugacugagaccaucuuauuggaacuaacugugaucuccauuuggcaccuagugaugggccagaaggccaaggccagggccaacugcugaucaagacagugaagcuggcguucucugucaccaacaauguuauucggcugaaaccuccuucuaaugugguuucaccccuggaacaggcucucacacaacaugguauguguuuuucuuccucggcuacguuucugcccauaaaaacauaguuaacgcccucugcuuggacaucagaaaucauucucagcucauuucuuuaggcuugguaacaagggacugcaucauaguuuauucuggacuccugcugaugacauaguaauacuuaaggauggagacuggggucauauuucuuugguucagauuuagguuuugcucagcuguaugagaaccucaggcauauuuaagcuuugucucagauuucucauccagaauggcacagaaguaaauugcuguauccaugggagacugaggcaggaggauaagcucagcuagggcugccuaacaaguagagugcuaggccaugcaaaugacuacaguguaggaagcuccuucccuguaggguggggaggacggcucacacagucccucaaggaugauggcggugcugacagcaguuacaaaugggugauugauugacugcacagaggagagggccuggcucaugcccacagucgccccucugcucuccagaggcagaagggccagggccaccugcuagucaagacagugaagacagugaagcuggcauucucugucaccagucccugacggucuggucuguauagcaaaaucuuucaaagacaaacaacccugaaaaaacaagcacaaaaaguccuucaaaucacauuggcucauaucagugugacucuaagcucguuaaucuuuggcucacuuucauuaugaguaauguuuuauaucaugucuaaaagcauuuauuuuuuuucuuuuuuaauauuuuuaauuagguauuuuccucauuuacauuuccaaugcuaucccaaaaaucccccauacucucccccccccaaaagcauuuauaacuuuaauuuuuuucauuugcuaugcuggggucugaacccagggccuuauucgaguuaguaggcgcuccacuauuaagucacugcucuaguaccaguuaugcacaggcuggccuuaaauugauuauguagccacgauguccuggaaugcccccuccccuauaccccuccccugccccuuuguuucaauuuguuacauuuguuauauuuguguucaugaugucugggugucagcucuuucuuuccacuaugaggguucugggaguugagcuauggucaucagguuuagcagcaagcacccacugggccaucucagugacccuugcccuucaauuuugguuccuccuuucuucaccuuccaagugcugagguuacaaguaugugcuacugugucugcccagagggguuuguguuuucugaaagugcauguguguguguggggggggugcgcgugcauacuugcaugugaauguggaagucagacuguggggcuuggcucucucccaccaccauggaggacugacucugucgucagacuuggcaaggagccuuccccacugaaccucauugccuuccugcuuaaggguucaaggcuuaaagguucuucuuuuccuuuuuuaaaaauuucaguacagugccuuuuguaaccuccuuauuaaagaguauuucuuuuaaaauauaucuuuguauuaaugcauuguauugaacuguuuauccccaaauccuaguuaucucuuugcuacugagaauaggacugaacuggccaccucuacuuaaucagccccaguggcugguguuuugaaagaacuguaaugggucccuggaucuguuuccuuugcuucaggugcccacgggaacaaccucauugcuguccuagccaaguacaucuaccacagacaugacccagccuugccacgucuggccauccagcugcugaaacgcuuggccacgguaggauccauggugcuggcucgagccgugaggauaagcuucccgcugcucuccagcuuguguguucgugcugcagugcagguguccacugagucuugaaaucugggauccccaaacuagaggugcaggagguuguaagcugccugauguacaggcuagggaucaaacgcacuuccuguaagagcaggaccugcucuuaucuucaagucggcucuccuacuccauuuucuuuuuagauuuacuuauguuuauguaucugcguguguuuauguaaguauguacaccaccugugugccugguacccagaggcuuagggagaaggucuugagucccauggaacucaguuacagguggcuguaagcuaccaugugggugcuggaaaacaaccagcacccacauguacaagaaaagcuggucuuguuuguuuguuuguuuguuuguuuggguuggguuuuugagacagucucauguccaagcugggcuaaaacucacagagaucugccugccucugccuccugaguucugggauuaaaggugugugccaccacuaagagcaaguauuauuuaacacugaguugucucuccagccccugcacuuuguacucugaacaucaaauuuuauauccuuccaucagucuaauagacauuuuuuacuuaauucagacaugagacacauuuaacaugugaguguccacaugugugugaacacacacaugaacaugggugaugaagccagagguugucagcagugggugucuuccucagucaugguccgucuuauucugugugacagucucauugcaucuggaacuugguuguuggcuacccuggcucaucagcaaauccacaguucucuggcuucugccucucagucugaggauuaguggcuggcucaucuagcuaaguggugcuaaggcucugaacucacaucuucaugucaguacaguaagcacuucacuggcugucucuccagcaccuacugucugcuggguuuuuguuuguuuguuuguuuguucuguaaauucuuucaccccagaaaauuaugucugaguuguuguuguauuuuacgucagugcccuucuacagaaccuccugaaguuuuucuggaccuagaacucuaaaccuguuuguccuggucuccagguggccccaaugucaguguaugcuugccugggcagugaugcagcggccauccgugaugccuuccugacccgccuucagagcaagauugaggacaugcgcaucaaagucaugauccuggaguuccugacaguggcgguagagacacagccaggucucaucgagcuguuucugaaucuggaggugaaggauggcagcaauggcuccaaggucagcugcacuuugggugaagcugggugagggcuuuggaagugcugucauggcccuugaauacccaccugucucugcuguaggaauucagccuugguguguggagcugucuccauguggugcuggagcugauugauucccagcagcaagaucgauacuggugcccaccucuguugcaucgugcagcuauugccuuccuucaugcccuguggcaagaccguagggacagugcaaugcuuguccucagaaccaaguauguccccucugggugcuagcucaugcaugagcuugacugaccuugucuauaaaauggaaguagguuuucugugcguuuaccagauuaugcauggaauacuuagcacgcaguucaguaccggggacuccuagaugucuuuuuuuuuuuuuucuauuuuuucucuuuauuuacuuauuggcuuuugggggcagggucucacuguggguuugggugcccuggagcauguuauauagaccugcagcauucugauucccaccugcagggauuaaaggcuuuaucaccacacccggcuaggguuuuuguguuuugauuuugguuuuggauuuuugagacaggguuucucuguguagcccuggcuguccuggaacucacucuguagaacucuguagaccaggcuggccucgaacucagaaauccaccugccucugccucccaagugcgggauuaaaggcgugagccaccacugcccggcuguuuugauuuuuuuaaaacuuauuuuauauucauuaguguuuugccuguauguacgucuguguguggcaucagaucucuuggaacuggaguuacaaacagauuaaccagaauuaacgugguugcugggaauugccucuggaagagcagccagugcucuuaacugcagaaccaucucuucagccccuuugauuucuuucuuuuuuuuuuuuuuuguuuuuuggagacaggguuucucuguguaguccuggcuggccucgaacucagaaauucuccugccuuugccuccgaagaagugcugggauuaaaggcgugcaccaccacgcccugcccgauuucauuuuuaaauagucaaaaaaauaaaggguuguuuuguuuuuuaagguuuuucugugguuuguaagcacaugucacccagcuauguauggccguagaacaacuucugugacuucuaugaugugggucccaggauuugaacucagaucaucaguguuggugguuggugccaacucuucucagcagccccaguuaaacuuuucuuuuuuucuuuuucuuuuaugugggaguggggugagcgcaggacugagaugguuucucuguguagccuuggcuguccugaaacucgcucuauagaccagacuggccucuggcucugccucuggaaugcugggauuaaaggcuugggcaacuacugccugucucccaguugcacuucugaaguggaagacacaguuuuauuuauggacuucuuauguuuauauaagaauaauugauuuaugagaaacauuuuagguuuaggacauuaaaguaugacaaaauaccagcaagggggacuagagauaugggggcuguaggaacggaaaaucggcauuucaacacauguuuucauccuagacccaaguuuugggagaauuuaacaaguccgcuguuuggaacucucucuccuccuucagagacaucugaggugagcuauguagaggguagagcagaggcuaggguaccugagcagaaggguuggucuguggcuucgagaaaaggacccucccuuaagucacaugcagaaggcuucacauccagcccaucuccagagcaguuccugcuuccuguccuggggggggggggggggggcagagagacagaguugcucuggguggaaagcucuggcaucuccacauugugggcauggcaccuguccauuggcauuggccuuuuguguucuauaaagguguguuuucuuguuuucuaaguguuaggcccuugcugucagcagggguggguguggaggguuuucuccauguaauuaaguguguuuugcucucccuuccacagcccaguguccuggaaaccugugcccugaucaugaagauaauauguuuggagauauacuauguaguuaagugagucuucccccuucaguggauuuguuacugugauuguguaguacuggggguugaacuccagguauuuugcuugcugaacaagugcuccaccaaugagccaugucucuagcacucuucccaaagauauggggugggagaugguggagcccuaucauugaaugcaugguugauaaucauggcgcgcaggagggauggucggucagugaacuguuccugacuggugcacugauggcguuuauguugucagaagagugguaaggcuuuucugaaaggccucagucucacuuguuccuuugggcugauucuagagcuggcugcugcgugcucaucacagcugcagauacuucugaauccugauucggguuuguauuuuguauaggggcucguuagaccagucauuaaaagauacacucaagaaguucuccagugagaaacgcuuugccuacuggucaggguacgucaagucuuuggcaguuuacauggcugacacagagggcagcaguugcacgucccugcuagaguaucagaugcuggucuccgccuggaggauacuucucaucauugcugccagucacguaagcgccucgugggcaccggguuuuugcuuuagucggaagcagugaugugugagcugcguagcacaugcaguuccuugggauaaagaaguucagaguuugacccugaaaugcagacguucuaugccaagagaugaggauggacagguacuuguggacaggacagagaagcaauuccaaacccaccagauauccugaagacuucccugcuguugggccuggauaggucuagggaauaccucuuaguaaggagugguguuugccucuggggcugugccuucuggacacuguaggugucugggauucaucugcagcugcagcagccccagaucucuuagagugcuguguguuuucauugguucuaggaaaaggacggaggccacugugucuucacuguauagugaguuuuuaaauuuuuuacuuauuauuaguauaugcacaugugugaggaggucagagacaaauguguggggucaguuccaccuuuaugugaacucgggcucaguucaucaggcucgugcagcaagggucuuccccccagacacauguuaaagagaguguuggucuuuuggaaaguuggcaccguggguggcauuuuucaguguggcacuguaguguuucauuauagcacaugguguugaacugucuuccucagggccucuggaccauggcuuaauuacaguugaaccuuggcaugugccuccuuguuccaaaaaccuugccaucugucugacuuguucuucaguacagacugccuauagaccccugagucuccagaccuacuacuguaagacuugccucccugauagggucauguccauguugcugccuuuuagaacccagcaauagccuggugagguggacaugccugaaucccggcaauuacuguacacaggcaggugcaucucuuaaguuugaggcuagccuggucuauggagugaauucaggacaacuagagauacacagugagacccuuccagggguugcggggugaggggagccaggaauccaaccauacagccguucuuacauuguaccucugucgucuuggaaacugaccugaugaacuuuaauucccacucucucccucccauggcuacuaaaauauuuguucugcaccugcaggcaccagagguauuauagcugggcuucagcugcuucuccaccccuuuuccucuacccuuccaacccugcagugcuagaugggagauaaaaaggauagggaggaaaggaaagagaucccugaggaaaguccaaguuuggauggaggcagcgugaucgguagaccacuuccugcugaugagaggcauagagauccuaggggcaaguuugaucuucgccaucagaauaucugauuucuuuuuguuguuguuucuucuuugcucacaacuaccuaacaaaccaaccaccaacccaccugugggcgcuagcauuuauacaaccucacccucuggccauugcccaggauuccauaugucacacaacugcagaaauucucugcagcuggcagucacacccugccagaccacaaggcaaaucaaagucagcugcuguggacggucugaagcagcccugugucccacaccugggauuaaacugaaagcacauuauuaaauauuucugugauuuguguuuuuuuguuuuguuuuuuucgagacaggguuucucuguguagcccuggcugcccuggaacucacucuguagaccaggcuggccuagaacucagaaauccaccugccucugccucccaagugcugggauuaaagacgugcaccaccacugcccagcaauuucuguguuuuuuuaaagaaaucaaaacucuagaauuaucacuacaggauauagcaaugaauaagcagggaaggccuggucacaaagugaggacagcgcaagaaagaugacccauagaacccgcuaacugugcuccuagagccucacagagacucucugacuugcuuggcuuguacagccuaauuuugaggguuuguucuuagucuuacaguaacucauucugauggguuaacuugauaucccugggagguccauucuuuucuuuuuuaauggaaauguaggaaggggacugggaggagugaagggaggggaaacugcuguuugacucaaagugucagagaagggguggggaggcugggagggguguuaacugugguggcagaggcagcuggaucuuugaguuugaggccuagccuggucuacaaagucaguuacuagacagccaggcuacacagagacacuguguauugagagaggggugggggcagauaagggcuugaggucaguuguaaacucgcagaugaaacuguaaggggguuguacuugaugauaauggcaaggacgaugaugugauagcuaacacaugacauaagaguagccaugguggccucugagaaguaaugccagacaccugaguauguaagaugccuugggcagagagcaugucggcaugaagucuaggcagaugagacugcaggcguugagugcaggagaaagcacuugguauguucagagccaucgaugagugggugugguuauuagcacaugcuaacagggaagcuggagcacagaggaccauggguuagccacagccugcauaacaacauggugagaccacuuucaaagaaacgaaaaggaggagguuguagggagggcugggcuagagggagcccagguggggcugaagguccuacagcaggugaccuucuugucccugggaagccugagcagaaugcggagcacaggaaggauggauggaguuccgauugggaauggccucaugaagcccuucacuucuugguucuuaaagucugucuugagcauaauccuucucccgcccauugcaggcagacgucaugcacuugacugacauggcagugcggcgccagcuguuucuugaugugcuugaugggaccaaagcauuaguaaguaugcccgggaguuccccuuuccugaaggucacacagggagcucucagugcucaaagggcggucagucagugcucagguggccuggaggugaggcucagugauaaagaggugccccagcuccuugcuccugggagaagucaggguuaggugaggagggccugugugucuaucugugcaguggaggcugcuucuaagcagccagacuccugacugcucugccgcuccuccccucagcuccuuguggcagcaucugugaacugccuccggcugggcuccaugaugugcacccugcugcuuauccuccuacgccaguggaagaggugagugcugggacgagagcuggccgcccgaggcuccaucugccucagcacugccugcccacccuuccucacccagaccgucuaguauacuucacagaaaauggagcaacucggcagacaagccugcagugagggagacugccuguggcuucugaggggcacuggggacacugagugaggcaugcugcugccuuggucuuucagagagcugggugcuguggagaaaauccuugggcccuugacagagauccuggaaggggugcuucaggcagaccagcagcucauggaaaagaccaaggccaagguguucucugcauucaucacaguguuacagaugaaggagcugcgaggugagccccagcuccaacugggccgugggauuuuuacaccgggagugcuuuauuucccacuaccccuuccccuuccucuugguacucuacugccuuucgucagaauggcccaccugugugacagcacccucucaucuguucugcagucggugauaucccccaguacucccagcuggugcugaacgucugugagacucuccaagaagaggugauugcacucuuugaucagacccgccacagccuggcauccgacagcgcugccgaggacaaggacagcauggagacagaugacugcccucggccccggcacaaggaccagcgugauggggugaggggacaucagcaggcugucugacagcacacaggcuguacucaaggcugccaccacccugggggaggacgggaaggugggagccugugggcgcaggcuuugagggaagcccugggagaggcauggcucucagccauuucagcagagcuagucaggcaggcaucgugugccgggaagaucggguggaccguggaaggugugagcagcuucaggucagcaucugcuguguucugaucccugguuggugugagcagagugagggcaggggugggcuagagaggguugcuuuauagggcaggcaugggcucuuuaaccuaagggcucacucuagaagagauaauggauacacuauagaacagucuuuucucuggugagggcaggacuuaagacaggguuucucuguguaacagcccuggcuguccuuuguagaccaggcugacuuaaaaccuauagagaucugcugcccucuugccucugccucuguuuccuccacccaaaagcugggauuaaaggcaugcucuacuaugccugacuagagcaauguuuucuacuaccagccuuuuccuuuuuauuuauuuuuuauuuauuuauuuuuuuuuagagguaguccuacuuuguagcccaggcuagccucuaacuuccugccuauucuaaaaagaauuucggguauguuuuguaugaugugaaagcaaguacuauuagugggaaacaauaaguacguuuaugcuggggcauagucuuauuaagugucuugguaugaauuguagucacauagaagugcauauugucuuccucugucggucucuacuaacuccucugaaguagagucucuuccugaaccuggggcucauggcuucucaggcacacuaggaccuaguaagucuacugauucucagcaugccucagaccugggaauacaggcauacguagaucugccuuguuauguggguacuagcaccaaaguccaguccucgggcuuaauguuuauguaucuaaguguuuugugugugugugugugugugugugugugugugugugugugugugugugugcaugccuggugccuccagaggccaaaagagggcaauuagaugcccuggaacuagaguuagagauaaguuuugaacccuuuuuaaaguaaggaaaggaauuuuuaguugauaugggucaaaauguauccuauaaaaagacauuccuguguuuuaucgguaauuuaguguuuugauaugugucaugggacgguuuuuucugguccugucuauuugcuguucaaaauuccaccuauagcuguguuacuguugguaauuguggcugcugagaaaggggguggcuucuuuuagggugugaccccugcccaguugacugagcuccagaggagcagcacaauuggacucaaggugguccuugcugauagcuuuuguuuuguuuuagacagggucucacuguguaacccuggcuggucugggaugcacuuuuguugaccagguuggccucaaacagaaaucugacuugccucugccucucgagugcuggguaagguguguauuaccaugccuggugauuaagaaagaaaguuggcuggguagagagauggaagguggguuugagagaaguugaugggauaaauauaaucaaaauacauuauaugaaaaucucaaauaauaaaauuauuuuuuaaauguaaguguauaauaggccgugaugucgcauaccuuuaaucccagcauucaggaggcacaggcagauggaucuuugaguuugaggccagccuggccuacacagugaguucuggacagugagggauacacugucucucgaaaaacaaacaaaaggguauaaaacacugguguuugaauagagccugagguugcagauggaggaagaugcugugguuagcaaaaggucaggccacucagaaugccagugguaguagagugguguggagagaagggcacagauguacagggcaagaagcaggaauggccccagacacacuugugagaggaucccugggcagcgaggccagcaccagcccucugccucuuccuucccgcaacugccuuuuccaccuuuccccugacugccagcagguguguguccugggacugcaucuggcuaaggagcucugugagguggaugaggauggggacucaugguugcaggugacccgaaggcuccccauucugcccacgcugcucaccacgcuggaggugagccuccgcaugaagcagaaccugcauuuuacugaggcugcgcugcaccugcuccucacccuggcucgaacccagcaaguaagacgcccugcuugugccgaaugguucccuuguaaaccagaguuugacucggaucucuuccugcccugggcaaaucuuugugggcuccaucuaauuauggguuuuuccucuagggagccacagcaguggcuggagcuggcaucacccagagcaucuguuugccccucuugaguguauaccagcuuagcagcaauggcacaggacaggugagugcccacgacccugcgucuuguccuucucaggugcccaccuugcugcucuucucucauguuauauaucuaucagaguucccuggggguguucccucauguuauauaucugaguucccugggagcguuuagcuuccugcccuugacacagggcuaaugagagggaugcagcugccagaaagcacuuagugugugcuuagcauggaccuggcuguagucugauccaaacaacauaaaugccaccagggccagguuauuagccuagacaguaucaaccccucagcaucgugucucucucuuccccccaaguccugagggccagcagguaugucuuagucuggcgucaccgucagaaccccucucauuggaaucuuuaugccuguuuagucuucuucaucuagccaggccucccuugauuuacagggaccauguuaagggccagagaagggcagggauacagccaagcagacaugucuggguaguggcagaccagauuugaaaccuuaugcucuucuugcugagucugauagccuugccucuccuagcucuccucauaccuagugacaacuguccacuugaagagacuuuucuuuccagcaacugggccacaaggaggcucuacugcuuugaguggguuccuguggcaucaauccugagucuguugccauuugucauagacaccuagcaccucucgaaagucccuggaugccccauccuggccaggagucuaccgccuguccauguccuuaauggagcgauugcucaagacucuacgcuacaauuuccugacggaggcucuagacuuuguggguguccaucaagaacggaccuugcaggugagaggcuaccuacgucauagaagggaauauucaaagccacuuagcauguggcuguaggacuugggguaucaaugcccucgucuuugagcaagagggcaugucccccucccucccuuccccucucuuguguucauggccggccucuacuucucuacucucucccucucucugccuuaaucugccucuacuacccucuuacucccccccuugcccuaaauaaacuauucuauaucaaaaagaaagaaagaucccagcacuugggaggcagaggcaggcggauuucugaguucuaggccagccuggucuacagagugaguuccaggacagccagggcuacacagagaaacccugucuuaaaaaaccaaaagagagagacagggaaagacagacagacagacagacuggcuggcuggcuggcuggcuggcuagcuagcuagagauauggcucgcaguuaagagcaguggccguucuuugagagguccugaguucaugcaaccacaugguggcucacaaccaucuguaauggaauccgaugcccucuucugaugugucugcagacagcuacaguguacucacauaaaauaaauaaaucuuuaaaaaacaaaacaaaaaaagaaaucugacuugagucaccugaccaaggggaagccuucauuauguuauuuuuagauugauuuauuuuguauaugugacuauacuacacuguagcuguguucagacacaccagaagagggcaucagaucccauuacagaugguugugagccaccaugugguugcugggaauugaacucgggaccccuggccagugcucucuccagccccaagaagccuucauuguaaugccagccaccuaagcaugugugggcccaggaccuaaccucauagguagguagacauggugugcagaucccugagcauccccuacgguccuguccgcagugucucaaugccgugaagacagugcagagucuagccugccuggaggaagcagaucacaccgugggcuucauccuacaacugucccacuucaggaaggaguggcacuuccaucugccucagcucaugcgugauguucaggugggccucggacauugcuucuuugagggucugaagaaaucagaccugggcagggagucagugggucuccucggugaacuggaggcgucucugaaugugggcuucuugcuuggggcacagguuugacucaggcugcuuacucaggcuagcucuucccuccauagugaagugagacuggaugaguugagaacuugggcucuuugagguagacuuagguucaaaacccucaggagaaggccuaaagcuggaggagcccacaggcuugagaggcaguaggcuguggccauggcuacucucucuaugaccuuggccagucacaucaacucucuccuccuucaguggacauaguaguaaucccaucuugcugaugucugaggccuguacgaugccagcagugcagggaaauguucuaggccugaguccugcugguuggcuguugcguuagagcaucagucagugggaggugaggcaugcuggguccugggggaagauuuguuuauagggcugccuccaugaguuuuuccugucccuccugugucccaggugaaccuggguuacuugugccaggccuguaccucccuccugcacagccgcaagaugcugcagcacuaccuacagguaaugaaagccccuagcccgucaccgcuggcagugccacccuugaucuccuaugacucacccuucauuucuugacucuccucagaacaaaaauggugauggccucccuucagcugucacuccccgagcucagcggccauccaccaccaccaccaccaccaccaccaccaccgcucuggcuaccccagcuggcugcuccuccaagcagccuacugcugacacugaggccucagaacagcgagccuuacacacaguccaguaugggcuucucaagauucucagcaggacccuggcagcccugcgccacuucacuccggaugucugccagauccuguuggaccagguacuaguugccaccucaaaacuaaggcuagguucccacaauaagccuugaaccugggcucugcaguauacuguacugugcuuuggagaacucccagcgaguuccagagugcuggcuuuuuugucuuucagucccuggaucuugcugaguacaacuuccucuuugcccuaaguuuuaccacucccaccuuugacucugaaguggcucccuccuucggaacccucuuggccacagugaacguggcccucaacaugcuuggagagguaagcuggugagguggcccccccacauaacuucccacuuguuuuagaaauauagaacauauccagccccuggagccuaggccucuuccuacaggggcaugcuaggaguucccaccgaguacccugugagguaccagggaaguugggaugcaagaccuccaacuagaagcucuaacuggccacucuuacugcuaacuugauuuuuauauugcuuccuauagcuggacaagaaaaaggaaucccucacccaggcugugggacucagcacacaagcagaagggacccgaacauuaaaguaaggccugaggcuugccgccuggagcagcuaugggcugcuguucucccaucugcggcucagcugugucugucaaauacuuuugcgauauugcccauaccugccucuccaggucccuccugauguucaccauggagaacugcuucuaccugcucaucucccaagcaguacgcuaccucagggacccggcugugcacccccgggacaagcagcggaugaagcaggagcugagcucggagcugguauggaugcugggcuggccagcagggaacgcuguuuggaugcugccgguuuugucauuugggucaggaauaguggcccuggaccucauuaaucugcugcuuuucuugcagagcacguugcuuuccagccucucacgauacuucagaaggggggcccccagcuccccugcugcuggaguccugcccucaccacagggcaaggccaccucucucuccaaagccagcccagaaucucaggagccucugauccaacuugugcaagccuuuguccggcacgugcagagauagggcgccgacugcugucuaccugcugcuccuaccaaccugcacugcagccuggguagagggcgcugccaccacaaggccagccacugagcaggcagcucccuucgucguccuccugcccacccgcugacauuauuuuuauauagcuaaagaggucaacagcacgggcagggagccaaggggcugggugcucagacucuuaacaauaucccaagguggccccuuuccuccgagcauucccauggcacuucaccagccagggaggcccugggugcuggcagcacaggagaguccuguguguagugaggguuuuccaugaucuauucuugcaguuuuuuugguaauaccguggucuauuuauacaaauauuaaaagugcuguuuauagagccu

SEQ ID NO: 740 - RNA, 8276 nt, Mus musculus
cgcgaguccccgcucucugauucgccgcacgggccagccucacgaccugcacacugaauggcugcgccacuaccugcaaucggccucggauugggugcguggcgucuccccggcgugauaggucaggaccaccgccccccuugcuccccauuggcugcucugcgaagcccggucuccggguaagauggcagcggacggacagugcucgcuccccgcuucauggcggccagugacccucacccacgucgaauacccugcagguaagagccugccccggcuccgaggacguucuccucgagcugccgccacagccccgggcguuccgggccgcgcggaccgccuucggggcgccuuggaaccgcggugggaacugucaaacagcgagccuuggaggggcucggccggcgcgcgcgccgcgcaggcgcagugaggcggcgaugagcagggagaaauugcgagcggcucgcucgugugcucugcggcugcgcggccgagucgcucuccggggucccggggugcuggugggcuguccugggccgggggagggucuggauagggcgggcgaggaucugggccuggacuuugucccuugugccccgcccucccccgagccagagaggccgcacuccugcucggcugugcagggagugacaguuuccuucacuacgcugcgggcugcucacuggagaaagcucccaguugcagggagugugcaaacccaggccagguuugggagaauuugcggcgccacgcccugagcagcgcggcagaggccagccgccaagggggcaugcagccccugggagccugacuuguaagagcuuccaucugacacgccucugggagugcccgccucucuggugggaagguccauuagccaugguucugaaguuccggcucggcuccauagaguggagcggagcggagcuuaggccuuggggugagacguuuccgggcuccaggguaggcaccaccccuccagucacuucaucuuaaguggcuccaaguacagugucuccuuucuguaauggugugugacucaaaugaccacaggccuaagaggugcugggcacagagccuggcccacaguggacacccaguaaauaccuguaguuuaucucucuagcuugccagcacccucccuggauaaauguuuguugcugagcagccggggcccccuugcuggccucugguuguccaggaagggccuguccucuuggguagagggccugagaacuugggucugcugagaacacagggccacaggccaggagaacuuugccucuggguguucuggguuauacuuaagguguggcaguccagggaugggcccuaucaaagugccuguucauuacccaaccacccauccauccauucauucugcauucccuuagcauagcaucucccgggugcaaggcccugggccagcucgggguuuggaaugaugaagucccugcacucuuguucuauggaaagucucugccccugaggagggaaaacaggccuggugaaggggagagaccugacuggggucuccacagcuucccgacucuccguccuuggcgucagaguagcuucuuggagggcucauggccuuucaggugagaagagccugcagcugugaacaccauaacacauacaaggcugugugugcugugggggcugguugagcccgaggauaucuggcaagguaccccugcacuugaugucgcucacuacacugaacaugcuuccuucaugccugaguccuguggcguguccuacauugcuacacucaagacaguagguuauggagaccuugucacuacccuaaaguacagagggcaaagagaggccccacacagcuacuuacacuagccagugggucaccaugucccagucacacaucucagcaggcucucacccuugugauuguggcugugcugccucuuagcuuuuguuuuuugaguucaccuaggcagcauccuaggugggggaagccacguguguauguauggguccagaaguaggacagcacaguguguucagggagcugcaguaaugucccugcaacuggagcagagggugggagggaagugggccaggucugcacagacucuaguaagcaggccuaaggaagcauaucccaagggcaggggagguguggggcauagagagagcugugguuagaagcccuggccucaggaaagccugagggucuuaucugcuguaagacaaccugaggaauuggucagagguuuagggacccuagcugcuguucccuguucccauagcccagcaguuaucaguugaacugugacagaguccggaucucagggaugggaaggcauggauucagagaagggcacucaugcaaaguuacuuagaaggaugugugugugugugugugugugugugugugugugugugugugugugugagaaucaacauuugaaccuagguuucuggccaacucuuaagucagucuuuccugauaaggccagauaaaguauauaugaaucugucccuuaaggcuuggaaucugcucucuacccucaguuggguguaugccugcuuguguaaagccagacugcugguguaggccauuucccauacuggguucacccagucucugaucaccacuguacgaguggccugugugccagagaccuuugccaggcauuugccaucacuccuacacaguucuggagaagauacaucccaaaggaaagguuggggagguuuagggaggcagacuugccuuaguuccugcaagcaacucaagcugcuacgggaagugaaugauggcaccuggccuuagaguagcuuuuuagucugucacguuguuucaguggugagaguggccuuuggaugcagccuugccuguccaaagacauaccucugaucuuagccucuggcucuccgagaggccagugguccucacuggcuccguccaggcuuuggcaggagaggaagcacagugccuugccuguggagaagcuuugagaaacugcuggcuguuguggguggccccgcuagagucuccagugucccucuaucuccggugucugggagagcacaggcuucaccagaggccccagccccacgcuagaccagaccuugggguucaggcuuccccucugacagagugaugcauccagccaggucccaugucucucugauuguguaacuugaacaagucacauagccaugcugagacucacuuccuucuguaaaauggggacagacaccuucuugaaauucaugguguguggaucccuuauagcuguggggaguuggaauguccauggcuguggcccugagcucuaggacuuccccuuuuguuuaagcccuguugacuuucaaggggcugagagcccuuuucugaccccaugcccugucucacgcuguuccucuguccccacaggugaucugucuggccaccuccuggccuaccugagccucagcccuauuuuugucguuguugguuuuuugacucucaucauauucaagcgggagcuacacacggugagcuuuggccccagcuguuagccagaacccucuuuuggccuauggugccuucgccugcaaagccuguagggaucuccuggcugggcccagguccuucacuuacuggccugcgcugugcauugagagaccacaguucccggcacuggguggcagggacuggguggaagccagcagguaugcagaggcccagcugagugccugucuuugccagcagauuucauuccuugggggacuggcacugaaucagggcgucaacuggcugaucaaacacgucauccaggagccucggcccuguggagguagggcugggacuuuggggauccagaucaucauguuggacacugaggaagccuguaucugccaugaugcccuguuuguuuucucccccaggcccacauacagcagugggcacuaaguacgggaugcccuccagccauucccaguucaugugguucuucuccgucuacuccuuccucuuccuguauuuaaggugagagccuacccguaccccugcugugugcucugcugugugcucugcugugugcucugcugugugccugugcucugcuggggacugcugcacuaaggcuuuugaaugggaccaggggcuguugggaggccugguuacagguugugggcggaggcugucugaugggccucuuuucccagaaugcaccaaacaaauaacgccagguucuuggacuugcuguggaggcacgugcugucucuagggcuccucaccgcggccuuucucgucuccuauagcagguauggagggaggaggagccccacccugcagccugccuaccuggguccuguuaggucauggucucuuuugaacagccucuguggaccugggcccagacacuguagguuaugacuggaaaaagaacccagucucuaauuuuaacagacagggcuccaacugcccuucccaauguagcagauaagcagugauuuuaacaguagcuucuugcauuaggcauuuguucccagcuuucugggguggggaguggaguggggagugggggcuaugcagacaagcucugguuuaagagcuggacagaaaggagcagauguggaggugggcuuguuucugcaugccugcugcccuuuggacgugcccauucuaucuguguguaucuucacaccuauacccaggauccugaggaaccuguuaggaacgucaggcaugggguauuauguaggccucaccugguuggcucucauguauuuccucucuggccuuggcccagggucuaccugcuguaccacaccuggagccagguguuuuaugggggcguggcuggaagccucauggccgucgccugguucaucaucacgcaggaaauccucacuccguuguuccccaggauagcagccugguaaccacuuccccgucccagcuccgcaucccugccccuccugcacuuauaucuggagagcuuugugucguggauggcacaaggcuuagaacccacugcccuggcuaccaccucccccaggggcuuaugggucccccagguucagcagucacagugccguguucuguccuugucucggcacuuaagagacuuagagggcagccaaaguuuguggagcuguggaggaggcuguggggcuccaggaacuguugggacgucuagcuugguggucugcucacaccuucacugcggcccugguucuuggguaucugucucuccaggcccaucuccgaguuuuuccucauccgggacacgagccucauucccaaugugcucugguuugaguacacaguaaccagggcagaagccaggugaguuacggggacagcagucaucacuguccacuccccaccccgugggaaggcuccucagaagcuagacuugcuucuguuucucacacugacguauguugugcucccauuuuuucagguggguaagcugaggcucagagagaaggcagcugcuugagcuccgucuguuagugggggagggagcaggugggaagcugcuggcccaguauguacacuuuuaccucuaaagcccugggccucaggggucuucagggccaugaguguggccauccucagcucuaaucagcuuucuguuagguggguaagcugaggcccacugagcugggggccagcuugaagcggaguacaagcuggggcaaagcuggacuuuggugucuccugauuuacacucuucuacuuaacuucucccagucuggcauggaguaccucagagcuggggacacccagcuucucccuaggucugaggggagcugaggcaggucagguacccgaggaagccugggaggguauugggagacaucgggaaggguagagcgggguggguguccagcagcuaagcaauguguuaguuaguacgucaagguccacauuauccuaaugagcuuaaggguaagucuggcccccugaggaaaggggauuugaggguuagggcaaagcaaucccauuaguggcagaaaggccccaucagcucuccaccuggcucccaggguggccagcacugucucgcccuguucagccagcugccaccgccuucauucucccccuggcaccuguuccgggucaggcugugugcagaggcugagcgcagagacagacagccacgcucucaccuuccugguguucacagcagcagggaccaugagaaggaagggccagcaacaugauccauguuagcgagcaaagcucagagguuuagagagugacaggagcucaaaguagagcaggacagucucccgaccucccaggaagacacaggccacagccacagggaugguagaggcaucucaggcgaggaacagcaugcacgaucuuuugagacagacagauuagugugugaaagccaggggagcaaguuggagggcugagggccaucacaccaggauccugugagccauguuagcuuucuaguucuccagguaccucacccaagcacuguucugagccucagcuagcccuccagagaacagcagagguuuugcuuccagccugggaaccccucacugcaccuuccucugcuugcguccuacaggaagagcauaccgccuuccuguagcugcuuugguaguagguaguagcagaaccaccuugggcugacuuguccacaauuagucaggcccggccaaggaccacugaccuuucuugucuugcccauccccuggcucacuuccugagcuugaaaccuaggucaucgugauacagcccagacaaaugcucuucagguuccagucauggcagcggcucugauuggcccggcucuggccccggguggcugugguuugguguugagacuaagcagggagcugugggacugacuggccacucaguaccagacaucccccgaucuaagccagccccauuuugcaggaacagacagcgcaaacuuggaacaaaacugcagugacugguggguguggcugcgucuagccuccgaaucuggccugcaccaugccuugcaggauggacagaaugauggauggaggggugaagcagagaccucuacagaccagagucaccaaguggagccuuuuuuuuucuuauuuuaauuucaauggacacgguggaccaaagugcugagucagguccucagccaggacccugggagggccugcugugugugggucacauggccagagcccaucucugcugcugccagcuccuggcuggguggaaagugcucuuggcacgggccucagcgugcguguagagcguguguaccucugguccugagaucaggaagugcagguagcggaaugcgcacuauuuauucuuuugggauuguggaguucaugcugaagaggccacucugcagcagcugcccuguguacacagggcccagguuagcucccagacccugugcucugagccucaggcaguacagccugccuccugcugggccugagcagggccuagggcccagggcccaggagcgaggccuccccugcugucccugccaccaucgccauuccagaacccuugucaguguuuccucgucuggggcagggcccagagucagcaccuguuuauccgucugucggcugggcugcuggcuuguguucuucccucuaccaacccgacaucacaagggcuuucuccgguccucuaucccuuccugacaaaagagccugcacauacgggugagcacacccaagcguuuacagcuccuuuugucuggccaucggguagcagucugucuucauccccacuugaacaaaagagaggaagcaggagcugggaugcuggcuguguggcagugcagacacccucccccaucgccugcccaugugcucuggauuugucccuguccuuccuggccuguccuggaggcuggaaaccagugcagguugauccuggggucugccugggagugggcucugaucccagcugccaggagucccuuuuaagggacucucuccagguuguccugccacagcuguggagaugcuuccagaacugaagcagccccugggggagcuguugagcccucccccguuucucccuggaggucccuaaccugcugcugaagcacaaguuuuuggugcuuuccuuuguguuuguuaaaggccguguccaagccccucagaugccagggccagggcugguuucuagggagguaggucagucacauccauccccccucccccguaggauuuuuauuuuuuacuuuuugccugagacaagccaagugugaggugguuuaagaaaucaaaugaaauuguuuacuauuguuuuaaaauaaaaucugaaacucugg

SEQ ID NO: 741 - RNA, 17190 nt, Mus musculus
aggaccggaagccgagaauuacagucacucgcgcgaaggcggcagccaugccggugcgaggcacucagggagcaugcccaccaacggccgucucgcggcggccgcgccgaccgaggcagcggccaucuuggugcggggcgccgaggagcaugcgcacuaacggcugccgccugcaagccaacugcggcgcuggcagccauguuugugcggggcgucggguucuguuugcuuguuuguuuguuuguuuguuuguuuuggugaggggugauggagggaauagguauggcagcaguauucuugcggagcaaggccaccugucaucuucuuugugcaugccuccacccaagcaaucugagacaguccccagucaacaguuguguucuccugccauuccuagagugacguucaaggacaccagucagacuugaacgcacgugaccgccucgacagcuaagguggcuuucggaggcggagagcacgagcgggacagcgccuaccguugugaccccgugacgggagcccagcgccgggcugcuaacagcugagcuagagguccgucuccgcaagccccgcccucugcggccacuccccggcuugggcccaccccgagaucggggcgagcggccggggacugcgagccaccaaagcuccgccccgugaguccugccccaccggcagcccgccgggcccgguggccgcggggccgccucuacuggcuagcggcagugacucggcgaccuugaaccuagaaccggagccgcgaacccacugaccccagcaccccagcaguggcgcagucuuuacccagcgcgaggggcggagcggaccaaguguccgcaaacagacugggacgauguuagccuuugcugccagaaccguggugaguucgcccagcagggccauggacgggacaagacgggcgggccuccagcaacggucaagaaaaccccagaccggcugguagggugcgaucugcaagguggauaaaggagaccagguaagggguggguucgaucccagaagaagacugagaaaccuagguucaagucuuuuguaccuuuccacuccacuccucccuaaugcucccaguuauucggacucagacaccugucggggcuacugguuagagagcucagcccuaggcuaugcuucugcccgacuagagccacuucuccaagccuacccagucuccuugaguucaucagaugcccacccuccccauugcauauugcuaagagaaccucagguggagacuaguacugaaaaucccccaaacaggcaggaggaggcaggagguggcaggcugccccucaccauccuuaucuaaagcagcuauccuaauggugagcuccuguccucucugauucaggcugucuauccagcugugaacuggacugcccugucagacacuggguuggcagcuaagacugagauucuacuaagaguccuggcagcaccugagacccuccuccaagucgucccgccuuccgucacccucugggaccaccuuacugcauaagcauuuuaaugcuagggagacugaaacaaggagacaaucaaaucccaugguugugcuaauaaacugagcccaaauggggucuuuuggcuuauuacucacagcagaagcacaaaaguguauuucccccacuauugaucccaaccuggaugauccagaacucauuuagaaaaaacaaacaaaccaccaaaagagggguggccaccaaggcccugaggucuggaagggaaacagcugggcagguguguggcaaucguugguuguccacuaguggcccuucccuggcaucuccugucuugcaccauucccaagcagggcugauuucagggccacagguuagcggccagccuguuuccacccuccagccaaguuuucccacaucaaaaagaucuaugaagauuuugacagguggauuuuuuaauaccucucuuggcuugccucccuggcacugggcccaucuaaagaagacaggagagagcucccagucuccucuuaccucaguaccuacuuccagcccacuuaccugccuuacuccuccucuucuggaggcuagcgagaggcagagcggcaucugcagccccacagcuaccacugcuccagccuuagaugcuaccacgccaguggcuacugccucaccacccuucacgccugaauugugagucuugucuucucuuuccaguccaggcagguggccgcucuugcuaguuucugcucauccaauugguagcacaguuaggcuuagagguccagcccaggcagacagacagggcucacauccucaguccugccauggaggacgagcagcagagagagaagguauggaauggcgcuacugccgcuugccugccacugugccagcagccugggcccuuccugucuugcuuucugccaccuccagagucuccgggacucccucuuccugccucucucugccaccucucauccuccaugccaggccacucagcgcucuugcugcagcacuacccacgccccucaccaccgccccacaguggagagaaagcacagaggcugaagccucccccagaggugcugucaccagcuuacccauuuccaguucucuccgauuucuuaagcuggaagcggggggggggggggugagacaugggggggcuucgcuuaaagagucagcugccaucucucucgugcguccugacaggugggagguccccuuaccucugccaccccaauaaugugacucaucuacacccccacccuuuccuagccuuccugcauauauaggccccugagagacgguacuccuguaccuugagggcugggcaucuagggcaggccccacccaugaagcugucuuugccuccaggggauggcauauaaggccuaggaguguaguuuagaaagagcugugcuucagucugagagaaugaguaggcuguucugcaucccacagguaaaaccccugggccuccucaagcccuccuccuugaugaagguuucuggucgcuucaaggcccaccaagaugcacugccaaggcugccugugcccccacuucagcaaucccuggacuauuaccucaaggcacugcagcccaucgugagugaggaagaaugggcucacaccaagcaacugguggaugaguuucagaccucagggggcguaggggaacgccuacagaagggacuggagcgcagggccaagaaaauggagaacuggguaagugagguggcagcagccugacaguugccugggggccgugggucccccagagcugauacuuaguuaggggcauggggagaaggcugggaaccaggguggugcaucagcaggugaggucaugcucagcagaagaauuacauggacauuuuugaaaaggagcuacuggcugggacugggccucugagguagaacuuuugccuagcauguaugagacucuggguuccacucucagggcugaggggaaaggcagagcuaugaauggcagugucugucagaggaagggcagaggaaaagggagccgcaauauggccugcuuugggauagcgccugggcuggaggguguucagagcaggacgggcagucagggaaggagugcagacuuaagcuuggugggacagccugagguugcugaccauguuccuggcucugggucuaaucaguuaaauuuguucaauuuauaaaacauaucuacacuggcacaugguacacauuucuguauucauauuauacauaaagauuaaggggggaagagagcccaagcugcagggcaggagccaggggcagugaugaggcugaggccuucaccuggaggggaguguggugccuaggccuggcacaaggagacagggagucaugagguccaaugcuguuuggaagacagccaauggcacuugcuaauacagugggacugaggggugggagcccccuuuuuaaagcaacugggaagaagguuaccaauaugaagcucaagaaagcuggcuauaggggacagcugggugaaaaagucacccucaguguccauggccccacagauaccaagagcuacagagucaagucccuuagggaguucaguauuucagucucgucuaaauaccuguucccauggacccuaagucaacuccagaugaugaaguuuuaaccgcuuaauugauggguaaaugcauaugcuuauauguauaguuugagagaucauuaucaaaaagugaaaauaaaagccuaugcacucaguaugaaugcagguuucuguuuuucaaauauucuccaaaugagcuggugggaucaguagacacagacucugcaucuccaucugagcuggugggaucaguagacacagacucugcagggacagagcugugggucugggccgacuacagugggaaacgggaaguucccgggguugauggaccucaguggagucuggagccacaggugggaaguaggaacuaggugggacuuauuagggacaagcauuugccaagccuuagcagcucagggccuuugacuauggaagucagaaugcuggccuuaaaaggaucuuagaagccaggcgugguggcacaugccuuuaaucccagcacuugggaggcagaggcagguggauuucugaguucaaggccagucuggucuacaaagugaguucuaggacauccagggcuauacagagaaacccugucuuaaaaaaacaaaaacagaagaaaaaaaaagaccuuagagauucuagggucuaguggcuuucugacuucauugagccaaggacucuuugaagccaaaggcucugacuagaguuggggucaucacaggacccuugaagcauugcugucucuggcaggaggcaccuucuccccuugucuaaacuguagccugcaaucccuguaggugugaaggcgccuguaugagagggcacccuugucuguccgcuuccuaccacugaagaagcugagaccuagagagguggaccaaagccuacauccucacaguagcuuucaggaagacccccgagauguacagaaggccagcaugccucagugcccaguccuuggcuaugagucagcagguggcagucacaugucuucccugccuauggcaagucaccuucccuugucucuuaccaaggucccugggugaguggcucuaugccacagguuagccaauguauaugacgcagauccguucugcugcugacugggacgggcauggagcacauggggaggucuaggaaccuuuaagacauaggguauagcaucauggugcauggcuagcacaugggagacaacacaggcuagccuacucugcaaagcucugggccagccaacgauacauagugagaccaauaaauaaaaguaaaguaaaauaaaauaaaauaaaaugcaaagggggauauguggaaguuauggacaaacacgacuuauuuuaaguuguaaugagcacaaaaaaggcugaaguacuguccacaccaugccuauggcugaucccaagaaaccccauccauggggcagaaaaaggacccacccgcauguucuuacucuuacaauaauuuacccucucagugaggcugccccuuaggauugcccugauuuugagacgaaagccagugucguccuccuagucuaaggugagugaggagcaccaguccaagugcguaguccugccgcaggcugcugccccuuggacaauucccagcuggagaugguuggaagcccacuugcugggcuuuuuucuucccugucauuccuugugcuuuauucuacauaucuaggcauguguuuuacuuacuaguguauuauaaucauugacagggaauuuguaagauaaaguaagcgcucagcgacggaauguaugcagauuagcgaguguguggaguccaggauucaagccucaccagcacacauacacacagaaagaaacaagaggaaagcugcucgcugguuuauucccuggccaaguuugcuuauaguuguuuucccagguuuuucucuaggcaguaccagucgcacaggcucaggggaagaugauguugaagaagguagggaaggggcugugaaccucagcacuugcugggagauaguccugcagagaccccaagguaucugggguccugaucagcucuacucugguccugugcagcuguccgagugguggcucaagacagccuaucuccaguuccgccagccuguggucaucuacuccagcccaggagugauccugcccaagcaggacuuuguggaucuacagggucagcuucggugagugucugagacuggcgcaaggcugggcagugccugugggcagggcucuguguguuuccagaacccucaaaucugcacccuaggaaacuggaaaggccuuggcccugugcuuucaucccaccaacagccucaucuuacagauggggaaacugaggcucagagcagugaggagaccaucucccauggucacaagucaagaggacaggcuucucaugccagggcuuugcaaucauucacccuccaaccaugcccugagucccucccacucugcucagcuggccacacaaugaccuuuauacacaguccccuuuuccauauucagccaugucaccugcccuggccccuguuccaguccuaccagagauaaaaauacuagcagcagggaucucuugcccaggagccugccacucauuauuggcaccagcuucucuuaaagagaccagggcaagaacagagagaagccaggaggggaaaggaggggaaaggaagaaagacguguggcucaguggucuggugauccuggacuacacacacacacacacacacacacacacacacacacacacacacacacacacacuaauaaagggaccagggcuucugguuacagaugggacucagccuggguucucccacauacuagauaaaguaucuuuauuuuacauaucuuacuucauccauccauacugggacaggggauggccucagacauugggagaugguuagugugaggcaggaaacccugaauagcccaaggaggaagagguugacacuagugucauggggacacaaagacucagaaagagaaagggcauggccgcugggauccuugggcccuggaggguacccuugaaucuccaaucaggaauacuucaggccggcuggcccuuggugggagucagucacugccugccuccuauccugccauagugugccacugcugaacaacacccagguccuuucagguccucuccugccaggagcgcuccccacuggagacgguucuuacugcugcaggucuacuuugaacuccuuaggcccaugucucucgaggggcagugcugauuccacagguccuucccacacuuggcaggcaucccuggcccaggguccuccaguggauguccauauggcuucagaucucugcuucauccuccagguuugcugccaaacucaucgaggguguauuggauuucaaguccaugauugacaagugaguagcccacccugaccugaauaccacccuugcccacaccuacauaauaccauagccaccccugucucuuacacccacugugucagugcaggcacuuagcgggcccacgucauuuucacuuccuguuggcccagcuuuggaagggguugaggacagugaucagugagaguggagacauuuaaguccucugcuucagcucccgggacuucuccuagugacauugacaucccaggcaaaauggaucacaguuaccuguaacaaacugaagcccagauaagggagaaggaggcaguuugcgggugacucauaaacaggacucuaaucccugaaaaguccaggccucaagaccuguaguuucaccuuuacacccuaauaacaccugcucuugcugguggcaauggugacaccaaggaauaagucccucacccagaucaaaguaguauagaaggugucuguccacccuggccucuuccccauucacccugcccaguggccccuuccuguguccacccacagugagacgcugccaguugaguuccugggaggacagccgcugugcaugaaccaguauuaucagauccugucuucuugccgugugcccggccccaagcaggacucaguggugaacuucuuaaagucaaagagaccacccacgcauauaaccguggugcauaacuaccaggugggcaccacugcccugucugaggggcucuagccccagccccagcccgagcccaacuccagcuccucccuggcccgugcugcacuaguugugaccuccauugccaaggccaggagaggcuagugguccuucucugccugaggucagcccuucucucccugucugggcgucacaguucuucgagcuggauguguaccacagugacggaacaccgcucaccucagaucagaucuuugugcagcuagagaaaauauggaauuccucacugcaauccaacaaagagccuguuggcauccuaaccuccaaccaccgaaacaccugggccaaggccuacaacaaccucauuaaagguacuuccagggcaugggcguccuuacaugccagauaggucccaucccaagcugggguagccaccgcuuugucggacccucucaaucuggagcagguguacuggcccauuuuauagaugagaaaaccaaggcucagguugacaaagccaguuccucccugugaaguagcaaguuggauuuagacaaguguucuggccgagguucccuucucuguacacucucugcucccagaaccacucccaucaaacccuauauuggccaugggcauugucagagucugauugcugguuuugaauucuggacugccacgucagcucucuaugugacucuuggacuucugcuuuucuaugucuguagugugccaaguguugggcccugcccuuugcaguauggggcaugccuuuaggaauuuguugaaggcacagcucuaacugugcacucacaauucugcacauucccugaaggccccaaagaugggaaguccccauccccagaggggcaugaggcaagaagugcccagggcaggagacgauggguucugaggcucccuacaccuacccaauuccuacagacaaaguuaaccgagagucagugaacuccauacagaagagcaucuucaccgugugccuggacaagcaagugccuagagucucagaugaugucuaccgaaaccacguagcaggccagaugcuacaugguggugguagcaaguucaacaguggcaaccgcugguuugacaagacacugcaggcaagugaggaccuggcagggccauggucucaaaguuuggcucacugaggcuuugaacuuccuuccccuccccgcccccccaacuuaggcccagcguccccagccuccuguuuguaaaacaggcaggaagugaggaggcugaugcuacuauaauuaccaggcaagcagccugucauuaccaggccugcaugccacugacccccccccagcagagccuuuagcaugcagacgcucacucucuggggucagugugguacacucuggguaugacgucuccucucuacucacacacaggagcaguagaacugccggggugugccucuaacaucugcucucagauauucgagcauagaacgcuuggguggaucugcauaugcacuggagauggcuucaagggcccuuccugugagacccacccggaaagcaggugggucagggagccucuccaggaaucggccugacaggacggguccuuugucaucaacaguucaucguggcagaagacggcuccugugggaugguguaugagcaugcagcugcagaagggccccccauaguugcacuuguggaccaugucauggaguauacgugaguaugguuccagccucacucccaaguuccuggggacauacaggugacagacuuagcuuguagaaaaauguuacucucauuugaagaacagagucaaugucuguaucucucuguaucucucuuuuagauuuuuuuuuuagacaggguuucucuguguggcccuggcuauaauggaacucacuguguagaccaggcuagccucagacucagaaaucugccugccucugccucccaaguauuaggauuaaaguuguacccuacugccuggcuuagaagauuuuuuuuacaaaagguuugucuacgcauuuuauguauaugguugcuuugucuguauguaugccugcacaccagaagagggcauuagaugccauuagagaugguugugagccgccacgugguuugaacucaggaccucuggaagagccaagcagccgcccucugggcugcugagcugaaggaagcugcaguccuguaguguucugaagucuaccucuagcccuaaacuucccagcuugguggcuguggacagggcuguuuccccagacccucucaucuggccucuuuuuguuugguugguuuuaaacagagucucacuauaaccugguuggucuagaauucccuaacugauccaggcuagccucaaacucagaaauccaccugccucugccuccucuaagugguaggacuaaaggugugugccaugaugccuggcuuccaucugaccuguugaaggcuggagugaagucaguuuucacagagcuaauacacaaucucugagccuccuccccaccucagucucaggggcccuccugggcuucagugacaccagcaugagccuuaggccuuccugucuugugcagaaaaaagccugagcuugugcggucuccuauggugcccuugccaaugcccaagaagcugcgguucaacaucacaccugagaucaagaacgacauagagaaagccaaacagaaccucagcaugugagugcagggcugggcccuguuaggggaggaccagccacagggcuuccagguccuacuucucacccaugccucccucucgaaucuccaccccagcaugauccaggaccuggacaucaugaugcugacguuccaucacuuuggaaaggacuuccccaaguccgagaagcuaagcccugaugccuucauccagguagcccugcagcuggcauacuacaggugcgcccugcccaaccaccugccccacagaggaggggaggcgggguacaggcagcccuguggaaacguacugagacccaccucccacgcaggaucuaugggcaggcgugugccacguaugaaagugccucucugcgcauguuucaccugggccgcacugacaccauccgcucagccuccauagacucgcuggccuuugucaaaggcaugggugacuccacagugccggugagagggcuagagcaaggguguguagacugagcuuaggccucuccuuccuuuccuguugacucucugcaaauggauuguaccucuaugguauuucagccccacugugggcaaagggaacuuaacagaagauggagccaugaauuuaguucuaagcuuucuggcaaaaccauguauccguaagagacaagccagucuccguccacucaugcaagugagugcuaggcuccagagaaugaggggaugggaaugcaguacucgcuguggugccggguacagagcgagcugcuaagguggaaagggagagggaggacagggcuucagcuuccugucccccucucccccaggagcagcagaagguggagcugcuccggaaggcugugcaggcccaccgagccuacacugaccgggugagugagcccugcucuuguccuuagccugccugucuguccuguccauccuucuguccauuccugcuaagaacugccucuucccaucuguuuuaaauuaauaaugucauuugagcugggcaguggugaugcacaccuuuaaucccagcacuugggaggcaagggcaggcggauuucugaguucgaggccagccuggucuacagagugaguuccaggacagccagggcuacacagagaaacccugucucggaaacaaacaaacaaacaaacaaacaaaccagaaaaaacaaaaaccaaaaaagccaaauaaugccauuuguaaguugguaaaacuagggucauccuaguaaccccccaggccccauuccaugauuacaugaacacaggcccuuggaucuguguuucccacucucucagcaccucuccuguuugccagcaguuggggcuacagccaggaaggugaugguguggccaucagugcaugcccaugcuacaaggcaugcacacacugccugucgugcagugcacacugguccccauccaugucacacagcuaugcagacacugcccuguuaaacacauggacagacaccaccuaucacauagccuguauaagcccugcccuugcuccauggcauacacaagcccugaucauguugcaugcacgcuguagcucucguguuuauccugcacugcucugccuuccugggcagaaggcuagccuccuuaacccuggguuuccccuucugggaggugaggacaauucuaccuagacaccuuggucucaugguucuaagagaccagugucuggaagggacagcacugucacaggguuccaaggagggcagggaugcccugugacccuguggcaccugccucugacagaucucccacccacaggccauccgaggggaggccuuugaccggcaccugcugggucugaagcugcaggccaucgaggaccuggucagcaugccugacaucuucauggacaccucuuacgccauugcuaugcacuucaaccucucuaccagccagguaggccacuggcucaggugcuccaagaugcuggugacagaaccuauuggcaggggcuggagagauagcuaagagcacuugcuguccuuccaaaggacccagguucaguucccaguacccauaucagguuguuuacaaucaccuguaaccuuaaauccuggagaucagauguccucugcuggccucugggcacacacacauaaaauauaaauaaucuuuacaguccacuggcagcuggaccugaucggugauguggcccacauaugucaccagagagaggcucacugccaaaacaaguggauucccaagcaggagcuugggguaggaacacugcuguaacaaggguggaaagacuuaggccucuuaagagagagaauguuccauuaacucacuggccagcugaaacugacuaccugcugaguaccagcuggcaggugcugggugcugggacacagcuacacacaagccacagucccaggaagcucccaggcuuccuuguggagcacaggcaaggaggcaggcguggccuuggggcagugcugggagccccgaggagggcagugggaggacugcucccuccaggaaugugaaggaaggcucauccugggaaggaaagggaagcacacaggagaggagcagacacagagaggccaccgcaggccugggugugaaagcuuagcuccugcugucccuaggucccugccaagacagacugugucauguucuucggaccuguggucccagaugguuauggcaucugcuacaaccccauggaggcccauaucaacuucuccgugucagccuacaacagcugugcugagaccaacgcugcccgcauggcucacuacuuggagaaagcucugcuggacaugcgcacccuacuccagaaccaccccagggccaagcucugagcccaggcccagaccugccacuuccacagccaaacccacuuugggauggacacuugccauggcucacuuccuuggcucccgugcccuccaguuugagccagaaaagcauucucuagcaaggccccaacguccacaccaagugccuuccaggcccuguccuuagcaccugccggaguccaugugcagggcugaguccagaggcugaacaagacuacggcccagguucccaauguaucauccacuccaugaaccauggagaagagagccaguccagcccaucccuucucacagcaggagccgggaagaguuccuuuccucagccuggccaaucucuugucaucuccacagccaggccaaaaucugucuucauugguaaaugcccaaggaccagcggugggaggauuaucuaucagugagggcucucaaccuccccauagcuaaggguuaagucuuuguagccaaagggacaucugaggcccagccuccaccagcccaccucaaggugccaucucccugcugccacacucuggugacucuugagccccagacuuauugcuuccauucagugugauucuugcugcagucauggugguauaaugugauuaugccaggugaucaauaaagggaagaagugcuggugaccuugauucagcugaggggcaagcagggcagaugucuggcccugccauuuucuaccugucucugguucagggagcuuguauccaagcaggcagugugggccagcaagcucccagagacaacauccucaggcugagcugugacaacuaaggcauugagccaaggaugucgccaaacccuaaugagccaccuuccuguccuggauuaggccuucccaagucccaugguuagugcagugcuauggaucugggguggcaaacacuccucagcccaaagccaggugcagcuggccuccacugaacucaauaggaggggcaauggagcagggacacacuagcagcccagucaauacaaacagaugcugacuggaagugggcuggaggagcugucacuaucagguccccaaccuugacaccugcuagaggguacauguccugcggaagccccuggguacauaugugcuuggaauguggggccgggaggcuggcaccccugugaagugcuccgugaccugacugaccuguggucaccugaggcagggccugcaacauaggaugaaacuaccucagagaagcuaacgucacugcuacuaaaugacaggcucccaagaguacauuagucaucuguaaggcagggaagggcuugagacucugaagcucagcucacccaggcucacaccacaucccucagccaucccagggcagcaaguauacagaaaggaacugucuagucagggugcuagcaggggcuaaccagauuuccccaggauguauccuaguucugaccaggccacagaaaagaccugaacuccacuguaacuaaaaaacuguuaguaauuugaagucuagaauacauucuuucuccugggggucacuacuaguuagaaguuauaauccaacugcuucagcaggcuucccacauguaaguguguaucucccauauacucccacccagaggguguagcacauaaccugccaggaaaggaaagccagccugugcgcacucagugcugcauggccucuggucaucagcuugguggcgggcaguucuucuaaggcagaagucuccucacugaggcagacaaugcauguggaguuggauauggaagccuugugaagggcagaccuccccaggccucaggacuauucuguggaggaaaaccuggccggaggcaggcuggcagggagggaggguuuuugacaguagcacagaccagacauagcggcauagcuauguaccagaguguaccagaggcuggcaggcaguggcagauguuggggucauucaaauccucacuuuggggggcuaaagggaacaaaaauauccuggaaaugccugugacuucauggucuuaccacauccuugucucugagccuccuuucagaagcucaaguaauguaugcucagccuccagaguuucagauuuuauuuuaaaacaauaguaaacaauuucauuugauuucuuaaaccaccucacacuuggcuugucucaggcaaaaaguaaaaaauaaaaauccuacgggggaggggggauggaugugacugaccuaccucccuagaaaccagcccuggcccuggcaucugaggggcuuggacacggccuuuaacaaacacaaaggaaagcaccaaaaacuugugcuucagcagcagguuagggaccuccagggagaaacgggggagggcucaacagcucccccaggggcugcuucaguucuggaagcaucuccacagcuguggcaggacaaccuggagagagucccuuaaaagggacuccuggcagcugggaucagagcccacucccaggcagaccccaggaucaaccugcacugguuuccagccuccaggacaggccaggaaggacagggacaaauccagagcacaugggcaggcgaugggggagggugucugcacugccacacagccagcaucccagcuccugcuuccucucuuuuguucaaguggggaugaagacagacugcuacccgauggccagacaaaaggagcuguaaacgcuugggugugcucacccguaugugcaggcucuuuugucaggaagggauagaggaccggagaaagcccuugugaugucggguugguagagggaagaacacaagccagcagcccagccgacagacggauaaacaggugcugacucugggcccugccccagacgaggaaacacugacaaggguucuggaauggcgaugguggcagggacagcaggggaggccucgcuccugggcccugggcccuaggcccugcucaggcccagcaggaggcaggcuguacugccugaggcucagagcacagggucugggagcuaaccugggcccuguguacacagggcagcugcugcagaguggccucuucagcaugaacuccacaaucccaaaagaauaaauagugcgcauuccgcuaccugcacuuccugaucucaggaccagagguacacacgcucuacacgcacgcugaggcccgugccaagagcacuuuccacccagccaggagcuggcagcagcagagaugggcucuggccaugugacccacacacagcaggcccucccaggguccuggcugaggaccugacucagcacuuugguccaccguguccauugaaauuaaaauaagaaaaaaaaaggcuccacuuggugacucuggucuguagaggucucugcuucaccccuccauccaucauucuguccauccugcaaggcauggugcaggccagauucggaggcuagacgcagccacacccaccagucacugcaguuuuguuccaaguuugcgcugucuguuccugcaaaauggggcuggcuuagaucgggggaugucugguacugaguggccagucagucccacagcucccugcuuagucucaacaccaaaccacagccacccggggccagagccgggccaaucagagccgcugccaugacu

SEQ ID NO: 742 - RNA, 6913 nt, Mus musculus
ugugggccagcugucucuggcuugucucacucugugaacccagcuccugcuucugaggugccuucccagccugacaccaccuagagguaggagaagugacuugggcccacaccccccccccccccccccccguaagugaaucccucucggcccaagcaccaaggcaaccucuuuguccucuuucccagggccuccaugcagacucccaggagucaccgugaaggccagaacaaggcugugccauugugcugcccacugaccugagagcacucccaggagcuggaacugccuugugcccaguuccucccucaagcccccaugcaacuaggccaguccacaaggacaggaggaugguagguccagcagggguggguaccccacaucuauuccuccuccagaauuggcccagagcguuccccaacccuugcugugggauaucuaagccucaucuuccuuccucccugcccugccuguccuuucccuccaaauaucuaucccucuccucuccucuccucuccucuccucuccucuccucuccucuccucuccucuccucuccucuccucuccucuccucuccucuccucucucuccucuccucuccuuguucucgccucuccucuccucuuuuucucuccucuccucucuuuuccucgucuucucugaguccucccugggccuccuuccuuucuucuuccuggguuaaaaauaaucaacuuucugggaagcggcaguucccgcugagccgcccuccccacacacgggagccccugagaauagcuuucugcggcucuccacugaaccccucccucccuccucccuccuucccuccgcccccuccccgccggcugacuaauaagccgggcagccggcucugccagcucgcugcaagggcguuaacugcuucgugcccggguggcguucagcauauagcgacaacaggaggguuguagggcaccaggccacacggagccggagcucugggcccguaguagacguuuaacuaacccagcucugcuaggccgagugguuuggugaacuuugucaucuaacuaccgcugcgagccugcugcugcugcggcuguuguguggcuagcuaguuccuagcuuaggaggaaggggucagugggaucagucaggagaggcacccaagggucgggaccacgugaagggugugacuggccuagugacuccuuggccccggauucugggaaccauugcgacggggcagaggucaaaggcaaggcaaggcugccugcugcucuggggauccaugcagguaccccacugggagggacuuugacaauuaagaaauuacaucuagggaaacugagguccaggggguguuauucaggcuaggaugcaucugaacaucugcagcagugcgugaggcucagugcugcagggggcugaugaucccagucccucaagguuggaagaagagccgggauaucaaggucaaaggugagggguugcuaaggagagcagaaagucagaaggagcagagggguccacucaagccccacccacucugcgcguccuggcauuaccucaucaccaagcaugcccauuggcuggcucuccuggaggccggcccaaugcggcggagcgcauuaacccguuccucccagcaagcugcgcucugcccacaccacccaccucugugucccccacguagccugcagagccugagaguugagaggaccggggaauaggugaaggaggugcaguccuacggccgcauagucccaugggugcuguguaacugggacaucccuguccuguucugggcugugugaccuuggacagacugcugcaccucgcugagccucgguuuguuuuucucagcuguaaaaagaagugaaugauguaacucacgcccuuccuaaucccugccaugugcuugacaaaugcggggcacacgugggcucugcgucccacggugcgccugagugagcacaagugguaccauugggaagaugggguuucgggagagcaaacggcucaagguuaccccgccaucucagggcugccuuucuuacaggcuucuucugcucuucagggaaguguugcuucccgcaguagagguggaauugugcccagcugcucagaccccagcaaacccccuguaguugaccagugacagaggagagccuuguggucuccaggaauauaagcugggacugaacccccaauggcagaggaccccuggggcaagcacaaagaaaggacuacugggaaggacugaagcauagcaaaggguuagucagcuacugguccagaaggcugcuucucuggacuuuggaaauaugcagagacccacaggccugccugaguguuuacaaauuauaaaucaggcuagcaagcagcuaaaucaaaucccuucccuccacccugacaaauccaccuuccuuaggaaagauacaggccuccaaggcuggguuuguauuucuagcucccggguuuuucuggugcccagaagggagcacacgguggcuagcuuccucccaggauccucagcucuaucuaccaccucugcuuguccuccgcgggcugugcacacucaggaccgagugggcacugcaggcugagagucagcuggggccacgccccuacagacagccaucugcuggucaccugagugcugagagugcccacgaggcaguuuagacaacccucggggccucugagacccgagcuccggggcuccgaccacgcuggucucugaaccaccagucuuaaguggagagguccugccaagcgcccugggcugcaagugcagcugggguggucuucgcuggagccaggggcugcucucuuggaauuuccuucugcccuuugcuucuggccacacccacucuagcuagaucgccaccccuaagccauugcggacucuucccaaaguucccguucccacugcuucggccugugcugugcgcaccuaccccucucugcccccucccagagcuccucucccacauucccugcccaccugguaucccucccuaaagccagccaugcaaaucuuccuggaacucagaccaggcugcugcuuccuucagcaacagaacuggcuuccauguugaguucccugccacaacgugccccacugauggccagcuuccccuggaugccaccuuuuugucucaucccccuguggcucugggcuccagccauuggccccagcucugauuagguagggcacauucuguuccuuucugcgcugggucuuugcacucuccacuugcuuggcuuggaguccuguuuucugccccucaccuccuggggguggggcgucccugauccccacccccacucccagcccagcagaaaucacacagcaggagcugguuaucugcggaguauccgguggccagcuagcuuccccccguggccagugugcagcaggaaagcugcccggcagccaagcuugcagcugcuccucugggucucagcagaaugcccagcaucauggaggaccacugggugcuggaggggaucucuggaucucagcaggccccugggcucucuagucuucaucagcacugccucccgcacagcccccuuuauaaagggaccucauguuuccauucuccaggacaaggacacuacgcacaaagguucuuugacacaaaaggcgagucacagacccagaucagaacccaggugguccaccucccuccuucuagcuacagaccgagggggcaauaucuugcugugggucuuugggcaaaugucucaaccucucuaguggaagcuuugcuuuguauaggacuggccagaagggugggugaucauuugagauucuucccaguuaacauggggcugggggugcugugauuugugaccuucagacaguuccucugauggccugaccugcagcuagcaccuaccuccaaucauucucccaggcuucucuaugaagugcacccugcuucacugccaaggagacaaggcagggaagccuggugguuagaacacccagcuucagggugggccaagugcagauccugccaccuccuuagcauagcaguguggcuucaaagggucgcuguccaccaggcucuucaucugucacaacucauugagcccugggugcuuccuggguugugaggacaacgccagcacuuggcugucaugucagaauggacacaagggcuuugguccaccugccuguguucucagcuuaucagucaaguuaaccacgugguugaagaaugucaucuccacucagacgaguuccccaaauccaacugagaaguuggaccugaguaccuggucagaccaccaaacuguccugccuuucugucucaggucuagccugagcagcuaucacucugucacaggucuagccugagcugcuuucacuuugucacaggucccgccuguguugguguuagccuaccaaauccaggacuugccuuggcuaucagguccugagguucagagauacaaagcuaaagguuugggggggcgccgaggcuaguuauucuggggugagguggguaggaauuggagcaggguucuugguuucccaugccauaagauuuauauuugucaccuaaagguccucucaacagcacugggacaccacucagguccucagcagggcauggagacuugucugagcucacaagaaggaggggaaaugccaaguucucugugguuuuuaaacacauuugugugugugcgcgcacacagguaugcacaugcaggcagaggccagagguguagggucccuuggagcuagaguuguggacaguugucagcugccugauuuuggugcugggaacugaacucagguccucuggaagagcagcaacugcgaaccacugagccaucucuccugccccugcuccccuugcguuugcucugaaacacccugcuuccugcccagguaaacgcaugcacaucguacugagacagggaauggaacugauaaagaaaauuucaagauuuucacagguccauaccuaacacgcucaagggauucuuacuccccaaaucuuucguuuucuuuuguuuucauuuuuugagucagaaucucauguagcccaggcuaacuuuaaacuugcuaugcagccaaggaugaccuuggauuccugguccuucugccuccauauccugagagcuggaacugcagaccuaggccagccugccuggugugauguggugccguggacagaacccaggacuuuguacgugcugggcacacacucugcucguggacccaccauuccucgcucccagacauggucauuaaugagcaugggggcuccugggucacaucccagcagccuucccucacacugcccucauucccuuguuuccugucucugcuugacucuggguacacugaggguaacuggauccuugcugcagacccuccaugcaugguucaggucuaagcgagggaggggugaugcggaccuucccacucuucuacagucuuggugucucccagcucuacaugugaaaggaugugcccuguucugaaucugagugcuggauuccugcugauccaaaggagagggaggccuuaguacucaaaggaauggggcuuggggggugggagguggggguggagggguggcucgucuguaggggcugguuacaccuacaucucucauaagcucacucaccuuuuuuggccauacaggauucccaccaugacauugcuguguuuuuacaagguaauuuucaguauugucccauuuuacagaugaaaagguugagacucaagacagagauuaccuuagggcuguaacuuuaagcugcaguuggggucagaugagugacugaguguggguaaagguuguuuacaggaagaauaguuccuggauggauggagcauggggccaggacagugauaauugugagguugagggaguagaggccagucucugaaccagaaaagccucuaucaggguuucugcccucagaggagauccaccaggggacaaggcuggaggccaugggaggccugacugacuugagagccagugucuggggucuguggugugcagaaugggcugugugauggaggggaagugagucuccuucugugccauguggauggaguguguguguguuguguugugugugugugugguauguguguugugugugugugugugugguauguguguguguaugugugugugguaugugugaauuauguguuuguggggugaugcuaacugugauacacaugaagggaagagcuaaggagagauggaguuggaagaguuaacuggaaaagcagggugagguuaggaguguuccagaagugaaaaccacacccgcacaugugcaaaggccuggaggcuggaggaguccaggcaaaggagcacggaggacuugaaagagcuccagcaaggcugaggcagggaggggaggagcagaggaggggagacggagaggaggggaggucaggggcagcugccuacaagguccacuagcuuccacagugugggcagggagccccagccacugcccaggugaggggcuuugcugcuucagggaaggauguuaggcagaggugaggaacagcagcugccccccacccccaccccaccccacccgccucugagaaggacagccuaguuuuaaucuaguuuucccucuguauguugggucccaacaggacaaagccaaacagcccgagaaccugccaacuggagguucuggaacacucucugcguggucuucccgagcaagucuucuagguuggaaccucuggcaggagcagaggccaugacuugaacccagaccugucaucgguagugcucccaacugcagucaucccuuaacagcuggccagguuccaggucccuuucuccuuccagccucuguuuacccagcuugcacaaucagcucauaagucuacaauuuuuuucuuuuuuacucugaaau

SEQ ID NO: 743 - RNA, 3639 nt, Mus musculus
cacucugggucagagcagccaugccugauccaaagaggaccagagcgcucuuuuagacccagaguaggcugugcuugacugaguggaaaacaaagauggaaggaaaggagagguguauuacccccacccuccuaggacaagaagagcacagggggccuggaaauccaggaaccaaggcauguucauuuucuguuucucucggcuauaugaugcugacaggguccuucuuucugggagugccauggggcaaaugggcucaagugugagucuugguugggagagcugggagaagugcccaugagagucuucagguugggugaugagggcucagcucaggcaaguauacccagguaugacauaauuguuuuuuuuuuuuuuugcuuuuucaagacaggguuucucuguguagccuuggcuguccuggaacucacucuguagaccaggcuggccuugaacucagaaauccgccugccucugccucccaagugcugggauuaaaggugugugccacugugccauuacaccacugccuggcugguuuuguuauuuuauuuaucuuuuuuccuaaaacagggccugcaguucucaaaucuagucaaugauaaccuugaacuucugauccuucuaccaacugaaggccucucugccuccuaaauaccgagacuguaacaacguccagcuaccgcuggcuuuaugugggacugggguaucaaacacaggacaucauacaugccaggcgaucacgcugccaacugagcuacaucaccguuguaucauuauuuaagaugacucuguggguaucuguguguaagcaugugcaugcucagugcaggaagccagaaguggacacuggaucuguugggguccaggagucaccccacaaaccacacaaacacugaucucagucagguagggauaguuaauugaguauucaucacaggacugauggaucgaucggggccucaaaccagacucaggagcugacugugaccccaagccagaauccuacagagcuuuuaagcaugaaauccaugaauguuugugccaaguuauuucaucagucaggauuuaggaauagggaacuuccuuaggagcacgucuuugcuguacauuuauccuguccucauuugucgggguguuuaacugugcuggugacuuaccuugccugacauucaugucuuaacuugccaaccaggauaucauuuacccauguacaggacucuuucugccaaguaagaugucaguucccagggaggucucaggaacuuuacucaccccuacucaaaauggaagucuuauuccaaguagcuucuuauauuggugcaggcgucucucuuaugucgggguccaucccaggggcagcuuauaaaagcaaaacccauaaacguuuauacauagaugcaggaagugcugcugggugguugauuuagguccaagcuuauuguggcuagcuguacaaagcuguucaaacugacugguuuuuaauaguaccaaagcucaggacauaccagaauaugcaaucaacuugggaaugagaaagauuccuagaaacaacacaugagaaguuuucuuuauagcaguaauaacagcauaaaauaucuggcuagacgggcagcaguuacccaggccuuagcaggauccgcuggagcuggaguuacagggguuguaaagacacccaacaugugcgcuagggacugagcucagaucuucuggaagagcaguuuguacucuuaagggcugagccagcuuuugugaacaguuuccucaagccuccuccuccucuuccuucuccuucuuauuauuaauaauuuuggcuuuuuugagaccaugucucacuguguagcuuuggcuguccuggaacucauucuauagauuaggcagggcuugagcucacagagauccuccugccccugcccccugagugcugggauuaaaggugugagucaccacaccagaccaaacuugcauuuuaaaggaaauuuuacuuuuuacuuaucucugugugcauaagcaugugugcaugcauacauacgugcaggugucuuuugaguccagaaggggucagauugccugggaacagaauucuaguucucuguaaaagcaggaagcacucuuccuucuuuccuuccuuccuuucuuaagauaauuuauuuuuguuuuuauguucaugugcuuuggcauuuugccugcacauaugucugugugagggugugagaucuuugaguuacagacaguugugagcugccaugugguugcugggauuugaauauagguucuuuggaagagcagccagugcccucaaccacugagccaucucuaaagccccaacaagcacucuuaacugcugagucacaagucaucuuuucagcuccuuggcuuuuguuuuugagacuaggucucugguaguguaggcugguguuaaguucauugugcggcaaaagauaaccuuuaauuccuugucuuccggccuccacuucccaggugcugggauuacaaguauucaccacuuugggguggugaauagcucuuugaacuauugaaaccagguaauaccuagaauaacccagaguagcuaucaacuauuaggugcacagauuugggguggggacucaauuggggguaggauuuuuccgccuccuaagccucuauugcuuucaguauuaauguguaaauacacauuaggugugguagugcauucuuucaaucccagcauuucaaaggcaggaggaucacugugaguuucaggccauccuggguuaccuagcaaggcacugauccagaaaaggaaaaaaaaaaaaaaaagaauaaguaaaagcaaaacacaacuuuaagcaccuacuguaaugcagagcccaggaggcaugacaaguaugucuaacagccggugugucagccaacagaggugagcuuaaggcaaaaauacuuauuaugauaaccuucauugccugcaagccccacuagacucuagccuaaacucgcaaaucccacaaauuuaacccucagaguauuguagcugaaucauuacauccaccaguuagaagaggcaacuuagaacuccgaggcgguuagaggggguuugcaugcagcaagcucaucuuuccuucaagacccggugcagauugucugaguggauagggaagggcgguccucaggagggcaaacuucuagauuucugcuuuauuuggccuggcaauccuuaccucugucaaagccuuucuuuccuguucucuuuccuggguugauauauuauuuuaauauacuagugggcauggguggauuugagcaacaauggcuuuuaauccuccuccccccccccccccgacaggguuucucuguauagcccuggcuguccuggaacucacuuuguagaccagguuggccucgaaauccgccugccucugccucccgagugcugagauuaaaggcgugcgccaacaacgcccggcuuaauucuccuuuuaggguggaaaacucucaugauguugguuuuuaagaauccagccuuguggcgcauggaggcgcgugccuguaaccccagcaaccacgucgaugaugcagaaggauccugaaguuuacggccagaacucaguuggacucuugucuuaaaagagcuacacccucaagugugugagauaucag

SEQ ID NO: 744 - RNA, 8253 nt, Mus musculus
uagcccagugcuaggacccgaggagggcuccaauaaaugcaaguuaauucucauguguucuauguguauuuacacuaaguaugcauguauccacacgugcuguauguguguagaggucagaggacaaccuguaggugucuguucucucccucugccauaggguccuaaagacugaacucaggccacagggcuugguggcaagccuccaccuccugaaccagcucagcagcccaguucuucuuacucugccugucccuucucucagacacuggugacaucaagaugccuuucauuggaccucggccugugagagccaggcaagugaucaagucagaggugaagacuggcuggagagacggaucagccauuaaaggcuaggcuaggggaagauggugaggccaaggccagaaggaccacaccuagauucaccuguugcaugggguuuguauucugcccucugaguuccacugaagcucuagucuggggaccuucaaagugaccuuauuuggaagaagggucuuguagaugucaggaggcuaaacuacugcuauucuggaucagggcagccuccaaagccaagugcuggagccacugaggaaaggagaagugaccuggacaaaggcacagacccaaagcaggaagccacgauguccagucuucauggugcuggguauggaacucgaggcauucugcucggugagccaacucccaggcccaaaggggaacuuuuuuuuuuuuuuccccaugaauagggauguuuugcuugcauggccauaugugcaucacuuuugugccugugcccacagcguccagaagagggcaccagauccccuuggccuagaguuauggguggcugugagccacuaugaggguguugggagcugaaccugggcugaucaagaucucuccaguaaccugccacccuccacccgacuccuccccccucuuggagauagagccucacuauguaguccuggcaggcuaagaacagaaccuagguccuuugcaagagcagccaguauuccuaauugcugagccaucucuccagccccuguacagauuuuuuccccauuauucccuuaacaacccaauaaacaaugaccaaccugguguuuacucuguugggugcagagucccauagagcugaaauaggucaugagaggagcuguguacccauucuguguaagauccuuggccacuggguuugguguccugggcuauccuggaaccaagccuagcaucccaacacuugagaaguggaggcaggaaggcucuugguuaaaacaaagaagaaauuuuguuccaagccaguaacucuauggcagauggcaggugccaagcagagagaacacaagcccccauaagggauuggagcuacaccuaugauggugcagccucaggaccauugacaccuccccauaacugaccuuuuuagagucaucagggccuugccgcaggacucaaaguugcagccacucaaauuugcguagggggacgcuaccugguacaguccuuucugcuaugucaaagcuuccuccugcucagggucuaggcaagugauauuaugccaauuuuccagaucaggacaugaagguucacagagucccuccagugaaaagugggaaaagugggcagccuguuuggcuaggcgucaagggacagagaauaaggaacugcccccagcgucuguggggaagaguuggggugcaagauccucauuacgccacuuggucuacacaguggagaaacugaggugguugcagccuuuccuuagagaguggccaaagucaaguaggcugcagaaaguaguguucaggcuccgaauagggccugugucaccucggauuggagccagucaguagcggggccgcaugccccgucggagcucagacgcccuucagcggccucgcggggaauuucagugcggggcggagccggacagugaugaucgccgcgagguccuccccggcggcagggggcagugugacucacaugcucccucaaaggcccgcacggaccggaaguaggagugguaggauaacuuccggugcggaacuggggccugggaggauugcucaccggcgcggggucugaaccgguagaucgggaggugguggccugugggugucggaacacgcggccgacgccaugccguucuugcacggcuuccgcaggaucaucuuugaguaccagccccuaguggacgccauccuuggcgcccugggcauccaggaucuggagcggcaggagccccuggaugaguaagucgcugcgguccucugugguugucgcagcgggagugggagcugcguggccgcgagcucgagcuccagccugaggcgggcucggagugucuuguagggcagaagacccgggccucugcugccugugcauggaugcuggagacguccuggcuggggccgaccggacuuucggcagacagcaggccucuccgagagccucuggggaagcaagccggugugguccgugugcccugugcagaccuccuuggguacucggagcgcuacgccuucggagugcuugugcuacagagacaagcgagcacccagaccggcaucgcggucugagaugcagaguaggguggggcagaggagcuagcagucucaccaaggaugucuuuucuaaaccacaucagcccuuuccucugcggccuacucuguaaaugcagugccaggcguuuuuaagaacucggaggcggggccgcagggcugcacaacaaggcgcuacugcccuccuuuggcggagcccagcauauuuaggagggcugccccagauaagcguuuuguguccgggcguuggucagaucuuagggcccaccuguugcaagaggucuggugggugagauuagggcgaagagcaaguaaggcgcgucguggccaggugacucugaaggugguguuugggccguugucagagcugggguaacauauggaacagcguccaggcccaagaugcacuuaguagguaguuuugucuaggaagggugagagcuuuagggcuacccucaagguggugugagagaagauggggcagagccagcacuuugacagcaugcugaaggauggcuuugaaaucacuuaaugcuuuugaccaagaaagaguugugccccacagagcaugcgcagcuuguguggaugcuugugaaagggcacacaggcuagggccacuggcccccgugaguucccacuuucucuguucugccucuuggugcacaguucugcuuccagcgaggagagccggauccugguccucacggagcugcuggagcagaaggcucacucuccauucuaccaggaaggcgugagcaaugcguugcugaagauggcugagcugggccugacccgggcagcugcuguccuucugcagaguggggccaaccucaauuucgaaggucagcagcauccugaggauggggguggggugaggaggacuaggcagccaggcccagccacugcuuuuccuccggucuuuggggugacuucccuuguucuuuuccugugggugucuuucugggggcucuuagcgccucuacucccacaucuuccagaucaauccuucuaccauguagagaauacacuggcaaugcccagagcuaagggcaggugauuucucugcucugagcuguccugcagguuuugcucuggcccuagaggugggaagauaagccacacugggcaucuguuacagcaggcugcauagguucuuuacgcaucaggaaugaugaagggccagccaccuguccugccauuggcugucaccccuaggagguaggagacagguagggcugccuaugagcuugugggggucagugcugacccccacacaggccuucaugccuuucauuggaaaacaggcucagagacuacagggaacuugggaauccuacaagcuacagauguuggggaggggggguuauuccaaaacccauccacauuauggucaaagggccuggcugugugauacaugcagaaggcugaggcagaaggaucucuagcgaccuugugcuaccuagcaaggucagggcugccagagcaagguaguagggacccuggcucaagaaaacaaaggcuggccuagagagauggcucagaguguuaaaagcacugacugcucuuccauagguccugaguucaauucccagcaaccacaugguggcucacaaccaucuguaaugggauuuggugucuucuucuggacaguuacaguacacccauauaaauaaaauaaaucuuuacaaaacaaaacaaaacaaaggcuggcugugcuaagcuggagcaugaagccacacugcauucuccucaggaacagcccugagggggaaauaagcagaaaggagccgauacagaugagcuguagccuacaggaacacaccaggacaaugcagauaagcuguagccuaugggaacacaccaggacaaggcagauaugcuguagccuaugggaacacacaaggacuugaucuacacaccugagaaaggggugcuggggcgaggcucugaggcuaggucccgaaccuucaagaacagacuaaccugaacuucuuugccuucagacccuguuaccuacuacacagcccugcacauugcuguccugagaaaccagccugacaugguugagcugcuggugcgccacggggcugacaucaacaggagggaccggguaagggccagcuccaggcuugggcauguuugguaaguuuaccaaggagccuugcaggcuccgggcaacauagcugcuguccccuuuggcucagauccaugagagcagccccuuggaucuggccagcgaggaacccgaacgccugcccugccugcagcgccucuuggaucuuggagcagaugucaaugcagcugacaagaaugguaagagagacgcugagagguuaagagcacugcugcgggcuggagagauggcucaacggguaaaagcacugacugcucuucugaaggucaugaguucaaaucccagcaaccauaugguggcucacaaccacccguaacaagaucugaugcccucuucuggugugucuuaaaaaaucuuaaaaaaagagcacugcugaucuugcagaggauccggcucaguucccagcacccacagggcagcucacaacugucuguaaauguagugucaggggaucucgagaccucauagcgcacacaaacauacaucaugcaggcaaagcacucauacauaaaauaauaaaacuuaagugcugggguggagggcuggccaucccuggggcuggacaccuguuaaggguucagaaaagacaggccaagugccugggugcuggccccagucgauggcauggccacaccuggcauacgggcagaggguggcaauuugccugaguccagcacccagcgacucuggagagaguguggucacugucugcacacugccccaggaagcaucuuuaagaggugaguauacccagcgucuguguguggaugcaggcgggucuuaaccuugcuuggcccucuuauuccuguuuuuguguggaugaaaucaagccagccgcucuucccucggccugagaauccugcuuccacccuccucugggccucaccucccuccucuuuguagggaagacagcuuuacuucacgcccuggccagcagcgauggugugcagauccacaacacagaaaacauccggcuccuccuggagggaggugagguucccugucuguccauagcuguggcugcugcuccucaccccccccccccaacacacacacacacacaucuacaccauugucugguaagggcugcuggucaccucucauuucuguucccauggcucuucaggggcagacgucaaggccaccaccaaggauggggacacuguauucaccugcaucaucuuccugcucggugagacugucuguggggacaaggaggaggccccgaugaucaaccgcuucugcuuccaagucacgcagcucuugcuggcccacggugccgaccccagcgagugcccggcccaugagucccucacgcacaucugccucaagagcuucaagcugcacuucccgcuccucugcuuccugcuggaguccggagccgccuacaacugcucccugcacggugcauccuguuggucuggcuucaaccucguuuuugagaggcucugcucgcacccgggcugugccgaggacgacagccacauugagcuucugcauaaggcugagaccgugcuggaccucauggugaccagcucccagaggcugcagcugccugagaaccucaacauccacccaguggguagccuggcagggaagauccaggcccuucaugccucccugaggcagcucgagagcuacccgccaccucucaaacaccugugccggguguccauccggcugugccugcgaccguggccuguggacaccaaggucaaagcacugcccuugcccgacaggcucaagugguaccugcucagugcacacagugauacccaagacacuugcugacaagucccaggguggaaugaucugggguaccugaaaccagccugaggauagaccuggcaccuauaauggccuuugggggaggggucccuuuuaucugggaaaggccugcccuuuacugcuaugaaaccacuaggguggugcccuggaggccaaaggcauggaaggcugcuccagggagauccccgcccccucccucucaguguuucacaaugggaggggccagugcagaugggauacagcugcccucuguauuaggagcugaccaggcugugcacagggaaugaggcccaggccccucagagcccuggcagcugugguucgucccauggcggaggcacaugccugggguuucccaggaccagugccaaaaauccugggccauucaguaaggcccuacccauucauucugccgccucgggucucaugaugccuuugaggagcuggggacagaacugaggcggccacaggcuggucuucuggguuagaggccugcccaguccugugguggucagggcucuggcacugugguuggugguagcucugcucaugccacacccaggucucggggcuggugccuucuguuuaaaggcaucacgagcacagcaggauuuaugaggggcccagaagacacugcugaggccugaagcuggcuccacucuagugccaagcccucacgagaucuucgcagucagcuuggcuuuugggaaugagcagagaugauuaaauauauuuauaagauuaaacucugugucuuuguaugacaauuuggcacgcucaagcgaucugacauacauccacacacagacugccuggggcaucugagaauaggacucacccuuuuauuggcugugucagagaggagcuccuaggagcugcaggcugcugugacccaucaccaaagaggauauggggcugugaccauuucuguaauugguacugucuggcagguaccauguguggccuggcuguccuggaacacagcaguccacacauugaggucccuaggcaaccaagugaagucuuuccccucaggcagcuagaccagcggugaccaacucugcuuuccauagcccugugggaaguugccagggugcuuuagagugacagggcugcagugccccaauccagggcacaccuccccuagggcuugacccuucccacuggagucaauggugugucucuuggccugccagcugcuggcccccagcucuggcccuggcuucaucucagggcaaagcuguagacaugguagaucucaucuggcagguucuccuggcgcuccucggccaggaggcugaggccugcagugcggaugauccggcggaccaccucaaggucccggcacacacugcuguccacaucguccaggaucacacccuccugggccauguuguccuugaugacgaugaugccauuggggcgcaggccccgcuugcagcggcgcagaaacucagccaggugcugauccgucagguggccuggggagaagcgaggcgugagcgugccguaugugugcccucagcacaggccagcaagcgucucucucgaucuuaagaccaucucaugccaaaggaggccagaguucugacguuauccacacaaaagcagagucagaagcugggauuuaagcugacugggugcccuccagcccugcucaacaccuacccaucauaccacacacccuucccaggccuggaucggaagguggagcugaaagccccuaaacaaaagggccaagcccacaguguucacagcagc

SEQ ID NO: 745 - RNA, 10673 nt, Mus musculus
uagagggcgguaccgggcacgccggaggcguggccgugcgaguggugagugcccaagcaugccgggagucgggggaguggccgugcugcugggguuucaccgugugguucgaaggccguccuguugagcggugagcaugguuacucgaugggcguggucgaggguguggccacgcggcaauaccugcccuugcuuuucggaguucggagugguugccugcccugcugaggcggggcccuacgggcuugggguguggccuggcaaggcggaggcgggucugagugcagccgacgcucugacgacacuucugcgcgccggaagagagagguucccuggacuacgcgucugguaacgcagcgccaagggucugguuccgcuaugcggauuacugggaaaacauuccgccggcgccgggcugacucggagucggaggaggaugaacaagaaucagaggagguucgguacguguugcugagacaggcuugggacuggauaccggccagcgccacgcagaggcuccuagggauaaggccacaucgcggcugggagaggugccccggggucgcaugggucugacugccgaugaccacuggaucagggacucggcaaagggacauguccuuagaacggaguuuggcuuuugaguuccgcaggucucaaccugugcgucacuuuuuauuccuuuuuuucccccaggcuaaaacuggaagaaacccgagaggugcagaacuugcggaagaggccaaauggggugagguggguaccacggggguggucgcggcgucauugauuuccagcuaaaacaaaaauuuccagcuagggucgcagucacaaaucccuccuuugacauacaguucuacugaucauagagggaacuaagguucuuuauaaauguuugucacaugcccugaaccugauggucuaugggucugcuccaagucacuaacuguaaauuuuagcuggacugaugaauugugauugacaacguguuaagagauaagaauuugggaaacuuagguuaaaaaguauaauaaauaaacaauagccugguuuggugcaauccuaucacagggaguuugagggcaaccuaggcuucauaagaagaauaaagaaaaagaaaaaaacuugagguagagagacagcauuuauaauaauauuuccauuuauuucccaccuauuucuuuuuuaguuuaucccaugcuuuuaaagaguuaaaucaucauauuacugugagccucugaccaugguguguguuuuccagaaaaccuuuuuagaaggcugcgucgugugcauugccaggggugugcacuauaacuugcuaccagauugacugggauugugugcugccucacaccuagacucccagacuugagaaacugaaacagugggauuaccaugaguuuggugccagccgggccugcagagugaaacuggucucagcaucaacaaggcccauccuagugccauagcacuguagucccagcugugugggaagaucacagguuuaaggccugacugagcaacuaugagaccugggucauaaaguaaacaagaaaugguggggauagcucagugcuggugugcuuacucagucccugucaagccuuggcuucagguuuuagggucauuuugauaaauuuuccucuggcauaugucuucugauacagaucccuugacuggcagaaccuuacucugugauuuccagaauaucaaauggcuuugcaggagcgugcgccaacugcuucauugccucucacccgaccccccauuucaccauucacagcgagcagagcacuggguucuucuuuggcuuuuguaacuacugcccacuacucucucaguuauguaaucccaauugucucaguuugcuuccuacugcugugaccaggaccaaaacaacuuguacccuuccugaucauccucaguuauugggggaaucauggcagggccugaagcagagacuggaggacacugcuuccuggcucauucacauccagcuauguuguacaacacaggcccacuugcccacggggaggagcacuguccacaggagcagguucucgauugaaguuucuucuucccagacaauuccagcuuaugucagaucaacaaaacccuagccagcacacugauuuccuccuugucucuguguuguuucucuuucugugguuugguuucuuuugcucagugcggcugcccugcugguaggagagaagguucaagaggagacuacucugguggugaguguuggcuccucucuggggcuguucuuccucuuuuuuuuuuuuuuuuuuaagauuuuuuaaauuuauuauauguaaguacacuguagcugucuucagacccuccagaagagggcgucagaucucauuacagaugguugugagccaccaugugguugcugggauuugaacucaggaccuucagaagaguaguuggugcuuuuuuuuuuuuuuuuuuuuuuuuugguuucucuguguagcccuggcugugcuggaacucacucuguagaccaggcaggccucgaacucagaaaucugccugccucugccucccaagugcugggauuaaaggcauaugcucuuaacuacugagccaucucuccagccccugugacuauaaccaugguaccagggagauagcucagaguguuuguuauguaagcacaagaguccauguuuggauuccauggcaucccauaaaaaccuaggcaugguggcacaugucuauaaucugagcacuggggaggcagagaggauaauguagcggaauaagcaagcugagagacccucucucucaguauaagucaaaggguugaggaaauggcucugaggcuaaagugcuaacauuguuucugagucaggcuccuagcacccacauaauagccauauaugauagcuuacaucuguauuccuaccaggggguccgguggagucauauagaugucuagagcuggcugaccagccaguccacccaaaucaguaaccucccugucucugaaauuuaagguggaaagugauugggacagauuccugaguuuggccgcuugccuccacaaccacacaauaugcacaauuacauauacaugcagagaaauuaaaacaacaacaacagcagcagcauggugaaagauugaugagaacacacagcguuaacaucuggccugcacgugugugcacauacauguucaugcacaccagcacacucgaugaugacacuaacugagcugcuguuguucuagauguguccucuaagcugugugcuuuucugcaggaugauccuuuccaaauggcgacagggggcaugguggacaugaagaaacugaaggagcggggcaaagacaaguaaguggggggagcggggugcagacacugucgccugggccugagugugcagggacagggagggacaucccgcauagagcauaccauaagugugccaagguacaaacucccaggagggcucagagccaagagagaagauucuuuuguaaaaggguaaaagggccuuguuuguuauuucagacauggggagaagcuuugcaugaaaacauaguuagaaaaugauauacugacaacccagcacucugcagauggaaacagaaggauuaggaguccagggucagccugggcugcacuagacccucucugaauaaagcaacugagaaaauguguaaguguauuuaaguaacuagggcauagcaaguagagcugagggccugagguagaucccugacccucacauaaaagccuagugggacagcguguaucuguaaccccagcaucggguaaguguccugagacucgguggccaaaauaaugagcucuggguuaguaagagacaaaggggagaagcuaaaaagaagggcacucugacacaaccuuggcacacacagaaacuuaacuauuauaaaaguuugcaaaagaaagcaugcauucagacuggagcgauggcucagugguuaagagcacugacugcucucuuccagagguccugaguucaauuccuaggagcuacauguggcucacuagaaucugguacccuuuucuagugugucuguagagugugacguguacucacauacauacauaaaccaaucaaucuuuaaaaaaaaaaugcacucauuccccaaagucucagccgacguugccuuccugcuugcauaugugucuagcauugucucuuuacauaccauccugugucuuauguuuucauguguguucugugguaacuuggcaucaaugacugugaccugcucccuccucucagggucagugaagaggaggaucugcaccuggggacaucguuuucugcagagaccaaccggagggacgaagaugcagacauguagguaccagugaggcccauugucugucugaggacuguagcugagccccagccagacacagacacucagacaugucuccucacagacggagggucucguguuuccuuggcuguguccucuccacuucucaggcuuggaaucuguggaaggugucaaagguggcucucuguuugcauuuauguuuccuguccucccuccuuacauucucagcucuugccuuucuugauuagugauauuuucucaaaacacaggguuaucauguacuuagcaaucuuuucucuuguuuuugguuuugguuuugguuuuuggagacaugguuucucuguguagcccuggcugcccuggaacucacucuguagaccaggcuggccucgaacucagaaaucugccugccucugccuccugagugcuggguauuaaaggugugugccaccacugccugguaucaaucuuuuucauugaggccuuuaaaacaugguaucagaguaucccucccuggagcccuucccacuaaggaauucuuccucacuuuuccuuuaucuugguaaaucugaguucacugugcaagcaagugugugugugugugugugugugugugugugugugugugugugugugugaaugagagagacugggagggagggauggagggagggaaggagagaaagagaaaaagagaaagaggugggggagagaaauagagagggaaagaaacauaaggccauuuuucuguauucaaagagccuuggaucuugucaccccaggauaucuguugucauaaucuccagugcacauugguguuuugaguucagauuuucagaacucacaugccugaaauucccacaccaaggagacuaagaguuaggaggaccucacauuugagaccuauuaggucagacaauugugagacugucucaacaacuuccagcuacuuuuauucuuaguuuuuccaugaagugauaauuuuuucguuggaggcagguguguugacacacauauuuaaucucaacaguugauagaagcuggcaguucucugaguuugagaccagccugguuuacauaaagaauucaaggcuagucacagcuucuccaguuuccccaacuuagcucagcuucuccugucucaccugucuccuuagaauauuuccuccaccagcugccuucucucauuugccaaccccacccccugccucaacuaacuuuuuuuuugguuuuuuuuuuuuuuuuuuuuuuugguuuuucgagacaggguuucucuguguagcccuggcuguccuggaacucacuuuguagaccaggcuggccucgaacucaaaaauccaccugccucuaccucccgagugcugggauucaaggcgugugccaccacgccuggcuucaacuagcuuucuuauacccuguucuguucccagaaauccuagaggcaaccaacacugaagguuauaaggucaaguaguucuaauagcuaagaauucuuaaagggauaguugaccagcaacuggggauccuuuaaaggguaaggcacacaagauaaugcacacuacacacauugguuggagaaauggugaguggguaaagaugucuucugccagccuuaugacugacuguguucaaccuccaggacccucauaguagagggauagagccaacuccucugacuuuacauguguuaugguacacguguucucacauauacauagauaacaaaauuaaauguaaaauguuccucauuaaagaugcuaaucagcaguugcauuguuauggccauucugguccacugaaucuguagucccccuucucaggaugaaguacauugagacggagcugaagaagaggaaggggauuguggagcaagaggaacagaaggccaagcccaagaaugcugaggacugccucuaugagcugccagagaauauccgagucucuucugccaagaagacugaggagaugcuguccaaccagaugcugaguggcaucccugagguggaccugggcauagaguaagucucccaccccuggcugugccccgcccacccucgggaagagcugacaggguuucaguuagcagucacacagacaagccacggaguguuugccuagcauuccugaggccugggucaugggagacggcucaguaaaguacuugucauacaagcacgaggacuucaguuugaucccccgcacccauaccuggugugccagguguauuggggcacccugggcagcuggagauuagagagccaccaggcucauuguucagcuagccuagccugcuuagugaguuucaggccaaugagagauccugccucaaagaaaugcgguguguggcuccugagggacuauccugagguugcccucuggcugcacaugcacacagaagcgcacacguguucacaaguacacauguaauggagauccuucuugguauccuuggaaaccuacagauaugcccucucagacaagcugucuccagggcuuucuugucaccccuggucccuguggcuguggaggguuccuggccuguggaggcaaaagugucucucuuuaaugagauucccugcuccucuguaagaggcugagccaccccuccuuugugagccuguuucacuuacggggaaguacagaggucagcagcagccuugcugaaagugaaguguuaggaggccuguggacucugggcucuuucuggccuggcaagcuuugaaccuuaggcagccugcuucguuuucauggggaaugaucucucucucucucucucucucucucucuuuaaaguuuacuuuuauuuaugugcacugaugucuguaugaagguaucaucuuacagacaguugaaagaugcaaugugggugcggggaauugaagccugguccucuggaagaagagucagugcucuuaaccguugagucaucucacggccuaaccuugccagccccaugggacaugguuucuuguaugugugcauuucuggggauuugaaacagggcccccacacgcuagguaaguucucugccagugagcugcaugcccagucauagauuuccuuuuuaguuuuuauucauuuuuauuuuuuaagacaggguuucucuguauagcccuggcuguacuggaacucgcucuguagaccaguagaguguaggcuggccucuacucagacagagaucugccugccuccuucuccauaguguagggauaaaaggugcauccugaguucaaaucccagcaagcacaugguggcucacaaccaucccugaugggagccaacacccucuucuagugucggaagacagcuacaguguacucacauauaauaauaaauaaauacuuaaaaaaaaaggggcuggagagguggcucagugguuaagagcacuaucugcuguuccagagguccugaguucaauucccagcaaucacauggugauuuacgaccgucuauaaagggaucagaugcccucuucuggcuugcagguauaaugcagcagagcgcucaauacauacgauaaauaaacaaaaauuuuuuuuaaaagggggaagggggaaggcugacuggcugugcuggcuccugccuuaaaucccugcacuagggaggagcaggcaggaggaucucuuaguagcuuaguagaggucagccuggucuauacagcgagucccagggcuacacagccagggcuacaagaaacccugucugggaaaaccaaaaggaaagaaggaaaggcaugaagcaggcuggggcacuguagagugcugugcucugggacaagcuucuccugcugcacugggacuggccagccucaccagucaguuccaaagaugugauggccuugugugagguguggcucucucucuucacguagcgcuaaaauaaaaaacaucauuuccacggaggaugccaaggcccggcugcuggcagagcagcagaacaagaagaaggauagcgagacaucuuuugugcccaccaacauggcugugaacuaugugcagcacaaccgaugugagugcccuguagccuuaccuccugccucauacagugcccugacugccauacaccaugaguccccaggaguccugccuccugccucacacauguucuucucuguucaguuuaucacgaggagcucaaugcacccauccgaagaaacaaagaagagcccaaagcccggcccuugagagugggugacacagaaaagccagagccugaacgugaguacagcuguggauggcacucagguagcucuugaaggcagggucaugcugggcagggcagugcucaggcccuggggaccaaggcaucugacuuagacccccuacuaaggaccuucuccuuuccaaacuguggcuccuccuggauaaagugagaaguguagaguuagcgguugguugcucugaggcccccaagcuggaagcuaguaaagacuggcuuugaaaguuuugguaaaggaaaagcaaaaaacaaacaaacaaacaaaacucuuugagcucucuguggccuccauucuggggcugcuguuaggugugacuccaaccagguuuucaucuugaacaguaguaucugccgguuccaccaugacagguaaccucuguucuccucaggguccccucccaaccgcaagcguccugcuaaugaaaaggccacagaugacuaccacuaugagaaguucaagaagaugaacaggcgcuacugaggcagcgguaggggcuggauaacgaugugaugcacaggggugcguuugugugcaugugcaagcgugggggcacacacacauguccucuugcauaaaaccugcuuauuagcucuugaguuccccaucagauagugcuucugcucaguggcuggauuucuguucugguuuugguuggagacuguagcucucuguguauccuaggccaugaacucccuccuccucccuacuacugggauuuuagaccccccacccccugcauuuucaagcacuaacuuuguaacuauuggaagaaaacaaugugucuaugucuaucuauauuguuuccuaccuagggcaaacucuccucaagaguguuauuaaauccuuuguaaauauguugccugucuucuaauguuuuuccaggcucaggaagaaccagcuguguucacugugggccaauacugacaacauaggggaggagugaguguuaagauucauuauuuuauguauauggguguuuugcccaugugugcauacugugcccauugaggccagaagagguuguuagcuaucuuggaacugaaauuauaaaugguucugagacaccaugugugugccagguccucugagagagcagcugccugugcuccuaauggcugagccauccagccuguuugcauuguauuuugugguuauauacguagccauggcuuauuugaaauggaguugaaaaauacaucuguccuugcuggguguggugacccaugccuuuaaucauagcacgugggaggcagaggcagguggauuuauaugaguuugagagcagccuggucuacagagcaaguaccaagacagccaggagagacccuguaucaaaaaaagagagagagagagagaggggagaaggaggaggaaguggaggaggaggaggaagaggaggaagagaagaagaagagaagaagaagaagaagaagaagaagaagaagaagaagaagaagaagaagaagaagaagaagaagaagaagaaagaagagaagaaggaaagaaagaaaagagaaaaaaaaaaagaaaaaaugcaucugaccuguuuagagaguccauuucacagccaaaaaugaaggauggguucagagacacugccauucccugacuuuuuauagaacuacaaaguucuuuugauuaaaaaggaaaagcagagacaggcagaucugacuuuuaggcuauccuaauuuuuuuuuuuuuuauaauuuauauucuccagguuuuaauuuauuuauuuuauuuauuuauuuauuuauuuauuuauuuauuuauuuauuuaauguaaguacacuguagcugucuucagacacaccagaagagggcaucagaucucauuaugggugguugugagccaccaugugguugcugggauuugaacuucggaccuucggaagagcagucgggugcucuuaccuacugagccaucucaccagcccccuaggcuauccuaaucuaagaacaaguucagcacagccagggcuacacagagagacccuguauuaaaaacccaaaggaaaagcuuagugugguggcacaagccuuuaaucccagcacucaagaagaguuccaggcagucuagagcuacauaaggagacccugcccaagaagacaggugagcagggc

SEQ ID NO: 746 - RNA, 1880 nt, Mus musculus
ccuggcuucaaggauuuguuuuuauuuuugggguuuugugccuagaauaauauauauaauugaucauuauagcuauaaacuaucuuuguaagauacuagagcuggucaucaaggcugcauauacauucggaccuuuguucuuggggcuagagagaugacucaaaggucaagagcacuugcuagucuuccagaggacuagaguuuaguuuacagcagcaguguagggugggugacucacauggcauuuugaguccagcucucagggagcccgcgcccucuucuggcuaugcagccacuggcaucugaaaggucaaacagaggaacgcacuaacacaaauaaaaaaaauaaagaaaaaggguuuuuuuuuuuaauaggcaggauuaauuuacuagagccucuuguucuuguuucuggaaaaaaaaaaaaaagcucagcugguaaaggcaccugcugccaacacaggugaucugaguuggauccucaggacccacguggugggaggagaaauugcacucccauaaguuaguuguccucugaccuccacauucaacuccacagugcacuacacacauacauacacacacacaaacacuaacaaaaaaggaagaacaacaggcuggagaagguauaaaaugaaccaguaugauggcacacacuaauccagcauuugagaagcugacacagaaggugguaaguucaaggccagccuagguuucacagcaagacacucucaucauuuaaaacaaaaacaacaguggguucccauggagacacccagugucuacgcuggcugugcucuuggcauagaccccgucacagaccugaggaagugcucaggagcaaucgacugcggcugcggcugcggcauugcuggaaaaccauguggagacugagagaggcaugagcuugcuuaguucauugcuuucugaagagugguguugcuaauccuuuuaucugugggcggauuuuaaauuugcagcugcuggaugaaacagccacgcugguguucuuuguccugacgggguauaaauuucgcccagcuucagauaaccccuaccugcagcucucucaggaagaugaugaccuggagauggaguccguguaagcugcccucccucccucucucccucccucccucccucucucuguugaaugguaugguaugcaggggcccugcucucagcacucucagcuuggaggugcucccucuauuuuuaguggaaggauguggacacuggagccccuggugugcuuugcuuaguuugaagugcagugacugccagccauugcucaguccugucagagacaaucagaacuuaccacccuauuauauauccuuggagcagcucccagugauccaguggcaagagucugaaaguguucugggccaguuuaaaauggguuauccggcugcgagcauugcuacugguauuugaaaauugcaucuucugggucaucauagguugacagcagacugcaccuccaaccugcaucugagugauggggcuagggugagguucagggaaggcaguuguuuuccagauagaucauaaccugucugccagcucugacucuauugagcugagcugugugugugugugauggccaccucaggccgagauccccacugccccgcacuuuuaccuuucuccucuccacaacucaaaggcugaggugaacccaggcugggcugccaggcacaucagaccucguagagcagcucuuggugcuggcugccccacuagggcagugcaugcaagguagauccugggaugggcccugagcaagucacucccgugcagcaauacccuuuccacacagugggaaggcaggaggaccuccaacugugccuucaccagagggagcagucauugcaagu

SEQ ID NO: 747 - RNA, 2380 nt, Mus musculus
gucuaaagcaagucuuugcagaacgggaagcccaucagcaaucucuguguucauuuucaguggccccugaccacccccccacccacaucccaaagcgugguccuugaggaagcauuagucugaugggguugcuggcccaguuccacacacccagaaggacaaccucgcucugccaagcugcugguccucaaaggaagauucuagccuaccccccagccuuguucccacauuccaucacccaccugagcucacaugcugaccugccccccuccucagcacucaccguguguuccucaggggccugcgcugcccacugcugccgccuuuccugucuagggcucugugaggacuuuauucacccucucagcuauuuagagcagaauaguguucucaaaggucugccuuuuguuccuccuuuccugaggcugccccagcaagauucugcaaaacauucacaggagucccccucauaccuguaccaccuagaauguguucacaggccaaggagucucccaguuccuccaaggccuugucuguccuguagagguguguuuguuuugugcuuaaaaaguaucauacaaagcugggcgugguggcacacgccuuuaaucccagcacuugggaggcagaggcaggcggauuucugaguucgaggccagccuggucuacaaagugaguuccaggacagccagggccauacagagaaacccugucucuguacaaacaaacaaaaaaaagcaucauacauuuaggugacccucugccuggccagggaccaccugccugcuuccccacacuauaaagagggacagacagaacaagcuugggagcagauguggucaugacuggcaugucaggaccugguaugauuuugaccacagggagacuucauccuggccaguggggaaggcacacaggcuccuagugugugcauacagagcagagugaggcagacacauuccugagacaggaugcucauuuggaguugaggugcaguagacggggagggaacuggaggaccagucuucuuagcauccaagugcuguguccugcugauggggcuggaaagccuguccacaugaaggaacucuuccgucccuaaacagcuuuucuggauggcccaaauaauugucagacugagcccagagguuucaccugcaggaggucuucuggccuguaugccuuacucagguuggggugcagggacugggaaccacuuaguaauguuuaacauuaaucacugaaauauuuccaagcaugggauuuggaugugcucaggacuggccacuauauggaggcacuucacugcaaagcaaauacgcccaauaaagauuccaugaggaagcuugugucugugguccuagggaaacccaggcacugccuagcuuccuccucaaaauucaguguucauacaguuccucauguuguggugaccacaaccauggaauugcuuuuguugcuacuucuuaacuguagcuuugauacuguuaugaguuguaauguaaauaucugauauacagauggucuuaggcaaucuccuuggaaggcucauuugauucccccaaaggagucgugacccacagguugagaacugcuguaauuccuuauuaucugugcucauuaaaucagcuggcugccugccacccacucucacugacaguagccccaccuggcgaagccugacuaccaggccugugguaccagugcacaccacugauguguagucauaggagauccaggucaggacccaguccugcugccaccucaggaugacagcagagauccggggcuaagcccccacugaaacaggcuuccuggguauccaguaggguugucccugagggaaucagacauucagguaagucauucaucucugaccccuucacuaggaacgcuuuagguuggcagacucugggcuggagaaauggcucugugggcgaggugccagccacacaggcauggcacauugaguuuggauccucagcacccacauaaaagccagucuagcuggccagugugcccuggguccugugagagacccuaucucagaaaacaguugagaguuauagaggacacugugucaagcugggccugcucgugcacaacacuacacacagaaaaagaagcacacacuuccaaguauaagaguaugguacugagccgggugugguggcgcacgccuuuaaucccagcacucgggaggcagagacagguggauuucugaguucgaggccagccuggucuacaaagugaguuccaggacagccagggcuacacagagaaacccugucucgaaaaacuaaaaaaaaaaaaaaaaaaaaaaaaaaaagaguauggugcugaggccucaccccagguauaacguucaucucccauuucc

SEQ ID NO: 748 - RNA, 50468 nt, Mus musculus
agggcggggccuuucucgcgcccguccccacgugucccagguuccugccccccccaggcccugugcuuauaacccuggaugcgcgccucucucagcccugcuccgccgucugccacugccgccugggcucacugguaagaaguuccgggcccuucuugguccccacucucuauccagggucucaugaccaaggaaucccagagggagcgagcagcugcagggggugggcucagggcagcccccgagugaccgcgcaguuaguggaaggaaggaggcugauguccggggcgcugugacgcacacguuccuccugccuagggaacccauguaggagaacgggucccaaggucuccggagcaggaggacuauggaggucccccucugguuuuucacgauccucugugugcugcgaaggcuccaaguagagucccggagaguccagaggguugggggcuuccgaaucccucucccuggaucagauucgccgaucuauguucaggcuuguuucucaaaguaagcaaaagguccagccccucuuugcccuuaggggcuugggcgugugccuuucuccugagugugacaguacccugcucugguggacacgcgaacccugccuacccgucccggguccuuccuaggcugugacugguuucucuucuccguagggugcaaugccaggcucagucuggguggggcuucuagacagguuuccugcuagcuggcuggcucuuugggaggagccccuucgcaggaaaugucuguuucuggcuuguuaacggcuugggcccuucucuggaaggcaggcuaaccgagaaaucgagggaaaucuucuccaggagaacuaaccgcgcucucaguauuccccucugugaagugggucugucaggcugucugcaagugcagcuggcaggagcagaccugcccuuuccccagggguagaguaggaaaacccuuccuuugaucccucgcuuugcggcuccuccaccuggcaggugaccccugacgucagccucccagcuccagggcugccagccuugugccuggacucagaacucuugcuguccaagaguucaaguucagugagcuguuuugagaacuguggccagggucugcccacuugcucacugggucugggaugaagaccugaaaagacagggucccgucccccccccccccccgcaacccuccccagccaccuacucccccacuccuccacccccucccccgccccagacaaggcuuucagaaggaagaagacaguggagaaaccuaagagcugggcugggcagagacuggaauagccuccauuucaaacucccccuacccucucccccucccaccauaaaccagccaagucugggagcauuggaagggccucagggcugcccaaggaauucugacuuuacccagugcccauggaguccauaaaugaagggcaacuucuguccacuacccaccuccuccacgcacauaguaggacagaacagcucuuagcacccuuggucaagugugccccucaccccagcugccugccugcucugagcugaggaagucagacacuccaggagccuugggguggagccacgccccggcccaccugcugcauuuucucagggcccaucucauugaccuuggacgccccuaggucagccagaucccuccaccaggcugugaacacacugcuucuggagugagugccuuccuugcgggcagcccugcaggaagagauaccuugcugaacucugggucugaggcaucgguuuucacugaagguuuugggcagaguucacuucccaggaccuggcucccuguucuuuugaggcugguuccucccuagaccuggaaaauggcugggcacccagagccucaguugguagcauuaaugaguggacugguguguucuucuaguguuacuggagcuguuagcaucagagcacgggcucuggcugucccugaaaagcugugcucugcuagcuuccccccucccaccccuuagcccaguuaaagagacagguaaaaggcagaugaaggacauguagucuguauagcuacaccaggaagaggaacagaggacacuaccccaagcccaccuuuggcauccugacacgagguuuagguuuuaacaaggcaagcgccaccaggaauugcucaagaaugcaaucccguucaagguguggcccggccaucauuaucuuagcuaaguggucagaacugugugacaucggcucuugguuuguuugcuuauuuauuuuugagacaaggucucacuaugugguccuggcuggucuggaaccaggcuggccccaaacccacagagaucucccugccucugccauccaagugccgagauuaaaggugugcacuaccaugucuggccucuugggagaaacguuccuucccucagucuccccagagcuccagguuuuuccuuccccagcuugggaaguuccugggaauuccguuguuucaguagucaaagggacuacacgugucuucaggccuuccagaacagcuacacuagauaaagguuugagucucucaccagaaauugguaaaacccgcuuagucucccuccuugccuccuucgggcaugaagaucagaaacccgucaaucaaauauaaacaggcuagauccaguaggaggauggugcgccuccugcuguucaauauugguauugcagucuaguuuuaucagacaugaaacugcagaagggaacugagagucaucucaggggucuucugggccaggucuggucaggguuuuaaaagaacaguaguaacagaccaauuagaacugaguaaucaugacagcagauagagccgggguggaggaacaacccagguagcugucuguagucuggugacucgucaccaagacaggaagcaaagggcaaaaaaccccuaagaaccagggagugacuguagucagccugggcucauguuaguuagcaagguaggugacacucucuguggcaucagccaaagccaacaggccagugaaacaccuaaccgcccagccaaaguacuccccaggcccaaagaggcucguguggcuaacgugaccagagcaagagucacaugcauguuauccucagggacagacugcuacugacaccuacucagauugagagccaagaugauauauauuauuauauccagcucacaggcuguggcuucaagcccagcaugcguguacacaugugcacacauaugcacacacucaggugcacaccacaaguacacagagucacuuucucagacacccaaucuuagggguacaaacauacacaccagugcaggcacacacguugcaggccugcauaggcacgcagccccugcagaacauagcccuucauacugcacagaccuggcugaggccaagcaggcagggcaggugucugaccuaccccccuuucacccucgaggcuuccaguauccuuggaacagacugggaggaagaagugaccauuaagagcugggugaaucugcaagggguaucuauugcccggaugcccugagaugucugagaacucccuuaccacccguugccuuccucuucccucuggcaccucuagacuggaauccaggcuuguccuacagagaucaauagggcacacaacccaguugaucugcguuugggggccuggcuauucccagccuaauaaggucuuggcaagucccuuaacuugagcuucaauucuucugccuaaauuggugcaaacgccuaauuaacaaaaggauucgacauaagauguauggauuuaguaucuuuuccuuuauaucuggggguggggacagaggucaacauugucuuccucaagucacuccacauucucccccucuuuaguucauguguuaccugugggguguuuugacugccuguauggcugagugcugcaugugugcagugcucauagaggccagaagagggcgccaaauccucuggaacuggaguuacagacuggugugaucuuccauguaggagcugggaaucgaacccagguccucugaaagaacagccagggcucuuaacuauggagcugucuccccagccuccucuccaccuugauuuuugagacacggucuuccacugaacccagaguuuacagauuuggcuagaaugacugacuggugaguuccagggcugccugucucugccucugggauuaugcaccagcacacccagcuuuuaaaaugguugccagggaucugaacucaguuccuggcagguauuuacccacugaauugccucuucagcccgcgcacuuauccucuggagugugaggauggcuuccggugaugcgcacagaacuugacaaaccggaugguuugcauacacucagcuaggggcuggggugcagcucagugguaaaguguaugcuuagcagacacaggacuguggaguccauccuccgcaccaccacaaggucuccaugucccuugacaggucacucaacaucaaguggccacagaggucucaauaucacauuuacuuucacagagugguucaucuggccaggaaagcagacuacacggacuccagggaccuguaccuauaauccaagguauuuuccaccuuuguccugccucccuucucccuccuucccuccauuauccauggccgguugccuagcugcuguugccaugggcaccaucaucuggcuucagggucagggccugcugagucacccggcaacccagguccagggcagcuggcuaagggugggcaggcagucgcugccuguuggagacugcaggcagucaggaguaucaguccauguacuagcaguauuguuccugagguguuugcagcaaggccugccagagaccuccggggcugacuagagagugggcccugggagaauauuugggggacugcauaguccuugcuccagcucccaaguccaccugcagcugugacuagcuaagcccugcagcuuagugcccgguggccugggaaagccacuggagcuuccugguagugauggcaaccagaugagcccugcuguacucccugagucuguggagggucauuguccuucccagcgacaucuaauaaagagccuagcugacugcccuagugcagugacucucagccuucccaaugcugggacccuuuaauacaguuccucuugguguggugacccccgaccauaaauuuauuuucauugauacuuuauaacuauaauuuugcugcuguuaugacucauaauguaaauaucugauaugcgaccccuguuugagcacugacuguuguucuaguggaaagugagacacggagaccuggguccauaucuggcccugaugccuacugacauuauauuuuuuuaaagauuuauuuauuauauguaaguacacuguagcuguccucagauacuccagaagaaggcaucagauuucguuacggaugguugugagccaccaugugguugcugggaucugaacuagggaccuucggaagagcaguuggcacucccaaccacugagccaucucaccagcccgccuacugacauuauaaucaccuggcuggcggcugagcugcagacccugagcuuccucuguacgguccagcgugauggcuauaauagcgccuacucucagggcuacaugcagggcaugcugggauacaccccacccgagggcucucgcagagccuucugggcagaagaaacagcugcaggagaaaaauagacaagacaguccuaguaccuucuggaagguucuguuaguugagagacagguuguauuaugguugcaugacugugggggcugcugggaaagaccuucaggcuacagagaggcagucugcccaucucgcuccucuccaggccgguuucuccaucuggacucaagcaaaccugccuuuaaacccuuagagaacggaacugacagagauacugggagucucucagaucccucagaguuacucagaguuacuacccccugaacacagagugugacagggcaccucgaauuccagugagcccaaaagggagagcagccugggaccaaguauccucuccuguggccuccuguccacccaaggccggaggcggcgucuauugcuggacaaggagccaaggaacaaagucaggccuuucucuuugaccuugagcugcuuguucuaugaccuugaccacugaccuccccgaagccccacugucuaccuauaucugggguccuuguggaggcucagugugauauacacuuguggcccugcccaacacacuuugcuuuggcaaagaacaguucucaaggaggcggcaugucagcugccugcugcucuggccccccagggccccuccccccccccccaccucccacuguacacaucccucagacaauggcuuugguccagccgcucagucucaaaggcucacuuuagcuggaugggucugacuccaaggucugccuccucauugcuggucccacccccagcccucugccaccagcauucuuggaucccaugugggacgugugcagagcagucaggucagggacccccgggaggggugcaugugggacgguggauauucagccucccagcaucccaguuguuuaucauucaagggauaaagcuuuccaaggcugcugggauggggcuggagccaggagagaccgagcagggcugaccugcuacacugcuacauuguacuuauaucuuucuugcucccuccagacaagauguccagcaagggcucugugguucuggccuacagugguggccuggacaccuccugcauccucguguggcugaaggaacaaggcuaugaugucaucgccuaccuggugaggaagugccuugcguguccaccccucccccauugcuccccucacugcccacacgucaccguccuccgccaagccuugcuuuuuucucucucuacaauccuccugagacagaagggaaacagccucucccuccaugagacgccuccauucuuugaccagagagggcuggcucucaggaaggugauaaaggaugaaggccaccaggcagauccuuagcuugccacugcucugucuagaggggggucccugugcuaugaaggcacauaguccuagcucuccacguggccucccuccaagcagccuucaguucugggauggcaaauaggcccucggaguagcuuaaugcuacuuccccauccagggucuagagcagacaucacuaaucgagccguggcacuuacaguccuucacagucucagaaucuguagucgugaugucaggccugugauuuagaaacuccaaccuagcuagugcagcugaaggccacaggacaaagccaaaaccaaaagucaguucuuggcucucauagcagaaguccgggagacggaagccuucaggcauggcuggaucugggcaccugccugcccugcuuggucuccaauuggcuuuauucuugaccuuuucacagucagcaagaucaaagcccagcugucucaggcucacuagcugguagugaagccuaaggcuccucccacuggcagagguuccucucuaugccugcaccugggguacauagggggaggggagggcguaaugagcucccaccaccaccccuagggagaggauccucccaggggagaaggucugaggaaaggacucuguugcuuuggauagugauguuggccuagggccaggaggggucucuguguguagucugcugccuuuguuaccugcuacaaagacugggagggggaggggaggggauggaauucaccuggugagugucagagguguguguguguguguguguguguguguguguguguguguuagcacuacaguccccagaguugccagcuggcagguugacagcugagcaaucucagacagguagagcugggccuugggaagaaccaggauacgaagagcagccuguggguaccgguagggacccggcaacgggcccaaguccacaggcagaauagguuuagcaccuucuacccaccugucuuagucaggguuucuauuccugcacaaacaucaugaccaagaagcaaguuggggaggaaaggguuuauucggcuuacacuuccauacugcuguucaucaccaaggaagucaggacuggaacucaagcaggucaggaagcaggagcugaugcagaggccauggagggauguucuuuacuggcuugccucuccuggcuugcucagccugcuuucuuauagaaccaagacuaccagcccugagauggucccacccacaaggggccuuucccccuugaucacuaauugagaaaaugccuuacaguuggaucucauggaggcauuuccucaaccgaagcuccuuucucugugauaacuccagcugugucaaguugacacaaaaguagccaguacaccacccaagugcugggauaagcugguccccuccuguggcucccuccuguggccagggcacauaugggcucagggaaagacagaccuguggauaagacauguagcugugucccaaccaccuggacgccagaugcaguuuugacagggaaaccagugucuugcacccagccauacagugccaaguacgagcggcugcauaggcccagacucucaagucgccccacggccccucucuuuccucugucaccucaccagccugaggcacccccuucugcugauggagacuguuugugggugguggcuggccggccggguucacccuggggccucacgauucucucugcccugggcuuuacuggccuguuucugcuccacaggccaacauuggccagaaggaagacuuugaggaagccaggaagaaggcgcugaagcuuggggccaaaaagguaagacgauggaggaaggucugugacgggaggggcaucagagcucaugugcccugcauccccuccaggagggcagggucaaauaugcugcuuucagauagaugugcaccacccgacaucuauucgucugccugucugcucaccugcccaccauucuacuuaccuacuaaccuaccuacccaucuacccagucauccaucuacuuaccuacuaaccuaccgacccaucuauccacccaucgguccauccacgccucugucuaucauccguccguucaacccccauucaucuuuuggucugucugccccucuuuugucuuucuguucucuuuuccauucucucccacaucuacccaucauccacuuaccugugcaucccucuuucaacugucuguccuuccauccuuuuaacagacaucaggacucccugauggguguaagcaauagggaaggugagucacagauggucccacucacacgaccccucagugccaucuguggacugcuccuacugcagugagcuucacacuugaacccuuucacuuggggagagaauaggagauacuccagagguacaaaaggcuagcccacccgccuggucagaacugaucccucugcaggucaccggcaguugcuugacacugcaaggcuccacaaacaugucagaaggggcauuggggagcgagagucacaggcccaagucacgcgcuggccagaaccuggaaggagaauuucccucugugcaugaggggcucaggggagggcugccucaucccuaucuaggcugagggaaaacacuguugagggcacggacaggggugagcuugagccacugucugcacagggacucugugugcugccucuuacuccuucguuccuuuggucucgccagcacuccguaugucuguauugagucugcuugcuuggaacauuugguuuuacccauuauuacuuuuaaaauauauauuuauuucuuuauuuuuauguaaacgaguaaucugucuuccagcauacucagaaaaggguaucggaucccccuuacagaugguugugagccaccaugugguugcugggaauuaaacucaggaccucagcagacagugcucuuaaccacugagccaucucuccagcccacccccuccaccguaacuuuccuguugccuauaugaaagcauccuuaacuaaaauagcgaguagcaccccagugcgugaugcaguguguuauauacuucaaauuuuauuauauguaugggugcauuaugucuguauacugugugcguaccuggugccugaagacaucagaaggugguguugaaaccccuagaacugcaguuauagaugguugugagccaccacgugggugcugggaaucagagccggguccucuacacaaccagcuggcgcucuuagcagcugagccaccucuccagccccaauacaauuggcucucacuggucucucuagaagggucuuccuuccucaggacugacuggggucucagaauucacacacagcagcuuggucuggauauuuagaaugcucagcagagucccuggcuuuacguucuugcugcuccaagcucuuuccucacugaaucuagccauugugacaaugauaucugcaguuaccgccaagucccuucaagggaauuucaccucuaguugauagcuucuguuugagaucuuaggggacaccagaguucuguccuauugggaaggaugcuagaugggcuauugggaaggaugcuagaugggcuauugggauugacuaguaaugucugccaugagugcagaagggagaguaacaguacgguuggcuagaaugaauuagugauauauacuacagcgcagaaggaaaggcaggcauagccuguucugagcuuauauggcuauugguauggcuaagggcuccuuguauucccuuuggaccccacuccuugcuaggcucuuucucauagcugcucucccuuuagguguucauugaggaugugagcaaggaauuuguggaagaguucaucuggccugcuguccaguccagugcacucuacgaggaccgcuaucuccugggcaccucucucgccaggccuugcauagcucgcagacagguggagauugcccagcgugaaggggccaaguaugugucucacggcgccacgggaaagguaaggcuauggauggcugggcagaucuggugacuauaggaggggagggagagcaggcugcugaggaucccagagugggccaggaugaaggcugggcugccugaacaaugguggucccuuccaucugcaugcugaaucgucugugcugggcucccaguggaagccuugucaccugcuugguagaccagguuacacaugccccagauaaagucacagcauaugucaccaugggauaaaauacaaagagcuaaaaagaguuggagagccaggauucuaaggacaccguauagccugcuccuuccaaaggcccagagggcuguguuugaaacugcccucccagcagccccagggacuuguuccuuugcuuguagaggccucaguggugcuccggugucuuugugaugucuguuccuaucuccuuuccuugaaagcugccuucccagauaacagacaccuuaaugcccucucugaaauccacuccuucugugaagaccaaacaaagucacauucagagaucuggggacuugacucuuuuuuuuuuuuaagacagugucucucucuauagccauggcuguccuggaaaucucucuauagaccaggcuagcccgaaacucagagauuugucugacucugacuccccaguucucggacuaaaggguuauaccaccacaccuggccguggcaccuagcuuugaggaucaccuuagcacaugugcaacacaggcugaagaggaccccauggggauaggcagggcuccuaauugcauugauaacuccaaagagugggccaucaaauuuagugggugccaugauagcagucugagacaggacaugccuaaccauccugccgcccguaacccacaaggcuuaccaccuugcuguauggggcuggugaugaugcagguacaggagacaugcagcuaaggcugacgucaaagagcucaccugaggguggucccagaaauagccaaugaccaggauggcacuggguguuuguggaagcuugggcaccuucaucgucuuagauucuguucagcuggcuuguggcaggagcgucaaggguagggugccuccuggucacagacauaauugagucccuuaagucuaucgcaugcccuugggaagcccaauagaauggcaccugauaagacuacagaaggacgggggccaggagcuuuggagcaggggacaggagaaagacuacccugucuucaugaugucuguacucuggggaugaacacagguagacuuagugcagaaccagggaucagugucucucaggcaagaggcuguggcaacaaauggcccaugaggacacagaguagcuaugggagagacagcagagucugagcccagcuugggcaguucucccccaaagcauauuggccagcagcucuccugaguaguagcuguaaaaugggggagacuggucagccaucuucccacccuggaggaguuuccucugguacccagucugcuuaguugcaugcuaggagaccaaaugaggcuccaguguguaccaccuucccgaagacagccaugguggcaaagguggaagaaggucagaccuggggcucagaguugugcacucagcucugcuagcaugccccagugucgccaucgaaagugaaacugacacccagcuccuggaccauuugggagaugggugaggacacaggucauuaagaacaagcgucggcagaauaaaccucugaggcacugcaucuuuccaaaugagccgaacuggcagcggugaacuccccaccuugggaggcaugcuggccgaagccggagucaggacucugaagguccaucccauggcaaucagcuggguacaacaaagagcuguacuucuuuuugauucugucuugagugaggcagagcccagccagccacagacaagccagcuagcugcuguacaguggcuacucgcugugcuauaugcauauauggccacuagagggcaccagaggcuuauguuugaggaagcaugggcaccagaugaugauguugaugacugcagcaguuuuacagggcuucacucacagggcucuagaucuuuccacacgggucccacagcugcuuugauugagucuggcaggaccccacuuuuuauaggguagaccguccaacuugaaauaucucagggccccugagcagcaagaagaccagggagaccgccaggagccagcaccacuuuggcucugcugucccuggucuguguguccuuagggauacuccuaugccugucuccacauguacauggcuccaagugacacacacuccaccucuuuccugagcccacggucccaggagacagugucuaucuaaguaauggggaaugagaggagaccuggagagguccugggcccaggcuggggaucagcacuuagaugcagugucugacugccuggagcacacacuggugacugcacaugugagaagcaguugucccaagagaaugguggagauggugacggagaggcagagccaggcugggggaugaggaaaugcugaaggcaggucccagcaagagauuggcaaagucccgcugaggaaggggggacuccacagccaagguguacgcaggcuacugggacgucagagcagagagggccuuggguaaccucaagauugagucucuggccuuugcggaagguuggugauaugccuguaguuaucuugaccuggauggucugggagccaaggccuggggugguucuuauagcccggaacuugcuauguagaccagccuggccuaaagcucagaugccccugccugucuucugaaggcuggaauuuaaaggcuuagccaggcuccuuguuuucaguggucucacugugugccccaggcuggucuugaacuugccaucauucugccuuagcuucuccuuauuuggagucuuuacaauauuaucuaucuaucuaucuaucuaucuaucuaucuaucuaucuaucuuguguguuugugugugugccuaggugaugugugugcuacaugugugaauuaacccacagaggucagaagaaagcauuggaucccuuggaacuggguuacggauaguugugagccaccauguaggugcagaagaacucguguccucugcaagagcagcaagugcucuuaauagcugauccaucucuccagccccaacacugagauuuuacauguccaccaugacucuuguaugccaggccauggugcagccagaugguggcgcugugggacugagagacacugagccagcaggggcgcuggcaggaugugucaaacauucuggaagaagggcaagaguuagccaaugacacuguaaggcaguguagcccaggcugcaggcacagccugugcaacagcccagggacaagguggcacucucuccucccagcggcccaaaccagggagcaucauuuacaaagccaucuuucauauccuuggucgcuccacugugagaugcacagagcacgaguuccccacccucuagauuugaaagaaaagacuggaaaugugagccgaagacaccgggggugcagggguauuuuuguaaauggcaccaucugcagggcuaucccagggcagauggaaggugcccccccuucccuacccucccauucccaugggugcucaccaugguacacgcaauguacacauguguguguggacaugugugugacuugacaguguccgucuccccauccccuaccuaggcauguuacuaggagcugcccuggcucgggagucccuugcaggguugauaaagggaacucggaggcccuaggcucuugccugggacagacuuugaaucaagaaagccuguuuguccagcuuuuccagguucucucuaaacagauggguguccaucccccugcugugucugggucagcagacaccaguccagucgggccuggcucgggaggcacaggcugccuuuuguguuggcgaaacuugaagccguggggaaagagugggcaggccagguagcacuuggccauguacagcaaaaaucuaagagucagcuuugcgcuagaauguucugguguguggaucccagagaaaacgcugcucuccacaccucugccucagugucccaccuugaugggaacagcgcagccccacccugugggcagcccuacccauggagaugagcucacugccugcucaggauggaugugaugccugugugacccugggcuccucaucucuaguccccuggccccugugacugcccuuaugauaguaauaggagguagccaguguggggacugacuagagggguuggcuguggugcccuguguccgagaggcuuacagacagcagcucuccacagcuccuggcuccguuggggaggggcugguaccaggcuuuccacaccaccugacaagacucuggaaaauaacauguuauucccaccgcugccuggcugcguccaugcaguuuucacaguaggcgaaaggggccucuauuauuucacagugccugagccucccucucugugaguggcagaacgggcaacccggaggagacggcaucccuggcagccugugcccacccugccccuucuccucuugucuuaugggagugcucaggauggccauauacagacuaagagaugugucuaagggugcugaggcccaugguugggggucuagcccugccccaaggggacacccaucuguuugccuuguaacacuguggcuuucugagccucagucuccuguuuguguagagagaggccgaaagcagaaggcccuucuaggugacuuaguucugccccugcccccagacaggcacuauaaaauuggggaaacgggggcccagggaacaacuggaaucaccacucuguggguguagaagaucaaagcacguggcuggggcagcugaggggcccauguuuuccuacuuggagucuccugaauucaggucaccaaccccagaggagcacacuccuacaugcaccgccuggacugugcauacauguacacacggugcccccgauagugcacacccucacagacaugccuuuuuacgugccugugcuuugccggcagccucggugccaucuagugugccggccuuccuuccaccacauacaugcuuccugagcaccgaggugugcugagugccccucggggaagcucugaucugggaugcccugggugccagcccuugccccucccagggagcaguaucugcuucuuuggucucuguccuuaaaagaagauaaauaacaaaugucagagagagaggaaagccgcugccauuuguccucuauucuuuugugauccauccauccuguaacucuaauauacccuuaucuuccauuccaggggaaugaccagguccgcuuugagcucaccugcuauucacuggcaccccagauuaagguaagauguuacuccuuacccgguggacggugcgagaaggacguggacguccagugacaagggcaggguccuuaugcuguugacucuucucugugucacucuauggugcccauggcuccuaaagaacaccaguagacuggugguggcaguuucucugaaggucacagucuuccuagacauccucucuuccuggaggggcagucugggcgccugggagccauugguaucuuugguauucccugggugcaggccagaacagcucugagacucagucucuugcuguugcauucugaccccuuucuggauguuuguggaugaccuccuccaugucucaguaauugacugucccugccuuuggcauguccccugcgguguacaagugaguauggaccagccugucgucucuggucacccuccagcuugacuggccuagggccucugucugcuucucucuccauccauucauuuauucccucauucauuccuucaguguuugcugagugucaauaccuugcaggccgcagacaccacccccagggaacauggcgauuuuucuaguugccucaguuuaagaaaauaaaauaaaaacugggcauaaugauacacacauuuacuucuagcaguuaggaggcagaggaagguagaucgcuaugaguuaaaggccagccuggucuauauaguaaguuccaggccagccaagauccuaucucaaaaaacaaggcgaaccaggcagugguggcacacgccuuuaaucccaucacucgggaggcagaggcaggcagauuucugaguucgaggccagccuggucuacagagugagucccaggacagccagggcuacacagagaaacccugucuagagaaaccaaaaaaaaaaaaacaaggagagagagagagaauuucauuuaauauuuuauugaaccccauguauccaagaaguuauccaacauggaaucggcuuuucccaaacugcuaaagaggguuuugucuucuuuggguacugauucgccaaacccagucuuaccggaguggcugcaucugguugcgcagccucaauuggagcuccuugguaaccccaggaggccuaauccuuuuccagcccccugggcuucuuccucuccguagcacaucuuucccugucccuugcauggauugccagcuguccccagccuggggacggaacuggccuggaagugagcaguaaugaguucugauacauuugaccucugcaggccaggccuccgaaggcacccagcacaguagcugcgaugcagggccuuuggcagagccccuccuucuaccucugcuucuaguucccacggucacuuguagaggcugcaauaacuauuuucggggucuccauuuacagaggccacacccaggggcugugguggccuaggggcaagggccccagcuaguuggucucugggagcccagccgaacguggaaugcucucagggcugggcuugauuaaaggacucagggaugagaagcacccaguaccaccccaccccaccauguccaccacaccagugacauugcacuggauaaucuguugaguucugcuucuccaagaccugucccuaaccccgcaggccugcgaggcccaagaggaauaagcguggcugggauucuuccucaguuaccccccuccccuaaccacuacagcuccacagagggacugcaacaaaggaagcucaacuuaucucucucccaccccaguucaguucaccaggggucgcugagccaugaagcucauuuccuucagacacucuggucucagcuggagaaacugaggccaggaaggaugcacagccauuuguccauagagcaggccuuucuacaacccaauaguguuuccuuagucuccuuaagcauucccccauggauugacucuucugagggacacagcaagagacuccuuguucuuacgccaaaggggugugugugugugugugugugugugugugugugugugugugugugugugucugggcucuccgagauccugaccccuuuguccugucugcaggucaucgcucccuggaggaugccugaguuuuacaaccgguucaagggccgaaaugaucugauggaguaugcaaagguacaucucugccucugugggacuuuugaggccuguggcauaagggcaaacugauccccauaugauacaagauagaaccccuucccgaagcagcucucucccauuucagccuuucggagaugcaugguccauuucuuaggcgagcauuucugagagaccucaguuugcugagcggggaggcaccgggaugccugcucuuguucuaagggaaauaagaauucuucgugccacuucugcccugcauaguuguggguccccaagaggcugccaggaagagggacccugagcagagaagcuguucucugcaccucaauuaccuggcuacuagcugucccccagugcuuucccuggagcuaguagaagcucccaggacagugucaaacaaagccuuuuguggcgccugccuuuuuuuuuuuuuuuuuugaaauacaaguugcaauaaaacauauuagaaguuuuacaucaagauccuuagcugcucuccagggcaccuuucuuuuuagcgacucgauggcagcauuugacaaacagccucaaucaaucagacggggggaaaagcaagucugugcacacaccagaaaauugcucagguuuuuaaauagcagucaccggggcuagcugugcaagugcgcugcagccaaggugccgcaugguaggggacgcugcggggaacgcggggauguggggaacgcagcccugccucagccgccagcaucccauuaggccccugagugcugggaggaaaggcucuuccaccaucuguuguuuuauuauuaagagucaaguuuacaagagcaaacccauauguuaccaaacaaaucggcaaauaguggugcuauuaagggaguggaggcuggcaaggcgucuuuuuccucccccccuugucuccuugaugaagaagaauaugaagcaggccccaucuuuagggauaaugaguuacaagccuugugcucaggccccgcucccucacugguccagucggaagcuagggccuggccaaccugaggcugcaugguaccucccagcuccacuagacagcagcccuggcuuuucccagcagagcagaauuugugauccacuccccucccuuuuugucacccccacccuacacacacacacacacacacacacacacacacacacacacacacuucuuggauucuuagcuuccaccuugaauaaucuguagagcaggaaaaguuugucagagaagaauguguauccccaccuuccuccugggauuuauuggaauaaauagagcagguuggggcuauggaaaaacuuuagcacauccagccagaaagcugccgcccacccaggaaaugaccaggagagccaagcagccgggcggcuuugugugaaauucacagccaggcaagaucugagacagaugagggaaaaaaaucaauggggcuuugaaaaaucucugcuuucaaaaccguuaaguagccagggucaaaggcuacuccggaggcacgggcaaagccucuacuuggcuucuguuccuccccugaccaccacccaaggcucgaaacuauccugucaucaucaugaguacaaguaauuagcaaaagaaacauccuaaugccacggacggacagacagucccaggccugagaaagcugaggcaggaggaucucgaucgaguucagggucuaccugggucaaucagugaagucuugucuccaaagagaaagaaggcuggaggguagaugcucauuuaacacgagugagucccuggguuugaccucaaaaaaaaucacuacuaaagguaaccaaugcuaaaccagaguuucacagugggcacuaaauagugcccguuccccccccccagcuccacccucccugucugccccguccccuaccugcccccccacccccagcucccccacuggcuggcgguugcuuucuauuccuaguugcccugggaaucuuuggggcugggaagcucaggacagagucaaguggggcuugagguccuguacucugcauuuuguuagcauaucuggggugaggaucacacaccacccccaaaaccaaaagcuccaggguccugaccagcuguucuucucagcugcccagcagcaaggccucagcugucacgagcacugucucaaaaagucccaguccuggccuguuggucccacucagggagagcacagagcaaguguggacauuggcucuggauagguuuggaagacacacuucccucaggacugagcagcuaggaaaugcaguauauucuggcugccugcacuguuucaaucaaaggacagaagcuuuaggggcgacuguggcuuugcuguaguggauggugguguuuuguuuugggacaugaucucacucugucccaagugagggacucacuacacagaccaagcugacaucaaagggauccuccugccucagccucaagugcugggauucccacaugaacugccaacauugcuuuuucuuuuucuuuuucuuuuucuuuuucuuuuucuuuuucuuuuucuuuuuuugguuuugguuuuucgagacaggguuucucuauguaguccuggcuguccuggaacucacucuguagaccaagcuggccucaaacucagaaaucugccugccucugccucccaagagcugggaucaaaggcgugcgccaccacgccuggccugcuuuuucuuuuuuauguuuagcugagggaacaacccaaggggcuggcccucucuucuuucagcauugcuuuaagcuugggacuauaaugaaggacucucuccaccccucgcccagaggagagcucuagaauuuuaaguaccagcccaugagcaggaugggcaaaccuaccccagagagacagucugagaaugguagcaguggagccaagguucccacuguaaccacaggccugaggggccugagagaaacugucuggccacugagcugggccuacuuccugaguuaaaggucagaguucauggggaguuacagugaggugucugugcucaggggugacagggcuagccaccuccuccuuucccugaaaacugagagagggugaccagccauuuaccuggucuggcaucugggcagaucuuccuuagcaauggugaggaccauuuggaagucgaauagcuucaagccacaacuaaugggggaggugcaccugggucucccuuuagggucuacagaguugaucgcaggucuuggaggguggccccaggagauaacccugcaguggaaccuucuacaaauaguccuccucuccucugguccacacagagcacuacaggccucugugguccacucacagcuacacaguagauauuuaggcuguuaacgcccccagcucuuaugaaauaguaggauaucaguaacaggugcuaagacuugcuuagccaggaccugccccuaagcaucugcuccuagcacccuaggcuccugaaaucuucuggaagaaacucugaggucagccugcauucuacucucuugugauuaaugagggcaccucuagggguuaagccccucccucccucccucuuucccuugguagccugaggaggggagaggagaccagaguugggagcuagcuggcaccuugagggaucccaggcaauggagcgugagugaccuucaugugcccuucuaggcaccucacccuguccguuuugccuucaccuguagcaacacggaauccccaucccugucacccccaagagccccuggaguauggaugaaaaccucaugcacaucagguaagcccaaccccuccugguacugaggagacaacccagugcuuaagagcacuggcugcucuugcagagggccuggguuuggcuccuagcacccacacgguggcuccaucuguaauggcagggaauucagugcccucuucuggccuccaggggaacugcaaaugugugguacccagacauacacacaagcaaacacuccuacccauaaaauaaaaauaaacgggaagccgggcaugguggcgcacaccuuuaaucccagcacucgggaggcagaggcaggcggauuucugaguucgaggccagccuggucuacagagugaguuccaggacagccagggcugcacagagaaacccugucucgaaaauuaaaauaaaauaaacgggaaagagaaagcgcagcucuucuguuccugagcuugaguuaccauuuccgcucgugugugcaggcaagcccagcacaaugaccuggcaagccugcuuccuggguauugggaacaacuucucagaggauuaaaaacccucaaggauaaguggaggccuggggcuguacccacaagaccgagccuugucagugggggugggggagguugggggaagaacccagcucuuccuugcagccugcaguucccacagcuaacuggggugauucaguguucucgguaggcuuggcagugggugcuuuggacuugugggccauccacaggaugguggggguguccaugauauuauucuguagacucaacucaucucucuccugcagcuaugaggcugggauccuggaaaaccccaagguaagccacuuugccagggagucggcugccuaugguagcccucuccacucauguuaucugauggaugcgaggccuaauuugaaauuucacaaggggcucaaguaacucugcgaucugcucucucaaacucuccccacgggcuacuccgacugcuccccuccuugcugugcacaguccccgccucacccucccccccuuucccugguguuauuuuucuaauugcuguagagaugaaugguggaaggaaccauuucagggaggcagagagaaacugugauugaaagacaauaaagaagugauuaagcagacaaggcacuugugggagggcccagccuaugcccacuagcuaugggcgcgacaggggggggggcguuuugccuggauuagggugaggcuaggacgcaaugaccccauguagccugucggcagccuccuggguuggccgggaugggcccacagacccaugucaaacuuuaagguuucucuccccaggggcuucccuucacugucuccucgugcccacugugggaggugggggugggcaggaugaagacucaugggaggaggaaaaccucuuuguccccaagggaaugacugcacuuuuccuggcccagccucacacccugggcagcugcauuggggugggucagugugcuuggaagacaugggagaauuugggcaucugggcccaggggaucagaggaccgucuggaggagaauugacagggcaguuuaggucaggagccucauacugaggucccaggguaccuuccugcccaggucugcccuccugaccccauccccucaaucgcuacccuggcagcaccaggcuuacccaccagucacucacugauggccgucugaccucagaccuggcucuggcuuuucccugccuugauuuuucuuggauucugacaggcuaagucucauuuuauagauggagaaacugaggcagugcaguaagucaucccuggugcagcugcugaguaagaacugaagccggggcucucagugcacccccccgaacccccauacuuuccacagcauccauccugucugaucuuacacaaaggaagaaaguacuuagcaugagaugggacaaggucagaggcagggggaugagcggcuugcuuucucuucaggccgcaguuaagauuagguguccugggucugcucagagcuucgcucauccagcaguagaaccaggcuggacuggcuaucaaugcagaggcaauagcaucccagagcccacacuugucacuagggagagcugguguccuugcccccaccgcuccccuggggacugaugggcccauggggcugcugccugcuggccacagguuuuuccaguucaugcucugcugaccccaugacacucaggccaaccgcuccucauuagccagucagucacaccgaggggggcccagaacugaacuacugagcaacacuucuagguacuuucaggccaggcuccuguuggccaaguacagcucccuccaccuucucagggaagccuguggcuuuauccuuacuagacaagcaacacccccagauugggcaccucagaacugggggcgcagagcugaagccacuugagcagcuuagggccugagacgagauuuggugugauucccacaucgcuaugggcagaucugggucccgaggcuagcaugucugcaccaagcguacugucacugccagggcucaggugccagagauaagcacucuauaucagaaccccaaacucugcuucucacugccuuauacccuccaacgagucuccucucaucaagcaguaggaacaggcuaggguagguagcagcguagauacaacaucuagcccugcugcugagagacaccgagaguccaagccgcucccucucuguuggccagggaacuggcagcauuguccucuaugcuggcuuggccguggaggcuuucccccauccuacgacacccagaugccucugcuccaugcagcacccccccccagcccucccccaccauuggggaggagcacugagagcuuugaggggcccuuccccccuccccccaaaaaagacccgaggucugcggaagggaggguuugaggcagauggcugagccauuuucugccuccgccggggcugauugaagggcaaugaggcagcuaauacgaagaaagauagaaauuuacuugcuuuaacuucauacggcccacagugaaagaguucauucagccgccggccgccauaucugaugggugaauaagccauccccacauucaucaugccucuacaucacggguuaguucaugggccauuugcugcaaucccuccuucacgggcccugcuucaugcuuucuuuugcugcccagccccaaccaacucccaccucucucucucucucucucucuuucucucucucucucucucucucucucccucucccucucccucucccucuccucuccucucuccucucaccucucuccucucuccucucuccucucuccucucuccucucuccccucucccucucucucugucucugucucuuccuccauacuacccagaugacauuggaagugagcccuccugcugggguggauaaauggcaccagauacucaguggugaacuauuugucauuugaacugagcuuuuaggagggagaguuaaaaagaaggcaggcacccggcgagcucagaaugcaaagcaaacauuggcuuauuucuaguuaguuauuugacagaauucaggcugucagcugcccacccuagucccggcuaacgcuuuagaguauguaaacuuguccuguccuaaggaccuuuccugccucuuguccccuucccaaggcacucauccucuacugcuuggcauguggccggagaaaggacggauucaaaacugaaguggcuacagucagucauagucgggcauaguggaaggagaggucuagaagguuugacuuagccagcguggcgagcucugggcagguagggaagugacugaaaaggggcuguauuggucaccugaaggcccagcuucaggucuuucuauacucaagcaauggcagucguugcacugcccagagagggucugggaaugugguguuucucugaagucuguuccaugaugaaugguuugacacucagccacaggcaucuaacuauaucucagcccagguugccauagcagcugggaagcagcaugugaugcaggaaagagggugaaggugugaugugggccagccaugucucugguuccuggaggucucuugcuggggguguuucuuaaggacccuuugcaucucccuggaucugucuuuaaggucacucugugugucccccacacaaacagcacuuuaggaggguguggcugcuagcccagcaucucuuggaguucagugguagaaugggaacaguaaauguuaccacuguguguggcaccaaggauucuugaaauaugauacuucugguguuaaguccaggauggcccggggaaaugaggcuguuuguuuggucacuccauaccuaagcugugguagaggauccacaauacagaauggaacagacuaccauacuguggccccuucuagagggaggcacaguguccaucacuagaaggcagacucuccaccuucacagcaaguggccauucacaccaggccuugcuuaacacuucaagauuaagacagucagggcacauauccuuucccuaggcaggaacugaggcucagagaaauacagccacuuucugaagagaugucacagccugacaucuggcucagggaugucuuccaccauccuaacaacaguuucgugugguaguaauccuagcaggugggaguuaggggacaggaagaucagaaguucaaggccaaccaggguuccaugagacccuuucugugaaaccacagagcaaauucaccacaguuguugaggccuugugauuuucccucccacgugcuggguggccaggaaugucugcggccggcaggguagagcacagcucaugcaaaacucagugucucccugcagccuccauuucugcccccacagaugggauaguagcauuuguuccuagcaggcaaggcugcuuggaucuccaaaaugagcagugguguaugaaugagcucgcgguugcaaugaaaaggcugugguccccagccaucagcagguggacagagcagcuggggacaggaggccccugggacgaacuugagcaggcaggcccagacaccccccacuccccccacacccccacucccccaccccccacgcccccauccuaaugguggcaaguauccaggcuucaggcuugggcuuaggggaagcuggagccucuggaggcaagggaauuuugagaacauccugggcagccagcagccccuccgccucugccgaaggaagagaggcccauuuucuaacgcacccaaggaaaaauauacauaaagguugauguguuuucaaaugguuuuugcuuuguucuucucucuucuccccgugaguauuaaccucagggaccccggggacggcucggcccgcucgagcaccugcuggggucacgcacagucauuagcuuugcggucagugcagaauaaaccccaauuccaggcaccgacucgagugugcgcgcgugcgugcgugcagcuccgggaagccaguguacugugcuccuguggaagucacucuuuccugccugacuugcuucucuccugcuauucugccuccagcugugggggcggcaaagaaaaagaugagaucaaguugaggggaaaaauugucugauuucuugagcccuuuguuucucgggccccuggcaggcugggcuggcugggaaccgggaguccauugggacuucuggcugauggagaagugccaggggcugguggucguagagaggggcaaggagggucaaguaccugcaggaagcagguguauugcuuggugucgcccaugaugucccaaguccuauuucuuucuguuuuagaaucaagcaccuccgggucucuacacaaaaacucaggacccugccaaagcacccaacagcccagauguccuugagauagaauucaaaaaagguaugugcccaccuaucaggaaugaaagggguaggcuuuaagggucucaguuccucucaguuccucugcguuccugggcccaggcccucuaacuccuugcauuccuggaagcuagaggcuuccaggggcuuugaaaguucccaacagugugagccuugggaggagggguucccaagccgcagugucauacgcuaacacuggaucccaaaguagcuggcuuuugaaagucauucucuacuuccuugagccucaguuucccuauuuauaaccugggguuggggaugggggaaccuguucuuuuccuagugugcaaggagaucuguagggaaggcauccaggcagaugcugccaccaggaagucagccgcaaagcuggcuuuaggaacacugaagacucugcucauuaagcuuagcucgcccugacuuagccgucuggggucuccaguuaccuggacucaaaguugcugccccucugguuccucucucuuguccuagaggaagaaacuggacacagucaugcccggugaucagacuagaacccagcugagagagaguguggagguacaaggaaaagaugcucacaagcaaucuuccugagggagagauggggucugacaggagagagaggagguauaaggcaguccagaccugggcggaccauccacaaaguggacaccaggccagggcgccagcaagagggucucugagacucucagacgcuccccaauguaccucagaauugaaagacagagugauggggggagggaggaggcugcuaugaucuuguggaacuucaccuuucuggggcugaggugugcaugccuguaaaacaggcugugacaaggcuguuugcagguacccagcauaacuugaagcuacugugagggugugguaccaggacaggccuuucuacccacagccucucccaaggggcuguccaccugccagggccaucuuugugccucuuuggcugugucacuuuacaagucacauuaccuaggaacuaaggagaccuuggugggacccuagacacaguagaagucuuggguccccucucgaacccucuguugggagcaaggagucucccuggggcuuuacucugagcagaugguaggaugggccaggccacacugcagacuucucccacgagacccucaaaccucugggagcugggagggcagagggugggagguaagcuggagguggcagagggucccgggcacaagccuccaacagccuguccuggaggcgcaggguagccccaggcagaguugaagaagagccagcucucugaaaagagggagggaggcccccuccccagccuacuccucauucacucgcuaguuaauuuauuugaaguuuuaaucuaauuauuaacuauuuuaaaagcuaagaggcuuucuccggcggcagcaccaacaaugucaaccucuccucccaggcaggccccauccaaggccccagcguugggugauagauaauaggaccagggaaggagagaaagagagaggcgagggguaggggguggagagggggcuuaagguucauuauugggcagacuuacauuuaauagcaauuuacaaccaaguuauaaaaccccuggaaauggggguuaagaauggugaggcugucaucgcccugagcggagccccuccaaacggagcccggcuaauaaagacuccaaagccgcuauugagcccugauuggcacccgauggcucgcuacaugguaaugagccaggcagaugggugggggauuagccgccaacuuugaacagcuuuucuuugucacuguuacggcucucuuguuagcccucuaauacauuuauuacccauuucacaccgcucgagaaagugccccuugcuauucaaagucaaccccaaacccacccacugcccccuccccaccaccccccucaacacggcccuucucuggcugagcuucggcugucucccuccugccaccccagacaacacaucccagaauucaaggcuaucugcuggagcuuggguacccuaagcucaccacccaucagguggcuuucugaaggucugggauacaagguuggggcagagaggcccacauccaccugucaagcauggcagagagcuacuuaggggugugugugugugugugugugugugugugugugugugugugugugcgcgcgcgcgcgcacacaugcucgcgcuugcacacacgccugugcguacucauagggucuggcugcaccucggccaggcggccccuggguagcugguggggacagaaggugcucacugguaagacaauggcgaagcgugaaauucaauuaguucagggccugguuccaauuucacagccccuaaaugcuaaaggggcagagagaaugggagggagggggcgagcguuuuuauugcauuuuccucuuucauucuggggggcuuucuugccccuucucuccccccagcacagggcuuugaaggagucauucggacuccaugucugucacauccauuuaaggcgauguggguggagggagagggugggguggugggcacaggcugcucugcugagccccagacugaaggcccacucuccucccucucugccccaggggucccugugaaggugaccaacaucaaagauggcacaacccgcaccacaucccuggaacucuucauguaccugaacgaaguugcgugaguguccacagucugccugcgacccccaggaccgccaucucaagcaagcacaggccugggccugugugacuaauggucacagcuaaaguucaugaccuggaggucuggcaguuggccuuguagacauagagugcccugagccgaggguauugguuuggcauugguauugguuuaaauccacaaaccaugaacacaaaaguuccaaggcuaccaccaccuucuauggugggaccagcuggggcugcaggccuuuggcugagccaggcauuaggacaaagaaagauaaauccucagugaggguuagggucaagcaagucccaguauagauguagcgggcggagcacccagggugacccagacaauccguucucuuucagggccuuagguuacccacuucucuccacuugggccuguuuuccuggcucaggugagcugagacauagagccugagagucaguaugcccauaguuaggucuucagccaagccaagggcaccugcucaguggguggccucuguccucaagcuuugugccagcaccugaguccaagugacguguuucuuuucaggggcaagcacggagugggucgcauugacaucguggagaaccgcuucauuggaaugaagucccgagguaaguggauucgacacccagggcugguuucggcacuuuccagagcuccuguaccaccugggugucaccuuucaccccaggccaccuuggcugccccuugcuuucucuuacaccccgaugaagugaggacuggagaugaagugugaacaguggccuuugcacugacuucuuggggugcuucgagaggagccgccucuaguguugggaggggucugggagagaggucggccuggaggucaggcugucuugugucacgggcgggccagucagguuaagaggcggaccaugcagggccaauuucguggucauuaaggcacuucuagcaccaggcacgcaguagagugggacucuugccagggagggcgcugugagcuauacacaagaaaccugaacaggacgggccaauucaggcaugacuccaaagccuugcuagagacagauagucccuuucuauggcaugccugccacuuggcuggucuaggcugccauuaugggaccacggggccaucagauccccuuccugucuuggagaugagagagaguaagagagaguugauucccaggcaggugccugucucuguuuuuacacgacucccacucaguccugggucauuugcugucuauauucucuuccucuucacuuucccuauccauugagcauuuccaucccaggucccugccaguccguccgugucccccccccccccccguguguguguguguguguguguguguguguguguguguauguuauuaacaauagaguguuuuuagggcauucccaucauuugggcaguuagggcccccugaacuggggcaccugaauguuuaaauaccagugacacagguaggggcuucaaaucacuuugcuucaugguugauuugggacaguaacagcuaaauaaaaccaggccaagguucagucccagucuaguuccuuggggagauuuuuaaauugagacccuacgucccaagagagcugacacgcugccacagcagcagcugucagcugugagagaagaugcagaucccagacccuggcccuggggucucgaacuguuugucgugggccucaguuuccccuacugcauccugggucuugccuccgauaguuggggguuggguggagcuggagucgccuagccccaggguucuccucgccccacacugaucauccuccgugagaaucugcacaacugcagcucucuugagaaggccuuguaaagaacaauaugcuaaugagugucuccuuucauucccagccuaccuuugucucuuaccuauuuaacaucugauuaaaugucccuuugucuccaccugcccuugggagccacacaaagaaauuccuccaaggcagcugaggggccuugggagaaaguagcaccuuugggagaaaguagcacaguuggggaaacuaaggcccugaaggggugagggcucccugcaaguuacaggcaggacucagauugacggucaugcgcccaguggacauggggagaagcccuuggagccuggacuguggagguggacagauccagguucagacccaagcaugauagccugaccaggcucugugggaguguuccggucccugagggaauucugagugagcacaaagguagccguaagcccuagggggucccgugcugcuugggaaugugagacaccaguauccuucuuaugccugucggaugucaugucacuaauuggcugugccacuguccuacugaguccagagucacggcugguaggugcugcuggucugauaggguaguuacucauuuccuucucugggaagauaagagcuagccagaccgaccguccugccgggugaagggguacagugagugaaaagagguaacaggugaugauaaaagcugagacuacaguaaugagggaagacaaccuggagaaggcagcagugcacaguucccagcuggcuagauguaugauggagagaggauagaggggguagggaggucccagcuggccugguggugggucucugcagaccugguguugcaggccaaggcuuuggcacccagccugaguccugauccaauuucaucuccacugagaaucaacccuugugagcuuuuacuucccugccugcgaaugggucugggugcugugucuuggauggagguggaccacccuccugacugaggucccacaaggagaagcuaagugugucucaaucccacuggcuucuugucacccaucuggagcucgguccucagcucuaccuagauguugugugugugccugugggcagcugucccuaaaaguacaggaguuuacagucuuggggagggaaaauugcuguauagccuuagacaaauugcuuucugucucugaaacacuaaucuucaaauggaagagccagcggccaggagagcucuccaggaguuuacacgugccuguuuccaugcuugguaagcuuaggguacccagccuuuauuucuacacuccacgcaugugugagaaggcaaaagcagacaaugaaugaggguacuauggacuccccgugaggaguuuauuaggugaacggugacagaggugcuguuaaucguugauuauguugagggcagagcuggaguucuccagaccuugguguaugggggggaaugucauuuguauugauuuuacaaagcugguaauugucauccauucagagauuacucuugucuucuggggcgggggccagggggaggaagagcauaggggguugagcagcauccgcaucccaaaucccgggucuggguggccuggcucgcauggcaggcccuuguggggaaccuacagggucagagccugagggcuggggagccuggguggauuggcuuggcugcauuguggcuguuuacauacagucuuuaauaucacaucugcuuccuaacuccagaggggggcuaauuaagugaagugaaugaagucaguggggagaagccugaggaggaggaggaaggggaggaggagggagaggaaggggaggaggaggaaugaaaggaggaagaggaaggagaggaggaggaagaggaggaggaggaaggaaaggaagaagaggaaggggaggaggagggagaggaggaaggggaggaggaggaaugaaaggaggaagaagaggggaggaggagggagaggaggaggagggagaggaggagggagccugggaaggagccuacuggcuaagucugucccuccugccucuguguguucuuuaccucacucuucucuggccuucccuuauggcuucucacccacgcuccucuccccauucugcuccuuccuccacucacugccccccaguuccaccugccagucccugucagcuuucuuaucuucccuucugucuuccgucuucccguucucucucccucuugcccccugaacuucauuuucaggagagcagcucgcugcccucuuaucuagucuccccgcacaccuguccagcccucccagagccgagcucucauacagccuuacagaugaacagcaaggggagaccugggaaacagaagacugggguagcaaggucaggcauggcuagucucacacacccaagcugaucugcaggaugggccaccugggcacaagagccuaaagaauagcuuagacucccacccugacuuucucucaucaccauagcaaccaccuccagccuugguccugguaccuaagaaaggagcccuggggcuccagucaaucuaucuucuaccgucucucuaccuguccaccuucccaaacuccuuccuuccccugaaugcccgagccuccaguccacauacccugaccucuagccugacuccuguggguuugguagagucuacuuaguuuuaccaaauuucucagcccaaccggcaaucuuggcaacggaugagaagaauuugagcugcugcagcuguguaguccccaccucguccucaugguccacucucccccucccaccaccccagcuccuuggccuccccagccacuaccccccuuccuagugguaauuagggugugauugaagcugcuccacagagggcugcugacaccucugucuuucucguaaacacggggagaugaaaauagacacuuggagccgcggugcgugucacucugaagaugucuguugucuauuccacagcagcgcgggcucagcugucauuuccccccucuuugcucggugguuuguauacugacugucaaaagccccaaauccagucuuuuagaauuagguuucugucaccgauuuuuuuucagaacuacagagaaaucaucuguaccccuaccccugccaagaaaggagagagcuucaaaauacacacgcacgcgcgcgcgcgcgcacacacacacacacacacacaugcacacaacuaagagagcuaaaaacaagcccuuucugaucagccacaauuaacuuuaacaccgccugagaugggaucaggcauauuaacugugcucaugucucuugccugggacuuugcuguaagccugggaccuuucggcaaccgcugacaaccuugggcugguauggaacgcuagaggagcuggcuucugcacgcacuucugcccacucuuaggugcugguguugccagccucauuuucccaggggauaucugcaaugggcaguaacuuguaggccuugggcaacugauggaucuuucuggaacccuagauaccuguguuguccucucccuggccugcugggggugacgcuucaguuucucucggugugccaggacagguuagaaucuaguugcuugcucucgguacccaugucaaagguuaauguguaagauccacaguuacuuagcaacuuccuguuuuccccuuucggggcucugagaggaugcugggacagaccaaggccaugcagucaagccagaugcaacaucaaguuguugagacuucugguuccaauuccagcucugcacagacagcuggcuugggaaggagagaagugcagagagggcacccgagucucuaggagucaaaguggggugcugccaccucuauuuacagccaguauaaggacaggcuucuccacgcuguacaaaaacagaucgucacaaacuccgcugccuuagucaguaugaguggcugggcugugucagaggugaccaacaggccaugggaaaucucuuugugaugcuguugguguuccuagggugacugagauccgccucaguccuuguuuguaucccugccauuuuggaggcagauucuucccugcauuugucugucuuucuaagcagccugcuggaacucacucuguagaccaggcuggccucgaacucagaguucuaccugccuuugcuccugagugcuguuggguuuuauguuugguuugcuuuggguuuuuugaaauagaaucucagauaaggcaggcuggccuugaacuucugauccuccugucucuaccuccaagccuccugaguccuggaauuacagggguagaacagaacauccaguucuuaaaguuguugggcguggugcauugcgguacugagaacugagcccagggugugugcuaggcucuguguuuccuccucuguaaugguuugcuagcucuguguuuccuccgauguaaugguucgcuaguuguuguuucuagacacugucguguucucuaacccaggcagccaccaccacaugccucaaccuccccacugcuggaaucacagccaugugccaccaggaccugcucuuccugcugaggucccaggucccugcccucaggcugucagccauggcuuuucuugguccuccugccugucacugccuccaucuggacuuugcuaugggagugaugaggcugggagccuuguacacaaacuugagggcaucaagggguguggugggagucuucagauagauucuggaggguggaggagguucccuaaaauggcagccucauaaguaaaaugggacagguguguauguguguguguguuauuuguauguauauguucauauauguuuuggggugcauauguuuucaggugcacuccacacagguguacauguucagaggccagaggucaauaucaggagucuuuaucauauauauauauauauauauauauauauauauguauauaucccaucauauauauaugauauaugugagagagagauagagucucucacugaagcuagagcuugcuggauuggcuagacaggcuggcaagugaacuccagggcuccuccugugcccacccagaaccagaguuaggguuacagcaaccacuuuuuaaaaaagauuuauuuauuuauuauguauaugaguacacuguagguguacaaauagaugguugugagccaucauguaguugcugggaauugaacucaggaccuuugaaagagcagucaaugcucuuaccugcugagcaaucuugccagcccacaaccaccaacuuuucugugggcacugggaucugaacucaacucuccacgcuugugugguaagcacuuuagccagugcacggccucccaacccugggguagcuuuuacauggcauguguugccugagacccugcaccugaguguguucuuagauuccgaugagugcugacgcauggggcaaggcccugagaggccaccuggagccaggacuggaaaugcagauucuggucuuguuucuccuuugagacacgguagcauaggcaagucacuacuucuuagauuccaucuuccugucuguccaacagacuguuggcccaguucagagaccuuaggacuccugaggggugcgaaggauugauaaagguaccucccugucacccuccagcaggaccagagccacaguuucuaugugcuaggccucugucugcauauauugaguuuuagguuggccaccccuuagagaauacagauagcuuugguccuaaaaggucuuuuccuucugaguuucccauuccuuaaagaucaaaaaccagccagcuagguggcucagugcaucuaagugcuggccuuguuagccucacaacuucaauucccaggacacacaugaaguuagaagaaaagucaauucuggaaggucugauuucuacacacacucacauacaugcacgacaauaaucaaaauuuaauuuuuuacaaaaccaaguggacaccaguuuauacggugcuaggcuggaacccagggccaggcccccagcccccaggcauguuaggcaaacacuguaugggagucccggccccagcucugguugcugucugugagguauggucugguuguggagccuagguuagccucagauaaccuguuccuccuuccuuggccuccucagugcuugguagaauuguccucccagacuggcuagcaugucacuguugcugagccgcauaggccugggguacaggugugcagucuucugccuuuuguuuguuucucugugaggcccuggugguccagaccaggcuggccucgaacucagagauaugccugccucugccuccugagugcuaggauuaaaagcgugugccaccacugcccccuagcugcuuuuaaagcuuuauuguggaaagacugaggaguugccaagacaacagaaaagccgccuccucagcaccaugcguugggaagcaugaagagagaaagcuuuuggaucaaauucugagcauggcgcugccccugcccuuccuucaaagcauaguggacacagguuuauccaaagccaugccagaacagggcccagcaccaggacaggcacaguccugccucuuuggugccucugugcuucagauagagcaugggacuacugguugacagcucagccagggccacccugucacuuuggagaccuucuagcuuaagcagguuguguuacaaauaggucgacuaggugagaugacccgaaauaaguuggcuaggugaguugaccggaagggacuugagcaagcgccuuucuccagacugggcuuugccuucuguaaccagcuaacucacaggacagcuggccauacccauuagggauccaggagcucagauuccauucucucccuauccaaccacuucucaggggcucagcuuccccaucuguagaguggagccagugcucaagccccaggcaaccccaggcaucucugaagauguagcugcccaggccaugugugcacucgcguguucaugcaugugugugcacagccgucccccucccccgacuccccaguggaagggaggaagggcuauuuggggcccugggcuccaccguaguugguuuaauuacagguuuucaacugcaggccggugggcaugcauuggggaggggggcacugcucagaaacccugucauuuucccgcgucugagggccucuucaaaggggggcaucuagacauuuucuccacaagccgcagaguggacugucguggccccagcaugaacauaaugacagacgcauuuugcagcaagcugggagugaauggcccgacuggcuugucuccugucagacaagucauuauuuuuuuuuuuuuuuuuuuuuuuuuuugucauuugcugacaguuuggguuucauguguuucucucuuuuuuucccuuuuucccccugccuggaaaaauggcuagguaucuacgagaccccagcagggaccauccuuuaccacgcucauuuagacauagaggccuucacgauggaucgggaaguacgcaaaaucaagcagggccugggccucaaauucgcagagcucguauacacagguauguccgagucccagccgccccuggcacuccacccccagugacgcuccacccccagggccccuaggacucagaccuucacuuucaucaauuaugccuuccucccaucuagccccacccacuagcauccucuucagaacucucaaguacacauggaagguuggaccaggggugagggacagaggaagggacagugggguggccuuuuugugagugccaagggagacauggaagccuccaaaguuguuuaguuguauccauuacagugucaaaagaaggacuaugagucauucccaguguuagccagacugaauucaguaggaacccaguacuuggcaaagauauagggcuccagacaaccugcgugguucccacaaaccucccugguggucuaaguuuccuucuacagaugaggaaaugagcugggagccuguagggaggugggagugagggcuggcuugggcccuguuaauccuuccagaagacacugcuuacuaaccuucaaaagggcaugcgcagagaagcacaugcgugcccugagcaguucugcuccgggacccagacuuuauauacagucuucguagugggaaucaggggcccuaagccccagucccugaucagaccuggcuuggugcccauuuuucugccacuugugaacuaagaaucauuuuaagcuuuuuuuuuuuuuuuuuaaugauuggaaaggaaaccaaacuuucaugacauggaaauuaugugaaauucaacacagcccucaugucccuguagucccuuugggcugcaguggcagggcagaguugauuuagcagaaaccugaaggcauacacaaccuacaacaguggcaacauaugccucuaucccagcauucuugaucccuacaaguuuaaggcaauccugggcuacacaaugagacccugucuuuaaaaaagaccaaagcagugcuaucauacaccuauaagccaggcacacacaggcacucgugcacgcacgcgcgcacacacacauacacacacaggcaugcacacauacacacacacacacacacacacauaugcacuuguucacacucauuuauaggagacauuuucugaccuugucuauaauauuugcaccuccuuaguuuggacgauuuugucaggcagccucucagaaaacaggcuguugcugccaacagccaaccuuggcaguuuugugggccggaagucugagugucuggauagaugucagucauagccaccuggcugaggccucuggccacgccuguccccauccccauccucccaggccugcuggaauccaucccagccuuggcuggcacucuauccuccugccauuguucucagcguugaagugcaauccccccucuccagguacagacagguguuuaaauaucauggcuuccuacuggcucggcaggacuccggugcuuaaagguggauucugguuacaaagugggauugacauuaagacauggcagggcguaggggagaggagagagcaccuggcuugagugcccaggaggcaucccgagggcugagccuggcagaggacagugggcgggcuuccgggaucccacagugucagcaucucucacugucugcugucuuuuuggcacuggacuaggcaccugauggguguuaccuaaccuuagcugcacagagauggggaaacugagguccaggcaaagauacuuuaucagaggucuuguggcuaaguuacaaagguugaaccugacacaggcaggcuucaaaagucacucccacaggaccugggaagcuguuagaaaggauugauugggggcggggggggggggugccaugacacgcccaggaagccuuggcuacaggcacagugccuagguugagucccugcucugucagccagcaaugagcccugcaaaucccaaaaugaggcugagcgauuaggagcuuucaaaggaaauaaaaccuuggagcagagagaggaacaaggcagggagcaagacuuagaccaggucguuauugcuaacauuaacucugccauauccagguguccacagaggucagagccagcccucuggcuguccagagugcucuugauuggccccuugcuggaaggaggcauauugcagacccagccuggcuggaugcugccgcuccucucccuucuccucagcugucccaucuaaagaguggaaauggccacuccgaggcauggguguaccaugcaucuggaacagcgccagcgacuacuaacuaacugagaccuggcgugauuuccagugugggcgcugagaggcuuugccucugcuuggcuuuauggucuuagguaaaucuguuuccucccugggccucaguuuccccuccuguaaaucccaagggcucuagggcuaagacgugcuagggucuauucccuucccacuaagcaccccgguucacaacccaucacucuaccuuagagcuacccuuuuagcuuuucuguggucucagggcacaaauggggagguugggacacagagaagccuuccuagguucauaggcuuccaggacacugucccugacucugccugaucaucucccucuauuccccuuuuccugauuucccuacuggcucuacggaguucagugagacgcucuucccggucagcccagcaggacuccagcuucaggacccugaaggcgccugacgaacauuuuauuuaguagcuguaccucaccuaguuaacacgccuccucccgccuguccucaacaugaaaauggguguaguguauaacucuagcagacacuuguuccaaucagaacagaggccuguaugcugggcuugggccaggggagcccucuguagcucagccccaagccccacccccugugcaccgcaggccugaacaugcacgaucucuccugugccaugggaccaggcugcuggcccauuucaggccagguccacuagggaaagaaacuugagccuaagaccccugugggcuagagaaacagaucucagauaaagccagggccagggcucugagacugaucucugcccuuccuaucaacagcuccaucuccaccugccuuccagccugggaggauaauggacuaauuaucccaacugagaaaaucaaagagcaggcaggacacagggaugggggugugugugagggggguagggaugcagggcggggagggugauugauguccccucccaaagagaccaguggcguuuuaaaguccuugguuuagaaguguuccaucagaucugaauccugccaugguccugcugugugacuuuguacauguucuuugcuucucugggccuuucuccugguuuacaguaaggggccgucagaggucauaguguuggaacagcagaguuaagugcucacugaauccacauaucccugcagagcaguuaaguaaucauaucuugcuaugcgcgugcgcacacacacacacacacaagacugagcccaucccuucucuguggugccucuccaggccucuaacaguagcugggccuugcuaaccuacccucuuaucaggguaggagaucacagaccaucuggccccacagcugcccgggugggcucaccuuccuggcucuuucaaaaaccuucugccuggccugccccucccccaacccugacuauggccaccugcugcugucccuuggauucuggggcccuugcucucuccuaaaggaaaggcugucuguccaaggauguugggcuauagggggaggaagugugcuuccucagugcugugugcaaauagaggaugcuccggucauauaaaggaaagcaccuaucaugacaggaaauagucacugacccucagcucccacucacagacugggucagcuuggacaaacugcuugcucuguugacucuccucuuccuccuccauuggaguauagggucacggggcagagagaguaguucagggccuacccaggacaccauccaaagcagucccgcauacccagugcuuguuggguacaagggcuucacucagcacugcugcauuauuuugcaggaauggaaacagcuguaggccccagagccccauagccugucugaccacaaaccaggcuggccuuucugggugcccucauugcuuagccucauggcaugugccucugagcccuauccaagaucuccuaucuucguuagcaaaauggagcccucuugggugagggucagggucuucccauaacuccuguguaugccugugcaugaagaagggguaugccuuccuucugaccuuuaugccuuuggggacaaggaggucauuuuuugcaagauggugggauggggacacaagaguguguuccucagcucacaagugaguaaggcagaaccgagccuaucagaagguaaggccugggcucugcuccugcaaccccauccuuccugggcccuggccuaaggccauccaaaacacauucauuguuucuuccugcagguuucuggcacagcccugaaugugaauuuguucgccacuguauccagaagucccaggagcggguagaagggaaggugcaggugucugucuucaagggccaaguguacauccucggucgggagucuccacuuucacucuacaaugaagagcuggugagguaggcucccugugccucagcccaucugggcuugucugggcaucuuucccagcacauuuuugcugaucucaugucaagcucuuugugagaagacagugagauguuuaugauggacauacuucuguaaugucauggaaccuacaagccaggugggaagaaaagugucagucaaaugauagcugugagcuacagauguggcuaggagugucugccuagcguacaggaaaccucagguuacaguuuuagcacuguauaaaccagugcacaucauuguagcacucagccaguagaagcaggaagaucagaaguucagugucauuuucugaugcaaaguaauacuguccugagccacaugagacugaccccaaaaaucaaaacaacaacaaaaaaaaaaggaggcaggcaaacugaaauguggauuagaaaaaaaauggccgaauaggaaaaggauaguguggcuggguauaaaaguuaggcuguggcgcagcugccuuaucaggaguugccuggaggauuuaauggauuccagggauggcaccucugguucugagccugggaagggcuuggaagaauccagacauacaaggaaagauaccagggagaaaggaaacuaacaaaccagguuguaagaagggcagggucagauguucagguccuauggcuacccugaagaaugguuuucauggagugcacacaggcaaggguagacacuggcagugaugcucauaagguugcccgugagcaauacuggcagucuggacuggguuggugaucccccaaaaccagauugagucaaccuaucuuuaggaguugcacuagauguggagggggaggucagugugcaggaacacacuguggacgagucggggcauggcuguguuuccuguugguggugaugauaaaacccagggccuuacacucacuaagcaagugcucuaccacagauauaacacacacacacacacacacacacacacacacacacacacacacucccugcugucagggaaugagaguugcgggagucucagauguaaguguaggaaucucugagauagcccggaaccauuuugucugcuuuagggcaaugaguacaaaaugaagugacauuggagggccucaagcuuguucucugaaguuguggacagaagaggccacuggggucaggggagagaagcagggaauccuaauggagucuccaggaucuuccuucuggaaggaccaagcagugggucucuggcagacgggagucaccuaagcugguacugccuaggccauccuccaugaccaugcccaguguuuguuuugacaugggagacaugggagacacaggcuucacuuaugacugaggguagccugcccugagaaagccagccgucuccucugggugccacuuggccaaacuguggguggggacaaacccucagagacaggcagcacuaccaagaaguaccggaggaggaccccagccccagccggcucaggcggaggccuggccugcccucccagggaugagucggaauuaaaguacgaguuuuguuuggcguucaauauuauuucucuccuucccuucacccagccacguugaguugcuuccccccacuucaaucuuucuaaacacuuuauaagccauaaauauaaccgaaucaguuuagaucagucgggguaaaugucaaauuaucuucucucuuucucucucuggcucuuucuccccucccccuccaaaugaacagccucuaauaaucugcccaacccuucauuaaaccuuacagucucacucggggagauuaaaugaauaaaguaaaagggaaagggggaagacggagaaaaaagcagaggcacuuauucucacugugucuccgaccauuucccuuuucuuuuugauuucuacaucgcugacuugaaagcccuugagugacagcgucacagggaccagcgaggaagccgcgagagguagcagagcuggaaaugccgggcgcaguagguagaaaguaauguaauuauagagcaggucagagccacucgaaugagcaaaaauaaaagcauagagguuuuucuguagaccgucagaggagguaaaaaaaaaaaaaaaucauuguaaacucuguuuccacaccccagccccccgacacacaccaaagcacuauuugaaaaagagguuuuccguucucaaacaagcuccucuugggacucugggcagccucacggggcagggcuguccuuggugggcugucucugaggggcuccuggagcuguuuguccagguuggcuugcaaacggguggaggagcgauuuguugcuuuguuugguuuguuguuguuguucuucuucuucuugcuuuguuuguuuguuuuugagaugaggucucuuguagaccaggcuuuucuuagaugcaauaugaugaccuugaacuuuccuguacuucagacuccagagugcuaggauuacggcguggaguuuauuuugacuuggggguggaaggaaaggaggacccuguguggcccaggugagggaagguucagcugccagccagucugcucucaggacugaguacaggggcgcucguaaaggugagggcuuuggacagaggugaggcuggguuuccagagcuugugagccagaaggcagggagcaagugauguugugccuugugugucuccauucccggcacucacaaaugcaccuaagugggcaaggcuugaacauuauugcacaaguugguacccuggucuagaccagccuuuccuaacuuauguaggcacaauaaaggacacaucggugcacacaucuuucccccaggagggagcauauugguuaguggccagcuccugguguugucaagacccaaaucccaaagagaacucuggagaaggggagaaaaaacaaaaccaaacaggagacagggucauggagggcguaguguggagugacuucaggaccacaacagcaucaagguuaaaacuccaggccccaaggaacaugugcagaaacucuguguguuuuaggggaaggugagaauggagagucaagaguuuuacuacauagccuaggcuagcuuucuccucuccacccuggugccaaggcuauaggugaaugccaccauugcugguuccauguguuuuagggaaagagccacaguuaaguuggagguguggguucauugcccagggucaacccaagggguugauuaagagcuggaaguuaggugugacugagacuacaggaccacagugacaaacauuggagagagccacugauauauucccaaagucucagccuugggaacccgcauacuucccuaagcucucugagauacaugacagaccaagauggcugccggcaugggcggcugugggagaaagagccagaggguagaaauggcagagagggugguuguacugaggcccaccgcaggugacagaugcugugggaaugcucugaccauggggugccugggugucaggaugguucuguaaggucugcaugguuggacaaaccaggguaaacaaguuggacugugggacuucaugcuauaaauaccugccagcuucccucaacuccagagaguccauuagcugcuccagguagaaauauuaaauuuaugggucauuucaggcccugguucuguagaggaccucaguuuacaaauggcaggaagaauucacgggcccagaguuagcagagcugggacccaaccugacaccucuaccugccucgcaauucuuauacucaggauaagucuuauacucagagcaucuggggguuaccuggccacugacugccaacauggcgccuguucccacacaggacucccagaguuagacugagucgaggagggacuccgggguaggguggcuuggccuugcugauaagcucugcuuuuccugcagcaugaacgugcagggcgacuaugagcccaucgacgccacuggcuucaucaauaucaacucgcucagguaagagagaaacucuggaucaugccagucaucagaggccugcagcuauggcaagccggucccggugugacacugacccuucacgcaccacgauguucccgaccaugcaccucuaguuccucaguacccagccagcuccuguucucagcagggccugauagccaacagaaucagcggggacuggauauauggcucccuguauccuggccugggcucuaacaguugcccuaauauuuccagccacaaagacguggggcuccuugacuggaaaaaccaguugaggaaaugcccugaggagcgauagaaucuuuaugcugccacuguuucugagcuggaaggucggguggcaagucagucgcuguggccuggggcucauaugcaauagcugaaguugcuuggacccgggggacucacaccccuucccaaucuccaggagguucaagggagggugugaggugcccccuacuccccagugaaucccauaggagccuaugggaauaaaccuaacagcuaaagguguccagggcugauauguaugcucauagacacaagcaaggucauucauuaccacagcugccauagccaagcugggccugggcacuccucuagaucauucucauccuuuaaaacuuuuauuucauucauguguaugguuuguguuuuuaauauggaaaucagaggacacuuuaggaggucaguccuucauuugggggggggggggacgguguuucaagacaggguuucucuguguagcucuggcuguccuggaacucacucuguagaucaggcuggccucgaacucagaaauccaccugccucugccucccaagugcggagaguaaaggugugugccaccaccaccgcccugcugaaggacaguucuuaccgucuaccauguaggccccggggaucaaacucaguccuugaggcuuggcagcaaacacauuuacccacugagcuaccuugccagccccucauuugcuuuaauucuuagagaaauuugaaaauucccuagacacaggcccagaauggucaagaaacuugccaggagucggucagagaggagucguggugcccagcuaggaagaccaacucuagguuuuucauugacaacuccagauucucggggccugugucaggaagauagagauggcuucucugucuggcaaugugccuuagguucccggcagccaccccaggucugcagagaccucucugcagccacagcccccaggccccuccaccuccugccuccugcuucgccuguggcuuauaaccccauaaaccuuuugaaauggcccagaacauaauggccucuucauuucuccuauugccuguuaaaugcuuuaucuucaacaaugacaaacaauguuuuccccucugauaaauuaauuacauuauccugauuggaggagccaggggaggcuagggcaggagaggggacugaagaaaaagacaacuucacauacaucuuaacaaacagcugcccccaccgcccccauccugccugaauuaauugaacggagcgcauguuguuauugugaaauuacauuuuucuuuguuuuccaucugguuuacaggcugaaggaguaccaucgccuucagagcaaggucacugccaaauagacccugacaaagaggagcgggccuccccacucugcagcucucccaggcuucagcauuaauuguugugauaaauuuguaauuguagcuuguucuccaccaccugacuggggcugcuguguccccccccgcccccccacagccuuuguucccugguccccuauagccuacaaaaguggucauccaagggaagggaggguggcgggcagcugcagaaagcauaaaaugacaauuaaaagaaguuacauuagucuuuuau

SEQ ID NO: 749 - RNA, 6861 nt, Mus musculus
cagcuguucgccuagcacguugcgccaucggccauauaagaaacugugcaggaugucggaggugaugaccucugccagcgccaaccccggagccuucagcccuguuuugagcaccagggccucagcugggagcacagagcccaucaugggcggcggagggcucgccgcgggcgccgaaggacggcuagguggacuccggagaggugggcaacgaagaggggucaaaggaaugaaaggagaggagggugacacaacacgagggaggaggaggaagaggagcaggaggagggugcacuggggagugcguggcaagagauggcugggaagacagggagccaaaccggagauucacaaaaucugcagagauggcagaggcagcacggagggcuggaaguccgcggguggagacaaggguggauaccaggaggggugcgggaagggugggcggcggguggcuguagagagacaacgaccaaggacucucgguuucccacuagccuucuauacacccagccaggaccguccuccccuuagcaaaaucucagcucuuuuauaggagcugcagugacccuccuaauugguuauuaaugacccccugacgucgaaggacagacuuguacccggccaggcucgaaggagccuucaccgacagcgcgaggggcgggggcagcgugcggaccgcucagaauagucucccucugcuccucccuccccccagccuuccuccuccucccccuccuccucuucuccccgugggaagcuccaggcagggagggaggcucaacucgcggcccggagcgaggaagggggguggggggggacggguguugaaguaggggaugcugcgcagcgaggcuugccuuuacucccgggacuagacugagaaagagggggcguauggcugcaaaccccgcggguccccaugcucacccgggcuaagcaagauccuugaucacuguggaucccaagcuaggccuucaccuuccuagcucugcgggccacucccagagcugccggugcuuugccuaucuccuuaaccaagcccaguacucuguccgauccccaccucuccuucgucccacacccucugcucuuuagaggcuucacuccuuaagcugcgguggcaacccggacagcuugggagaugcagaucucuugcgcuggcagcgcuacccaagcgggcgcuucguccuaaacgggcuccccaagagcucugcucgcugcgcacagccaguguaaaacuuccgucaccagcacagagggcugcugaggagucgccgucggggcuggaucucaccuaccauagaaagguuaccagcccuaggaguacuaaguugggguggggaguauugaaaggucaucagauacucacaucuguggaauacccuagagcaaugcaagaugggaauugcagacacccaaaaugccucugaaauugcggacggcccagggcaaagccaucugcugggcccugcuuuggaaucagucuacugggauuucaaccuaggaagccaccagacguuccucuuucuuuuuggucucuuaaugaugauucuuucuuuccuggcuccuuucucuuccuuccuucccccuucccgcucucccccuccuccaguggauucuguauagucuuuccaagguaccugggagccagcuccacaccucuucagaaacaguugcuaagucgggaagaucacggcuuccugugugcaccgaagucuccuggauagccuuaagacugcccccacaccuucagcuccagaaacguuggagcggcuuugggcacaccucacucaacagccuaaguccucagagcccccuccccuacucccgcugcaauuucaggugacgcaaaggaaaguuccgcagcccuggaggcugguuugugugaguucccguguuagggcuccacuguacagugaagacucuucaggccuucgaagcccugugacuugggcguggauagcgcuggcagcucgggacugagauuugacccacgaaucagauucuaaugccgcuaggaaaagaacccuuuccaucaccagcuccucagagcuaagcuugccucgcucuuggcaaccaugggaucccaggucuauauaagcccuagucggagccaguggucuggcauccucagcccggcaggcgggagacuaaagcgccaagccggcgauaggaagucuuccgaagcagaaccucuggagcccaguggagaguggguguaccgggccgggagagggaccaacgggcagggcgccagcagagggcagcgcugcagaggagcaagggcugccggcggguaagaguuccuuacagaugccgccggugaguuaaauccuuucgcggagagguccaguuuggagaggaguauggaauccaauggcucgguggcaagagagccugaccggcgccuggaucuaaguggagaggagacugagcugggcagaagaaugccaggacuggggcacucagccuccaaccccgaaagccuuccucagcguuugcggcagacuaaagggaacggaagacagcagagcauccuggggacagcccuucucuucuccggaccucugggcuccugccugacagugguuugaguugaacuaugugcugugcugucuucccagccugucgcucuucggaucagaucguuuggcuuuccccggcgcugagcaggauucuuaacaauucccucgcuacacucuacugugaaauucucccaggucccagaguccuucaugccuggggcgaauuuucguuccaaucccaagauugaagucaaaagacagaaggaccgaaggcucugacugagaccaggacccccucauuacuuuccucaggucccccaaaaccuggggaaacuaugcuggaggagccuaaacagccuucuagcuggggugcccacggaccuggaauguaguugcugcgcucucauuuugagcuucuggccuagugauagucccaccuggcccuaugcacccucaaaauccaguccugcagggaggacugcccaccgggaucgaacaguaaggccugugagcgcgcaucuguuugcuuggaggcuucgagaagaaaugcugcggguucacagugaaggaaccacgucucugggacccaggcgccgagugugccugcgcgaagaccccucccauggacccggcugggucggagcugcaaagcaccgcccccgcccccuugaucgcgcccgcgggcugucgcucggcgaucucuuuaauauucaugggcguuaauagagaggcccccaguauaucggcccauugugggcggcucguagggcuugaauagacccuggcccucuuucuucgcagaggcuucccgaggggccgggccaggagugaauggccccucuucccgcuccucacccacccccacccccuuuucagggacaacaucuuuaucccugcugcugcugccgccgccgccgccgcccgagccccauucacucggcccggacucugggcggaacgaaucaaucggcugcggcucuucggaggucaucuccgccgcccgugccccaucccccagcccacgggaguggggacaagggaagcagcggccggccgacagacccaccagcgaagggaccccgagugggguguagaggacagggcaggauagggugguaaucggaugggaacgaucagaaaggguggcugagccaaggaacaccaagagggucucaggaccccgccucggccaggcauugcuaauuccaacuuguugccucuggcagggagcccaggggaccagggcggcagugcgagcccggagaugagucccgcgucccuuccagucuccagcgugcaucccuucggguccgcguccgcaaccgcgagacccggagcgugggaagcagcggagacucugguccagcccucagggcacgucgguuucuuucagugcgaaugggcuuugcuccuugaugaccagguugggccauucggaccgcggcagcguagaccacauuccaacccuuaaaccaacgccggucgucccaggccucagugccccgggcgcgagucggucaggcagggccaacucgauggguccccgccccucccgucccggaggcgcuaggagaaaagaagcccauuguccgccaagaaauacauuuuggggccccggagagaaagcuccuguuuugaacuuuagaagaaagucuccugcccuugccccucacagggagagauuugucgucccaccaucuccagggccucagagcgccgccuccucccgaaacaucugccgggggaaaauccacccuggagggcagaucgugcuggcuuuaagccccgagaacucauuaaaaagauauuagcggcgggggcaggucccgcgcagguaucgaucgaccggaaugagcccgagcggggcugggggcuggggugcggggacaagaaagcaaagaaugcggcggaucuguguccggaacccccaccugggcucagucuuguacacccgggcccugcgcugccgagccucccgcggcucccaggacgcccccagccauccaggccccgcuggcuucuuccagcuccuugccauugccugaggcuacaggcacucccccacuccgcccugcuuuaaggcuucgccccagcuuccugcuggcugugcgccucugucucgcacugagcucccgccuuucugaaacccucuaggcuuucaccacccccaaaccuggucucucucuuaggcaacaauucuaccuccucuccauuccaaacagggcucaggaaaugcucucuuuauaggggcccagguguacccccgcuccccgguuccgguagcuccagggcgcccccgcgggcgcggacaaaggcgcgacgggcugccuaaaccgaaugggaacucuugcgggccgggcggucuucaacagacgugacuggagcaagccgcugagagucggcuauggcuaggaaaagggagaugguggucucccuguuagcccuaucuccacccuaacuaaccucugagaccagugggagacaaagacgcgccccguacacucacaucgagaccccgagcugggcagacaggugaccugggacuagaguuuccccgcgcgcccagagcuagauggcuguucuucuuaaggcgucgcccccccgacccccauacccguaccccaauacccauggcccaucccucuucggccaccauccuggcuguccacuggaaagacucuggaggaggcugggaaccaggagaagcaaugauggauugacccaggcuucuggaggcagagggcgcagagguggggagagagacugagguagaggcagagaugggaggauacagacaaagugaacaucugagagacucggacaacagacaggaugaaggaagcaaagaauggcaagaaagccgggacuaagaccaucagaagaagucagagguaccgcugagaagaaggagggacuucagacacaaaauggggauacuggcuaaaggaugcuccaggaaagacgcagagagugaaagaggagagggagacuggaugcccuggagucaagguggcagccaucaaggggcaccaaggacccccuucccaggcuacucacaccucuuuucucccagagucccuuuuccauacccacccccugcaaccuccaucaccucaaccuuccugguuuguuuguuuguuuguuuguuuguuugauuuuccaaguagcuucccugaagggcuuccaguuucuagcccagccucccuguggucuuggucgcccaccccccagaacagaaggccaggaaggaggaacugccuguguccgaccaucugccucaccugcucccuggugaaugagggaggccuccgguuccuucuuuuuugugucagguccuggacagcuuggagcuuccagggcagaaccggcccuugaucucucagaauagcuuacaggaaggugcacccuggugaaccaggagugauggcagccugccuuagccuggugguccugacccuugcucuuuagggucugacacauacuaggugcugugucuauggauggcagauggcucucuuugucauguugguggcuucuuggcuuuauccacagauuagaaacacaaaacuuuccuuuccuaaaaccuuugguacccggaccaagcuuaggcuccagcuucacagacaguggacauugaagcaaugcccagggcauccuccuaacacugcuuucuuccccagagaugcuuugggaaccuauggggaaaugcccaggguuucaagugugcauucaagccaggcucuugcagauucuaccaagaaaagaaccaaggcagccacuucccuugucugugucuuuaucugcacuucccuugucugugucuuuaucugcaagaugggacuaaggaaagaaucucuaccugaaaauggaaaccaaucaguaaguaaggagaggucagaaugaaagcaagcagaacaggagucuaaguagugucugcuaagcacugguacuguuuccagcauuucucaugacucaucucaagcuauccucaccccaucacaccaacguaacugauggcuguggcaaggcacagaagacgauguauuucuggaguauuccauauauggaaaauaucaucaacuguguuccacuuaagacgacaacaauuacaaaugcuggcaagauaguucaaccaguaaggggggcuugcagccaagccugacaacuugaguuugaucccugggaugcaugugguguaaggagaggacugacucccuugaguugucauacacaaacacacaaaauaaacauuuuauuuaaaaauauugcuauuagugucugucggccucuguguguguaugugugugcccaaugaggucagagggaucugauc

SEQ ID NO: 750 - RNA, 10640 nt, Mus musculus
acaaaggcugcuaccucccuuuauucucuuuuuuuuuuuuuuuuuuuuaaagauuuauuuauuauauguaaguacacugaagcugucuucagacacuccagaagagggcgccagaucucguaacggaugguugugagccaccaugugguugcugggauuugaacuccugaccuucggaagagcagucgggugcucuuacccacugagccaucucaccagcccucccuuuauucucauauccacuugacucuggccugacuccaccaccuucucuccaaccacacacuugugcauuaaaggagacagagcggaaguggaaagagaccauucucgauggcacugccaugucuuugucuuugguuuucuuuuuucugggguuaggguaaggcuggaaauggaacuugggaacuugcacauuuuaggaagugguccacuccugagauacauccccaggucaccauguuuucuaccaggacaguuucauggggcauuacauuguguggggugauuggaagucauaaauucuccaaguuauuccaagguaagucagcaucaggccgggacacugugcucugaaagaccuaaaacuacugggacccaagagcccaacccaccauuaccucccccuaguuuucucucagaacagaaagacaggccuggcucugcagccccacugcaggugaggaauguguuugucagaugcuccuuggggaccacauggcagaguuuucacucccaaaacuggcccagggggugcccagucccauccuucagcucucggccucaucccuccugguccaaaagccucuggcguguuuccagcaugaucuccuccauuacuuccgguuuuaagauauccuugaucugaagaaaauaggaaacgguauucguucauucagaaauacccaucaagucagcuagaacgagggaaugaagccuggcuaguauacgccuucugcauuaugcaauccgaccaagcaagcacacaagcccagcuccagaaagccagacagcaaggugcucucagagagcugacaucagagcucuucugucagucaccagaugauguuaacguuaaaaaaaaaaaaaaaaaaaaaaaaaaaaaagucaaguaaaagaugucugaauuuugggacaggcaugauaacuguagaaagcuauuaugauaaaaaauccugucuggcaucuccauccuaaaucagauuccuagcauggggcuagacauugagaagacuggaaauaucccaggaauaugaauauggcagggacucauuaagguugccuccaggccaguuccugccuggguuaugggaaacaaaguggaacacugaagaaacacaggagcagcucacacgcagggaggagucuggguaccugaugcgcaagggaggccucauagcaguacaggaugcuggugucgaacagcaucauucucugaguuaccagcaagacuacacaguuccgaagccgggagaucaccucucgaucacuaagagcuacgggcuacacaaggacacaaagaggaagggaaaaaaaauacaaacaggaucagauaagcaaacagccacagaagccacagaagagagaaaucacauuuccaccauggaaccucaugucccccaaacaacaaaccguggaauuguucacuuuuuaaauguguacacguacaacuucauguaugcauaugcuccuaaguucaaaugcacguggaggucaggggccaaccuugagcaucauccuaagaacgccauccaccuccuuugucuuaucggcaagucccaggggugguccuaccuccaccuccccagugcugggauuucauguacaccuccaaaccugacauugucacccacuuccucaugcucacaauggaagugcuuuaccaacugagccaucuccgcgcucccuguuaccucugcaguggcuguuuggcuguuacccugcaacuuugcgauguucaccagcaaagcucaaguucaaagccaccgagucugucucuucagagaagaggagacccuuuuuuuuuuuuuuuuaaauuuauuuauuuuuccggguggugguggugcacgccuuuaaucccagcacuugggaggcagaggcagguggauuucugaguucgaggucagccuggacuacagagugaguuccaggacagccagagcuacacagagaaacccugucuggaaaaaaaccaaaaaaaccaaaaaaauaaaaaacaaaaaacaaaccccacaaaacaaaauaaaaaagauuuauuuuagucacaugauacacuguugcugucuucagacacaccagaagagggcaucagauccuaugacagauggcugugagccaccaugugguugcuggaaauugaacucaggaccucuggaagagcagucucuuaaccacugagccauuuuuccagcccagaagaggagacucuuaagugcucaugaauaacuagcucagaccuguucaaagcacagccauuucugcaggcacugcaucagacagcgagcaaaccacaagccacaagcaaccaucugcagcucacgcagagagguggcuucccaagacaccaccgcugagaugcugcaacaucucugugaguucacuuaagagugcucuacacuaauuucucagaaagcauccucgguggcacaagacuauugauacacuaaaaggcaacagggcgcagcagguaaaagcgcucacugaaugccaagaugauguucacucaccuccaaguuagcaaugaagcccccagcauccucauccuugugcucagguguuggguagauccagaugaaaccguuguuacccagaaucacugaggcaccacauggcaagucauggaaaugagucuucugucuuuucaccagggaaggcgagaccuggacuaaaacucccugaccuagcuaaagagacagaccaugagacaggcggaguagcacgugccuguaacuccagcacuuacaaggccagccugggcuacaugaaacccugacucaaaacaacacgcaaaaaggaaauggaucagaagccagguaggaggagcacagccucugagaggcuggggcaagaagcucgcuaauacucggccagcugagcuaucuaguaagaccccacccacccacccugcaggaaaaaaaaaaaaaaaaagagcaagaaacaaucagcuagaugaauacaaccaggcuucagaauauacaacccggcgugccccaccacuguccuuccugggacacugcaguugcccagugcacagacagcgugcacuuugcagaaaacaguucuggcccauagcuacuuacacaucccagaggaggaggcaggcagguuggcaagauggugguaaaggcuaucaagucugacagcugaguucaauucccagcacccagacaguaagagauaacaacuccuacaagauguccucugaccuccacaagugcgcauauggggcacgcacgcaccuaccuaccuaccuaccuaccuaccaaucguuuuuucaaggcaggguuucucuauguaguccugaccauccuagaacucacucuguagaccaggcuggccucaaacucagaaauccgccugccucugccuccugagugcugggauuaaaggugugcgccaccacugccaggcagcucauuuuaauuaaaagaagguagcugucaauacuccaucacuuccgucugccuucuaauccagaggaggcaugcuggccauuacagaaacuagagccaacgaggagucucccacuggccacauagcagauccauuccaugacucuaguuuccaucuuaaccucaaauucccaugccacccacaagaugugguccaggggauuggcaaaaccaugccaggucuugacaggucaguucuaagugcacauacaauaagaaagugucuacaacaccaggcuggauggaggucagcacccauaccuccuccuacuucaaguacauggucaggaacauggugacagcugccacuucauuaaaggacacugcuuuuuuauucuucucagaaaacgaugagaugggaaacaaagaugcccugauguguccgagaaaguaugcuaucuaaaauaaaccccauuaauggagccucacagaaacaggcaaaaaucagagacucagaugggaaaucugucucuggcagcacuaugauggcccuguagacaugguucuguggacaugcggccagccucacaaugcugggcugagcauucccagaaagaacagccucacagccucacagccccaagcagaggggcucuaccagaacagguuccuuaggaggaaauggauuuaggaugccaaccacucugcccggccaccggcgggagacguccccuauccugguaggucacuaguccaaaauaacuggguucuguguuguugcuuuuuguucuuagauuggagguugggggcagggggucaugcaggaagaggcagucucucuauauaaccaugcuggcuuccaguuuuaaucaccuccuucugccuccagggagcugagauuauaggcucaugaccccacacccagcuaacuaccaggucuuuaggucagcaugcagggagcuacucggauucagaacugaacuuaaagccucauagccugucuuaccuucccauauuucaggcuccucgugugcagagaaacagcuccauccgagaacacagccuggaccuccgccuacucaugugaugaaggaacaacaguagccuuggcaacccucccuugugccaccuaccugcagccagcuucucccccaccaccaucaccagcaggucacucuggccaucuuugauggcccucuaugggagauaucacuaugaccucagcuucccccugguugguuggcaagaguaucuugcuacaaccaaccuuuucauggauacauggucauaucaucugcgggcuggugagguggacaccugccaucaagucugucaagcugaguucuaucccucagaccaagguaaaagaagagaaccaacucuugcacguuguccuaugaccuccacacacagcaauugcacaaacaaauaugaucaaauauuuuuuaaaacaaacaaagaaaauuuggguccacauuuucuuaauuuggacacaggcagguccaugggcaagaaugauggccuaugccugacaucucagcacucaggaagcugaaauaagaaugcguguauuugaggccagccugggguacacagugaguuccaagacagccugggcuacccuuuauaauaagaaaggaaagaccauuggaucuucaccaugaaucacaaguuacaaaacccagagcaucguucugagcuaaggaaaaugaguguagggcagcagagcccugaacaugguacccuggacucagucccacaagguucuguuccccuggccagacagaguccgacacgcucgcagcccugugggggagagagaaugaggugcaggauacacugaugaggucgccuuccugcaagaagccucucauggccagcucauccuccgcagaccuucuccucugaaacacacaagcacaaacgaacacaugacacagccccucagaagggcucuccccaccacugcucucugcuugaagccagccaugguacuguaauacgaagaauuaugacaagaggucgccaggacgaggugggagcaagggagaggacaguagcucuccucagugggacccugaguugacaaucagacccugagcaacugcacacucacugugacugccccacucacccagcacacuucacaccaggcugucucuggucacauaucucccuucaccugaguccccaaccucacuccacggucccacuaugaacaucuguucucuggugccuguauuuccucguucuccugcuaccuuacagcucuguuaucacauauccuccgcccaucuauaauaugguccuugugggacucagcugugcauccuuuuaucugguacucuccauaggacccagcucagggagccucuccaaaauauaugacagacucaacaaugauauggacaaaagccugucacugucugcaauaaccaaguaccauucaagucacugaaaacuaaggacaagcagggcagaguggcacaugacuuuaaucccagcauuugggaggucaaggcaagcagacaucugugaguuccaggccagccugauuuucauagugaguuccaggucagggcuacacugagaaaccuugucucaaccccacccaccccacacuccaaaaagcaagcaagcuaaggcaaaccccucaagagacaccuucccugugcaaggcugggcaucaagaaaggaaaucagcacuaagauccuaagacccaagagccuccucucagcucccuccugggagcccacgccauggguguuucuggucuuaccacacacaagcugcugcccauguugagagcacagggcuagaagaaaagccucuguguucaccaaaguagcagaucuggugacaaaaccacagcaaccucaugugaagcagacuucucagguggagcaaagccccacagcccgaccgaccggacaguuccagagcaggcgagcacucaccagcucucccccagguagguucauggaugagaggagcaagacggaguccagccuggaauuggucucuaccuuccaccucuucuguugaaccugugagagaaauaaaugugggauagcauuucacaccaccccagaaacaaagggccccuucuucauacuuucacagaugaaggccccaaucccugagccgccagccuccuucucuuuaugaacacugacuuuaccucugugauucuccccacuacaaugucuccgaccucuccauuguaucugcaagagaaaacagaagcuuaccaauagccagcgggcuggccacacagugucugaggcugaacaaacagaagggaggcaauaaccaucuuuuuuagcacauggguauaauuacuguuuagaccugggaacuucagacucucauuagcuauccuuaaagcaucugcucacugcaagcuguuacauguccacacugccugccuggcucagacacuuugcuggucccucacccugauuccaagggugaaaugcccuuuguuaaggcccaggcauuggacugugucucuuuucuggucagagcucccucaauuacagugagcucacugaguucuaauggugagaggcugggcaagguggggaauuauccacaaucccagcgccugggugguagagucacaaagccaccugauaucaauagccacacaaauggcucuugagcacuuguaaagauaacaaacacaaggugaacacugccagcagcugcuuccccuucuccacagcaaacuguucucucccuuucagccccagcucaguaaguguucaccccaccccacacuuaggccaaaaccuugauuccugucacgcucuaggaugagcccaacacaaauccugcugagggcaccuuaaaaugcaggagggaaacaaagacauccagacuggaaacuagggaacucuauucauucuguuaacuacccuuaaauacaucaguuacugcaacacccuuacaaggacggaaaauaaaguauacagaggagcuagccacugcugagggcugcgcccguuaucacuuggucauuuugcagcauacaguucccuaguccagcuaaacaugcccugccccccuucacugucuccaugacaacuacagcaaaugauuaagauauaugucagaucacagcuuucaucuugauccuuuccaagggcuucccaaucgacacacuaugacucccaaaucgucaucauugccaggcagggugaccagagcgcagccccggcucacccgacuacucagucccaagcucauucauuggcuucccuucugggcugcuucuagguacucagcccuguguuuaaguacuuuacauguaacacgucacugaauucuaacagcaauccugaagugguugucuucuuuaugaugcagaaaaggaaaguaacuccaggcuugggaggaucaagugacgugagagaaccugugacgugagggaacugugaggcucacccuccacgcaaugcccuagcuuacuuucugcugugauaaauacuacaaccaaaagcagccugagagggaaggcuuucuuuggccuauagaucacacuccaucaucaaggagcgccgcccagcaaccuggaggccaggacugaagcagagucuauggaggaagccugcuugcuggcuugcuucccaggcuggcucucacacugucugucugucagucugucugucugucucucucucucucucucucucucucucucucucucucucucucacacacacacacacacacacacacacacacacacacacacacacacagcuguccuggaacucacagagccugccucugcucccagggcuaggauuaaaagcauggccacaaugcccuuucuuacccagcccaggcccagcugcccaggcagggauggcaccgcccacagugggcugaguccuccuacaucaaguaccaauuaagaaaaugcuuccacagauaugcccacaggcaauccaauggaggcaacucuucaguuuagguuccugcucacgagguaacuccagcuuugugucaaguuggcugcuggugcugacugugauaaacaggaacauucaacauagcaggcuugugacaggcacgacuaaucucucugacaugggaagacggaaaaggccuguguagaacucagaugcucugagaaagagauacacaccuucuguccucaccugguuuucaaggcuuugacacagaucaguuuguucacucucuccacagagccggccacagacgcaaugagcuucucuucccccauguaugucccauggccccugcgcaaggacaaggccacaaagaaaggauaccaggauacauuggaggugaucuagaacauaguucuugaaccuaacgggcucccccagcccugagccucacacucuccgcagacagucacauggacgucuccaucuuaaaguaaugugcucaaaugucacugccuaacauccuaccuccacaucccaggcagcacagggauccccaacugcuccugguccaccccauucccaacuacacaccuguucucccccuuccgcugcauuuacgauuuucuuguggcauuuacuguuucuguuccuugcuauaucuuaaccuccaccaggacacggguguucacuuugguaccccaaccacaccggcuauguugaacacaugcugcaacuaugaaggaaugaauccuaagauaucugccaucuaauaccuuaaacuuaaagcuuagaggcaacacuauaaacacuauaaucucauuuguaccaaaaaaaaagaagaaagaaaaagaaagaaagaggaagaaagaacaaacuaggugcaacggacaaacggccacaccuuugaguuaagaauuugggaggcgggcuggugagauggcucagcagguaagagcacccgacugcucuuccaaagguccugaguucaaaucccagcaaccacaugguggcucacaaccauccguaaugagaucugacucccucuucugguaugucugaagacagcuacaguguacuuacauauaauaaauaaauaaaucuuaaaaaaaaaaaaaaagaauuugggaggcagaagcagguggaucucuugaguucaaaaucagagcggucuacauaguaaguuccaggacagucagugcuacauagugagauuggaggguugggggugagggggggggacgacggggggggggggacggacagacaucgggaagacuggcuaccuaaugcagauuuaucuuuggugguaauacaaugguggauuuugcucuccugccccacuuuucaguuaauacucacuaaccuaccaauuccuguugucaccacugucuuccaggugaggauaccggccuuagcaaggugcuaaacuaaggauaacaaugucagauguccgacuccauagacagcccuaacugccacauguugugacuuuccgugcuaaauuuguauuguuggguacaauauguugccucaacccccgcuccaccaaaauuacugcuuccaagucaggcuugucgcugagguaacacugaaagagaugaccaaccccacuguccauucagaggguuguaagaagggcccugcaaccagcccuccccaguucucccucccuaggaaggcucaagaaucuugaguuucaggauaaggguccaaaaguuccgaacgccauagaucaaaagagggaaucaggaacugacaaaggugcagccaagaugccgggagucagaagcgugaggcucgcaaaggagggaacuaguauggaugcuccgaugugucccggguaacucggggacuuagauacaacgggacaggaggccuggguuccgggacagcgggccacgugcagagagcucugcagccgccuccugaggccuugggacccccaaauccucacguaccgcaugaagccuguguccguggugaucgugucccccggcaccaccaaguguuucuuagagucgcggcccaagcucucacugagagguuugcgagcuuuagggagccucaucuccaacgccaucuuggcgccaaugacuugcgcaggcg

SEQ ID NO: 751 - RNA, 860 nt, Mus musculus
acuagggauuaacccucaucugacaggugagggcggaggcugaagauggcugauucauucagucaguuucuggucagagcagagguaauguugccaaagccacucuugccucccauguuaucuuugcagacuuacugaguaguucagccuugaugcucaccagguggggaagguaauggucugcugagcacagaguggggaagguaaugguccgccgagcacagagaggucauuugcugaggacacagaccuuagaaacgaauggcagccucaucagcagucucuggagcucacagcuucucacaucccgggagcuugguguccuggggacaguauagggcacauuccugaagguguucaguucccugaguagagcucuaguaagcucugccccuagcugcagagaacaccuaccaccaggcugacugugaaucugccuagaggcucaacaggaagcugccugggguugcuucuaggugaccuuugcccccaacccugucugaguacuguggucucaccucuauaggaguuccucugugaccagaaguacagugaugaagagaaccugccggaaaagcucgcagccuucaaaggugagccagggcugcuggcccaauagccccgagagagagagagagagagagagagagagagagagagagagagagagagagcuggcugcuuccucagcccauagcacacaggcucccuuggccccacaggacugggcugcagcucugauucauccagaaugccccacuuuccauagggcuuugagucagagguccccccaaagagucaggagcaggcccuuuccccuuccugugucccugugggccccuggcugccggcuugcucug

SEQ ID NO: 752 - RNA, 703 nt, Mus musculus
cucaggccgucucacucugguguucugagguuggaaagcaggggugaugcuguggcugacuagccugcccugggagcuggccucugacaugucuguuuucugugagagcuuaaucucuuguuuuucuaccagugcugacuaucgcucucauuuucagucuugucugauggucaaagcugucuuuguccuagcagcuuaguuuucaaagcuuaguuuugagcaaagaccacaaauucucauuauucacauucagcaauagcagcuuccaccuaagguauaaaauaaugaaagugcuuuauggucugucucuuagcacugaaauggcacagcuuuuggguuugcuuugaguugucuaauguuguuuuggggugggccuucugcagccagccugucccggucagccuuccuaucucagagguacuaugaagacuuagaugaaggcagcuccgcgucauccguagcucagccucuggagggagaagaugcccggccaaccugcacaucuguagcucagccucuggagggagaagaugcccagccaaucugcaaagaggaagaggcuguggucccaguaccucggcaugccccugugguccgcacaccuucuauccaacccagucuccugccucagucgaugcccuuugcaaagccucaccugauccauaguucuucaccugccgugaugagcucugcagguaaguca

SEQ ID NO: 753 - RNA, 15295 nt, Mus musculus
ggaugcuucauuugcauaucacuguauugucccuaaguguuugacuuggaaacgaccuauuaggucacacagaguccagccccugggggccaaagcggcaucgacgcccagagaccauggcaggaaccuucugcaggccuugcugugggcaccugccuuccccaggccucagggcugagugcugggagaggcuagcucacaccccaggcccucuggcuccugggcagcagcuucccagauucaauagguuccuggugggcuaauaguaaugucugaagagaaggcuccuauggucagguaaauuucggagaugcugagcuaaacaagacuucaguggcugggugccucucgugaacauucacugugagggcgagugugcaggacuuccccaaauguacuggaccacaaaagccuuuucggagaaguaucuagugggccagggcccccaggcacccuuuggaacgugcuacccuaagccgucggugaccuguguuggaugaguggugggcauacuuccccgaacuuugugccauggugugguagcacaguacagcuacugcugucauggugacgaguugacaagacucugccccuccuacggccaucuuguucuugucuguugccuucagacaaggaauggaggguaaacacgacugcccacgugaguuguuccggcugccucugaggaggcagaguccagugagaaagacaagccccacaguacuaagaaaccagccuccgaccagguuggggaaguugagucgguccguccccacucacugacccaccucuagccaccucucuggggccagcucugcccagagcccagggggguggugaguggcggcucaccaggcagagaugagcaucuggcagguguuggaggacauccacacgagcuccaccaggcggaacuggaaguagccgaugaugaagccugagaugacgucuguaaugugguggcguccgaucaucacccgagacaagcccacgcagaaggcccagagcaccagcagcacgcgcaguggcaccgccagcaccagguggcucaggaagaacuuggacaccauggcggcacggcuggcguggccggcagggaaggcauagauguccauggugagguaguccaggagcccagggcuggucucauaugggccgcggcgcuugaugagcuucuggacuccagccacugucaugauguccaagagcagggcuguggacagagcacagaggccugcgugucagugccaccggcugaccaagcuccuguccuuagcccuccugcuuccauuggcugacuaggcuccugucccuagcccuccuugcccucaccagcugaccagucucuggucccuagcccuccuugcccucaccagcugaccagucucuggucccuagcccuccuugcccucaccagcugaccagucucuggucccuagcccuccuccuuccauuuggcugacuagacuccugucccuagcccuccuugcccucaccagcugaccagucucuggucccuagccccccuccuccauucaucucucuuggccucagugaccucagggcccauucccacugcagggccuuugcacuggccguuccugcuaccuggaauuucccugcucccuucagcagagagacauguuaccccuggaaccuguuuguagaagcucccaccaugugccuucauccugauuccauuuucucacugucuggccuauugaacauuuuuucuuccuccucccccaccuuucacgugugugugugugugugugugugugugugugugugcgcgcagaggccaguaguuaacaaugaauaccuuccuuguucucuaccuuauuauuuuuuuuuaagauuuauuuauuuauuauauguaaguacacuguagcugucuucagacauuccagaagagggcaucagaucccauuacagaugguugugagccuccaugugguugcugggaauugaacucaggaccuucagaagagcagucagugcucuuaaccgcugagccaucucuccagccccucuaccuuauguuuugaggcaggaucucucucugaaccugcgguugggcugacaggcaggaaaccuuaacaaccuuccugucucugccccauacagugccggaacuacaggcauguguacguggacaugcccugugggugcuggggauuugaacuuagguccucaugcuuguguaacaagugcucuuacccacugagcucucucugcaguccauccuugaccucugacaucuuaucucacucuucucuguucccuagugacggugccaugagcaacuccagguaccugcaggauuccagggcugagauauggggcccgggcuauagaauuauuuucaaaguaugucagugaagguuccccuguuuucagagcacaacgguuucuuauaaagcugaaacgcaauucauaaacacacacuccgcagugugugaacacagaagccaguggcauuugugaagucauggugaugugcacccaguagagcaggcuagcucugaacucacagagauccugccucugcccaccaaguguugggauuacaggcaugugucacacaccuggcuccucugugcaccacuaaacugcccuccacaacugccaggccacacacagcaccucaccuucucauuugucucuccuucuuucuggaauguucugcucuuuccccacccaccgccuuuucuccaguguccuuuucaggccucugggaggcucacccuguccucacagacaagguuggaccugggcucugugaacuccuguguaguggcuacuucucaugauggugagccuguccuaaggcuugucacuuggccucacacuggguggcggucuccaaauguuaguugaaucaaucacugacuggaaacuuggcugggcucuuuucccauguuagaaguuuggagagccaggcagugguggugcacaccuuuaaucccagcacuuggaaggcagaggcaggcagauuucugaguucaaggccagccuggucuacagagugaguuccaggacagccaggacuacacagagaaacccugacccgaaaaacuaauaaauaaaugaaugaaugaaugaaugaauguauguuugggggaugccugaggcuccaucucagcuaccaucccacuauguggccuucgugggcugcucugccuauuugggccaucaaaggauggcaucaugccagggcccaacuccacuggcuggcuagucagaguggcuuccagacugccaguguggggcgagggaaaccuuccccagucacaaggaagccuggagcucacaccuuucugcucuggagcuggggcuggcguuagcugcagacagaccagcagugagguauagccacugugacugcaugacuuagaauaagucaccuagcuguccccaccugggagguggagaucauagauacuaucucucugaggagggacaguaugugccugcaaagguaacuagugguccugggcaagggacuuaggaauuccuaggaccuccagcacucugugcaaagccggaaaaucccugccucaaaagccuggcccaucaaaagcuuggguuugguagugaccauuacuggaggacaccuugccaggauccugacucuaaaaccccucgguguauggcaauggcugggcucucagucaucacuuucaugggaauaggaaaggacagaguuagggugcagcucagugacagagaauggguuugucauguacaggaacccagcuuccauccccagcauaugggggaggggauuugaugguggacuagauguaguaacgcaugccuguuaucuuagcccucuguaaguugaggcagguggauaaugaauuugagaccagccugggcuacaugaugagaccuuguuucacaagacccagcaaacaaguuggaacagcuauuggcuuccacacccaaauucccggguagaguugguucuggagauggaccagugugugcuagaccuggggucaaacaggguggccaagcuccuuauagccaagggggagauggauagucaccaaaugguugcacagagcaguguuauuacagccugugggaaagugccucgguagauagcagcugccuauggggcugugaggaagcuguggagcugccuucucaaugcacaggcuagaacaacucuuccccagcuuucucugguuggccagcccuggguguggccauucuuguccaguaaccuggaaccagaaauggaaacaaagguugccaucacucgaggcucugagaacccagcuugccuuggguaaaccacccgacaccucacuuagaucacagugggguaaggagcuucccacuuggggagaggcucgagcuggagaaagcugucugccuuugaucugugugggcuugaaaagaucaguuuacuccuugggccuccacguacugagguccagcagguccagcagggcagggacccaaggaaagagaccagauucaaacuugccgcuugcagaagacaugaacucugccaucuccucccggcucccaucccuuguucauacucauagggagcaacaaggacccuguuuugagggcuggccccucaggcagugacaaugagagcgccuggggccacagccagggacggagaaggcucugcugucucucacuuccucugagccugcaguagucacccacagcaccugucccagagggaaucaggagcaggcagacgcccaagcauucuggggagaaacguaguuguccccgaggccuggcuaucaagaaggccucccccuggcuuuaggggugaugagggcccaucuuaucccucuagcucagcaguccucugggccugugguggccaggaaacaagagggcuggaaaacccuagagcaaggcagagccaggccuacugguggcugugaaucagggagguaguuaggaggaucucacauguucccuuuggagcuugggcuguaagugccuagaagguggucccugggugugcuucugagaccuggugaagggugcucgcugcagugugacgcagaacccugcagcucgccccucugcaggacuugggcagugauacagggugugaguggugguagggguguuggccagcaaggagcagagauagguccuuaacugacaggaccaggcuuguagguuacagucaguugcugagguggccuccgccucugauucccauuccgggucugggaagcgaaagccagcauucuauagcuacuggggaguggauguugacaggucugucugguuucugcagggaucuugcuugacugaaccccaagcuucugauuucuuagggcugccuccuugagaagagaugggguaugcaccuaacuccugcuuaaggaugcccacugcaguguugugucucagaacccugagaaccguacagugacccagugcccuucaaggccagacagauacaaagcaccgcgcaugacugagucuagacaaugagugcccagcagccaccgcagaugacaaggcugccgcagccguguauuuauagccaccaagggagaggugcggggcggguacgcuaagggaaaaggccaacuacaagacaggauuuacaguuacaccauaacaugagugauggaggcugugucuggaaagacuggccugugaggugcuagccugccuggugucaggguuucucgcugagcagggguagugugggcaggugggggcgauggacagugaauuuuacauugucuuucugaacucacuccccccagcccccgugggcauguaauuuguauacauggucuucagauuauuuucggcuggggauguagauuaguggaaugcccugccaagcgcacauggggcccuggguucaguccucaacacggugugugaaacaguggugcaccacaguaaucuuccacucaggaaauggaggugggaggauuagaaguucaaggccaugccuggcuacauagugaguuuaaggccagccugggcuacaagagacccugcccccaucccuaguuauuuuuacaaaauaggaaauaccauagaaucccuugcaugagggaccuggagcaguugaguucacagacacagaaguagaguuugggugugugggguugggagcgacugcaguggagagcuaggguuucauggggcggaauuccaauucuguaagaggaugaacuucuggggauauaacugcagcgacaucugucacugcacaguaguguuuaaugccaaugaacaguguacuucgaaagguucagaugacauuucuauuauauauccacauuugcaaaaaguuauuuuuaaaaagucaaagcaacauucuaaagaacagugaucucccuggggagcguucaugaagcagacagguuggggggacacagugggaggcuggggugggccuguccuuuggcuuugaguucccugcucugccgucucaugugcauguguggcggcggcggcggcugugggugugcacaugcagucagcagcucuccugucucuugugaguccccuccaccuccaugccgugccagccuucuguugggugggucuggucugcuuuccacucuccugauucaaguggcucuucacuguaaacaucccugagccucugcuuucucaccugaggaguucacacaugaagcugacuccagggagaccaucagaacccagggcacaaagccccaggguaccagcucagcugaguagcuugugcuacugggagcaggucccagaaugaaccuacagauugugugacugcccucggcaggccugacuugcccuguauagugaauuccuuucuaucacaugucaaaacccugacccagacuuggggugaccaaaggagucuaggugccauauaauaucccuaagaugauauaaacuggcaucgcaccuuuggaggcagccguguacccuacugaggauuugagaucagucuaaauagccuucagucgggcaaggcacauagucuuuucagagguuguuccuuaaguuguccccaagagcuagagcuggugggcaggagguaggagaggugacagacguaucuucugcagaguugccugagugggaggcucaaggcugaggaggcuucauccccuguucucagcauaaaaggacacgggaugggggaggggagugaggauugcaaagauggaccauacagccgagcaggcuccagagaguagaggccacucgagucaaacacaacagggcacaugcugucuguugguaugugcaaggaagagccagagacauggugcccaaaacacaaacaggcuacucuuggggagggacuaaaggacaggcccacuuucuuugugaccuaugucacauggguggcaucaagaccaccauagccuuaccaaagcauuucuuccaggacacgggcccagcaagcuucugcucaaucucagacuaacgcuguugcgggggcuagucacuguagcucaggagcauucucucaaauuucugcuuaauccuacuuauuuuugucuuuuaaaaguucccucugggggcuucuaggauggcucagaugguaaaguaccugccguucaugcucaggauccgaguuuaguccccagcacacccauaaagucaggugugggggcggugccucuguaaccuggcaauaggggauggagacugguggauccugggagcucacugaccuuccagacuaacuaaaucaaugaccaaugacacugauuucaaaauaaugagaugcagagcagcugaggaagauuccagaggagccucuccacacaggcacgcacccaugcacacacuccugcaaacaugcacauuugggagggaaggauaguuagcuugagaccauccugggcuaucgugugauccugucucaaacaaacaaaacaaggguccuggaggcacauaacuguaacccagcacuugggacccagcuacauagugaguuugaggccacuuugagcaacauaagauccugucucaaaaguuccaaacaaauaacaugaaccaaaacaacccaacagauaauaagugcuggucauggugaaacucauuuguaugcuagccuaaaaaauacagaacaaaaaacaacaauaauaaaguguugugagggcguggagaggcugggaugcuugugggcggccaggggaagguguucacguucaaucacugugaaaaacauaggaaguucuuuccaaucucuguaaacacaguuccucagugacccagcaucaacuuccgagcagccgagagagccaggaguggagcccgagaugcaccgccccugcucccagcacccagaguggagaccuguaucgcuggaugaugggcaaacucgaugggcuccauuugcaguguaauacuauccagccgggaaaaggaagaaagucaggcugcugagauugcuuaguagaugaaggcaccaagccugauguccuaaguucgauucccaggacccacauuaccacagguuaucuucugacugccacccagacacacuguggcacauacuccacccccuccaauaaaugcuauuuugggggguuuugggggguuugguuuuuuuuuuuuuuuuuuuuuugguuuuuugagagcggguuuuucaagucaguguagcccuggcuguccuggaacucacucuguagaccaggcuggucucaaacucagaagucugccugccucuaccucccaaguacugggauuaaaggcgugggccaccacugccuggcuugaaacguuuuuaauuuuuuuuuuuuuuuaaagauuuauuuauuauuauauguaaguacacuguagcugucuucagacacaccagaagagggagucagaucuuguuacagaugguugugagccaccaugugguugcugggauuugaacucuggaccuucggaagagcagucgggugcucuuacccacugagccaucucaccagccccuugaaacguuuuuaaaagaaagacgaggcucacacauugacacaucagaauaaauccugaggacuaaaagaaacgaguuggucacagaaagacauaugccauggaaguccaugccuaggaagccacucauagacaggaaagagggcugcugccaagggcuggggugggggauggguacggaguuguguguaauggaggcagagcuucagguggggcaggugaaaagguccugcaggcagaugacagugacaauuucacagugaggaagaugugcuucaggcauuaaauugcauauccauaacauaccaaaaugaucucucucacacacacaaauaaaguaaauaaauguuacucuguguguguguguguguguguguguauguguguguguguguacacuuagccaguuaugugcuuggugugcaaacacugagagcuucaguagcaauguaaaagccaggagugacagugagcgccuggaaucucaccacuggaauggcagagacaggcagagcacugagcucaccagcaggaggcuagccuagucaugaguuuuagguguguguguguggggggggggcggguguuuuaaagaaugaggaagggacaggcugugguggcgcacaccuuugaucccagcacuuuggagguagaggugggcugaucucugaguuugagguuagccuggucuacgaugugaguuucaggacagccagggcuacacagagaaacccugccuugaggauaaauaauacauaaauaaauagaaugaggaggaagaggaggagaggugaccuugagaaaugguacuggagguuguccucugaucucugcaaugcaggugcaccugagugguggcuuucauuagaaugacccccaucuggucauauaccugaauguuuagggaguggcacuauuugaaaggauuaggagguguggccuugcuggaggaagugugucacugagggugggcuuugagguauaaaaagcccaagccaagcccagagucucucucugucuuccugcugccugagcauccagauguagaagccucuuauuucugucugugugucccucugcuuccugccacaaggaccgugggauaaaccccugacacuguaagccagccccgacgaagugcucugcuuucguaagagcugcugcggucacagugucucuucacggcaguagaacaaugacugagacacuugcgcacacaaugucauguucacagucagcaaagucucacuaauuacucaggucaggggcuggagagauggcucagaaguuaaaagcacuggcugcccuuccagaggaccuggguucaacuccuagcacccauauggcagcucacuguuuguaacucugguuccaggggaucugacgcccucacacagaaaaguaugcaggcaacacaccaaugcacauaaaauauaaauaaauagauaaauaaauaaauaaauaaauaagauaaggaccugggucaugguaacacggcacgagucacuuccuaccugagauaggcucucaagaaaaggacacacaaugagaagggacgggcccagucaccuaucaccuggcucccuggagggccaucaagccuggucaagugcuuagcaaagguguuggugucacugcccuggcaucuaggacacagaugacccgguggccuacugauggugacaaagcuagcacugugauagccauggccacucaagugcucccaggcuuagcacaugccaaacucauguaagaaguaagauacuuccuucaaguguccuaaugacccauuugacagaugaggaaacugaggcuccaagaggugaaggcacuugccuggggccacagcagguccugugguaugugcucaggucuaauugauucugagcuuuccucagcugcuaagauggcucugcuaggcucucuggagucuagggcacaaggcagggaggguagaguuuuggggacuguccuggggcccagcugccauuuucuacugccuuucuucuguuccucaggguccuggcuguaggcaugagaccuuguuucucagcucagaauguucccuggguacuggucaggugccccgugcucugagugugggcugaguuggacagaggccuccaggaccugcaguuccugcaauagugacaucagucauugggcuuuaccggguuccuucaaauccccaucacagauuuguagcuccugaggugggcacugacuaaaucaagucuucacaguaaguaagggccagagguggcaaacagaguccagggcugacaguaccccagggguucagacagcuauauaagggacaggucugcuguucaguagaugauggcugucccagaauggaggagguggcuggguuuccuacuagcaggugaggcuuggauggugggggccaaggccuaccuugcuauuuuguuggguuugguuuuuugagacaggaucucacuacguacaccaggcuggccuggaacucacagagauccaccugccucugccucccaagugcugggauuaaaggcaugagcaccacuacaagccagcuguggcauaagcuuuucaccccagcauucaaaaggcagaggcagguggaucucggugagcccgaggccagucuggucuauagagugaauugcaggacagcaaaagcuacacagagaaacugucucaaacaaaacaaaauaaaauaaaauaaaacaaaacaaaacaaaaaccaaccaaaacaaaaagcaugugcccagccuauuguuuugagaaguuucuaaugucgcucagguuagcuucaaacuauguagccaacuauaaugguuuguauaugcuuggccagggaguggcacuacuagaggguguggccuuguuggaguaggugugucacugugggcaugggcuuuaagaccuucauccuagcucccuggaaguggguauucuccuagcagccuucagaugaagauguagaacucucagcugcuccugcaccaugucugccuggaugcuaccaugcuccugucuuggugauaaugggaugaaccucugaacuuguaagccagccucaauuaaauguccuuuauaagacuugccuuggucauggugucucuucacagcaguaaaacccuuaagacaccaaugguggcuuugaacaucugaucuucuugccucugucuccugagggcuaggauuugggcacaagccaccacaacagcucgaugugcugagcaugggacccauggcuuugcgcaugcuacaaaaaaagcugagccccaguccaacauuguguuuuuugucacauucuucucccacuaagucaaagugcuggacgccacacuccauagaggcacuauggccccagagcuacccugccugcuccacacagccugugcgaguggcuacuccugugacagugaccaguagacccacagugacagagauggcaaagguucuagcuagagggcuuggcuccuggaccaaccaugguggacaagucacuugauccuccuaagcaucagcuuuccccucuguacaauggacauagugacauuuccuuuccacaaucacuagaaaggucuacugugucauaaaauaggcacguauauggcacaucauuuggucuaugacaaagcucagugaggauguucuugccaaccuuuuuuuuuucuuuuuuuuuuugacugggauuugaacucaggaccuuuguaagaacagucagugcuucuuaaacagucaaaaggcacugcugcucuauucaagagcggggcaccuugagucccacucucaaaugugguugcuggaagggucuacaaacacuguucuaauaagugacuuacaaagcuucugcaucuggggagagaaguguuuguagaggcgagcgaauccgggugagauguggauuaaaguguggcuaugucccuuggucggcaucugcaucugcucgccuacacauucaccauggggagcucaccuccugugggaaggcuguucacugggagcugagaccaggcugcccccgucucugagccuuucucuguagggaucacugaacagcaagagguucagcuccuugggauaaggcugagcaagacuggaguuucgcucagugcuaauccagccuccaccacuguauauccuggggcaguuccuugccccagccccgaggaacugagguuauggugcuggcuagacaggacagcauggcuccuaguaaaugcucggugcacugcugccaccgugagcacagggaggaggcaggaaggggcagauaggguugggggcaacacuuuccuacccuauccacccacaugaggggaccugacuccucacguaggcuuccugagucucaguccucagugaaucuaucuugggcagaggggaagcuucacauagccagaacagguucuguucuagaaacuucuguuccaguaccuuggccaccuguugucucccggacuccccccaccccgacucccccacccccagaucugaauugggcacugugcgaggcagugguuugucugacaguugggacugucagagacaacaggcucugagguuguauagucuguuugauuuacuggcaucucaguuuucuaaucugucagaugggagugucagggacagcagccucuugggacaagcugggagaaaacaguaacaaaguugauggcacaggcaucagaguaagggccuugggugggggcggacccggccaccugcuugucaagacugugauagcuucuuccuccuggguuguacccacguggagcuggggcucuagaugcuuugaaaguggauguaggggcacaaggguuuucacuggaacucucuagaacuggaggaguuggcuuugccuguguuucccagggaugagcaaagguucucagaggacccuagggaccaggaggugcuaggaggaugaguggggugggggcuggguaccaucucuagguagaaggaauggcuugcuuuccacauggguaccacauggcaacuggaaccuggcaguguugguuuggagggcuaguggcaaugacuuuggcaaaggaaacugacaaccaggcuccuuucuccaaaggcaucccagggggaggagcgggcuagugcuccaaguggcucagaguggguaauaggaaaccuuaggugggucccuugaaccuuuagacucuagaagaauccuaggcaauuuguagggucucuagcugagcaugaaagaggggaaaauuuggggucaguucaguagugucuguaacugguuaggaauaacaaccugaccaagacaucacacuaggccacucagcagagcccccaaauucaccccuugaccucuuuguacucugccccuggacagcaccccuguacagagaauugauucccagaggugccugcuggccucugcaugcuccagcccuccgcuccccccccccaauuugcagggggcccuugccuccccacacuagaggcuuguccauuucuggggcacccuuucugccuagccucauuacacgaguuccuugguuucucacagagccugaugauccuggaagggguugggccggcucccagaaggccuggcgggccgggugacagacagauggccgcgggcacacucaccuagcagcagguucaugagcaccucuuggccagccagggugcugcuucucaccaggcagaggauggugcccccgauccaaggaaugccguggccugugaugccaaugagcuugaccauggagcgggcgcuggcccaggaugcagcccggccggcacacacccccagucgcuuggacaugcagaugucaauagccagcagggaguugaaggcgaugcccuugaaugagggguucagcugcaugcaguccuccucgggcagcugcugugacuggcgacgcucccgugccccgucgcuggaggguggggguuguguugagggccccgaggccuuccuaccugagcuucugggcuccuggguccccuuggggggcugguucagggacaggaacucagcccgguugaggacauuguugcgaucccuggcacgggcccggcucugggaagcuggcauggugaccucacuuacuaugagaaggccagucccagcccaguuccaagggccuucucccagaagacaggagccaccaccuucucuguagcagcuguuaaauauagagaggagacuugcacauggcuauuuaccuccagcugccacccggcuccguuggggacgucaaugacagcugggcagucaauagagcccacccuuacagggccagcgccaauagagccacggacaggcagaugaauccacagcugaggccuggcugccucgggccugggcuauuuaaaucug

SEQ ID NO: 754 - RNA, 83562 nt, Mus musculus
agccgagcgcgggcgggaggcggcggcgagccacagcgccgaggcuccagcgagcgccgaggagcgggaggaggaggaggaggcagaggcaggagcgcagagcgccgagccccgcgccgccgccgcgcaauccgccgccauccgccgcccccgcgcccggccgccgcccgaccgccaucgcccgggcccgucgcgcgcggacgcagaccaggugggccggggccggggccagggcagaggccgggguugcgcuuugucuccgcggcggugcgcugcggcgggcgcggggcugcggccugggcggccugcucggcgcuccccagcucgccauuguugugucuucgcggccagggcgggaggacggcgggccgagcggggcugggcaaggcucggggucgggaucgagcccgagggcucuccugcgcccggggacggcggccuugucggccggggugggggacgcgggaccccgaggccgcccggaaccgcaggccgagcgccgccccggcucggguggguucggcugagggaagcggggugguguuuucacggcacccggagccgcugcuaaaaauguuuaaugauaaacaggaugucgcugcucggggccugccagauugauuuuuuuguuuguuucuuuuucuucgucuaccuuuuaagagagaaaugcagaccuauugagauagauggugggccucucuggagaggaucugccugcauaaaaguggacgcugcugcuuuccuuucuucuuuguaaauaucguggggggaugaagcccacuguuaggcaagaauaggugucgccccccuuccccaggcaauggugagcuugaaggaagugggagaaggggggcgccgaugcucuccggagugugucauuugcuaaauggcugccugggagaaaccuuuauaaagcugucuuuugcaggguaguuaaauuucaccuacguuuuuucuuuccuggaaagguuagcguguauuucgguguguugucuguuugcguuguauaucucacuuggguuuucuguccgucugucugaagccucagcgcccuuucucagcaguacaaccgcaggggcuugcuuuguaucguaaugucugcaccgucguggugcaagcugggaccugagggguacaggcuguggagugggaugcuugcugccaccgagggacuacucagccuucacaggcagagaggcaugacuuggcaagccgucggugcucuguaguuacucugugcugucaaccuaggacagaaggcuggccacuuguggugucauccaugcuggggcaugccacaggugcugguuugaaguggcagcguuggagaagggauucaaaacauugggugauguaggacugcuggaaguuccaggucagccugggcuacauggugaaaacccaacaaaauacccacauccguagguacuuugguuagugcugggccucaguggggaggaggcacggacugcguuaguagcccccgucagagcaggggguugucuggcuuucagugggcuggaauuguauaggauggauaggagaagagacaggaacucgggagucuugacuuuggaagagaacugcccuccuuggggaugggcaaauaauuguucggggagccuucagcuuguucaggcaagugucccucuuggagccauguucagguccucuugagugacuuuacccaagucucugagccccagcucuugcaucuauaaaaugggaauaauaagacuccugcuguaucucgugggagccuccgguaagguucacagcagagcguuucuguccugggaaggugguagacauggacauucucgcagguuccuugguuuuguuaguuccuuuuaaauccugacuuuuccucguguuguggcuuguggaauuggggacccccugcaaaugcugugaccagcaaauuguuucagggcuggcuuaaagguccaggggagcucagcuagauuccgcugcuagugggagaccauggaaggguuucagauaaugaauggggagacagauauuggucucacucuguguggugacguaggccuuggcucuuggagagcccugguuaacuugcugguuuccaguuggauagacagugacuugcagucugggagggagaggugugugugugugugugugugugugugguguugcuucauuugccuuaaucauuugcugaguuuaaggcgcuuccauguccccuccagggccuuuucuacacuugccauuuggcucauccuugcugucugaccucccuugccagucugguccuggucugccuguggcugguggauuagggaagguugaagucuacugucccugcccccaggauuguaauuccuggcggagcucgcugcucauguggggccugcucugguccuccccacucuuccgugggaaggagagggugagggaggggaaaucccugggcacuugagagucaaaagccuuaggagaguggaguuucuggaauggccggucggaacugguuccugagccuuggcuuuacuccgcuacccuccauccuguuugaauuucgacucucucccacccacccgcccgguuucuuuuucucagaaagaucauuuuauugucuuuuaaagccccccccccccuuugccucacacagaguaccagcucccagcuaauggcuguggguugguuccaucucccuuuguuccagcguuuaagauugaucauuucaggguuaguuucuauuucaaaccagaaaaggcugggagguccagugcaugcauuucuaacuuccauaaugaggcuccucugcugucaaauguucagaucaaguuacaggccagcagguauuaauagggccuggccggaacaggucuuaaaacaguacaguuuuuuuuuuccucuuaaaaaagaaagaagaaaagaaagaauauuuccagcagacacccguuggacucugugcugcgagccuuguuuuguuugcuuuugaguauuguauacaaaggcagggcuaaguaaguuuaagacuucuuuugaauuauagucgauuauauuuauugagugugucucugcuuguguaccaugguccuccagugguggucccagggcaaccugugggaguuggcgcuagcuuucuaucccgcgguuccucaggaucaaacucagguugucagguuuggccacagucacccuuacuacuaagccaacccucagccuucagucauuauuauuauuacuacuacuuggguuuggguagacuugggaacguugggauggggccucacagggcuaguggugcuggaagccguggggagagauaggugguuagccuccuggagcggggacauuguuuaccaugagccuuuagguuucacaggggcccuuuggcauccucacuugggagcuggcaggccugggccucaccacaggugacacugcuguuuacauaggcgggccugugggaaaucugugcuccagggggguguuugccuugguggcuugcuugcuuugcuuuguuuuccauuguacuuuucccccaucuguuauaaucuuuccagaacuucauggauucuguagagaugcugguguguggggcuucucauggcgguaggagguggcugugcagggugaaguccaccuccaggggcuauugucuggcauguuugccuuugugcccccccccccccuuucucccuccucucugacuauuggcuucuuccucuuuggcucugggagaagccaauccucgggugcucagggauuucccugccauuaugcaagggccuuuaaaauaacguuucccagccccuaguaaacgugauuccugaagaaaaaaacauuagaaaacauugacaaggauuuaagaaaauacagauacaauucaccuaccccacccgcuaacuggagagaacugcugugaguguccuggcgucuucgcaacuggaacacucuacauacgugcacugugcacagcugacaacuugguuuuuccugugaauguuguguuuuguguaccugcugauuuauuuaaucuugcaguuugcuaggcaguucaguuguuguuacccgucuuuccccuccugagacauuucugucuugggguuuaucucuggcucucuuccuuccugcaguggcuuuccuaagguugaaggcugugagaucuauucugguuuucuuuugaaguuuucucuuuugagacaggguuuuucugggcaguccuggcuguccuggaacucuguagaccagcucuggccucgaacagagauccaucugccucugccucccgagggcuggcauuaaagcagcucgccaccacauggagcucuucugaaauuuucaaucccguuccucuuucaucaugaugagcaugaaauggcuucugucaugagccaccagguucugggugguucugucucggucaggguguuuuuauuuuuuauaaguuuauauuuauuauuuuaauguuuaucugugugcaugugugggcacggggcugcagugccagaaggguguugaaugcaugggagcuggaguuagccugaugugccugcuaggauggaagaaaauaacugguuuuaagcuuuuccaucucuccagccccuggcucaaggucuucuccacaugcuagauugaguguagacaaggcguuugucucaauccuucuggaaguagggggguaugugaacccggcaggaagccccucccaagagaggcuuuguggggaaugucccaaccugucaucacuucuuuuuuugaugugugcagaucaaaggugugagccaccgccccggccagaggguggauagggguuucauuuugagacagaaucucucuuuguaaccuuccauggggccugcuauacacuuuguaggccaggcuggccucaagcucacagagaucugcccguuucugccucuugcgugcuggugauuaaagugggcuauggauuuggcuguauaacgcaggcuggccuuuccguggcaauccugccuccgcuucccacggaccaggaucgcagugugugcugacauuugguucugcuuuucuucauuacuuacuuacaauuuguuaauaaaguuuuaaaaauaauuuuuacuuuaauguuuguguguaugugcacaguguaccugcacauaugcaugugcacccgcgugcuuguggaggcuugagguuaaauuucauaucuuccggaucacucuucccccucaaaugaggccuggucucccuugaacucagaacucacugcucuggccccucugugugcacuggauugcagaaggcccaccugacauuugugaggugcugggcguuugaacucugggucucagguuugugcagcagguacuuuauacacagaaccaucucccugacccccaaaacaauuuuuauugugcuagaauguguccuuuguaaguguccaguucaguggcauggggucuagucacgggcacacacucauuaccagccacauuccucccgaacugcauccauccguuagagauugagucuucucccagccucaugcagccacccaucgcuguuggcuccaugugaguuugacuguucuggguccccuguauaagcaggaucacccgacguucaucauguugcuacuagcauacuuuauuuagcaugcucauugcauguugugguaggcuccagaacuuccugaggcugaggcaggaauuugaggauagucugggcugcagagccagaccuuaucuuaaaaacaaacagggugagcagcuggcucggcagguaaaggugcaagccuugugaccgugccagccggauggccugaguucaguccucgaaauccagguaagacaggcaggagaaaaccaagccucaguauuuguccucugaccuccacacacaagagguggcgggcccgucccacuccccagcacacaugcacacacuguuuugcacacauguacuacauuuucuucauccguccgaccauccauccaucuguagaugacaacuaguaagcacagcuguuuugaaucugugggacuuguuuaugccagugggagcuguuguucccugugugcuugugcucccaggguccccuguaagagggacgcaccacucuagaguuguguaagagggucucacaagaggccaccagcaucagcuucauucagccugggaaauggggaguggugcucugacguuuguggcagaauugaaauaagcacccacuuggaagcagugcgcugcggccuggggggaugaaaacggguuuuacauugaaaucagaaacugcagaucccuggagagagcccaugcuuuucaggguaccgaggcccuuuugaauauggacauucuguaaguacccaacuucccagcaugccuuggucaugcuuuuguacaaaugaagggauggaagaaggggcuguggccagcgcccuuacccaggucccuuuguguucuccagcgccuuuuggggcaggugguguuuacagacaguccagagcuuaaagaacagcucuguucccacaaggacagaaaauacaggccugucuaggagggguuagguugcuccugccugggugaccugucugugggacugaaugcacucaguguuuaggagucauuagggagagcagggggugguuuugagacacaaugcgacauuuucugguguuuauuuuucuggcaaauuaauuuaaaaaguacauauauauauauauauauauacacacaauaccgguuuacacacaagaaggaaaaggggguucacaaagaggaguacaagugugcccccccuggccuccuggcaggaagcauuguuuacauuugguuguguuuauccugccagacucaguauagcaguaaaugcaggcuucaagggcuuagggaaaggcuguuucagaaaacagacugggggccguggggguggggcauggggggagccagggugcagcugaggggcuggggugcagguuagaagcagagcguacaaggucuuggauucuggauccaaccuugaaaaacaaacaaaucaacacuggagucaccuguccauaucauagggcacguuuucagacauacugaggguuucuccuuauuaauagaaacagauaugauucuuaauauuuuagacauaaugcuuacuaguuuuuacaaaauguacaaauguauagaaaacaaaacaaaauagcucacucaucuaaaaauagcucagucccacggcccagauauucccaguagacguauuauuauuauuauuaucuuuuaaagguuucacuggcuggccugggacugccuuugauacagguaaccuuuagcucauaaagguccaccucccuccaccuccugagugcugggauuaaaggcaugagccaccaugcccagcuuaauauauguauuaacaagcgugguggcaugagccuuuaaucucagcacucagcaggcaaaaguaaaaauuguuuuaaaaacacuuuauuuacaaauuguaaaacguauaaugaagaaaagcagggcuaaguaagaugguagcgcacaguguaaucuugguacuugggaaguggaggcaggagcauugccauucaaaacuaaccuggguuacauccucaggcaugguugacaccagcauuggagaggcagggggaucucugaguucuaggccagccauggcuacauagugagauccugucucagugugugugugugugugugcgcgcgcacacacgugagggagugugcucugguggccagaggccagcuuucucuuuggcaguguggaguguacuaagaagccugugagggucuuugcagacucugcuucuugagcgguguuuuguuaaggaaccucucuuuuccuuccugcagcucuuuguguuugauuggaggugcgcgggguguucacccuccugagugaggccuuuugcacugagguuagagguugugaccugcuggucugugucagagcugauuugcagauggcggucuguagugcagggccauggcagaagcugcucuggucugucaggugaggaccugcagagggcguagugggacacagggccagugaaaugacccuugcuguuaacucuggcccuuccugccugguuccuggugcaggcaggucagagacgcccucucuuuggaguuucugugacaaucgccaguggaauguuucuaugcugagccuccuucgaaucuccuguugaauagguuccccccaacuccuguuuaauuuuuauuauuaaaauuauugcacauuuguuuguguguuuguauguguguguguaggcaugcauaccacugugcaugugugguuagaggacaacuuaagggggucgguuccuuccucccagguaggguccagggauugaacuuguugucagguuuggcugcaagugccuuuacuugcugagccaucucgcuggccccucuuuuuaaaaauaccuucuuuugagucagggucuuguguuguguagguuggccuuuaguucagugccguggucaucccugcgugcuguuucugugaacucgaaccucggaguucuccugggaggagaggcauggccgccaccccaccugcugcccucuggggugaccugcuuugggguccaccgcuuucaauucuguggguucuaacacugagcugguaaccuggggccaguuauuuaaucuucuuacucuguucuucuugcuugcagaaggcuguagcugcacuagaccuucauagaagggaggagauuugaaaggucauguacuuaaaccuuuauaagguaccuggcacaaggcaagcgggcucucaauaaacaggagagcuauuaauggcccugaacccagcacucaaggagggccuagggguuuggaguaggcaggcuguacacuugggacucauuuguuuacuggaugcugaggcuucuaaacucggcugcagacccagauccagcagccuugccuuuuccucuggcagccccgaccucucaaccagcguuggcuuucccgggaagcaggugcccuggguucuuuccgccauucccaccuccaagaacuccacugccaucuuuuacagccuguggggugcugaucgcugacuggugcccuucuuggaggcuuuucucuggaggaaggagugaaggcagguagggggcucuggcugugcagaggcucugcagcuagcuggccacaguucugaugcgguuuccaguaaugagaaacucucuucuuagcccacucgucuaccugcuguaggacugaacacauuaucucuuaguucuuggagacuccguuucuuuagcugcucaguguggaugcagccugucucaugucaccaguugucauauugcacugcugugugcauugacacaugccuggacauacuggugcaggggggugggaccugggcgaucagcaaugauguaugguacgguucugcguuuauuuacuucacugagacacccccaaagcagggcaugagugaacauccaaaccuguuacaaaaaucuaaagccuugcauaacacggggaguagcaugaaagccaugcccccuuccacccagaggaccucuguccugagaacagucccaggcagggcugcucuagcuacaagaacccugagccugugacacccagcaugcuucugccugccuucauguaaaagaccugugggaugugccucccucgggacaagcccacugugcucucugcacauccuggaugaaucaugguucugggcuggccaaguucacugggaacaaagaauagauuuaauuagcugaugaguucugcucuccugagaugucagggcucaccauuugaugcugacauucaagguuggagggcaggggggacgggacaagguggaccaaguugcugagauguggucugguuaggauaagauuuuauauagacaggugugaugggcaguucuguuugugugauaaaugucuguggguaaaugcugugauuuuuuuuuuuuuuuuaauuugugguuuuucgagauaggguuucucugaguggccuggaacucucucuauagaccagacuuagagacuugccucugccuccccaauuugggauuaaagguguguucugugauuuuuuuuuuuuuuuaauguuuuuguuuuauguguaucuugccugcaugugugcaccacauucaugcaguacccaagaaggccagaagagggcgcuagauucucuuggggaugguguuacagaaaguuguuagcugccuuuugggugcugggaauugaaccuagauccucugcaagauaagccagugcucgaaacugcuaagcagucucuccaucccuggcugugaccgaccgaccuaccuuucuuucuuucuuucuuccuuugguuuuuucgagacaggguuucucuguguagcccuggcuguccuggaacucacucuguagaccaggcuggccucaaacucagaaauccaccugccucugccucccaagugcugggauuaaaggugugugccaccacugccuggcaauauuucuuugaauaaguggaugugguauuugcaggaucauaguuugcugaccugcaagugcccuugggcaaugccuagcucuuccuguagucuucuccuuccuuguuccuucugacuuggucuuguuugaugggggcccaguggucaucacugcccugccuuuucucuaagacauggggaagaaauagcguguggguuuccuguaguagacccuuucugagaccaacucagcccuuuaucuuuagaauucaaccuuuauuuuccucagagagaaggcaggcccugugggggcuggguccuggugaccaucauuguaaauagcccucuggagagguaugugacucugaaguaggaagggaggggauugccauuuuggcugugaggacagcagcccccacaguucuuugugggugaaggcguugagccagccugguagaugaggucucacucaagucagagggacacucaaaauggccugguggccauuuugauuuaaaauuuucuaagccucauugugaaaccuuggugggauucaaacucaaagcaguccuccuuggcucugccuccguaggacugagauuacagcucugugucucuacuucugacccguaggggcuucucuggcagccuucauugcuagcuuuugccuccuucaucuguccgggaugcagaaagaaaguggauuuuguuuuguuuugcguggacuacgcguugcaucauccccagcaaaaugggguuugcccggugucagcauccuccuccugccucuagacuaggcaugugacuugaaguagugucagguggugugcucggacuggcccgaguggguguggugugguggcugaucacucuccugucagcuggcccagcagauggaggugcuugccucuaggcacaguguugggacugagugaaaucccaggauccaugggauggauggauggguggauggaugggagagccaauucccacagguuguccucaucuacacauauacccccccauaaaaaaauaauaaaaguuauuauguuuuuugagacagggucucaauguguauguaucucugguuggccugaaacucauuguguagaccaggcuagccaggaacucagagaugcuccugccucugccucaggaaugcugggauuaugcuaugugcugccauucuguuuuguuuuguguuuuguuuuguuuuaagaaaaaaaauuuaugucacaaaaauuuuguuguuguugcuuuugggauugaaccuuggucuguuggccugacccaccccagccacacccuagcccugguugcagcuuuuguucuacaaauuaccccucagcuggaguccuucuccucauaauggccugaggucuucugagaaguggugguguagggucagcaggcggaaagugagccugaccugagaggaguggcacugagagacggcucccuggccgaaucagccugaucuuggcagcccaggucccacugauaaaagcaugacccucauggggggcggcaggaacauucaaagcuggcugcauuguggacgauauggcuguucccagugguccaagguuuucuuguccagcacuuacuucuuagguggaucaguguguuggauugaccuggguucuugauucucaaguuaacugagucuggugccuguggagaucagaggauggggcugggucccuugggacugcagucacagagggauaugugcuaucguauggaugcugggaacugaacccagggccuccacaagagccacaagugguuguaaccacugagccaucuccccagugccuuuucccgaccuuuaauaguugguugcuugacauagguaugucuguguugggguuuuacugucugaagucacagcauguccucugaguucacauguauuuuuuuuuuaaucuuucuuguguaauguccuggcuuauuuguggcauuuucuucugcaggcugugguuuugauuuuguuuaguuuuagauggguuuugcuuuucuuuuguguguacauggugguggugcuggcggcggcgguggugggggcggcggcagcggcagcggcggcuaaagaaguccagaggacagucgcuagguguccuggagcuggaguuacacgguggcugugaacugcguguugugggugcugggaaccagauucuggucuuaccugcugaguucucucuccagaacaccuccccuuuuuucugguuuaugagaaaggcagguacccccgggaacccccaacgccccucuuugccuacugaguuuaggauggcaggugugaguaacauaccagguuguuuaaauucucuauuuuaaaaucuuuuuuuggguugguugguuuguugaaaggagguaucuguccgugacaugagacucacuauguaaaccaggcuggucuugaacuuggagugggucccucugcuuuucaaagggccugaguucuucaucgauuugaggguuugaggagcuagagguggaacucagugguugagggcuugucugacccuuguagccugcgcccauccagcccgcacucccgcccccaguccccgaagucagguuuucgaacuuauugaggcuuucuuuucuucugucuuuucuuuccuuauuuuuagacagggucuugcuguguagcccaggguagcuuggagcuaacagcaauucugcugccucagccuucagucauaggcauggaccaccaaaccuggcuucuuuuugaauuguuuuagccucuguggacagagauuuuguuuguuuuucuggauuuuggacuuucccucaaggcugauacaaacuccuuuuugaguaccuuugcguucucccugggggcagggagcugguaucuucuuugcaccuauuugagugggcuuuguguaccaagcuguggaaauuuauguauauuuucucuuguguuuaugacuuuuauuuuaaaauugcucugcacauuuacguucaugucggguccauucuucuguguguggcuuguccccgaccuuugcagaguagcucuccgccuuuuacuugucucuccuccagcaucacuuugugcgcuucguccacacagccuugaguuuauuuguucucacugcugaauagucaacacaguguuuacccacuguagggugaugggcaucuggccuacuuccguuagaucacgaggcaccaacagucucgggucuucaaugcaugcgccuguguguuuugucaguccuaggcaggguguggcagcgauaccaugccuuuccaguuguggcuugauuagcacagcaccggcagugcccagagcugccauguacggccccacaggcuugccagcgugguccugagaggguguaguuucugccuagacugaucuccagcuucauguaauuccaggagcggccccagcagccucuucuuguuggcauuuguuuagaaauauacaaaccgauuucuuaaauuucuuugaaaaugcaaaaagccaaaaauaaugagggcauuccugaagaacagagcugaggggcugucccaccagguaugaggaugucaugaaagccucagucauggagguagugacauaaagacagaagggacggucagugagcugaaggacaaaaaugucuagaaccagaugcauugcuuucgauagccugucucugcuggugagcuuccugucacuguuaacacauaccugugguaacuuacggaagaaggacaaagguccacaguucugcagcguccgguccaugguugguuggcccugugacaaggcagcacauguugaugggagcaugugaugcucaacccauuaccaaccagggaggaaaaagaaaggaaagccaggcaguggugcaugccuuuaguuccagcaguugggagacagaggcaggcuguucucugagaguucaaggccagccuggucuacauaucaacuacuaccaggacagccuuaaaagaagggggaggaggacacugggcccccacagucccuuuuaagggcacagcuccauugagcugaagaccagccguaaagguuuccgcaucuccuuuauugccgccuugagguugggggcgggggcagacuaggcuuugccuuuccaccuugaguggcuuuugaggucucacacccuggagccucuguccuggucuuggcugggcucuuucccuacagcacugcugccuucucaggugaccuguggcugucauuuuggggcauuuuugccuguuucuucgagcuuauuuuccuguuccuuccggugucaucuucugaaacugaggcaucagaaggcagccacugucuuaaacaacaaggcuguguuuucuuucuuucuuucuuucuuucuuucuuucuuucuuucuuucuuucuuucuuuuuuuuuuuuagauuuauuuauuauuauaucuaaguacacuguagcugucuuuagaugcaccagaagaggacgucggcagaucucauuacagaugguugugagccaccauguaguugcugggauuugaacucaggaccuucgggagaacagucagugcucuuaaccacugagccaucucuccaacccaacaaggcuguuuuuuaccaaguaaagucaaguccagaggcaggcagcauugggacucacugguccagcgguucuacccucagagcucagcagucuuaucauuaaaaacugaguacugaguuagccauuggugggcuagaaugaauggccuggugugguggcaucgacugcuuuguguggacaccuuuucuuuucuuuucuuuucuuuucuuuucuuuucuuuucuuuuccuuucuuuucuuuuuuuuuucuucuuccgagacaggguuucucuguguagccuuggcuguccuggaacucacucuguagaccaggcuggccucgaacucagaaauccgccugccucugccucccacgugcuaggauuaaaggcgugugccaccaugccuggcauguggacaccuuuugaggggugaaggaaccuaugagucugaaaggauucuuucuucccauaagggcugcuggcuguuaggucugcauuagcgaccucccugugcugcaaucaaagcucccaguugaagggugugauguguuacaacgaggcagucauggugguaagagugugaagucacggugcauuguagccaggaaaaagcaugagaugaauucugcuauucaguucuucaguccaggaccccagcccuugggaugcugccacccuaaucuagaaauucccucggacacgcccagaggcuggucuccauggugacucucaccggaaacugucgaggguugggagucguugcuuccuuucauucuaagggggcucuucuggggcugaggcagacucagagaaaacacgcccgaugucaccuguucucccggugucauugugugaucuuucugugucuuggauuagucucugguuucucaacuccaggaauuuuucuuggguuuuuaauuuuaugauuucuuccacucuugauuuaaugugaggcagggggagagguugaauaagugugugugugugugugugugugugugugugcugcuagagcauacuucugcuuggcuaagauguggggagaggacgcagggugugguagcccccuccugguuucucuugcuuagcuuccuuuuuuuacuuuguacccuuuacuguccccgugcccuuugaccucucuuagccaggguacucuguagggagucugacaggcucauuccugggccuuucugauucugaggcagccgcuacuuccuggcaucccaggguguguuccuucugaguaacagcccucaucuuguggcaugucagucugcugccaccaaaauugccgcuggauuucggguucucucucgucuucuggaagaguucuagaagaguaggugguccuucagcaggacaccgcuggaugucugggugguguugcucugaguccagccgaugggacuaguggccauuugagaugagugcacaugugugcgugacacagcaacuggaguauuuugugagccagccucggcggcacugcccuucuguucaugguucugauugagaggucugccgcugagcacagagucucaggaggaagccgcuggucgcagucuucucacaaugccugcccaccccccugagcccagccugguauagcaguugaagcuuucuguagcacaggcucugcguucaucuggggguuggcauugucaccuggcgguggcugugaaguagccaccugucccaucuccacucccuggcuccucuguguuuugacacagaagccuuugcacggaguuuguccccacuucaucuuuguggcauagaauucccagaggaucgggugguuacugggguaacaucacuccugggucugccuuucugugcugaguuggguugagccgaggcagcagggacucagugguagacaggacugcuuucucccucgaugagaaaguugcuuccugccugaggcccacaaccgcauuccuguuugcccagaucccagcuugcugugggugacgucauccacagagaggccugggguguaaacagucacagcugcagggcucagggacagcugcagguggcgggauggcggccccaaguguuccucugcuugucugucucucuaguuccuuuuuaaaauuucccuuauacacaucuacacaaauagcaaaucuauuuagaacugggguacaaugcugugugagcuucguggaugguauuuuucuuuuuccucuuuuuuaaauuacucuuuuuaaauuuuucuuucuuuuuuuaaaaauuaauuuauccuuucauauauuauauccagaccacaguuuccccacccucucucuguuccuaaccuccuccguccccccaccuccuccuccccauccacgccuccuuugagaaaagggcaggccucccagguugucaaccaaacauggcauagcaaguugcaaagauuaggcacaagcaggcaaacaugucagaaacagcccguguucucuguuaggugccgcacaaaaacaccaagcuacacgacguuagcauauacagauggucuagguuagauccaugcaggcucccugauuguccauucagucuuagccucugugaguucggguuuggugauuuguuuuuugagacagguuuucucuguagccuuggcugucuuggaacucacucuguagaccaggcuggccuugaacucacagaguucugccuguuuugccucccaagugcugggacuaaaggugugugccaucacugcccuuauuuucuucacuuauuuuuuagauacauguucacuaugcagcccuagcuaaccuucaauucucuguagacagguuggucuugaacucagaucugccaaaugcagggauugacgacaugacccauuauucccaccccauaauuuuuuuuuaaaaaacaaguuguuguuguugcugugcugggaugauacuugggguuuuguuuguucuaggcaagcuuucuacuccugagcuguauaccaccccucauugaccucuugaacugggaaccuaaaccuguaguagaauagagagcaaaacccggaggcaggcaagucacaucauggcggguguuuccgagcgaccagguggccuugcuggagaugggagauggcccaugaaucugagaguugcgugccugugugcgaccuguuuguacgaugcaugcauguaaucgugugaguaucugcuguauauggggugaaaagccgggagcauauuguguccauuuucucucacgcucuaccuuagugcccugaguuagggucucccagccugaggugggcuuuuugggcagguuggcugguuggugaguuuccuagugcugagacugcaggcuuguccagccaugcuuggcucucucaugugaguacuggggacaccacacacacacacacacacacacacacacacacacacacacgaacauuaaagcuauaucacgagugcaaaaagaaaacagauguuauagaaagaaaaccgagcagcugauugucccuguguuccugacgugggagccuuggaacugggacagugugguggugauuaaagugugcccacaguggacugccgagcucaagagaauuuucugagaauuauaguacaccugucuuuugaaggcucauacaggggcuggcccacagguccuguacaaucacaacuuggaucucgugauuucugaggguggacagcagucugaagacaggucuccuguguguggaggagcaggucuguucagcaggagccccaaggugggcagaagcugucuuggggaagcucaggccuuacuugcugcauauaguggagggaugggagcugcugagguuuuacugggcaggcacuggcagucuggauagacaacagccccagggcaucuguucugggucaugugugguauuaaugcucuggguggcccagguugccccgaaacuccacaccuuucugcuucagccuuauuaguauuguaaaccgccacagccagcucacugucuaguuucuuaacauagaucuagcaaguucaucucguguauguguguguauaugugugugugugugugugugcgcgcuugcgcuuacuauguucagcaugagcccagugcccugugcaggcuaggcagguccucucaccacucacucagcuacacuccaggucccuuuuauccuuuaaucccugaggaaucuggccuuaagucacagcuggugcgggguugggacaagcugcaaacccaguguuucggacaugggacuggggagagauguaagguaguguuagggcuuggcagcgggcucuggacuggacagugggcugaugggaggcugugugagguuaagcucguugcugucugagcuguagcccugaugaaggaaggggccugaggacuacaaauggagguugaugugugucaggccauggaaaggcugugaacugagugcaagagaacugagccugggaagaaaguggcuuuguuucuuauuuuaguuuuuggugcuaauuugggcucagaguccucuggugguaucucccauaauaaaccguagcucauuagaacuccacaauucaguccuguuuccucuaugccuuccugccugccugccugcuuaccugccauccauccaucgagauagaguuucucugugcagcccuggcuauccuagaacuugcccuguauucuguugaccacacuggcuucaaacucagggaucugcaagcagauuguccuuggugaggucuccacagaggagagagccuuggcugugguguuucaggccuggcuucagcugucuagacggaccagcuucugacucggaauggacaugugggaucaccgcuguuuccuaagggcuacuuugcuacuuuugcuuugcuagugugugugugguguggugugguguagguguguguauguguugugugugugguguguguuuuguguugugugugugugugugcauuguaugugugugguguguguuuguguguguugugugugugugugugugcauuguaugugugugguguguguuuguguguguugugugugugacugugugugaguguauguguuguguguguggguguggguguuugugugggguguguugugugugugacugugugugaguguauguguuggguguggggggguguuuguguggugcauaggucagaggacagcuugggaguaaguucucuccucccacuuuuaugugguuuccugauugaauuuaggaccaaggcuuaaaaagcaagcacuuaccuguugugccaucuuaccugccccaaaccuggguuucuuucauucuuugaagauguauuuagcuuuuaaaauauauauacuuuuauucguguaugaguguuuuaccugaauagugggcacugacucuaggaggggucgggggagucggguccccuggaacuggagauacugaugguuguaagccaccacauagaugcugggaaucagauccccauccucugcaagaacagcaaaugcucuuaaccacugagccaucucuccacucccucuuuuauuuuuaauuuuuuugaaaagauuuauuuauuauuauacauuaguacacuguagcuaucuucagacacacuagaagugggugucagaucucauuacaggugguugugagccaccaugugguugcugggacuugaacucaggaccuuuggaagagcagucagugcucuuacccacugagccaucucaccagcccccucuuuuauuuuuugaauugugugugugcgugcuugagugugggucugugaaagggugugccugugagugcaggugucuacagaggccagaagagggcuuagaucuccuggagcuggagugacagcucagauccucugucagagccgugugcacucaaccucugagcugcccuuacggccugcuuuucugaaugccacauagagaaguccugaaggagguggcccgagcugggcugacccacgcugacaccuguggaauccucuugcuuggauuccucuucauuucccugcuguuuuuacaccagaggucaggcagaaagccagcagcucgagguuggugugaucuugcucuugcgaauaagguuucuuugcccccguguguuauuuuuacugugccgcuuacggugauacgucaggcaggaggucccagcgcagcuccggugcucuuugccuggccuuguauauaugagauguuugggacuuucuguucuccgaauaccagauggcugcucauaugucugugucccacagcaccaagugguccaguguuuggagcauguauuggccugugagcauugaaaugucugaaauaaacaguggaguuagaaaacauuucuuuuuucaggcaggguucacauauguaacccaggcuggccuugaaugaaugauguuccuguuucuaccucugaaggcugaggguacgggcaucacugcuccuggcucugggccuuccuaaggcagaugccuuuuggcagagccggcacaaugauggcuguucugaucuucugccuggguuuuguguuauucuuuaauuuuugagugagauuuaauaaguaaauuuaugaaaauuaaaguuuaauuuuuguuacauuuuaaaaaugugugugugugcauguguguaauguguuugaggacacucaugcuaucguauguugugaaguggucagaggacaccuuugaaaguggcuacucucugucuaccacauggcuuuggggagcaagcuagggaccugacaguaggccaccaaguugggaagugagaucacaucuuuuuuuuuuuuugguuuggagacagagucucucucucucucucucucucucucucucucucucucucucucuuucucucucuuuguuuuuugguuuuuuuguuuuguuuuguuuuguuuuuuguuuuuuguuuuuuuuugagacaggguuucucuguauagcccuugcuguccuggagcucacuuuguagaccaggcuggccucgaacucagaaauccgccugccucugccucccgagugcugggauuaaaggcgugcgccaccacguccggcuuuucuuuuuuuuuaaauauuuacuuauuuuauguacguguguacccuguagcuguccuuagacauacccaaagagggcaucagauuccauuauagauaggugugagccaccaugugguugcugggaaucgaacucaggaccucuggaagugcucuuaacugcugagccaucucuccagcccaagaucacaucuucaucagggagaauagagagcaagugagccaagcuaaaaacccuacugaccugagagacuucugcaaagcugcaccuccuagagccgagguucucagccuucccagugccgcagcccuuuacagugcccaugcuguggaccccaaccauaaaguuauuucauugcuaauucauaccuaauuuuacuccuguuaugcaucgugauguaaauauuugaacugauguuuuggagauuccaugaaacgaugccauaaucugggacugaauguuuaaauaucugaagccaugggggaggagcagcucucauucacaccugcacauaaggccuggccgcaagcaccauuguccugcugagcccugucgcccacccaguagccgguuccuagguuuuguuuuguuuuguuuuguuuuuagauuuauuuaaucauuauauguaagcacacuguagcugucuucagacacuugagaagagaaagucagaucuuguuauggaugguugugagccaucaugugguuacugggauuugaacucaguacuuuuggaagagcagucagugcucuuaauugcuaagccaucucuccagccuccgguuccuagguuuuuuaccucaccugcucucuuuuugggcaggucauaguucugcugucuugucugaugauggccugcccuaccuuccacaucuaccuccuuuccuuugggugccucccagccguggccuuagcuagcugcacucgaugguauagccucuccaagugaccaccgugcucugagcuggcagaggugcuucaucaguaugguugaugcacuccccaggucuugagggcgaagacugagaaggcaggagaugguacuagcaucagggaggcugugaagagaaugggcuuucccugagaaagccuggccugugaagucagggugugaauuagggcucugucauccugcacugacaucugcagaccgcccaugagcgccugggcugacggcugucaggauccauccucaucuuuccugccuacugcaaucaugcuggugccgcagcagcagcugcagcccggagucuaggcccugggcucuuugaccuuggauaagaucucagucccaacaacuggacgugaaugcugacacagggguaucuucuaaaaggguguugugaagagucagggaccugugagugccugggggcggggguccggugcucaggaaugccauggcagcugucgcugcccccaccccaccccccagucaggccaguccagauugccuggucagucaucugacacuggcuucuacccaaaugcugagugaaauuaauccuguuacccggaaauggcuuuugauaaaacagugugcugggagacagacccuguggaggacagccagccagaaccugcuggacaggcgggcccugucuggagaggcguggccugggugucagugccuuuguuggccggaaucucuuggguggcuuuuguuucaucccagccugggccccugucgucuuuagaucacgagccaacgugugcauacuuagacuucuaaauagcuugucuuuauuaguucuuucucuagagcugucuuugugagggauauuuuuccucaucugccuaaaagcaguauuuucucuuuagccagugauuuucacagugcaucugagccuuagcugcuacuguagggcaagagggucccaggcuggccauggcgucugcagugucuuccaguuuucucuaugcuacuaacgucccagguuagauuuuguuuggagauaaaaagguugucaccuacaaaaagaacagaaggcagcagacagcuguggcuaugcaccagguugggccacgcucccagccaggaccuggagugucugggccaguccugucccauagacccaggugugagucaggcugcaaggcacugggcccugaccugcccagcagggcccggcagcuuccugauugacagucaaugccugcccaggcuugcuuccugccguccucgccuccaagcugggggugggugggagugugugaggauggguagaagaugggcagauaucuggagccgcuugaaagcccaccgacagccagggcuucugugcugugcugugagaagcagcuggcaggcggaagagccagguggguguaggcugggccaggccucaaacaggcaggcucugggggagaguuaaugugggaauucuaacagcuauggaauagcugacugaaagacccauacaguguucuaagcaagaucuguaauguacuuuauaaagagcaggcguaaaaugucuccaccuuucagggugccugggcagaccaccuuccacuuguguggucuccaccugugacuguugauggaacccaggccaggccccucccagccccugagggguuguuucuguaacauccccagugccugggaagagauggcuggcuugacacagaaguaagagucacauggcuguacuuggcuagaguugcccugcgcuugagaguucuugaccaguaguagccugucagcagugaggugacugaagucugggauaccaaaggugugggcagcagguuccaaacucagugcacugcuguguagcuguggugcgggccugcuuggccgugguggcgcacgccuuuaauccuagcacuugggaggcagaggcaggaggauuucugaguucaaggccagccuggucuacagagugaguuccaggacagccagggcuacacagagaaacccugucuggggggugggggguggggggaagauucccaggcccugcacuucccugcaugcucggggcaucacaggaaccucgugccuuuggagugagugguugcauucacugggaacacacaguucaagaagcaguuguggguggaggcuggagagauggcucagugguuaagagcacugacugcucucccagagguccugaguucaaaucccagcaaccacaugguggcucacgaucacuaggauccaauucccucuucuggugugucugaaaagaacaacaguguaaucacauacaaaaaaaaaaagucagucaugcacaggccauuguaguuggacuuuggcuacuuuugguucguucuuucacucuuucaaccccuggcacgauaggagagaaaaaggaaggggaucccuggguaaggucagggguuugaaagggggaggcaaccaaaaaaaaaaaaaagaaaaagaaaagaaaaaaaaaaagcugggcgugguggcgcacaccuuuaaucccaggaggcagagacaggcggauuucugaguucgaggccagccuggucuacagagugaguuccaggacagccaggacuacacagagaaacccugucucaaaaaaaaaaagaaaaggggaggcauuaucauuagacuccuuccugcugaguuccuuggggggaaaguuucuucuuugugcaguacuacuuaauaaacugugaccaacagcaaugaaccaacauuuauguacccucugaaaaguccaccgaaugcaaaccggcacacaauugcagaaacuugucaacgguggcuguagacagucuggggcagccgccugcauucacaccuggaauuaaaacaaaaacauauucuuacaauauuucuguuuuuaaagaaaccagaauuccagaguugucacuacagaccaucacugcccagauaugcuuuaaacccucgagaggggccugugucucuccugcagugcugggauuggcucgugcuucugacuuucccuuuccugagggugggggaugggcaaccccuagccuucuggugagugccaggcaggcauccugagggugcugucaccuggucagugccagaucagagaugacucugcucauaaaggcacuugcugucaagccugaagacccgaucccuggaucccacuugauggaaggaagagaccuggguccugugaguuguccucuggcacaggaaauauuuaccuuaguggggcagugguggcauacaugguuaaucccagcaagaggcagguggaucucuaugaguucaaagccagccuggucuacaaaguggguugcaaggacagagaaaccuugucucgaaaaaaaucaaacccaguuaugcgcacaagaauggccacaaaggcuccggucucccuucucaccaauauucauuuugguuuuguucuuucccuuuuuuuuggacauaggucucacugcguggcucaguuuuuaauuauucaucugaguuuaagccaaugcugcuaagucuagugcugcauuguguggcugggaaggaggugcugggcagggcauccuucucacuagucacuguggucagggaccacaggaguguggcugccaaauggugugugucccucugcuaaggccagagaugguggcaugccccuaagcuaauggugaggcggggccgugucuaguuuguccuuuguugugcccagguuuggccuuguguaggguuagcacgugcaugugauagcuucuguuuuuugugguaacuuauuauacauauugaguggcuugaaacccagaucuccucugcuucugugugccugagcugugucucccaggccuaaagccaggcugccagcagggcugcugugugugcgugcgugcgugcaugcaugcaugcaugcgugugugagcccugaaggcucuagggcagaaucccuuuccuugggcccugccuccugcaacucaguccuuuccucugucuucccagcuaccuccacccucccaccucgcugacugacccuguuguaggacccuccgugacugcauugggcguuucacucugugcaagcugguuugcuauccgcaggaccuuagcuaagucacagcuacagcaucccuuugccggcgggcucugggagugaggacucuuguucuuagucuagggaccuuguaacauuggacagaccuagccacagucccuguuuguaauccaucuugcugccucuggacaggucuccacuccacccuuacccuuggcaucuauauuucuuugaaacaaauauuauuuaaaaaaaaaaaaacuaccauuuuaggcuugaggguacaaagauggcuacugccaugccugugcuucagguuggaagcugcccugucccaucgcacggugagcauugggcuuguguucaggguaaggcauaugugugcauucuauguucuuuuuauaacagcuuuaguuacuuauauguguguguguggcugugugugccugcaggaauuugugugcacugcaugugugcagaugcccaggggccagaaaauggugguuccgagccaccaggcgggugcugggaacugagugugaucaucugccagagcaguaagcacgcuuagccaccugggcugucaccccaaguguuuuauguuuguuuuauuuucggaguuuuuguuuguuuguguuuguuucaggacagaguuuguguagcccuggcuguccugggccuugcuuugcagaccaggcuaacgcugaagucucacucuccugccucugcguuguggggaguauggaaugcagcuccggggaagccuguuguggcugcuuuauuggguuccuacuuccgaccccaaacacuagcuagaagagaaggguuagagaggaaggggcauagaccucuuucaaacaaaaaaauagacuucuuccugcugcuuggggcuuuggguuucucgggggcaaguccagucuucgucgucagaaugucuccaaugucuccucuugcucaggaccacuugacagacugcagcagcagccuucaccacaggcccccucggcucucacacucucuccagagugcccagaaucaaaccaccuauagcuugcaaagaucagaguuaggggaguggacaaacugaagcagccccauaugccauaccugagauuaaaacagaagcauagucacauaacugggguuuuaaagaaaccaaaacucucccuauagauacccgacuacugggaauuucuguccaagccauucuucugccucagauuauuauuuugaguugacaccaguguguaauccuacccaguuuauaaggaaguggacuuuuggaggcuuuuauguggaugaguguuuagcuuguauguuugucuguguauugugugugugugugugugugccugguguugguggaguccagaaaagggcauuggauuccccuggaacugcgguuacagcugauuugagccaccauguguugggauucaaaccuggguccucuggaagggcagucagggauuguaaucacugaaccaugccugcaacccgcacaacuuuauuuuuggcaaggcaguugucucuuuuucuggaauguggucuggcaucucggugugugugcagugugcagcguuuagaucuggguggcuugcaggcccaucgcugcagacacgguuguuuauggaacuguccauacacucuaccugcuguucugaaguacuccacuaaucacugucuacccugacuuuccuguuccacucuguucagaccuccagcccagcagucuucccucccuccccucuccuucccuuugaccuucuccauuucccagcgucugguugguacugcuuuucugucugcuucuuggagaucaacuuuuuaaaaacuuaauguguuuauuuuacacaugcauuauguguaaaauugagaggaccacuugugggaguugguucuucccacccugagagcucuggggauagaacucagguugucaggcacaguaguagcaggcacuaucucaccuccauguguaaguuaccauaugugaagugugucuuuuggcaacaugaugcucgagugaagauguuaguuagcuucauuuuuuuucucuuuuuuucuuuuuuuauggcuagguaacguuccauguacacuucuguucaucugcccacagacccugguugacugugcgaguauugacuguuaugacuagagcuguccagacauggcggugcagcugugucuucgcaucugcauaaguccucaggagcgcucacacuuacaccuccacacuccgccucggugcuuuucucgcucauggcaacuguuaguucuuugugccaucuccaacauuuggggcucucccuucucuuuuuggugauuagcaacugugacuggggugacguggugucccucgaacaucauggagacuuuugagucagcaucuacuugaggcucugugaaaugcuaguuauucugaaguggcucagacccgggccugggggaagaauaugguuagcggaacagauaguacucauccgcagagguuuaggagggagaucugaccugugggucauggucccagguacucauugcuccugaugcucagugaucggggcuggggguucucgcugaucaugggccagugagcacuggaaguuucuggccaugcgcuguaaaguucuccaggacuccauaguuguuugcauacuugggcuuggcccugaggugggucugaugcucccugugccauucgauuucagagagccugguguuccuggaccucuccuccaccacagcugugggcuaugauuugagugaggaagggaauuacuacacagccgggguggcugugaccgugucuagaggaagggcgaccgugucuuuccgugggggagagugccaagguggccagagggcuguccuuauacaugaguuccagccuuccaugugcauuguuuuuuaagauuuauuuauuuauuuuguguauaugaguucacuauugcucucuucagacucaccagaagagggcauuggaucccauuacagaugguugugagccaccaugugguugcugggaauugaacucaggaccucuggaagagcagucagugcucuuaaccgcugagccaccucuccaguccucuaugugcauuuuuaaaguuaagauuaguguguguguguguguguguguguguguguacagaugccaugguaugcauguggaggucagagaacaacuuccaggggucacuucuguucugccacuguggguuccgagcauuguggguucagcaaaugccuuuauugcacuaagcugugucugcagcucccauauccccccaccccucgcucucccgauuuucaaggcagaguuuuacuauguaguucugguuguccuggaacucacagaguuccaccugccuguccuugauggcugggauuaaaggugugcaccaccaccuccugccucacaugcaggccuucagggcauuuccugguacacauugugcauucacacacucuugcagcccuuggccaggccugcuuugugccagagcugacaccugcgccuuugaugugucaggagacugggcuccauccacacagaugugacaucaguggcucugucucagcuuuuguuuugugugccuguuguaauugaguguugcuucucgugcucccuagucugaggucauggcguacggaucugucuuaggcaccaucuuacugggugccagaugccucccagaaacacugauguauucuagcgcagguagcuuuaggacagucucacagggcugcagauucacuaugacagcugccucccucucccuuuucuuagucaccccgugaggccauuaaggacaugugacugugagacucgguggauacgcuugcuuuguguuccauacuuugcucccaggguuaggaagucauggucuuuguacagguuucaaguugagcgucucuaguuaaggcugauguagagaaggaagacgguggugaaggcugcucuuggucuccguuucauugagcagagcucacugguaguggaugggcacuugguguugaaaugaaugaaugaaugaaugaaugaaugaaugaaugagugggugaauuaagaguaaacaaggagaaugcugauagacauauugaaggguagaagcuuccaguguuuugagguuuugucuuaguggagggggugcugguauaguuuuucauagccaccccgcucuguugcauggcugcuguuucuccagccuuucuuaccagcaagucuugaguugggggugggguagcccaggcuaucugcagagcaggccaccuggagggagcaccuguggaugaacgcuggggacauuuuccuugggacagucccuggcugucuuuacgucuccagcauguuggagauuccugacggaccugaauugugauuggugacuuacccccccuccccccuuuccauuucaaaggcaaaucgggagcggugccgagaaaauuuccuuacuagaugacauuucaucgcaauguccgaucguuuggggcaaauaacccagggcaaggaugggaaaagcaaguacucgacucucagccuguuugacaaguauaaagggaggucaguaggcgcugucagguccucagguaaggcccggccgaaggccccucuugcguucuuugcuuccgucccuuguaagauggccaggcccgccaggcacuugugucucuagccaguuugggcaggcagguggggugacagcguuugcauagccuucccccucucaguuuccugggucugacuuccuaguggaaggauuggcugccacccacaaggccuuccuggggguucuugccgcacagccaggaccaugucauauugcagggguggucacugugggcugagcuuccugggccuggcuccaccguggcgugagcuccacagcggccuccugccaagguagaaugugcagaucccagcaguccuuugucucuagucugggggaggagcuggcagaggcuggagugacuaccaagcacuugucuuggcuugacuuggcuccuuagucugagcagugguguguauuuuggccucucuccuccugugaggugugugcucuaccccauguucuuuuccuugcaguuauuccuagacauggcuuacagagucucgggaaaguugccacagcccggcguaugccaccgccugcaaaccugccaagccugaagucugaaaacaaaggaaacgaccccaacaucgugauaguucccaaggacgggacaggaugggccaacaagcaggaccagcaagacccaaagaggugagccccaggagcggggugacuggguaggcugggcugucacggcgccccgcaccuucugcucugugagaugcagguguggccuugcagagggaggacugggaguaagaguguggacaggccuccggggcucugcacuccucugcuugccguuguuugguugggccucugagcugauuaaugaguagcauuucuuuggauaaccauauuccccaagguaauguguacagugauggagaccagucccuagagaaccacuaggugggggcaggggcccugugugcuccauguuaggagauuguagcuuggcagcgacagccuuaggagacucaaguccugagccaugugccucagagagccagcacaagcuccucagaugauagccuucuggguucucgacaucucugucugaaucagggaggaagccauauucugggaggggcuccagaggcaggagccuccugguagagcuugcuacuggguccugggcuauuuaaacaguuuucagccaggauaguggugcacaccuuuaaccccaacacucaggaggcagagacaaucauaucucuauaaguuugaggcuagccuggucuucauagucaauuccaggcuagucagggcuacuuggugagacacugucucaaacaaaagcaaaacaagaaauauuguguagucaguuugugaggggugcugucuguggauugggggguauaucacaaccaucgggguuguuguuucuagucaggucauuugugguuugcugggacuucuguaccugaggguuccaccuucaaggaaaacuaguccuuagcuccagggguggccaccagggcacugugguggauaauagccugaugcagaggacauauaggugucagcuguugucaucguccauuugaaugguaccuaccagcucugugguaagaaagcugugcgacaguugagugggauugcagagccucugcuucugggcugcauagaggaggccacagagugccaccccgcuucuuuggucucccagcaguggcagaggcagugccagaccccugcugaaggccucguguugaggagggaaugaaagggggcaguugaggcucucuaucccuggccugcucuccuguggggacuuggagccuagguuuggggauacagagcugcuacuaccuagaagcuucaguuugucauuuuugugacuggugagugucugggguuagguugucagugugucuguggaguuugccuaucagcugagcccgugcuaauggcugcuaaucgccgagugggcugucaagugcaaggcucuacuguggcugaguggaaagcuccacaccacccuuccuguuccucucagacagugggcacacgcugcagccuguguggagguaguugcugauagcuuggucugacagcggcaucccugugaucgugugacuggguaacucacagagagugcccagagaccugugccugugugugucuaaacugcuguaguucugucuguaauggggaagaaagaggagcaggaacuaauuaacuuauggccagucaucauuaaaggaaucuucuauauaaaaagagcucuaauagaccacgagaagagacuggaaucauaugcaugggcuaucuuguguuaaaaauauuacaugaacauauguauacggaaaucugugggaaucagagcuuauguaugggggaugagaugguaaugucuguuauuuauauuuauaaacuuauuuuuauugagugcaggcauaugcugaggcaagauagaagucugucaguugucaaagcauuugcucugaguggguggaggggagcucuggcccucaccgcagugacucaguuucuccagugacagcucuucuuuugcuuccuucgagcucauuugacagcuaucagaagcaagcagcagacugccccauguccugggcagugucaccgagucagccuaggacaugggucacugucuggucacugucacuguugaggcaggcagaggcccugcgcagaggcugacccuccugugcauucugcccuuuucuaguuccagugugacggccucucagccgccggagucgcagccgcagccggguuugcagaaaucugucuccaauuugcagaaaccgacacagucuaucagucaggagguaggugcugggccccguccucacauccccaggcaguccuggugcuauuuggaaaaagacagguucuuggccuggguaaagcuugggcugagcgcaggccagcugggcacuuccugaugugcucuguggacaccaguccugugagcacagcaagugucagcugcagaaacagcccauugucuggucugguguguucgaaaacacaaccagcugugacgcaccaaccucaccucucuucuccucuccucuccucuccucuccucuccucuccucuccucuccucuccucuccucuccucuccucuccucuccucuccucuccucuccucuccucuccucuucuuuugacaaggucuuacuguguggcuggccuuaagcucacagaaaucugcuugccuuugcuuuugcuuuuuuuaaaaaagauuuacuuauuauuauacauagguacacuguaacugacuucagacacagcagaagagggcaucagaucucguuacagaugguugugagccaccaugugguugcugggauuugaacucaggaccuucggaagagcagucagugcucuuacucacugagccaucucuccggcccaugccuaacucuuaccagcugucuugacacuucgauuuuguauuguccccuggauacaaagcuguugucugccauaacuggaagaguaugugucugggggccuuuggcuucuccaggacaccucucucuucugcagcgcugaagcccccauguccaucccauuccuuggccugugacaucacagugcagaguugacuuccuguuucccagauuaaaagcuaagcgggauuacagcccuggugcuucagauuuagcucugcagagagagcugggaaagcacacuugugcccugacccuggcucuggaaccuggguaggguucuuggcagucacuguaaggagggcaugggcuuugccggcuuuggccauuggaggaaggagccugucccacaugggucauuucaucuagcuauuaacucuucuuagagggucugggguuuucucacuuacuugagggggaaggaagaggaucaccccaugucuuggggacucuuagagggucuugacagcccacugccuuugaaguagaagucaccaucccccguuaguguccugguaaggacugugucauccugaggcuauagacacaggugacgugugugcagagagaaugguggcagcccuggugccccucugcucauaagauguugggcauguccuguguaguccaucaagagacaucugcaggcuugccacagaagccagcaaagaagcccuuguugucugugcuuagggcuaggcagauagagcaggcauauucugcaugagaagcaggucugggccccauugggaaucugaccagacccuuccaggggcauggugggauuuugcuugguucaugggucucuagccuugugaacuuucaucagagccugccuguggggccaaggccgagacaggcgaguguggaugagcagaagaggacgaccucuugggagucgggcugggaggaccagccuuguuucagaaugguugugcacaguaauuuuccugggcguguuccauacucaccaguggcccagauuugagacaugugcugaaaucacgguuggaguuuugucucuggagcaagacagcacaacgcugugugggcacgggacaaccuggcaguguuugcagaguucugcaugcaggugggcgugggcgugcccucagcgcuugcucaucaagcggugcugcucugggucccaggcuccugacucuggcugggccugcucuaccaagagcccugaaaguggccaucuguccucugcaugaggcuugagucuaacaugcaacucucgccccauccccucuuuuguuuguggagcugaggguagacccuaggccugagcaugccaggccagugcugugccgcugagcccggccauggccaaguaccacauuccaaggcacagcagguuggcugagcuggcucuucuuguuuccuuccuuuucuuagaacacaaauucagugccagguggaccaaagucaugggcacagcugaguggaaagccagucggacacgaaggugguaagugggugcagaugguuuggauggggugggugggcaggagggauugguccuuuccuuagaugagggacccuagaagcuguggaaccuuucacaaaagcuaguguugguguuguuguguccuuugugagugaaguuggcugccaauucugugaugguuggccucauuugaguuuaauacugguuacuggaagugcucuucuaaagcugggcagaggaaccccaacacgggcccugauguccuucagucagcugcacugcucggggguaauuacugccagugucauguugccaccagcugcuucucccucacuggccuggcacuagccccggcuucaggcaugcgugcugaggaagccagcaguauggggaugcagcagacaucgcagacauucgcccaaagccuuuggaggauugggugggguugguuauugucaguauccuggcuggcaggaaggucugaaaaggucaguccacuguguggcgacagaggugaagggcuagcgugcugcaggaugaaguggucagaguauuuucaguggcucggguaaacugugacuagguagcugugugcuuuagaugaguccugggcacguggcacagucccuguggcccuggaggugagaccaacgucagcagguagauugcuuguuuguuuuaagauugauuuauauuuauguguauggauguuuugucugcauguguguaucugucugcauaccagaagaggucaucugauccuaugagacuauaguucagaugguugugagccagcaugugcugggaauugaauucaggaccucugaaggagcagacaguguucuuaaucacugagucaacucuccagcccccagcaggugguuuugagagcaccauaaauucagaaggcuaccugaaguguucuggguuuuccgaauuagcugguguacuucuguucugaugcacauugacgacccagcucugcaacccuacccgugagggagagugacaaguugacugauauagcuccuagguggaaucugauuuugcucuuucuguggggacucagcccuggcagcuguuacucuuguccucugcccugggguuaccuucccacuccuaugugucccugcaagccagggcuuugcaacaccugacuucuguuggacauggacggccagcgcagaggacaugucucucuccagauccguugugguggagaggaaagcccauguguuagaauguuguguccagcaucuccuggggcacugggcagucacagugugcauagcuucacucuggauagguggcucagcagcacacuacaugagcccuuugcugguggaggugaggugacagaugggcagcaaggagggcaggcaacugagguccucagaaaggccgguggggcagcgacugcgcugucagcggagacccggcggucugcguuuucuaugaagguuaaguggugagugugugugcaugcuuccagacucaucugggaauuccgugcugcauguaggcaaguagugugugugcauaugugugcaugugaaggucagaggaugguuuugcuugucuucccucaugaaugguaaaccucauuuuuugcaacaaguccucuggcuugaagcucacugucuuaaauuacuuucuguugcugugacauaacacugugaccaaaaguaacuuggagaggaaacguuuauuuuagcucacagcccaucaugaguagaaaucuguacaggaacuccaggcuggacuccuaucuggaggcaggaacugauggggaagucacagagggaugcugcuuacuggcucacuccccuggugauucaguuugcuuuuuuauauaugaucugcccagggagaacacugccucugguuggcugggccccaaacaucaaucaguaaccaagagaaugccccacagaggugccuguaaucguauggaggcauuuccuaauuacgacuuccucuucugaguauaaguguaugucauggugcuugguacugguguguguguguguguguguguguguguguguguguguguguguguguaaaaauguaggugcacguguggcacguugcucauaugugguggucagaggucagcuuucagaagucaguucucaccuucccccuuguuaaauggggaucucauuucuugucauugcauccaugcaccaaguccucuggcccaggacucucuggaucauggaguccacuuccuagggagugcuaagacuacagaucccugcccuuucgcccagcuuuucacauagaugccagggaucuuagcucgauucauuaggcuugcauuguaagugcuaggacagagaucaaaggugugugcccuucccccugguguggccugcucugauuaccuugcuugccaguauugggugacaaauguaaaagugcugaaaucugagggauacuagugugcagguguaggguugaguuaccugucauaguuuuguuuuuuguugcugugauaaaaggaaagaagggagggcuuauuuaauuuacaauucuaguuuuugguccaucauuauugggaagugaaaaugucagguauuuuagcagucaaugucaaaauuggagagcaaugaaugaaugcaagcaugcauacuaguguucagcuugcuuuccacucuuaaacauccacaacccuaugccuggggaauggugcugcccacagugggugggaacucccacccaauuaacauuaucaaaaguaucccccacagacauccccauuagcaauaugauccaaacaguccuuccuuaagaguccuuucccaggugacuauagagcagugguucucaccuuccuaaugccaugauuuuauuuuuaauacauguagugaucccccagccauaaaauuauuuucauugcuacuuuuuuuguuguuguuuuuugguuuuugguuuuugguuuuuuuuuuuuuuuuuuuuuuuuuucgagacaggguuucucugcagcccuggcuguccuggaacucacucuguagaccaggcuggccuggaacucagaaauucgccugccucugccucccaaguacugggauuaaaggcgugcuccaccaugcuggcucauugcuacuuuauaacugugauuuugcuacuguuaugaaucauguuguaaaugucugaugugaccccugggaaaggcuuguucagcccucaaagcuggagagccucuuuucuagagugucaggugacagcuaacaccagccaccuaccuuuucucaguuuugccaguagagggugaguuugcccgaugcugucacuuggcaggcuguucucacccagcccuuuaacugacugugggagcaagcaggccacugcugcagugaccugcccauuucccugugcauagcaguuccagucagcaggugccuauguauuguacugaaaaccuagggguguggcuauaacagggcagugguaucccucaguucaguagugugguacacagcaugggcugagagagcacuaguccuuaaaggccauucuccucuguuaauccaggaagagaugggaucugugugucaggaguggaguuacaauguuaaaacagggcuguuccuuccaaggggguucugguugagcagugagugacugcugaagagagaaauggucuugggguuacaucaggaccacacuuggcuuggcagggcuggagaagguugggaggugagucucagaacucacuggccacagcuuuguggggugucugaugcugccccucaugaagcagucuuacuacccuaagcagacgccaaguacccggugauuuccuguccccuuauccugugugagcaccugccagcuccugggaacagcuaagggagucgucacugccuggcaguacagaugcccaccuagccaggccacauggggcuaggaaagcagcgacacuuggcugucuuaccagcucccucugucuucucugccucuccugcagguuuaaggggcucaagccgacuguuauccuucucucccgaggaauuuccgacgcugaaagcagcuggagggcaggacaaggcuggcaaagaaaagggcgccuuagaucugucguaugggccaggaccaagccuccgcccucagagugaguggagggcagcacuguccucagguccugcugggcgccagaccccuugcuuucuacccuugcacguguccccagcugccugggccugggccugggcgucagagcauggaagcagguagcugcuugacauguuuguccugacugccucugucuggccuguuccucaccucuggcucucucccucucacugagcugggucuugccacuuguccauuuaucauccuuuacuccacuaagcuggcuucugcuuuguggauacaugcagggugcagcuaacuugaucaagucccugguuccauagccuguuuccacgcuccuccacauacugucacucaaagagcgugucagucuggcuuucacccuuccccagccaugucggacaugaccaggugaaucugcagcagccagcacuguugcgcccucuggugccagggauuggggcaggcuugcagugggggccuugccagcaggccucccgugaggguuuuuuuuuuuuuuuuuuuuuuuuuuuuuuugguuuuucgagacaggguuucucuguauagucuuggcuguccuagaacucacuuuguagaccaggcuggccucgaacucagaaauccaccugucuccgccucccaagugcugggauuaaaggcgugcgccaccaccgcccggcccgugaggguuuuuaagaacuggauuuucugucaggccugaucaaggaagcugaacuuguucagcucuugaauucaaggaucugcccguauuguucggucccgaggccucuucuguugaugguacugacggcaagucggaggcacaguccugaagccaagugaacaccaugccacucuggcaaaacagccacuuugcccaaugugcacagugcugaaagggcuggucaauguuaggggagcccugcuguggcugagaugggucacccugggggcuaaaguguggaaacagaaccagcuucuagauuguucccucuccugaggugagaagcaaauggccugaggguguuccuggcuucauggccucccguguaccucagggccgccggucuuuuuucuugguggugguggugagcgcuagguccuuuccuguuucagcuccuaaccggaaguggauagggaggagucuggauucauuccugucuggccccacaguccugcuagaugcaguggggccacaggaguuaccugcagugacaguuuagagacgcacugaggacaaauacacacugaggaagcgggugaugucacaccugggauguuugucuccuuuugcaauugauuuaucaauuaauccuaagugugcguaaggaaagucagucuggccaugcaggguggcgcuugccuuuuaaucucagcacucaggagacagaggcagauggaucucuaugaguuugaggcuagccuggucuacagagagagagagagagagagagcuuuaagccagccaggaauauagagugagacccuuacaaaaaagaaagccagauugaacgggcucaagaagcugucagguuuuuacguuuuucagacauuucuuuuguguguguuugucagguagggagcacacuuacuguagcaugcauguggaggucagagggcagcuugugggaguuaguucuucccuuuugccacagcaguccugggucaucagcuugauagcagcccacaaaaacacaucacccgcucauccucggguuuuuaccugugaacugagcgugugcucuguguauaccacauguggucacaggguaccgauguuccaaacagaggcucauguggacagucgcacaagccuuggugggugggguagugcuggcugaaggagugagucaggcuguccuggugucccuguguucugcccucuggguggucucagccaucgggagccaguucucuuuccucgugugucucugaaguggaacacguuucucagacacauccaacacccccuaagaaguucuagcuuccugcuucccacuugccugacaacauuuggguuucuuuucuguuuucacuaugaaugauauggggguauuuuuuaaagaaagggugguguccauugccccucagaaucuuacaguuuucuuuuguccccuuccacuucacagaugugacaagcuggagggagggcggugggcggaacaucauuucugccgccucucugagcgccuccccaacagagcugggcagcaggaacgccaguggggcagacggagccccuuccuuggcaugcaccagcgauucuaaggagcccucucuccgcccagcucagcccagccgcagaggggccucccaauucauggggcacgguuaccagccacccacguaccaugacaugcucccagcguuuguaaguacucaaaacauccuguccauaacuguaggcuccuguucgccccucagccugagcucucucaggguagcagauaggggccacuguggccggcagcagagucccgcucccucuggccuuucccuguccacugccccuggcuucugccccugcuguucaaugccacuguagcuuugguucuuuagaaaaagggaagacagguguucucagccuuauuggauccaaggcagauggggcacugugauucauuacaaagcucuccacucuucccgguucccgaccccucguuuuccacuuuccaaagugaauucucauuuaccauauaauuggagccaucauuacaaaaucucagucauugauccuguauuucagauguguucaccacagucaucagagaaccagacuacgguggaacgaagcucuuuuccccuuccucagcuccgccuggaaccccguguuccuuucagacaguuccagaugaacgaccaagaugggugaggcugugacccuguggccgugugugucagugugggacaguucaugcgugagugcucugugcucuggagacuggggugggcggcaggacuuggacccagcaaggagcguggucugcagggcuaacuccugcagugcaggagucugguagcacuguggugggguuggcagugagcaugugguacuguggauggaaccgaaccguagcaagaaugcaauuguucacugcagguuucuucuaaggaaguagcucagauauucacucagacaccagagguggaacucguuuuuggaaagugacuguuugcacuuacagguugacaugagcccaucaucuuuugucugucucaccaggaaagaaaggccaggcguggcacggccagugcgcccacugaggcagcugguggagagggcaccaaggcccaccaucaucaacgcggaaaaccugaagggcuuggaugaucuggacacugaugcggaugaugggugggcaggugaguggguggagggccagcagcccuuauaugcagccagagcagagggcgcucccugagugacuggcgucguuuuucggugucugcuuuugauuguaaagcucugggagacugauacuuuauuuuuaaaagaacuuucuguaguuuacaggccuggccagaaaucaucccaugcugagaugcagcccacaugugcuagaaugugugcuuacccagucuaaaaauucuuuuuucuuagguuacauuuauuuauuuacuugggcuacauguguguaugcauaugugcugugucccagcacacauguggacagaggaugucuuguaggaguugaaucucuuuccaauauguguguccuggggagucuaacucaggucaaccuuggggacaggcacuucaccuucuaaguugucuugcugggacacacccugcugauuuugaggcagggucuugaucugaccuugaccucugugucuugcuucagccuucuaagcgcuaggauugauugcagguaagagguacucaccuauuugggguuuuuugggguuuuuuuuggauuuuugagacaagguuucucuguguauccuuggcuguccuggaacucacuuugcaguccaagcuggccuugaacucacagagcucuaccugccucugccuccugagugcugggaucaaaggcgugcgccacaaccgcuugucagcauucuuauggguguaucuguaguuucuguugcuccugugacauaacugugacacacugugcuuucuguaucuguucaaagucucacuaagaggaucuuaggguucuagagagaaggcucagguucagagcacucacuggaugcucuaugggaguucagaacuuucuggaacucaaaggagccagcaccuuuucuggccucuauauagaugggcaaaauacucacaaacauuaaaaaaaaaaaaaaaccaaaaaucaaauaacaaagaaaaaaaccuaacccaguaugguggcacacaccuuuaaucccagcacucaagagacagaggcagguggauuucugugaguuugaggccagccugguguacaugugagauacugucucaguaaaacaaaauaaaaauaaaaaaccaggaacaaaaauagggucaggcuagacuccuggcuagagagauaaugcauugguuuauagagacccacugcucugauauaggcccugguuuuaauuuccagcacccgcagcagguagcucacaauuaucaguaacucuaguuccuggggaccugaagcucacccuuggacuccugcaugcaugugcuacagaugauuucaugcagguacacacacauacauaauaaguaauuaaaaagaaagaaaugugcauuauuucauaggcuggagagguggcuccgugguuaggagcguguccuguugcagaagacucacccgggacuccaccuccagaugaucugaugcccucgucuggcccacacggcacugaugcacaugugacauuugcucauaaagauacuuucauacacaugaauaaaaauaaaacacaguucacuaauccaccuuuagcauccaauccagauauucuuugccuccccugggcccacgcacuguccccacucacuaagacuuucucuugaguuggucuggcaccuuugccaaacaccaaucgacuguguaaauucuugccuauuucucgaugacauuauuuccguggaccuguuugugcagcugugcaaauuaaaggauaucauaaacucaggggaggagcuuuccaccuugggucuucacaugguucacuccucaaguucuuggaggauuugugcaaauguguacuucacccuggcaguauuuacaaagaggcugcuucuguguccgcggcagccccucaguucugacucuuggggaccagggcuccggugaaucucgugcuccguccucuuucuucucaucaguguucuguagcuuucaauggagaaguaucuuuuuuacuuuaaagauuuaauuugaagugugugucuguguguggcuauaugcacaugagugugcagaugcccucugagaccagaagaagguaccagaucccuugaagcuguggucacauuuccuggacuccaaacuuaaguucucugcaagaguuauaaauacacuuaacugcugagcugugucucagcuccgguggagaggaucuuaauguuuucugguaauuuuuuccuggguagagggccuguugaacaugugcgggggcacauggauagagggccuucuuagcauuugaauggaaggugcugaguucagcugcuccuguaaaugcucuuccauccccccaccacuaccacuaccccacacauaaacaagcuggaagugcugguucauccuguagucccagccucagcuacuugggcugcuaaggcuaccugggcacucgcaacaaaaccuugucagcuuuuaacagugguaguaggagcagagugaguggcuuguuugauagaguggcaagcagauggcauuguguucauucccccuccaccauauaaaugggcagugguggcaaguagguaggacuuugacuucauagcaaguugaaggcuagccugugacacaugacagugucuccuaagcaaauaaauacagaaaaucguuuucagauacuuuauguuuuagauacuauuauaagugcauuuuuuuucaaucacuuugaagauuuuuuuuaaacaaaucccagcuggacuccccacuggacuuuguagaacaagccgcaggucuuacugguuuuuguugaccuaggauuuucugugugaauuccugugucaccuguaaaugacgauacuuugguuuuauggggcuggagcgcaaucccaggaccugcucgugcugugcgggugcucugccacucaguuacagugcugcuccuuuaaaaagcagcuucacaagccuggggugguggcugcacgagccuuuagucccgcccggcacuugggaggugggucuagccuggucuacacugagaguuccaggacagcuaggccuacauagugagacucuguuccaaaaaaaauagacaggcauaaaauugucuuacaugaauuagauuucuuuuccugggguuuuggggauggaacccagggcuucaggcaugcuaagcagugcuucagugugagaugcaccccagcugucuuuucugccaguuuuuauggcuuuuucuuguuguaugcugugguguuucuagaguagugcuaaggucgugugucacccagaggagugaugcuaacucucaggacagugacauccccuugugguucuaguuugcugagcauuuguggguuuuguuuugugagucuccguggguaaguggguagaccccgugcacauuuucaugggacuucccuucucuguuuugacagcacggcacaugcauggccuucugugugcucagauucaguuugcuagugucuugauaacauugcagacaucuguguggguggaggccuuuacuuuuaugugugugugugugcacgcgcauguguauaugggagagcgugugaacaucuccccagucacccacacucauuuacaacccaauaauauugggugcuguaaggacccaccaccacguuuuguccgucaguuauggacacuuuuucugccugugccagucaggauguggggcacgggacaccagcagucucugacagaguguaugugcagcagagguaggccccaucugcuuuccuuuucuuuugccuugaauucgaguuuucaggcugguuguggggugcauaccuguaaacccagcacccgaagaacucaaaaaccaugaguuugggggcuauauaaggagggugucuucaauuuuuucuccugacuuaacacugugugugggaggguuaguauugcccggcucaucgcuguuaccuagggcucucuuaggaguugcaauugggcaggguaagcagccccugggcucagauggggcaccacagugaugcacuggagcuguccuugccguugcaggccuccacgaggaaguggacuauuccgagaaacugaaguucagugaugaugaagaugaggaggauguugugaaggauggccggucaaaguggugaguccccucucuccaguuccuagcguggggcucucagccccacacaggcuuguuagugcugcugccuggcggacacugugcuaggagcaguuccugguuuccauagcagcgggaaugaggcccauucaagacagcaugcaggaaccggucagcaugcaucaaggcucgacugucugcuccuuaaaugucugcacguaauuucccacugauggucgcagguguggcacccuguaaagcuuuugugggauaccacugaaggcucaucuuuguuaagcacaaacucucagaggccagccucuucagcagugcacugcagccgugcugcaggugugugcacaccagguugccugcauucacucugccuccccccccccucucucucauccuuuccacuggacuaauuuuacuuaaugcucuuuggaaaauccgacauuguacuagaauucccuuacgauuuuauuuuuauuguuuuaaaauugugugugcgugugugugccugcgagauugcaggugccugcagaggacacaggcaucgggacccuggggcuggagugucaggugauugugauuaaccagaggcaucuccccauggcuguuuuuaucuuaacaucagcagugguuucuggcuuggcauuuugggugucaauauccgcagcacaucuugcucccagagugcacuuggagcuuugaggucuccucugacagcuuccauauuguuuaugcaugauuggcccacaggggucagucagugugucuccuucccuuuggccugccuccuaugguguguccuucacgcagcccuccuugucuccuaagaucccacuuugguucugggaggccaagaccauuucucaaaggucaagucagaagucauuaauauucuuuuccuuuuuuuuucuuuuuccuguuuaaauuugagacaguguuuuucccuguagcccuggcuguccuggaacucacucuguagaccaggcuggccuugaacucagcguuugccugccucugugugcuagcagccugguuggcaacugucuccuuuucuacacuggugggcuuccuauauccaccguggcgauuguuuagugucuuccuuuugcucuguuguagagccuuguugggcaccugcccuaggcuuggccaaggagggaaauggcagggagccuggaggcacagcccuucuguugcuuguggcagcagcucuuuguuucucccuaaggcccaguucccgcucuuuuaagauuuuuuuuuuauuaacuuuuauuuuauggguauuuugccugcaaauaugucugugcaccacaugcauacacauguaucuguggagaucagaagaggguauuggauuccuggagcuggaguuacagacaguugugagcuacugugugggugcugggaauugaaccuagguccucugcaaaagcagccggugcucucaaccccagagccagcucuccagccccgauucccagcucuugagaugugcgugagccggccuugucugugcgcugaggaugggggcugagcucccuggcucccaggacuuuaugaugggacuugguaaacaucguaccucaacuuuggcaguucauggauaaagggcgugcgugcaguguugaaggaaauuagucugugacguggucuaauagcuggcuucaaaauucccagaggccccugaccaguggggucagacaggccugacuggggaaacuuaacaguugccaucugcccuaggaacaacugggauccaaggcggcagcgggcgcugucauugagcucugcagacagcacugacgccaagcgcacucaggaggaagggaaggacuggaguggaacagcagguggaucccgugucauccgaaaggugccagagccucagccuccuuccaggaagcuucacaguugggccucugggccugacuaccagguacuguggcccggggucugugccuggcuguuuaguggcagcccugguauauacaugggcgcuuagcaaaugcacgcacucucccucugucccuccuucccccaacccccgugcacauucgcacagacucgagcacuuugggaaguugguuuucuucuucugccuucaugugguuuccagggaucagacucaucgucgggcuuuaagacaaaugcccugcuuccugcucugagggccuggcccucuuacuugaaacagaauucuguaugaagacuggcugggcauggccuuuagucccaguacucaggaggcagaggaagguggaucucugaguucaagaccagccaaguuccaggccagccaagaauacacaaugaaacccugucguugccgccccccgcccccacacacacacacccacacacacauacacaaaaucacaaagucuguuuuccuggcugaccaaagaguacgccaccuaccuacucuaacugcaggccaugcgagugucuucuuccugcuuuuuguuuuguuuuguuuuuuguuuuuuuguuuuuaagaccuagcaucaaaccugaucacguuuguugcugcuucacugggaugcauacacugggccgugauccugcugaagcccuuuaugcaugaugucgccugugaaucacuuggcacuuugcccauuccacagccuuucacagacucuucagccuggaugcuuuggaagagggcaggccccucuggcuggcucagucuguagcuugcucauggugagguccaugguuucugucuuggacgagauugacugggcuguuuucuggauuccuccuggcucuggugacuggcacguuggccucauggugacugcgaucuugccacggcucacacuggacagacagucugugauugagagaaguguggggagaguguugaggcgggcuagccuauuauauuuaaacugcacacgucuauauguauggaguaaguguguagaggucagaggacagcuucguggagucaguucuucuucucagccaccuuuaucggagucugggggcugaauucggauugccaggcuuggcagcaagcaccuuuaccugcugagcccucucacuggcccuguucgucauacuuugaguucacucauucauuucagcaguugguaaucucucauugucugccaugaggaugaaguuaucuuugauuuuacuccccuagcucagguccuucgcagucugacuuugagcucuuccuugcugucugagggaaacuccuccacagcucucugcuguugggucaggguuucuaagaacucuggauccuuugagugcugggugguguuuagaauacucguuacuauugggugucgcugcuccugggccuucucaucugggaggagggggcggcgggcgcacaggcgucugacuguucagucuccauuccugucuguguugaaaacccaaaaaguagagggagggaugucuccaguucugaggaaugugauucaguucuuucucacuauguuguacgugugugugugugugugugugugcgcgcacgggagcucagguccacuguguaccuguggaagccagugaccagcuuugguguccaucucugcucuccgagcuguuuaagacgggguguuuguuguuuuucugauggguauggcaggcuggcaggccuagaacacgggcuacagacacucacgcugugccucuggcuuugacguggauucaugauuguacaguuagggcccucagccccuccuuccuccagcagcaaccauguuguccugacacuggugcuuccuugguugaugcugugugugaauaguucaguccccacgucgcacagaugcccuccccaguccccacacgggucaccuuugcuccacagugccacaccuuuauccugugcuuaucccaaaccagcccagcacucacagugcaccccucucauccugcugggcucuggccacacacggagacucugacuccuuggcagcugaugcacccaccuuuccugccacacccaggagugagccagugcugggaauggagaaggacagcauuuggaauucccuggagaaauguagaccuccucgugcccagugucuaggccccuccugucuucucuguguuccugggcucugugcuggcugcagaggacacacaugaaacgugcauugugccucccuacccuaccuccccaaucugcugcugaaggcgucacagugaaugugagcccucugagucuguuuaggucuuuggguaggagauaaucagguuuaagaauacagaaaagugaacugaagaaauggcucaacggguaagagcacauguuauucuggcagaggacccaaguucaagucccagaacucacgucagcuggcucacaacucccucucacuccagcuucggguagauauggacaccucuggguucuccuggcacaugcacuguagugcacauacccaacacagacauaaacacauaacaaaaauaaaucauauguaauucuuauguacauggguauuuugacugcauguauauaugcaugcacaacauauaugccuggaugcccuggaacuggaguuagagacaguguacaggcgagcugucauguacgugcugggacuugaaccuggguccacuggaggaguacacugugcuucuaacagcugagcaguuucuccagcccaagaaaauaaaacacagacugcacaagcguguguggucuggauggcccaguggguacaggagccugcugccaagcuuggugacuuacuugaguaagggccucaggacccagaugguggaagaggagaacugacucuccagaguuguacauauaauacacacacacacacacacacacacacacacacacacacacacacucacacacuuuuuuuuuaaugcgagggccauagagauggcucagguguuuucugcucugaccugcaccccacucccuccuucuuuuggcagaaacccacaaugggcagcauguuccgccagcacuccgcugaggacaaggaggacaagccacccccacggcagaaguucauccagucagagauguccgaggccguggaacgagcccgaaagcgcagggaagaagaagagcgccgggcccgagaggagaggcuggcugccugugcugccaaacucaagcagcuagaccagaagugcaggcaggcucagaaggccaaugagaccccgaagccaguggaaaaggaagucccccgauccccgggcauugagaaggucuccccgccagagaaugggccuguuguccgcaaaggugagaggccucccuaucccacagcugggagccuugaacugucgacuccacuuuacuggcugugagguagccaaaccuguggcagagacaggagcucuguguuaaggucagccuggucuuuguggaguuccgggacagucaguacagagagagccccaaccuuaaacacaugcaugcacacaugcacagaggugggccuggggccuuaucugcucucagcucugcuuuucugaauuuuaauuugugcaugcacucgagugugcaugagagagugcgcgugugcguguguguaugcauggucagaggacaguuuuguggagucgacuccucucagaguucagaggguucagaggcugaacucaggucucuagguuugugugcuaagugcuuuuacccgcucauccaucuugccaccccaucuuuuuuuuuuuuuuuuuuuuugguuuuucgagacaggguuucucuguauagcccuggcuguccugaacucacucuguagagcaggcuggccucgaacucagaaauccaccugcuucugccucccgagugcugggauuaaaggcgugugccaccaugccuggcuuugccaccccaucuuaaauuuuuaaaauaguuggguaaaugucuuacauaucuacaaaccauuuuuccuucaucuauaaauguaucaggcuggcaagguggcucagcagguacacgagauugccucucagcauguuagaccggcguuggagcagauguucucugaccuccguuacgcuaugaugugugugcgcgucuaugauuacacaaacacagacguaaauucauuucaaaauguggggaguggagacauagcucagugguugacccaguuugcucucacgggugaccuggggguaguucccagcagcucauagccaucucuuaacuccagguuuaggggaucugaugcccucuucugaucucauuggguaccaggcacauaauacaugcaggcaaaugcacccaugcacauaaauuaaaauaaauaaccccccccaaaaguuuauauccccgccugccagccuguggaggccugucaggugccuuacaagaggcuugcggcauacagagacaccaucuugcuguuguuucugcuacugucccuuccuguacugaccaggcaaacguguggcagagagccugcgcaaaggggaacacuguuuuacaggggaugcaaaggggucuuuccagauguuggaguauacgucuggcaauaacaauuccaaaaagaguggcugcagucuguaacaagcugcaggacuagagacguucccccagggaagccaucagcuguauucugugacaguccccagucaacccugauagauucuuguuagccucagcccuuguaaaccccuccugcauguguugagguauuuggccaucuaacgcuaccugugcccuucuggagucagggcugugcaaguguccuuaugacgcccgcucucugcagcuuguguggagacugcuggcuuggugcuuauggccacagcaguacagaaacugcuuugaacaugcuguuauuugggcccuguugagggcaugaucucacuggauccuccuucaagccccgugaaggacgcaugguugcucucaguacucacagacugcguuggacaagcagggccucaggcuucccacccaaagugguugaauccugucuguuugggagaugaauuuguagguggucccugaguuagggcugcugucuccauccucagagcccuuuaucagucucaccacaguguugugcaguucugaggucaucagcugaauccucaccuguguuuuuguugggguagagccuucuaacugugccucgugggaaauucauauaccccaggagcacuugggguaggcagcuggguccgggucagugaaugguccccagugcagucuaggcaguaggcagaagcacucacuguuuaucacacaguuggccaagcuccugugaacucgcugugacuuuuccuucccugcucucuaggcuccccagaguucccuguccaagaagcacccaccauguucuuggaagagacaccugcaacauccccaacagucgcucagagcaauagcagcagcagcaguagcagcaguagcagcaucgaggaggaaguccgggaguccggguccccugcacaggaguucagcaaguaccagaagucccuuccuccccguuuccagcgccagcagcagcagcaacagcagcaacagcagcagcagcagcagcagguaaaccgacggacauaaccacagagcagaugcucaacccacucacagcaguacccuuacauguuacgguggccaccacagaugccagaggugacaccucaacccugggaaacucccaucaauagagucucugggugugauccaaacccuuuuacucuacucucugagcugcaugcaguguggcuugugggaagcccucacucagaguagcaucccucugaucccauucaaacauccuggggcuuaggaggccucugcagccuucugcacugucucaggagucccuggugauggacaggucagcucuggguuaaggauguucaucuuguaggguucauguuggagagccagggcccccacccaaacauugcguggccaacuuggguaacgucagucagucaucagucuguucucugcucugggaaccuggggacgcuggggacacuugcuucagcagagcgggaaucucuggcaguggcaccuaggagcgugucagagcauuguucauguugguuggcuucugaaacuuucagaggggcuugcauuuuugcucugaaggguggcgucauagcagucccuggguccuggugaugucugcuggugcagccugacagcaguuguguaaucauggggacuggggauguagcucacugccagagugagaucucccagcaagaguuagaucucgguuucaguauuuggugcccagcauacaaggaaaaauggcagccaugccuaggaaccauguguuuugauggagacugggaugauggagauaucugcuagaacuccggcagcuggcuuauaauguucgcauuuaaacuguuucaaaaaugguugugccuuagagaccaaggaucuccagagucucguuuaauuuccuaugagccuacccuagcuucucugcuuuggggucauaggaagcguaguguugguauauaaguacacucagucccucgaggcugggaguggaggcaccagugggcaguguuagcggucacaccugcccaaccaagcagcaccaguugcucuugcuagggaugagggagucaguggccauguaucucuccucaagagggugugagauugacagggcuuccgggaugggcugguccaguccucaaggacugcaguuuaaccagaggguguuguguagaccaagaaguuagcucuggagguccucacaucagugaacugcagugacugagugcuccucagagacagcagccugcaggaguugcagccuagcagcaggcuggagggaggccauucuguucucagagugcaccgggcaggccaaagucugaccugacacaugggcugguuggguggagucaguguaccauugcuuucagaucacagauaguuuguguuccucaguucagugccucagagcacagugccccagcaagccacucuuaguuagagagacuaagagcagaaaagaacugggaguauugugggagaagacacugggggaugcucaggucugguaacagcuucuuuccagagggaacgcgcuuaugcuggaaacucaguuugggaacggaaagcagaggagcaucaguccaggguuucccagggucaccaagggcucaugggacuggggggggggugcgucguggaggaguuuguagccaaggaggcaaaaucugacagaacccuauaggcugccaaugaccuucugggaugaagcuguugggcaggaagcagaggagguauuggaggcucuucugaagcuuggagccaacaaauguagaaaguacaugcauagccauagauaaaaggaggggagcggauccgauccugugagguguugagucaaacuggaacccucgucugauggggugcacacagcccuuguagugacaccaacaugacuccauccagcucugagggaccucagccuaaaagcuguaacaggccuggggaccauggacguccuucuuucuggcuuucugccagggccuuugugugccuguccugugcaguacccuuagcacacccugagcacccgugugccucgcccucguucacugcuucucucccccccccccaggagcagcuguacaagaugcagcacuggcagccggucuaccccccaccuucucacccccagcgcaccuucuacccacaccacccccagaugcugggcuuugacccacgguggaugaugaugccuuccuacauggacccacgcaucaccccgacacggacgcccguggacuucuaccccucagcccugcauccuucaggugagccccgggagcccagcgaagggacaucaccagcagagguagacccacggugguccaggccggccccugugacaagcauuugaccagucuugaguuuuaccaagauauugacacaguucugcuccugucaaaaaguuauuaggaccugagugugggguagagacauauugucauuucaucacuugagaggcugagacggaaagguggugagguugagaccagcguggguuaaguguuaagacugucucccaaaaaagcaaaccaaaaaaagcaaaccagaacaaacauuguugggaugguuaugaaggugugugcugucauugcagccccugcguccuugcuggugagucucucuagcccagauuguuccugcccaaaguuggucuaaugcuuuuugcuaaaaccaaauuuggggguucaucacccuuuugguuuuuguagcucacuugucuguucuccucacaauauagucuuuauagcacuguuuccaacauugcuuuguuggggucaugugaugccuucucacugucaggugguguguaccacaagcuaaacugucaggugaucuaagucucuuucuugcuagucauauugaaguacucgauaaaauugugcuugccaauuguguuagacugauauccauaccauuggucuuguuaaaaauccccuuagucgguuacugacagcuguugcgacugccacaggauugggaguucagccucuuggggaagcacaugcuuuuaguuucacacggacucagguucaucucuagcuccaaacagaaauaacuaaauauccagugugguuguggcuuuauaaacuuccuauaaggaagggguguguguguguugauuuuuuguuugguuggguguuuuugugcuguuuuuguuguuguuguugcugcuguuguuguuguuguuguuguucuggaacuuucagugaagaccaggccggccucaaacucacaggaaggugcuagcccugaagaagacuggguuugcucccagcaggagaguuugucuguguugcugugauuaaagguguucaccaucacuguagcucaggcugacccggaucucauuauguauuccaggcuaaccucgcauucauugaagucuucuugggucaggcuccgugugcuggaauuacagguuggggccauuacacccagcaaacugucugguuuuguuucuucuaucuggaaacacauagaaaggaauugguuuuauuuucugucuuugcuacuuuggcuaaaaguagcaucauuauucuagguuuugucacugucugucugauaccuuuuguuccagcuuuugacuguuuacuuuccaggacucuggguuuuaguaguguagcuuucccugugaggagacgcugacugcaagucuguggcuuuucguugccaaagcuuguuccauagguuuauugggaugcugggcagugguggcccuuaaaucccugaaagugggagguggggggcagaggcaggcagcuuucugacuuugaggucagccuggucuacagagugaguucucggacagacagagcuacacagugaaacccugucacaauugcuuucuaccaccaccccagauaagauuuugugugugugugugugugugugugugugaacuggagacauggucuaguaguuaagagcacuggcugcucuuucaguucccagcacacacguggccucuucugaucaggccuuuauagguaacaggcaaguguccauguauauacgugcaugugugcauacauacacaugccugugugcugccaucugggacagacucagaccuguccucagcucucuugucucuucacacaugucuaauccaccuucuuaaauuuuaaugccugccuguauauuuuuggaaguaguauuugcuucccaaauuguuguuuuguucuguaauuucuuuuucccuccauuuuuuuauuuuuuuaaaauauguguuuacccauuuggggaguuagaagaucagaaggucuccuuccacuguguggguuccaggaagcaaacucaggcuuggaaaagcaccuuuacccauucagccaucuuaccagcuccuauuuugaauuuuuuuucuuuguuuuucaagaugggggucucacuauguagcccugguuggccuguaacucagucuguagaccagggugaccucagacucagagcuccaccugccucugccuccucaggucugggauuacaggugugcgccacuguaaccaagaagugcuucauuccuuuucuuuuuuuaaaucauguuuuaaugauuaaaauacaaauuuuaaugcuguauguuuuucuagaaagugucagcuauaguauacuacauucauaccccuucuggccauuuuggauuuaaaguucagaccuggugagggagaguaucuuucagagccguccucucagaggcuuccugcccuuacagccacuccugguuaagcuggaagaccucugcauucuucugggaggcagaaauuugaauacagccuccuugaaacccaaaggaacagaagguuuccuaagguuugucuguugcauccuuccuaggaauucccuuuacggaaggacacgggcuuucuaaugcuugguaguauuucagaagcauugaaaguccugguucugagaggaugcugauguggacagaugggggaagcuugauacagccgguagauugacguuacguuacggguguccuggucuaucggggccacuccaggcucucccuccccaacagccagaguuuccaaauacaaaauguagaguguccuuguccaucuucccauagggauaugaggaagugaagccaaagcccugucuaagucuuccuaggaggucuaaaucaacugagugcuggcuggucaugugugcugccugggauuuggcccauccaguccacacagcucugccguguggugcugugcucgcuccccagcccugcugggcagagaucuggcuccuguuuauuguuuuucuuaccuuucgaguggucucucauucugggaaccagcauuggcuucuacgggccacaggcaggucagaugguacaccugcauaccagcaggcuccccuggucagaguaaagacucgguuguuuaagggauaccugcuguguccguguggcauuaggacaacugccacuuuggaaggcuauguucugccuuguggcuuccgccgggcauucuguguuagaugagagagguugauccuuugccuucuucaggacugaugaagcccaugaugccccaagagucccucagugggacuggcugucgcucugaagaucaaaacugugugcccucgcuccaagaacggaaagugaccgcccucgacccagcuccuguguggagcccagagggcuacauggcacugcagaacaaaggcuacucacugccccacccgaagucugcugacacucuggccaugggcaugcaugucaggugagcuucccucugcggcugaaggaaggcuccgcagucccaguggagggcccuaggaagaggccccgucccgggagacacagcccaggguggguggggaggaguggaagcaggugugcuugaauguuugaugcgaguggcucucucugauggccaggcugaggcacaggaggaaccccguggucgucgaacugugggcauggaguaaaggggcagagggugggcucacaggccggugggucaagaguggggucugggcucgcuccuccugugcguauaggagcuagcccugccaccccaggcccaggcuccccacucccaggcuccagcuuguucauugcuccaggggaccgccagcuccucugucuccagggcaguucauugagcuccacugacaucuucacggccacggacgccaggggccaccgagcaacgaaccauaagcuagaccaaauguuuguguuuucuuuucuuuuuaaaaaacuuuuuuuuucuuuaaaaccaaaccaaacaaaccaaaacuaagcccuguucagcauggcggccaggaaccaagcuccaaucacauugacugauuuuucugguuccuuuucaggaaugaaaggucuuacugugccucccccggaaggccagggggcauaagugcccagcgcgaucucuuugaggagagaggggaggaguucuugagugcuuuugacaagaaggcccaagcagacuuugacagcuguaucucuucucaaagaauaggccaggagcuuuuauuuccaccccaggaaaauguucaggaggugggugcuccuggggguuguaccccaaaccucagguguuccccauuggagccugacuuugucccagcugagaaaaagccagaguauggcagcugggauguuggccaccagccaaaggccgccgacacagccaacggugucgagcuggaggcuccccgacaggagccuuccuuucauguuuccucuugggagaaggaagggagccccaagaaacagccaaacccggagccugaguggacaccugagccccggagcuccagcggccagcaccaggagcagccgggcaggacccggaggucaggacccaucaagaaaccaguucuuaaggcccugaagguagaagagaaggagaaggcccuggagagaggcaggcaggggcuuagagaggagagcucacagcgggccccagagaaagaacccgugggcagggccgaggaggacgaagagaacaacccugcccuagccaaugccuccuccgcccuggaggacaaggcugccucccgggcugguuuugcccacgaggcuagcaagcuggaugaagaugaaaaggcagauaagaccugggagagcaggcccucaagggaggccagugacauucccccaaccaagagaaacaacuggaucuucauugaugaggaacaggccuuugggggacggggccaggcccguagccguggccgcggcuucagagaguucaccuuccggggcggccggccugcaggcagcagcacaaguggucuuuguggcacggguguccuugggucucguggcauguacaguaguggccagcgcaguaaccgaggcaggggccugcgugacuuccccccaccagaagacugccccagagccaagccaaggcgucgcauugccagcgagacucacagcgagggcucugaguaugaagagcugcccaagaggcgccggcagcggggcucugagcauagccacgagggcaugcucacggagagggacgagggugcccugaaggacucauggcgcuccaacagaacuuacaccgaggaccagggcgguauagacacccgcagccggggaucccggacaugcgggagagcccucccaccccgccugagcaacugcagcuauggccgcagaaccuuuguugccaaagaaccuccccacuggcagagcaggagcccaggcagcuccuggcaggaauauggcuccucugacccguguggcccacggcgaggcaccgacagagacuacauaccagacuccuaccgacaaucugacacauuuggaagcaggcuuuuugaggacagccgcacggaggacaagagguccuuuuuccaagaugaccauggggcagauucugaaaaugcagaaaacaggcccuuccguaggaggcggcccccacgccaagacaagcccccucgcuuccggcgccuccgucaagagcgggagucccugggccuguggggaccugaggaggagucccaucugcuggcaagccaguggccaggccgguccaaacucuguccuggggacaagagugguccuggaggucacagauccccagagcuuuccuaccagaauuccucugaucaugccaacgaggagugggagaccgccuccgagaguagugacuucagcgagcguagggagcggcgagaaggccucguggcugaacccgaagcgcaaggggaugguggccucucuggguccaguuugggugaaaagaaggagcuggccaagaggagcuucuccagccagaggccccuggccgacagacagagccgcaagcuggagccgggaggguuuggggagaagccuguuaggccaggugggggugagccuuccccccgcugcgagagccagcagagcgggacgccucugaaagucaaaagguaacgcgucagcaccaucgcggguccuuugucguuguccuguucgcaacagcaucaaguccaugcaugcacgcccugccaagccaggcggccccggccgcugugugugagcaucuccaucacgugcuccugcauugcuugucugcuucuccauggugugucauuguugauguuguuguuguggcuugaucaacuagacccagaguuccccaugcccuacuccccggaggccuucuugugacugcuguucuagcccguguucccagaguccaaccuccggauauauccucagcucugcccugacggcuguugccuguguguggugcccgacaagcucugcagucuacccgcuugguacugcugcagcuggucagaaggcaacacucacuuuuggucauguggagaaagcucuugccccuaguggcccugcuucccucgugcugccuggacauggcuggagccaccaggaacagaagggagcagcccgcucucagccagagccugcuuuucuagaagcugaagcuuaugggguggcccauggcccaggcugccuguagggagaaugugguccugcugcccaaucagcgccucagguugagaugucuggggugcagagguuuuaccccuccuguccuuagaauucagaguucacaacucacguguacauaccccaaagaaguugacucaggagaauaucuguuaagucucggugugacuauacugcagccccaacaaggcaucaugaaugaacucaagagcccugcagugagauagccugugcugcucuggucugugggccucucuugggugccuccacccggccucuucucggcacugcagucuguggaagcagcauacagugggagggaagaguacuguggagaggguacuccagcagccuucacccugccgcagaacaggaccagcacggggcucgcacugugggcaggcucuugugacccuugauggcucagucgcaggaaccggaacuagauagcugcugugucugugugugggccucgugcauucagauccuccugccccucuuuccuagccuuugaguaguggagcguucauggacucuuccuuccuuugcaggucuccagaugaggccuugccuggaggccuuggcagccauucacccuaugccuuggagagaaccacucacgccagcucugacgguccugaaacccccaguaagaaaucagagagagagguuucuuugccuacccagagggcuagugagcaggaagaggcccggaagcaguuugaccugggcuauggaagugaguuggggcucuccuuuggagugagggguggugcaaaacaacccagccuccugucuuaugaugcuuccagccuugcugagccccagugacaucuguauaacuucacagacuuaaaggggggcauccaaggccacauggcuagcaagagacugaccugggugugugaaucugcaucucuaaagccauuaucuccacgggugcugucugagcacuuguggguugugcuugcaaugucugcucacaugggcaggaggagggcggggcaccgugucuagauuuccacaggcacuggugacauugcuccuuggugaguggacuucaucaguugacgguugggugauucucaucuuauucuuuguguggccuuugguucagaugcucucauugacaacugcgccuccagcccuggggaagagaaugaagcaagcucuguggugggugaaggcuucauugaaguccugaccaagaagcagcgucgccugcuggaggaggagagaagaaaaaaagaacaggcugcucagguaagcaccacgggccgagaggaggggaggacucuccgucgggcaugcacugucuccugggaccugucacaaagaggcuggcuuuuccagggucuaauagccaaacugugaccggcuaggucagagauaagccucagcgccccuagucuuccucuucccuuagugccccagacuggcuaggugauccugcaggucacagugcucaggaacccugacagaaaugcuugcagcuagacacugcauucggccccgucugucagccugcuccuggggcaagucugccuauccuggcagugcacccugagcccgggguucugaagacacgggucaggcaucucaagcugguuuggguaguaauaugacacuuuccuaggagagugugcuuaagccaugcagucauggcuuaaggugggacugcaucagcuccucuucccugcaggugccugucaaaggucggggccuuucaucccggauuccuccucgguuugcuaaaaagcagaacggccugugucuggagcaagaugugacugugccuggcagcagccugggcacugagaucugggagaacagcagccaaggugaggugggugccugccucaggagaggcagggcacuuuccggagacucacaccuuugagccgucaguauaagugugucaugaccuauuccugggccccaagcagagucaguguugagcagcagcugagcugacuuguugcggcagucacaggugggggauacaucucuggccccaggacuacuccaauagacuagcagaaccucugcaccaugucacccucaggaaggcgcccuguuucagauggccaggagggaguaagggacccccuuccucagcacagagaagcccucugaauuccucccucuuguuuucuguggaagaagaaaauucagacuaacggaaguuaguugaaaacuauuuccuuacaucuuuuuuguuugauuuuaaugucccuuucaauugaucaaguucuuuuugaaggccugcagugagcacggccugcacaacagggagccuagaagaucgcacaguuaacaagagcuuuucuguggcuucuaagagagcgaggacgaggcugaacccaggcuagagcaaaugccacagugggugacucauauuccugcacgucugugccuuuauaauugucacuauccuucuggcccugguguagaacagcaauucucaagugauguccugcucugguagaaggaugaacgaugggggcuggaggacacuucugaccauaccaccaaugccugaaauaacccucagccaaacgggcacagcagcaggcaccgggcugaagcgcagucagcuucgaagggucucaguuguucagaccagggcucacgugugcuccauccuguccauaugucuucugggucugccucauuggcuuugggugcugggggaguucuguaggcugcucacuuaauugagcugugccuuccuggaucauucaaggcuugaaguagcugcucgcucccgguuucagugcaggagaguguuggccuaagaggacugagaauucuauugaggccaaccagaguaugacucaguguucuggcacuggccucucaccucagcacucaggaggcagagacaggaggaucaugggaguuccaggucagccagagcuacauaagauccugucugaggaggcuggcuguuggaagaagcucucacauuagugccuguaugucagauuuagucacaaaucucggucuucggagcucugugcccuacaaggcgggguugggguggggugggguaaggguguuccaucaacucgucuuuucaguugguggucacugcaguggaaaggaacuuacaggcuccugucuucccagacugcuugucccccauugaugcccugacucuugccucccuuccuugucagcccucccugugcagggcgccgccagugacucauggaggacagcugucacugccuucagcaguacugagccuggcaccucagaggugagugccacuacccaacacccuuccuggcagcugggcuugcacagggugcccuacuguggucccuagcuuaucacccucuuuagcuuuggccucugcuuucuguguggugccuguaggagcagagagacaagggagacucuuagcuggggagcuggcguaagagucaccuuugagcugcuauugccuggcaccugugugcucugaauaaaaugaguuugguggccuucuuagauccaugcagugucuaguggucaugagcuuacauagaauuggcgcauucauuacacuuggugugugccaugggccacuaucacgagggcaggucuggacuuuggaguggaggucagugguggggaggaaagcuggccugugcuguccagaggcugccuccuggaugcuagugcuuugcaguuuggggucagggaucuaacccauuuuguguucugcacagcagggguuuaagagcagccagggagauaguggcguugacuugagugcugagucucgggagucgucugcgaccuccucacagcgcaguuccccauauggcacucucaagccugaggaaauuagcgggccuggccuggcggaaucuaaggccgacagccacaaggaccaagcucagaagcaggcggagcacaagguaaccuaccaguccccugcacggaggccagggccugggcagaagaggcccuuccgucucugucuugucucccgagaugccaagggugccuggaaguaugugugugugucucagcccuucugcuuuuccacaaggacucagaacaaggcucugcacagagcaaggagcacagaccaggacccaucggcaacgagcggucucugaaaaacagaaagggcucugagggggccgagcggcugccaggggccguugucccgccuguuaaugggguggagauucacguggacuccgugcugccggugccgcccauugaguucggagucaguccaaaagugagcuucgcuuugucuccuuucucucuuggacuuggaugaacucuuaggguugucuccuaaagaggaaagggaagcugggagcugagcacucugcucuuuugcggagaauguuaggacagaggcaggggugggcagguuuuauuggauugcuuuguggcaccaguggguacagcugggcucaaaggccagccagagggugggggagacaagucagguggcuuccguucuuguguguggucauuucccucuccuguggcucuggccagugcaucguggacacugguugaugugggcgcgggggcaggugagcuggcccgaggcucaggugcugugcccccuucucuuccaggacucugauuucagccugccacccgggucuguuucugguccuguagggaauccaguggccaagcuucaggacgucuuggcuaguaauguaaguuggccuguccuccucuggcucugcccgugcacccaugcuggcagcucuggcuuggggaccuuuggcuggaggugauaucagugcucuuaaggacugggucacuuggcuugcuuuagcuccagucuccaugcugugcuagcuguggggcagacugcucucccuagggagggagcccagagcaagcaccaccaccccacccccagacucuccuuucauggcuagugggcaacucugguuaagcaggaggugcccccuggaagccaggcucccucaaugcagguagcagagcgugugaaugccauggcccacuggguucugugccauggagagucagagauucagcacugugagcuacuuggagaagcagcuaacagccuccccuuugaucuguccccuggaaguugugugcaugagggaggauggccagacaguauucccaagaggguuggaggaggagcuuuagugcuucagaacguugccagucuugacggaaaacgggugggauuugauguguuugagaggccauguuagccaagucucuucucuuugggaauccuaaaugaguuguuagaauuggcuaaugagcccagcaaccagggugcagucauugcauuucccacguuuuaggacggcucaaagacccgagugacagccaccagccacucguccccauuugggccuggccguauccaagcccuugcuuccuaguagcucggcccuuuguguggcugggacgugacuguggagggcuaguggaguguggguguggaggugacucuaucacagaaacuaggcagccugcucuagaugaguucuggucccggguguuugggugagcagcugcccugugucccugagcccugcaugugccccaugacucucuuugccccucuccaggcaggacugacgcagaguauucccauccugcggcgggaucaccacaugcagagagccaucggccucucucccaugucuuuccccaccgcagaccucacacuaaagguaaagccaggccugcgcugggcuagggcccucaccagcaccucagcuugugaagagguggcggggagcccuccgcacccacacccauggcuuagguugcugcucuccccucuuguccccaguaguaauuugcaucccuccccuccucuugcuuccaaagauggagucugcacgcaaggcuugggaaaacucccccaguuugccagagcagagcucuccaggaggugcaggcucgggcauccagccuccauccucugugggcgccuccaauggggucaacuacagcuccuuugguggagugucgaugccgcccaugcccguggcuucuguagcgccuucugcuucgauaccagguaucauauccccugagccaggcccaggaaccuucuccauucacugucgaaaagccggauucgcagcucugccuucaccuccagaguaugggcgacacuuguuuuuaagucagguaguuacaacuucccacaugcuauggacaguguaaucccugcucuguuacucgaagcaggauugcagugccauagggagacacugggaacuuccagagaggagugagcacagauagggcuuugagucagacucuagucguugccaagucccuggugagcugcuuucuucuccaauaaaguaggcugaugcuacugaaccacaggggggcugcacccacgaagcaagggcucaucugugcccucugucaccaggagcuguuucaguucuuccuguuaucaugcuugugacuggggauuuugagggcccagcugccaaggucucagugauguguuuccaauagauccuucugacccuccacuguggacucaaagcagggagaugaagaggacagugacugagagacugaggcagcucucuuccauaggaaacagcccaagcacucccacaggggagucgguggagggcugggugcucuccugcaccugccuggguuuccugagcugugugcugcaucgaaaaaccgaacagccucugcucacacguguccucagccccacugaguccccugggaaacauggccgccgugugcaacgggaggcuugauccuuuccuuccuuuuuuuguuuucuguuucuaggcagccaccucccaccucuguaccuggauggccacguguuugcaagucagccccgacugguuccucaaacgauaccucagcagcagagcuaccagcaggugaggguagcaagucugguagccaggucagaggucagagguagcacagcugugucacucugcacuucuuugugggugauuuugcccccugccccaugugauacccagagaguguuuguagaaaggaugugagagaugacaggcauggaguagacaccccagauuccuacccagaggccucacuucucauagcuggggauuagcugcaguuggguuauguugauaaugggauccuggcaggcccgagucccugggcacaggugacuuacauuagaaagagacaguuuuagagauagguaggauguugccuuugcacaagauugggauucugucugugugaggcugguauguuuuggagccucuuuucagagacuggugcuggccucccauacagccugaaguguuccuuccuacuccacgucucugauccagacaggaugggguacccucaacucugaagacauguuaugcuauuuuccugagaaucugacccacuaaauggaucuuagugccucccuuuauuguuuuuauuuuaugauuauuuuuccugcaugugugcuuugugugcucugugcauguacugcccacaaagccaaaagguaugggauccuuggaacgagaccugcagacaguugucagugggugcugagagcugaggccgggccuucagcaagaacaaguucuguuaaauaccgaguuauuuuucuaguacuuuccuuaagauuucugaguuccacucuaguccaggcuguccuggaacuaaaauaagacacaacacccagcucagcucacguauauccuaaaaaggauacucagaguucaccuccauugauguguguagcuggacucgcuucugcugugugguuccagugguagggcgaccgugccuugucuuaccacuuacuggccuuuugcugcgggaagacagaucagaugagucgagcuguacccuugccauccaggccaggacuagguggaggugggggcauguguuucgggcaaugcaguaaucaccuggcucuuguucccaggccgccacugcccagcagaucccgauaucccuucacacgucucugcaggcccaggcccagcuugggcugagaggugggcuccccgucucccagucccaggagaucuucagcucccugcagcccuucaggugagauagcccaggugucagaccucccuacccuggugucgugugugcugcuccggggccauggacugggucaccacagacugcuagggguuccuguccccucugccgggucuuuuucccacuaccccaugucccaucccccaaaccccagccaacguuucuguauucgugauagcuucagucuuggucaucacugggucuuccugagccugccacagcuugggguuguucaugguccucuggucaggauuguuccaguccacugaaucauucucuggggaagcagggaucuuuagcaaguccuugguaucuguguucaucaguguuggagauggcuguguaccuuguucaccugucucugacccccaucuggcuuuugcaggucucagguguacaugcaccccagccugucaccacccagcacgaugauccucucaggggguacagccuugaagcccccauacucugcauuuccuggcauacagcccuuggagauggugaagccccagucuggcucacccuaccagcccaugaguggaaaccaggcccuggucuacgagggccagcuuggccaggcugccgggcugggcaccucccagaugcuggauucccagcucccacaggucaguuuggucuguugguagucuccucccuccuugccucucaguugccucuugugugcugauguucagauguaucucucagaugcagacagacuaacuagucccacagcgcuguguucugcuggcuucccuucccucuagagcgacagagaugguggcugugggacuggaaaugggccaggugucauguuuguuccuccaucccuucuaguccccacuucagagccugcccucucuguguguuggagcuacccccacccccacccccauccgugggucaaaauguacccuucacuccucacccucgggcccuguguggcagcugagggccuuucccucuguuaggcagcuggcucgcccucuuacuccaucuagauguccugguccaugccuguguguagggagcaugcaugggccaggacucuaaguacuuuaaccccaggcaucccugggaccugcucuucauaccaccguguggcauggcuuccuucuaccccugggaguagacccucagagccgugcacaugcucugccuccaucaguccuaucuccuagcggccacuacugcugcuucccccauguuguauugcccucuguccuccgccaugacggcuugcuucuggaccacagaggcauccugucccucagaugccccucgucgacaggccaccagggcaaauauccuucuucuuugucucuguguagagggagacucggagcugaccuuuuuuuugguuuugguuuugguuuuucaagacaggguuuuucuguauagcccuggcuguccuugaacucacuuuguagaccaggcuggccucgaacucagaaaucugccugccucugccuccugagugcugggauuaaaggcgugcgccaccacacccucagccaccccaucacagcaucacccaguugccccugacuuguaaaaucaucuucaagauguuuucccuggcuuuccugucuccuuauacccucuuccuuccuuccuuccccgcucccaucuaauugugggugugcccuucguuccugucuuugcccuccuuccuggucacugucauccaagcacugcucugcccuggguuuauuucuucaaccuuggguccccauggcugcccagcuuugcuguuuuauaucuccuggcagcucuagcauacugguuccaagacauccugcucaucugaucuacauuacuccauccugcuuuucccaccccucccacuucuggcccuucaguggcuguacacacacacacacacacacacacacacacacacacacacagagccauccuuacuacccugcccauaugcugugcuggauaugcagggucuuaccuuuugcccucaguccuuaguacccugugcagugaguacagcagcccugccuguggaagggcaagagccaggcuguccccuucccagacaucguuccugccugacuuuaccauugcccugcugugcucugcucugagguccuggugucucagugauguguuuccaauagauccuucugacccuccacuguggacucaaagcagggagaugaagaggacagugacugagagacccaaguggcccugcucugcccagugcuauccucuccccgaggcuuguucugacuggggacgugaucucgugggccccggggguucugcuggucugcugcuggcuugcugucuggcagccuccagaaggcucucuuaggcuccaguuuguucuuuuguucauugauucaaaaaucuguggugcccaucuuugugccacacaaagggaugcgaggccaggcuuccugggccgcugucauuuggggaagcucucugccgucuuuccccuccaagccugcacuuggcacccagcucugugcagcaugucacaugcauugcucugucggugccacugcucaugucugacaguacccuauggcgucuccagcacccuuuguuuaaugaagacuccaaggccugaggccacucaggagugccaugucugcucccagaugcauguuuuagcuuucuccccagugucccuucugccucuugacugugcugucacccaacagcucacuaugccacugccucgguauggcuccgggcagcagccacugauccugccacaguccauccagcugccuccaggacagagucucucuguuggagccccccggaggguuccuccaccuggcucccaaccucccguccugaacaccagcagagagguaaaggugcucccagagaggggcauugugcagccaaagccucuaccacagaacggcuguagaaagggcacgccuccagucucucacacugcaaaggccucagucuaagauacuuaaguguaaacuagucaggaagacaggcguuggcgugugccagacugccaggcaucauauacagccugucuuagccaaugaggaggagccacguggccaccacaggugcaggaccuagacuccugaguaaggacaggagucuguguugcgugucucaccaggccacgugagcuugauguaacuggggacugggcgauugugcacacucaguuuccugucccuucaaggaagagccugccugccccugcgcaugcuuuaauccuagcacucagacauggggaccggaggucaaggacagccuuagcuguggagugaggcguagucucagaacaagaauaaacacuaagacugagcuucucccugaguccggguuggguuugggcggcugugggcugggcugucucugggccgcugaaugacucuuuugcuucuuggccacucuaguccgcuccgauggaguugaaaggcuuccacuuugccgacaguaaacagaauguuccuacuggaggguccgcaccauccccgcaggcauacagguaaagaugagcccuggaguuggggcgcauugccaagagcccaugggccaggggaacaugguggaaggcauugcagcauggcccccuuuguguuucugagugucacugaggcguccuugucacguguucaugcuguagcuagcuguggcagagugcguccuggggaaauuguguuuguuucuaaucugcaguguaucaggcucugaggaguaagaacuucgugggguggcagccacagccccgcggucucauauccaaacucacccucugaccccuauuagagaacuucuuuuuuuuuuuuuuuuuuuaaauuuauuuauuuauuuauuauauggaaguacauuguagcggagucagaucucguuacggaugguugugagccaccaugugguugcugggauuugaacucuggaccuucggaagagcagucgggugcucuuacccacugagccaucucaccagccccuagagaacuucuuaaagcuggguguggguggcuuuucuucccaaaccacaaacugguacccgcuguuggcuuccuugguacggguuuucuaccuccaguaaccaucaagguucuccuuggcuugauucagagguaucugauucuguuggaucaucgcaggggcucuugauucucucaagcuggguugggggagcagcgcugggccugggccugagaauauacaaccugauaccuuguguuuaagcacugagugggacagacagaucuguagugucuuucuagaggcacccaggacacacuguacagguggaguccauucgccugacucugguguuccgggcugacauaaagugaagccgccgcccccccccccccucgucuuacacucuugcugugguggcucuguuugugcgggaguacauuccguucuacugccauugccuggcagagggcacacacacuccauggucgccauggucugccugcccagugcgauggcagugaccugggcucagcagguuguaaggagagaacagccuugaaagaaacugggcacucuagccacaaauggaaaauauuugggagugggaagggaccaaaaaugguaucuugucaucauuucuaaggaauauaguauagcuacugucuacauaguguuuguaagcagucuagagaggauuuuccaaguguauaggaagagcuggguguagugggucaguguagacagugcaugcguacuuaagacacaucaggcucuggguuccauucccagaaccaaacaaaaacaaaagaacaggaggcuagagauugagaucacuggcugcuugcuuuuccagagguucugaguucaauucccagcaacuacaugguggcucacagccuucuguaauggauccaaugcccucuucuguugucugaggacagcuacaguuuacucauauaaaugaaauaaauaaauaaaucuaucuuuaaaaauaaauaagaauggccucuauaggcucauauuuaaaaaacaaaacaagacaaaagaacaaaaacaaaacaaaaagccacauacuggagaacauggcuagguuacauguaaauagcauguuaacuuuaucugugaagagacagagggauaugaagacacaggcauuguggugaccagagggauugcuauaacucuuguauagcaagauuuucaggaaaugggcgagggguccucaguuaaaaaucaaaggaugugcuuuuccgauauggugguaucuagcacuagacagccucaucccaaaagacucgcuggccucugcacaguacucuuucuuacagaagaccuuuuucucauaaaacaucuaagggcccuaaggacuaaaugugguuguagaucucuccccuccccccacaagugagaccgaggaccuccucucccuucccccugggguagcuucuuagaaggcugcugcuagccuucaucuggacaccgcaccacacugguccagauuccacagccugaggguggcacuggcugucuucucauggcaagggcuguagcuccucuccugggugugucuccgggaggugccaaggagcacuguugaccgcccuccuuuugcauuugcguuugcauucuuagcugucucaggucugugcuuucugucugcugaagccucuggccagagggccucccugucucgaucugccuccacgugcugcuaggcauugacuccaucucuguggugacacauguguauucucaacccugccuuugguuuuuucaggccuagcucugcuagccccagugggaagcccucuggaucagcaguuaacaugggcucugugcagggacacuacguucaacagguagaagauggcuucccagacccugcagcccuggacacuuaggccugucuccuagcgccaaaggagaggggacuguccaacugauggaugguuuuuauuaagggaaccgugcccuacugcuuagagcugggccaccugaguuccuccuggcaaaagcacuucucuugauggguguuuggauccuucuuuguccugcagagaagggaggagcccgauucccacaagaggagaugccagaagguguacuaucuauccacagccacuuacggcugucauggcgcucuaggagacacgguuaggccuggguuagcucaggcugggugugugugcgugcuagcucuagugagugcuguggcaugucucuguccugggugggaucguggacaggauacagcgucccccacuucacaggaaggauuucucugugucuuucccuguaggcccuuuucucuuccuccuguaaaggugggcugggacuucagagcucaggaccuuggucaggccugggacuuaauaaauuugucacugagagguggagauugugagggugauggcucucuuuuugccccccuuccccaguguuccuuggaggucacuguuccugcuaugagauggguuuuuaacccuuucucccagagcugagggcauaacucaggggcagagcaccugacuagcaugggugaggcccuggguuccacccugagcugacagaacaacaaaaaacacccaacaaaguuucccccagaaguuagacaacugcgguuacccugugcaggccaccacugugcagagcugcuggcuaguguaacccugagaucaggugggguccuggggaaaugccguuauucagagacacuuggaauggggcuugacugaaucaugcaucaagaucugggugaucacaguuggcuucauuccucagcuggguggguauccagcccauggguagauuggucugcugaaggggcuguuugcuugcccauggggcacagggugcacugauuugaaaaggccccucccgucagccuugggaccugaaauguucaccaaggaugugcuacugacuugucuguggaggaccgggagucuucccgccuuucucaaucacugcacccuugggaaggacaggacaguucugacugcacgccaggcuccucccugguuccugugaggauagcuuuuggucugacacuggagcagauagggaguggucucuacacauuuugcccuguggucacuuugguuuuccuguucaucuguccuaaggcaaagcgaguggaugaaaaacccggccugggaaccgugaagcugcaggaggccucaucagccaccucccagaugaagcgaaccggagcaaucaagccucgggcagucaagguggagggaagcaaagccugaaggugccugggucucuugccucaccuaacagggacggugcgccccacacccuaacagggauggugugccacaccagccuggacagccaccgccuggcuuggacagagcucucuuccauucacgaaagcuccugagaguuccaucgucagccagccugcaucguggacauguggcuuugaccugcuugcuuugguacaaaagagcagacuuccuccuucccaccccucugcccagugacuguggagugagccuccugugcagugcagaccugcccgcccgcccgcccgcccaguucccuaggcacagugguuuggcagcagggucauuuuagcuggaggcuuuuuguuuuaaaaagcagcuaagguuuuuacaaaggggaaaugagaacaaaaugcuagcuacaucuguauagcugaacuuuuauaugguccucgcuguccucucucugcucugcuguccccaguggucaccuuuuaucuccguccuguuugacaugucacagugcuaccuuaagaggugauucuuaagagucacacacacacacacacacacacacacacacacacacacacaccccgguuggcuaaccguugggguuuggaggaugugauuggacauucugguuggucccucaccaccuugggcacugugaaguugguaucugaguuuaguucccugguguggaguuaauguuucagaauaagaauuaucuguucagggcccuuuugcugucauuggacacagugaguauugagcaccggaggaauuguggaguuuuguaauccagauuggccccacuuggggacugcaucuugggcuccgugcuuuagcccccuggguggcuuuguuccccacucauuuccuuuccucuuuguggagccugcugugucccucuggaucccuguccauucacuccucacagcuuaucaccaaaaucaauauaaggacacaggugaacaccuauuagucaaguuugcgacaggaaagacuauguauggcacauucaucuuccguccuucacuccugguaacagggcaggguguuggguaggguuucuaagcuauagguguguuacccuuccuuagagaacuggacagggucaagguauaaguggccuacagagaaaccuaugcagccucaaaggaggcugguggugucuaaaggguggugucuuggggcuacugcuugcagguuuugugugagcaccuguaugcgaggcuucuugcuuucacuaagaacaaggaaaauuucccauugcucaaaggaaaaugaagugaauuucagggugcucagcugcugcuuaggacccccauuuaaucacccaucugggguguuggagacagccugcuucagagagcucauaguugguggcagggcugggacaagcaugugggucuguccucaagugucaccaugggcaugagagcagagaagcagcuuagaagcucugaaguggcuucgcccugccuaguugguuguugaaggaagcagaagucuguuucccccggcagguacugccacacuguccccagcauuaccagucagggcagccuuggugcaguuucauugcaacugcagcccucggcuccuuccuucccaccuccgacacaucuccucucuucucgcaucccuccucagaagcacuguccacuuaggaguccccagcacagaucugccugugccccuaucagcccuuccaccccccggaagugaccgaguccucugccccacugccaagcucuaccccauaagucucacucaguaaaagccacacagucaccucuuagaaaugcggccagacccaccucacccaaugcuuggugggcauuaugugucaaaagaagcaaacauuuuucucuuucagaauuucacaggaugcuguuacaaacucaaaaugugcccuuuaggugagccugcugucagaauggcaguacucccuguuuuaagaagaaaaauuaggaggucaccuguuuucaguccuuucucuaacccuguauuucccuccugccucccacccuaaauaaaaacaagaaacacuagaauuuauuuauauguauugauguuguaggucuagauggaaaaaaaaaaguaaaugucccacugcucuguuuauauaaugucugaauuacucugugcaggaaaggccaggaaauugcaugugaaauuuggugugcucaccaccucugugaucucagcugugggcucuaccccucugagaggcacauuugcaacuagacgcugaggacagagggcaggcuucaggccaaaugucccuacuccucggaugaucuggucaagccaaguuuuuaguacagagguguuuuaaggugcaauaucucuuugugugguuuuuagagucaagcucaaaguauaauagaacuugggccuuauuuugguuucaaacccccaucuuuagaucacacauaaaaacaggagcgucugucagggugccauggccuuuggugggaacagguaaaguccagcccugccuuuucuacugcugagauggguggaggugggcagaaucuuuuacuccugccugcugaagucaccuccuacugcugguggcuuuguuggugccacugauggugaaauccaugguuuggcaaccaggacucuucagucuguugguccugaugcggcguguagcaucugucggugaagacuucugccgacugcauuuagucuggucucuuaacaguugcuuuccuugucugauucccaaguuuagcauuuucaaauucagaguucacagaacacuucugggucuaagcuuccuuaagggggauaaacaaaggaugauugcaguacacauuuagaaaugcugguucacauccaaagccacgcuugcucugccacuucuagagauacuuggauaacacuguccaccuugcuguccuguccucuggagccaccuuccagauggucagugaugaagucgugaaugauuugacacucagggcccagggcacaagaguguacccgcugaggccaugaggcaacucuggcuaaguccgccccccaacauccacugggguccccacucugccagguaccugcauguuaacuuucauguucgccuugcccucauuuccagcaagucuggguuagaggguauguugggaaucuuucacaggcaagggcacagaagucuggcuucuguauucuuugaugaguggaaaagccagcucuuugugagauggcucuaagacaaguuaggucauguggaacagaguggucagcguuggggaugagcacagucacccagcugugcucuccacugucuaccagcucugacuagugaucuuccaggugcaugacaccugcagcccccagcugcuugcuucagaccugcaaccuccccaggccccaucuuuggcaugucacaauccuggagcagcaguuccugugaaggcuccuuagcugaaggguccugugcucuaggcuuuccaccucaaaccuuuuauagaaaaggacuugggggauuguucuuuuugaggguccuuuuguuuuccuuugcuuuucuuuuggccuucccucugucuuucacuuagaccagcuauuugaaagggcagacgaugcuaaagguguacugugcagcuuguuuagacgugauauggggaacuucuucggaugggaaauggaaucgugaauucacccucccuucccuccgggucagucccuguuguuucuccuuucaaauaugugauuguacuaggucuuuccauacgaaagaacucuccuuauuuaaauaaaaaaaaaguauaaaaaaauaaagccaaacaugcuuucucaggcugugucgguuuucuaucaucuggaagaguacggcuggcgcacugcuucccgggagacugggaguggccagaauaccuuagggagcgcagcacugugcugugg

SEQ ID NO: 755 - RNA, 4611 nt, Mus musculus
ccuuuuuaauaaagcacaguguguuuccacaagcuguucacgugcucggagcucuccguuucgggccucgcgucuacuuuagcgguuucguuaagcagcgcguuagcuuacgggcaggaguaagagcuuugaagccucgggugcguuguaccuccuggagcugugugagugguggaucgcuuuuucucaacucuucccacacuggaaugccuacaagcugucugucccuccuccuccccaaggucucaggcucgcuauguagaggaugauggcuuugaacuacugccuuugcuuccccagcgcagguauuacaaucaugccuuuuuagguggguggguauuacaaucacgcucagauggcaagccaagcccgaaccgacuccagauguuuugccaaaauucaguuuuuacaaguuagcuuagcauugggugacauccgguuuaagauuguagcaauggggcugggcgaucgcucagugguuaggagcacuggaugcucuuaaagagguccuuagggauuuucuucuucuucuucuucuuuuuuuuuuucgagacaggguuucucuguauagcccuggcuguccuggaacucacgcuguagagcaggcggauuucugaguucgaggccagccuggucuacagauauacagagaaacccugucucgaaaacaaaacaaacaaaaacaaaaaaagagguccuugauuccauuuccagcauccacaugacagcucagaaucaucuggaaccgcaauuccagagaaucuggcaccaggcagucaaguuaccacagauacauauaaaauacauuagucaagagugcacggaauuguuuguucaucguuuaagcauagucuacccaaguuccugcaaagaaagggcgccagaagauuggagagcgagcucuuuggguuccaaguuuagucugaucauguaagucaugcuggugcuucaggacagcucgugggcacucagcuucaggaggaaauuguguugcuugcuggaaaccugagguauguauguggcuuuaaaagcuaguggaugcuacuacccagacccuugccuguucuguagcaagaggcuuaugccugggggacugggauuucucaugcacugccuuuggcacuuuguuuuuuuuuuuguaaugcuggcuggccuacaacuguaugcucaccagugacuucugaauccacaccacccuucacuaguguuaacaaaugacauuugauaaauaaaaugucccgacagcccuguaccuagguuccaggccucagugaugacugagccugaaccuaucuauaugaaucccccugaccuuuccugccccagaucuaauuuuuucuuccacagaaguacagugcaguccuccacuuguuccuauagaaacccagauagcaaucaggcaggaaguacaggauaggauggucauggguuggcccacagagaggacaaggcuucuuggugcugcccauuuucgagaugugccuuaaccacaggcugccuguugugguaggggguuccugaggcccaguguaaagaaaaaaauguccauguagaccaacuaaugucuuugaauauauauuaauuuguaugaucugcaaccccuuccgugcuuagccuucucagagacccugaaggaaagacauguguccuagucccugcuaaauugcuugagaccuugcuccguuuacccaagucgccuucccuccacaccgaggacaucuuucgaauccugucuuaagguuuuaaaauaaccaauuaauggaagacaaaggcaaaagucauagaaaaagcuguucuugggauggcugccuaggugagccuugggaacaccaccacagcacagugcugcgcucccuaagguauucuggccacucccagucucccgggaagcagugcgccagccguacucuuccagaugauagaaaaccgacacagccugagaaagcauguuuggcuuuauuuuuuuauacuuuuuuuuuauuuaaauaaggagaguucuuucguauggaaagaccuaguacaaucacauauuugaaaggagaaacaacagggacugacccggagggaagggagggugaauucacgauuccauuucccauccgaagaaguuccccauaucacgucuaaacaagcugcacaguacaccuuuagcaucgucugcccuuucaaauagcuggucuaagugaaagacagagggaaggccaaaagaaaagcaaaggaaaacaaaaggacccucaaaaagaacaaucccccaaguccuuuucuauaaaagguuugagguggaaagccuagagcacaggacccuucagcuaaggagccuucacaggaacugcugcuccaggauugugacaugccaaagauggggccuggggagguugcaggucugaagcaagcagcugggggcugcaggugucaugcaccuggaagaucacuagucagagcugguagacaguggagagcacagcugggugacugugcucauccccaacgcugaccacucuguuccacaugaccuaacuugucuuagagccaucucacaaagagcuggcuuuuccacucaucaaagaauacagaagccagacuucugugcccuugccugugaaagauucccaacauacccucuaacccagacuugcuggaaaugagggcaaggcgaacaugaaaguuaacaugcagguaccuggcagaguggggaccccaguggauguuggggggcggacuuagccagaguugccucauggccucagcggguacacucuugugcccugggcccugagugucaaaucauucacgacuucaucacugaccaucuggaagguggcuccagaggacaggacagcaagguggacaguguuauccaaguaucucuagaaguggcagagcaagcguggcuuuggaugugaaccagcauuucuaaauguguacugcaaucauccuuuguuuaucccccuuaaggaagcuuagacccagaaguguucugugaacucugaauuugaaaaugcuaaacuugggaaucagacaaggaaagcaacuguuaagagaccagacuaaaugcagucggcagaagucuucaccgacagaugcuacacgccgcaucaggaccaacagacugaagaguccugguugccaaaccauggauuucaccaucaguggcaccaacaaagccaccagcaguaggaggugacuucagcaggcaggaguaaaagauucugcccaccuccacccaucucagcaguagaaaaggcagggcuggacuuuaccuguucccaccaaaggccauggcacccugacagacgcuccuguuuuuaugugugaucuaaagauggggguuugaaaccaaaauaaggcccaaguucuauuauacuuugagcuugacucuaaaaaccacacaaagagauauugcaccuuaaaacaccucuguacuaaaaacuuggcuugaccagaucauccgaggaguagggacauuuggccugaagccugcccucuguccucagcgucuaguugcaaaugugccucucagagggguagagcccacagcugagaucacagagguggugagcacaccaaauuucacaugcaauuuccuggccuuuccugcacagaguaauucagacauuauauaaacagagcagugggacauuuacuuuuuuuuuuccaucuagaccuacaacaucaauacauauaaauaaauucuaguguuucuuguuuuuauuuagggugggaggcaggagggaaauacaggguuagagaaaggacugaaaacaggugaccuccuaauuuuucuucuuaaaacagggaguacugccauucugacagcaggcucaccuaaagggcacauuuugaguuuguaacagcauccugugaaauucugaaagagaaaaauguuugcuucuuuugacacauaaugcccaccaagcauugggugaggugggucuggccgcauuucuaagaggugacuguguggcuuuuacugagugagacuuaugggguagagcuuggcaguggggcagaggacucggucacuuccgggggguggaagggcugauaggggcacaggcagaucugugcuggggacuccuaaguggacagugcuucugaggagggaugcgagaagagaggagaugugucggaggugggaaggaaggagccgagggcugcaguugcaaugaaacugcaccaaggcugcccugacugguaaugcuggggacaguguggcaguaccugccgggggaaacagacuucugcuuccuucaacaaccaacuaggcagggcgaagccacuucagagcuucuaagcugcuucucugcucucaugcccauggugacacuugaggacagacccacaugcuugucccagcccugccaccaacuaugagcucucugaagcaggcugucuccaacaccccagaugggugauuaaauggggguccuaagcagcagcugagcacccugaaauucacuucauuuuccuuugagcaaugggaaauuuuccuuguucuuagugaaagcaagaagccucgcauacaggugcucacacaaaaccugcaagcaguagccccaagacaccacccuuuagacaccaccagccuccuuugaggcugcauagguuucu

SEQ ID NO: 756 - RNA, 21572 nt, Mus musculus
cagagucugucggccgcguagacacaacuaguugagcgucgauccguggccgcugcagaguaaucgagcggccucgcccccaacggucgauccugccuggcgguucgcaggccuggcuccacauggggagccacucuacgggacucgaagaaacgcucguagguuuuggagugccagauuugagagcccuccuggggucugggauccggcuuaggggcggcgcgcuagggacgguggauguucggauccuggcugagcaagucguuuccagggcggccucuuguaaaagccagagugggaagaacuguagagaaagaacgggcucggggcacaagcaacucuaggaggagaggaaugccuccagaagagggaaaaguccauccaggucacugggcuaugacagugcccagagcuccucagggucuuaguuuucaaccacauugggaagggacaggagaggccacuucauucauuagcagccuuguuccuagcaagugcccagcagguguuuuuggaaugacuuguagaaaugaguauccaguucugagauuccugaauucaccccucagauguuuuuauguauacccugugcuugaacacaacuguaauucuccaacagguauguucuggaagaguccuucugguucuauuaacccaacccgcuaugcuguaaauucaucgugacgccaggcggcuuuaggacccuguggccucguuugugccuucccgggcugcuguccguuuacuuuaaugguaguucuuucccucuuuuccagggaguccucccgagcuggcuuuucugcaaaauguuaagauuuuugaaacggccucuaguggugacuguugacaucaauuugaacuugguagcucugacuggccugggacuacuuacccgacuauggcaacucuccuacccucgggcugugguguaaguagagaucggggaggagagucaaugauccaagagucauuguaauuagugacaggaaucaccuugccguacagugcaaaagagagacauucuggguuucuuggaucucuuggugauggauguuuuagcaguguauugcucaggguucucuagaguaacaacuuaagaagaacacuauguuugcauguguguauauguaaauaaauauaauauaguauacauauauacauaugauuuauuggaaugacgacuuacuggcugcaguccagcuaauccaacaaucgcugacugugaauggaaaaguccaggacuccaguaguuuucugcucaguccacauggcugggugucucagcuggucuucaguauacucuggcuucccaaagaagugggcucuagugccaaggaaggaauggucuugcuagcaaggcgagggcaagcaggcucagaggaaaacuuccuacuucugugucuuuaaauagauuuucagcagguguggugcaaauuaaaggugugucuucccaccucaaaaucuggauuaaacuaguguuccuuccugccuuaaagguccagacgagaaguggauccauccauuuuaagcaaaagaucucucauagauguacacuuaacuucuggauuguagaucauuccaaauguagucaaggugacaaccagaaauagucaucgcaagcaguguggguauggcccauuugucccccagaacaaccacuagaauacauacauuuuagggcuuaccuuauaggacuauaguaagaaaguuuuggucugucaguuuccagccucacuuuuccuuagccaguugaaaggugucgguuugaugaauuuguucguaaggggaacuaugcuguuguuauugagaggguauguauauuagcuaauacaggcauucucuucuacuuuguuuuuuuuuuaaauacuuuaaguuuuuuuuuuuagauuuauuuauuauuauauauaaguacacaguagcugucuucagaugcaccagaagaggucaucagaucucauuacagaugguugugagccaccaugugguugcugggauuugaacucaggaccuuuggaagagcagacaaugcucuuacccgcugagccaucucgcuagcccucuccuacuuuguuauaggggucagauauauacauggguagacugaugaccucagcagcccccuuagagauuaauuugaagaagauucuagacauauguaugacuaauucacuauauacgucugaaagaugaggauuauuuaagaguauacgugugucugucuguccaucugugcaugugcacaugugccuucagacucagaagaagaugacagauccucuggagcucaaaauccaggucuuugagaucugccugaguucugggaucugaacacagguccuccguuuacaaucagcacaugccuuaaccaucucuccagcuccaagaugaggauucuuuuuugugggggagguuggggguuguuugguugguuggcuuuugguuuuucgagacaggguuucucugcauagcccuggcuguccuggaacucacucuguagaccacgcuggccucaaauucagaaaucugccugccuuugccuccaaagugcugggauuaaaggcgugugccacuacugcuuggcaagaugaggauucuugaaaacaaagaacacauaaccacgguagcguuaucacacuuaagaccuaaugucuuucauuaucugaagaagcuucugugucauucuuccuuccgcauuugacucccuuucaauuagaucuucaguucugcuccaguccacagcuguagaaaggugcugguggccagugagaguaugagaugggauuagccucaaggcuccuggucaggagguugaccuacacauaccuaagucaaaagcuguggggaggcuggggaaguggcucagcuggguaaagcacuuguuauacaagugugaggaccagaguucagacucccucacaugccaugugggcaguguguuccaucuguaaucccagcaugcugccagcuaggcagggacucucuggagcaagcuagcuaggcagacuagccaaaugacaagccucagacugaugagugucucgguagauaaaauggagaguggccaagggccugcacguaugugcacacacuuucauacacgagcaugccuacacauaacugccuguauaucacauacacauccaugcaggggagaaaaagacuagagaaagaaauaggcucucuacaagacaugcaugcucacugggcuugguaaauuucccaccauguuccuguggguuaaaugaugcugugugugucuuuguguuuggggacagaauacaguuggaacaaaggauccgacccucacgcuucacuuaccugaagucagcuggaaacgagguuuuauuuuccugucuguguuuacaguuaagacuucucgaggguuggagacucaguacuggcagcucuuacaaaggaccugggucaguucccagcaucuacuugagucucacaacugccaccaacucuagucccagaggaccugacccucucuucugcccucgguggacacuacacacaugugaugcauagccauacagggaaaauacccauacacaaaaaauaaauauuuuuaaaagcuuaaauagggggcuggugagauggcucaguggguaagagcacccgacugcucuuccgaaggucaggaguucaaaucccagcaaccacaugguggcucacaaccauccguaacaagaucugacucccucuucuggagugucugaagacagcuacaguguacuuacauauaaucaauaaauaaaucuuuuaaaaaaaaaaaaaaagcuuaaauaacaguucaguuuucuaguuggauauaaaggcggguuuuguguuuguuuauaguuucgaugaaguauauuaugggcaguacauuuccuucuacaugaagcgcaucuucuuucuggaugacagugggccaccauuuggccacaugcuacuggccuuaggagguggguaagagaaacagucagggccuuggaggcccugcaauauaagcuuaucaaauaaaauuuuucaagggcgcaaaucaugauuuguuuucucaccuuguuuggcccauguuccaaauguuuuguuuuagguugguuagggggauucgaugguaacuuucuguggaaccgaauuggagcagguaaggauuuuaacucuccuuaugaaucuacauaugaaagaauagagacaggaugcccaucccccacccagcacuuaaccuuuuacuacgcugagccaggauacagcuggguauuuauguucaagggaccaucugguuaaaggggcaggagggauggcuaagcaguuaagagcacugcugcucuucuggagguucaggacuugguugccagcacccacaugauggugcucaaccauccguaacuccaguuccaggguguuugccacaguggccaggcauauacagucauauaugcaaauacccauguacauaaauaaaagauaaaaagaaagaaaagucugcuuaaaguuuuaagugcuuugugauuguaacuauuccaucccuggcucuugguacauguguccuguggcauuuggcagccacuguguauguauaaacuuuguggccauaauguuuuuagaagcuccuugggguacauaugcuaaaucagcauuaauuucggaacccucccucaccacaucuaugcucggugagagcuggcaccacggcugcagagcugauauuuacuacccagagaggcugaggcaggaggaucaccugaacucaggagacugacauccuagacaagcagggucucacuauauagucuaggcuggcuuggaacucaauauguagaccaggcuggccuugaacucaugaucauccugccucucaagugcuaggauuuaagguguucaucaccauacccaguggugaaacccagucucuuaaaaacuacccaccaaucaaauucccaagcucauuucaaagacuuuaccccaaguguacacccucaguagcucaugugccucccaguuuuguaagauugcauuugccagucugugagcugcugugucaguaggcaagcucucagcucugcuaugugauuccuuuccagaguacaguagcaaugugccuauaugguccuuacgccugcugccagcgcuugccggggcccugucagugcccauggccuaccagauagugcuagagcuccacuuuucccacggugcugccauuggagccgcccugcugaugcucauugguaagccuugggucacugcccaccugccugugaagagaacaggaaaagaaaaccaagcacuuuggggcauuucaacaugacacuugggaguagugccugugguaguaugugugcugcccuaguguguguguugagagugugugugcugcccuaguaugugugugcugcccuagugaauacaucugcuucauccagauuccagaugcgccccacucugggaugcucuuugauggaggauugauggacuguaaggucagacacuuuuuggaaguggaaauauggccauggugguaauuaaagguggggguugccagacaguacuugaaggcacauagacaccauggccuucauacacauucauacaauucauacacacacguaaguuuuuuuuuaaauuaauaccuaaagaaaacagccccaagcguggggcuguaacccagugauugggcacuugccuagcauuuacgagguccugggugcagccccagcacaaaagcaaaaauaucccaugguggcucaugcuggccuguaaucccagcacugggacgccugaggcagaagagucuuaugugugcggucagccugggcagcauagcaagaauagggccccaauuuuuuuuuuucaaaacuuccuucugcaccaacauaaagauuuucuucuaugugacugcagaaguagcucagaggucaagagcaauuacugcucuuguagaguuugguuccuagcuuccaaguaaugacuuacuaacuucaguucuagggaauccaaugcccucucuugacuuccacaggcaccgcacacauggugcacacacauacguacauggcagcauaaaauaaguuguugcucccuuaagaccauaaaguaacuaugugccauuuacaugguauuagggauuuuugauaauauauaaugccuuuaaaugugcagaggauauguggaagguuuuauguauacacagaaacuggcaucugcagaggaugcucucuguccagucucuggagacacggcugugugccccuccugggacuaguucuguauucacagcagcuuggacugcucagugcugacaacuguuugucucugugacagagaacgcccugaucacucaguccaggcucaugcuguuggaguccauacugauauuuuuuaaccuguuggcuguguuguccuaucugaaguucuucaacucccagacacacagguauggaaagagagacacacuucuuguuaggagaaaaaagggauucuagauuguuuccuucauuuuuuagucagggucugacugcggagccuuagcuggcagccaugccucaugucagccuccagggcgauggugcaggggaaccugcaccuggcucugggugacuuugaggaguugcuuacagcgugccuuuugguuacuuaauccuucagguugacccuuagcccguggcuucauaaguacauccuuuuuuaacuuuaacucacaggaaauuuguuuuccugacaaaaaggaaaguucuucugagacccaaauggggagguaugguucuuuauauuguggcugguacccaguaggacuggccaacuagaagcugcucagacaagcuccauggcccugaccugugggaugaguccugugacugcuuccuuguucuucuguuuucuccuguuuuguucagcccuuucucagugcacugguggcuguggcuacugcugaccggggucucuuguuccugugcaguugggugaguuagagccccugacuuggauaguauucuuccugucuguggccuugucugucuuguaaccucauuuuaauucugucuuuuucaggaucaaauacauggggauuuucaccuaccugcuugugcucggcauugcagcuguccacgcguggaaucugaucggagaccagaccuugucaaauguagguggucacaccagggccucgugaaucugcuguauguggggauuagggugucaagcuguccuagggaguaguuggcuuaaagaaguggagccucuggauccucagggcuggagagauggcacagugguuacgagcacugacugcucuucugaagguccugaguucaauucccagcaacuacaugguggcucacaaccaucuguaaugagaucugaugcccuuuucuggugugucugaagaggcugacaaugaacucacauacauaagauaaauaauaaaauuaaaaaguaaaaaagaagaagaagaaggaggaggagaaggagaaggagaagaagaggaucuucaaggcuucaggagcagggaguagggaagcuggcgccccugugagcuucuagcagcaucuaccugggacaaagggcuucaggguuucucaggaacuucccugagccuccaugcagguucuggaaauggcuaccgcacucugcagaucgaaagaccuauccucucaccccuggcagaugcgcgugcucagucacuugcucgccagaaucguggcucugcuggucgucccagucuuccuguacuuacucuucuucuauguccaccugaugcugcucuaccgcucugggccccaugaccaaaucauguccagugccuuccaggccagcuuggagguaagaaacacacagagcaaagacagucaggcucagcuucucugugagcaaugcgggaucuguagcccucgggagggaaagguggggcagggcagcuagggcuccaucucgagacuuuguuuucaguaaccaaaugaguggauaucagguagauaaauagauaaaaauacagcgugagggagcagugcugcaaacgucaagaacugaggcagccauguugcauguucauguuuguuuauuguaaggaacaguuucucauuguagccuuggcuguccugaaacucacacuguggaucaggcuggccuugaacucagagaucugccugccucugcguccucaguuugggauuaaagacgugugccaccaucaaccggcccauguugguguuuuuaaaggaauuguaaaauacugauugugugggaggaagagaagcugcuuucauagccugacuugcaguuagacaccucaugagacagacucaagcccgugcacaugacacuagcuagcuacggguguacccaggcugagcgccccuaacaaggaagucugcaauuaacaaggugagaucuucagaacuuucugagugcuugcaaggacacucaagacaccuucagauuacagaguguuuugcauuuuggaccuucagauuguggguggccccccaacucucccaaauuagaacacuucugguuccaacaucucagcuaaaagaguacugacccauaaaauguaccaggugugguggugagguguguagccuugagcaggccugcucaugcuggcucuacugauggucacaucugcaugucacuguacccuggucucauuucaugucuuaaacacagucacuugccucaaucacagcguugauagucauaaggaguguguggugggaaagucaccggaaugccagggagcacacacccacuuaugauugugguucaguaggacccaaguugauggguuacaacuaauuaucugaucaucucugccaccaccccaucugucaguuucggauuguuggccuugguccaaugagacagccccauagaaagggcagcugcugcugagcccgaccccuccuccugucuguagagccaucgggugggaugcuuggccuccugagcuuaucuaagaccuuuucuaugugucuuagggagggcuugcccgcaucacccaaggccagccccuggagguggccuuugguucccaggucacucugaagagcgucucuggcaaacccuugcccugcuggcuucauucgcacaagaacaccuaucccaugauguaaggaaagugacaauuuuaauuuguaaucacaaauguuuuacauucucccaguuugcuaagagcugccauuuucugugaucaaguuuagagagacaaaggcagcagggcccaggcccaggcccaggccuuuugugguguccaguaugaaacacuaggaggacugaggcaugccagccacuccuccuccagugccucagagcaacucugccucacuguuuguuccauguucucuggccccuauauuguugaguaaaacuuccuacuggguguucucugcagagaccacuagagagccacccgcuucaggugucuucuuuguugacaucucacacagauaugagaauggccguggcagcucccaccagcaacaggugaccuguuaucccuucaaagacaucaauaacugguggaucgucaaggauccugggcggugagugugguuuccucagagcucauugguccauccaucauaacuggcagaucgcucugcugaguccuaggccuucuuuucacgagugcuuccuggcuagagaccucuuucucccagagcuugaguaucugcugccagcuguuauuguuauugugaggccagggccgggucggcauccucggugaccugacuuagcuucucuuaggaacugugacaggaauugugucugcuccccucaagaggaccuaguguggaggccucucugugcucauucugugugcagccuggcugauagucugccuaucaauaagauucuucuucuucuuuuuuuuuuaagauuuauuuauuuuuauguaugugaguacucuguugcugucuucagacacaccaggagagggcaucagaucccuuuacagauggucgugagccaccaugugguugcugggauuugaacucaggaccucuggaagagcagucagugcucugaaccucugagccauuucuccaggccugagauuaauuuuuuaccagcauucacccuccaucccucacuccgaugccagcacaggcagccucuaggaggccuuacacugggcacucuccuucccugccuuccccgguguccuggcccuauggacucuaguuccugcccucgagacugcuaccauaaccuccaugagcaccucacuacaucaggcccuuggccaucucugcacucgcacaccuucuugccaagaauaugaaggcuggguccuuugaggaggccuccuaggccagucuacacaaaugcguacccuccucuccugucucuuuuccccaggcuggcccguuuccaaucucauaugguugcugacuugguuugcacaucugcaugucuguuuuucugacucacaacagugagugaggccacccugacccugacccugucuguccuguccagcuguuuccccagcacuggggacuugagaaguucuaaggguuagggugcuuaucuacuuguuugguuuuguguuuugucuuucuuuuuccuguuuugucuuugagauagcaucucuccuuguagccaagccuugccucaaacucucaguccucucaagagccugagccuccuaaccacugggacugcggguguguaccccccacccagauaggcgcuuaauuuuuauuuauuuauuuuuugagguaugaaaaagaguaugcugucaacaugaagauauaaggugggggaagcaguuaguguauucuucauagauagugugacaguggcagauggcaucacacuuggcagugaccuuagguugaggagcuuuagaggaaacacaagugccucgauucccaagugucugcucggagaccucagucucagcaucccauagagcuuaucaaaagggggcugcgugucagccugacagcacugucuuccuagacaccagcuggugguaaacaacccuccccggccuguaagacauggagacauuguacagcucguucacggcaugaccacccgccuccuuaacacgugagugccccagugcuuguucugucagggucuccuucacucugucuacaucccacucagccuguuuccgucauccugacuucugccuccaccucacucccgugagaauacacagugggcuucauggcuuuucugcccacagcccucucucuagugacccucucagcucuccugaggcuccuagugacccugacuagugucaccccaucacuuggccucccugguagcccugaaguaagcagcacagcaccucaggguuuccccacucucuuuacugcugggguaccuaaggucaccuuaccagaaaccugccuguacugucccuccuauagaucuuauucugacacucacucugucuggcagcccaucauccacugcucacugcugggccucuucgggcgccuggugcauccugagaugaagugaguccugccugaguagccuggaggugacaggcugcuugugaacacugaggcugacccacacagaguagccugcugucucagcgugagaccacugugcccaucucgcccagagacaacaguacuauacugauuuuccgaguucugccagaccagugauacacuggggccaguucuuagacucagacuuccaguuccuggaacagacauucuauucucagagauuugcucaccuguccaaagagugagugacacccauccaauuguuugacaucaauucuggacacacacaaugaagacccucccucacagauacaccaacaaggcgguuggaucugggcaguccugcaguugagucuugguucucagaugacuuuaggcugugucauguugaccauuaaagccugccuugggguggcccacaucccggauacauagccucugugggagcugcauuuguggccagcuucccuagccuuggcaggcagagcaggcuugguuuccaaaggcacuguuuuucccuuagugacacucuaaggaauagcucugcucugcucuugcaggcacgaugucgcagccccacugagcccccauucucaagaagucuccugcuacauugacuauaacaucuccaugccugcccagaaccucuggaaacuggugaguuccgugcuggccugggugcagcagggucucauggcggucagugggagcaccugcucccuaccucagaguacccagaaugccuccucagaugaaggguucaaauggaaacuuggauaagaaacuuugauuuagcaagucugagaugucccaauggggagcagucaccucaucaggccgagaguccucugggccucaggcauggauugggaaaguuccaagugcugugucuucccugccagggccuuucgggucagggcuguuccagcugcagcugccucauggacuguucacuuuuucacccucuggccuaguuucuuucuggugcugugucaaaagcaacuuagagaggaaaggguuaagcuacaguccaccccucuucgagucagggcaggaacuuacugaaaccguggaggagcacugucacuggcucacucccacauucaggcuuuccugcccaggaucugcccagggaauagaaccacccacaaugggcugggcauucccacagcaaguaacagccaagguaacucccucacaaauaugccaguaggacagucuaaucuggacagccccucaguugagacucccuccucaaaagucucugggcugugucacauugauaauuaaagcuaaguaagacacccucccaccacagacauggcagccuccgccacuccugugucccaggggaagccucccagccaguucuuacccauagcccacaggagcacaagcaguuuccuggugagggccuuggccaucagagggcgauuucacugcgacaguguccuucuggugacagucaucugcucuccuggcuccugcuagugcuccuucccuguccuggcccaaaguguuauucuugccugaagccuacuuccucguccuggcccaaugucaaauuccuaccaagcggucccaaaagcucuccacagccuaccuagguagcaccaugccaguuuacugccuucgccagcacaggucugucugggggggcugcuuucauuggcacaccugacccaccuuuaccuguuuuccccuuggaugugcggcacacuuccauggccguuuccauccugcugcuuaaucccucccgagugggccugacugauaaaaggccggcgucccuucucguuggaagcugucucaggaggaauggcacugagucucacugaccucccugccagcuugcugccaguggcuccauugcugaccugugccccugcccccuuccuagcagcccuuugaguaccacuuacccaugucagauggagccuccagaaaggggagcaggccucaggagcggcugccuggcccaggauggcuugucuaggaaccaucccuguuuuggcuagaguucuguguccucuugucugaauagguaucuuuugaguccccguggcuagcucaaaugcuguguuguaaagggcguauggggucauggagggucuguagugccaaggacuagcuagcgaccugugcuuccuuugcuggagagcuuagcccagaccaaacugauuccauagcugugugacugcuccucacuuaucuuaggcaaaaggccaagaagccaugggugucuggucuuucgguagcuauuuaacacguacgaucugcaaagggaugcacaagugacuagucauauuuagguuuauaugguuuguggugcuggggaugcaacccagggccucaccaaugcuaggcaagugcuccacugccagccccccaggcugacagguucugguucugcaggacauugugaacagagaguccaaccgggauaccuggaagacuaucuugucggaagugcgcuuuguacaugugaacacauccgccaucuugaagguaaaggguagcucagguaugccugucaggccuagccucacccagacuauuccuggagcuguucaggccugugcucacauagcugccaagugaugaacaucucccuguuuuauaguacacgcagggggagaagaauccuaggaagaccuggggcagggaccugcugacacagcaguggggucagccgacucucugucaugcucauugccuuucuugguuuuacuagcugagcggggcucaccucccugacuggggguuccggcaguuggagguaguuggggagaaguugucaccgggcuaccacgagagcaugguguggaauguggaagaacaccgguauggcaaaagugagucaucaaagcucugggccaugggcaucugcuugucucuguggaucuggugccacucaaggaaacgccaaagcaacgcuggguuuggagggaccuagguuccuccauucuguuuggcugagucccuugcacccauccaugaguaauaaggcguuugugcuacgggccugcggaggaggcuccugcaucccagaguacacuaauccugucuuggccgaggaguguggggugugggaaccuauggggugaugugguuuggugaggugucccccuggauacgggaaggcuggugguagcuucuguccuccccucuucagccucucugugucucguccuugucuacugucaggccaugagcagaaggagagggagcuggagcuccacucgcccacucagcucgauaucagcaggaaccucagcuucauggccagauucucagaguuacaggugaugagugccuggagggaugcccgcccgccugcccuugcucggugggagcugauuucugccuuugauggcgccgcgugcuauugcugggcucugaaguucaaaggacuugaaccuggaacuugagagucugcagcagaaugagugucucucccgacuucaggccccauggaccugcaccuaguaggucagggccaaggaguuacuguacucaugugacauuacaauaaagucgggaugucuucaggccucccgucaggucagaaugggccacauucaacucacagagcccuagguaagacagucagacacucaacucugugacaagauuccugucgcagucugcagggcagaugcuggaaugugugcagucaggaccccuaccaucagcccaggucagcuugcagggcccccaccggcagcacuugcugauugaacuuaggcugggcgguuggcauacaagggauagcaguuuagugauagaccaugacaucguggcagcuagaggcaaugaucuucugcaaccugugugugcuuuauccuguggcaguggaagaugcugacgcugaagaaugaggacuuggaacaccaguacagcuccaccccgcuggaguggcucacgcuggacaccaacaucgccuauuggcuacaucccaggaccaguguaaguaagcauguguggggccguugggcuccuguagguugccaggauuucuccauagcagaggcucagaaggugcuuuuuuuuguuuggacacuggggcaguugaaggccaaagagcaaggccucccuuuccugcugccugcagagggaagcccacuuuugcccacuccugucagagcauuuuauguuuccccuguaucacccagccacuaagcuggcggggucugcuucugcuuccuugagccacugcagacugggaucgagcggggugggguugccuggaagcagugcuggcgggggcucacuagguaaacaccaaccuccccagccugcacagccagugcaccugagccagucccagggcugccccgcagcuguguguguaaccauggauucucuuucuggucuuuucuaugaccuuccuaugaauaguuuuguuguuaagaggaauucccagccaggcagacacacucuugcaaucucagcuccauagguagacagggaugguacguuugaggccaggcugggcugcuuaggacacaauuucaaaugagcugggauuuguggguagaucugagcggcagugugugcacagcaugcacagaguccagugccccaaaucuccauuacuccugauuuucaguuuugacaaacaagagagaggaaguuaguucuugucuagaagagaggcccugggaacagguucauccagauuuguucucaggcuacggagguccagaugcucuuguguggcuuuggacucugccaaaguacauuugugcucuccuauggccacugcccucugcuuggagugaggggcaggucgccagcccugacugccugugauuucaggcucagauccacuugcuugggaacauugugaucuggacuucagccagccuugccacaguggucuacacucuacucuucuucugguaccugcuccgccggcgaaggagcaucugugaccucccugaggguuaguguacccucccuggauaggaacacauugugcauaagugacaggcaccuuuccuaggacccaaggcccugggccccuguuuuuacagguaggggcccugaacuggggcaguuaagcuccacaucacaauggaaacuuuagcaaagagggacagagcccugguuccagggcaccgacaugcgcuacaagcauugggaugaaccaggcagccagcaagaggcauaagggcagugacugagcagcugacagaaacgcacuuggaaagaaaaccacagccacagcagcagcagcagcagcagcagcagcagcagcagccccccccccccgccccacccccaaaggcuaugggaagcaguauggcuccuucccuguaaucucuguucaucucagaaacacugagaaacacucucccuucuuucugggcugaauacaauguaucuuuguggcugccagagaucugccagcagaauucucagaugaaaacaaccuggccuuuacaguguccuuaauuaaggcuggcugugacuuugaagugcugggucugaccucaucccaauccuggagacuugcagaaaggguugucaagacccaggaggaaucaccagugucaucaaucagcccacuuagucuuuggggguugggugaggugcugaggacaguaugugacuuaggaaugugguggugcugcucugagaucuacccucccacagaugccuggucccgcugggugcuggcuggagcccuguguacuggcggcugggcacucaacuaccugcccuucuuccugauggagagggugcucuuccucuaccacuacuugccggcacucaccuuccagauccugcugcucccgauuguccugcagcacgccagcgaccaucugugcagguguggggcugugaaaccaggaagagcuuagccuucauuccaggacagcagcagggccgcccagaccuggugggauguggcagauagaaagcuuuugguuagagcagaggacccugauguggagucggagugggacauaccucuggcauuguggguagucauggcaaagccagaagcagugaugaggguugugcacaauguguauaagcagguaaggguggggggcacacaagcagggaggucuaaggagcgcaagggggguccacaggugucagugggugucagcagguagagcauagauuccugggagacagccaggcaggggugcugaggggagaugagccaggucucugaccucacuguacccugcugcccacaggucccagcugcagaggaaugucuucagugcccugguuguagcaugguauuccuccgcaugccauguguccaacaugcuacgcccacuaaccuauggggacacgucacucucaccaggcgagcuccgggcccuucgcuggaaagacagcugggauauucugauccgaaaguaauagagaacaagaacacagaagacaagcacacaggacaaagccucaaagauguguuugucucccaccaacaggagccucagcaggcaggacugccaggguccaggaggaacuccagggacuaauuccaauuucaccucaagagcccuguccacugguuccuuguuugaagcaauugauuucucuucacacagugaagaaugugcccagccacagcguuacccaugaggcccaacucugacccagccagaguuugagcugccaguguaggaaccaccaaggcaggaggggcacccagccagggaaggagugggggggacucaggacgagcugcgggccuacuauagggccuuagcccugucauuuauggggcccacagugccacaccucauugggcacaggcacagccacccucuguaaacccugaaagcugccagccauccacagacuccugagccaacucuaaagaguccugggagacugcagccaccuaacugccacggccaaggugucguccauucacuuccuuaccuuuaauguaaauaaaacaggacaaauuguuaauguuuuauguuauuuauugauucucccuccaaagagggguuucaguucaacaaaaccagcccagcacuagcagaaggcagccccgagcucaucacagcucagcugcugugauccacaguuguauugaacauaaaacgagacgucccgugccauggcuuguggcgacagcaaagggcacuuccaaaaacagccgucccauggggagggacgacaaacuugacaacacagaagggagcguuugugaagccaggagcuugagcugggugugcaggagacuagcuggcuuuaggcagccacggucaccugccucugcacugaagugcucccuggcuggagagagccugccuggcaugcuagccaugaacuguacccaagugacuuguacacaggcagcccccugguucaaggcugccugcagaauugggagacaauguuucagccacaagagaccugauggcccacucccaucuacccaagauccaggcccccagauagagucauguggguaguccuuagggucccugccucaggcuccuuaaacuggaccauagcccaguggucgguuguaaaacuagguucagagcucacaaacagccugccacaaaacaaacaagggaucuaacaucucugcaagcuuuacuucugcaacauggacacaagccacaccauacggggaagcacuucccuugggcucacugucaacaccagaccagccagugcccgggcuguuuccuguugcaccaugauuugugucccgcauccccuggggaagcugguaccaugggcuuacuaugcuguuugggacagugacccagagaccuguggccuccuccaaugagaggaaugggaggaccccagaaugcucugucagcaugagucugcccuccgugcaaggaaggcuuugguccugaugccacccuaggucccacucauugagagggaucccugacugugcuuuuaggagccaguggucguccccaggcccuuaauccugggucuguggggaaccuacauaugcugguccucaauggggucugcugcuagacuccaggugugagcgcuugccaguggccaacaccccagggugaucuccuggcucggggaagguccucuugugguugcgcccguugggcccgccucggugccgcuugcacagguccccguugaggauguccuggauguguugcacgaucagguugauggccacuguaaucaagggaagguucagaggcucacucccaccccacugcagccuccccucucuccccuacccugcaaaacacucauggugcagaaaagccacugggccuuccaggcucacagcaguccugaucagccagccuuaugucucaccaggcagaaggcaaccaaccggacaggcgcaguccaacguccuggcuuggucugcugugaggguacgugggacugagcacaucucaacagccugacaugccccgcccagcagcucuauguguuuggaaaguacacaugaacccaugucccagauaaacagcgacuggccccaugcacacacuugggcggccuccguagccaaggcaggagaugagagucucugcuucaugguuuggguguggggcugggguuuucuuacccauauuaucaacuccucgagggaugaucacgucagcguacuucuuagucugaaagacagagaaggcucucuugaggcuggucacuuuaagguacucaggcacaggggcugauagccuggauguugguggcacuggcagguugggacagccucggacaggugagagauggggucugaacagugaaggagaaauuuaacccggacugaaccugcgagucagugcuguacugugcuugccugauuacaguuuaauugcuguccaggguaggugacaccacccacaguuccuggccucugaaauugggacuaaaguugcaaauguccuguaggagugagccugacagggcaagagcugugccaugcaugggccugcauggaggcaugcauggcacuuggcaccugcaugcucucaggauuuaguuuuuuaggccagugacacugcagcacacacaacugagacaagcagagagaaaggcugcugagagaaccugguugaaccagacaaagcccagagaaggugaggguauacuguggacccaggguggguccugaugcuguggguuugggucaaggaggccuguccccuguggcagacaaauugcugaaggcaguagagacucuuuccaugaaaggugagaagagcaaaccugagcugguacccacuguggcaggaucaccagguggggugaagagggacugaaacccacuccccuucccaccagccugggaaaugcuuuggagcggcuugcaggaugggaagagcugagucaggaaacugggggugucagugguaccacaggaagaaggacagaggagccaguugucccugcucagcucacgcucaggugcagggcugggguuucgcugccuuucaucaucuacucagcaaaaggccuacaaguaagagacugcaacagccuggacuucacacauugcacucugcagaaacuucagagagcauaaguauuaaagaaaaaaauagguuagcacacuuuaggugcgugggggcaguucaagacggguuucucuauuuaacagcccuggcuguccuggaacucacucuguagaccaggcugaccuagaacucggagauccaccugccucugccuccugagugcugggguuagacgugugcgccaccacugccuggcaauggugugcacuuuagucccagcacccggaaggcagcucuuucagcggcagcacagggauuugggucccguuuuccuaguucacaggggagugagcaagacacacaggccagacuuggaagagaacagcucauacgggcacaccggggucuagccugagacacauaggccaacagugcagauagcucccaggcggacagagcugagagccaugcagucaccccagggucuagccugagacacacuggcaaacagugcagacagcucccagguggacagagcugacccccaauuuugaguuugaaugcauaaaggcaauaccggcaggcagaacuccucaaaggcugguuucacaaaggcgguguacugagucaggaucugcuccag

SEQ ID NO: 757 - RNA, 21572 nt, Mus musculus
cuggagcagauccugacucaguacaccgccuuugugaaaccagccuuugaggaguucugccugccgguauugccuuuaugcauucaaacucaaaauugggggucagcucuguccaccugggagcugucugcacuguuugccagugugucucaggcuagacccuggggugacugcauggcucucagcucuguccgccugggagcuaucugcacuguuggccuaugugucucaggcuagaccccggugugcccguaugagcuguucucuuccaagucuggccugugugucuugcucacuccccugugaacuaggaaaacgggacccaaaucccugugcugccgcugaaagagcugccuuccgggugcugggacuaaagugcacaccauugccaggcagugguggcgcacacgucuaaccccagcacucaggaggcagaggcagguggaucuccgaguucuaggucagccuggucuacagagugaguuccaggacagccagggcuguuaaauagagaaacccgucuugaacugcccccacgcaccuaaagugugcuaaccuauuuuuuucuuuaauacuuaugcucucugaaguuucugcagagugcaaugugugaaguccaggcuguugcagucucuuacuuguaggccuuuugcugaguagaugaugaaaggcagcgaaaccccagcccugcaccugagcgugagcugagcagggacaacuggcuccucuguccuucuuccugugguaccacugacacccccaguuuccugacucagcucuucccauccugcaagccgcuccaaagcauuucccaggcuggugggaaggggaguggguuucagucccucuucaccccaccuggugauccugccacaguggguaccagcucagguuugcucuucucaccuuucauggaaagagucucuacugccuucagcaauuugucugccacaggggacaggccuccuugacccaaacccacagcaucaggacccacccuggguccacaguauacccucaccuucucugggcuuugucugguucaaccagguucucucagcagccuuucucucugcuugucucaguugugugugcugcagugucacuggccuaaaaaacuaaauccugagagcaugcaggugccaagugccaugcaugccuccaugcaggcccaugcauggcacagcucuugcccugucaggcucacuccuacaggacauuugcaacuuuagucccaauuucagaggccaggaacuguggguggugucaccuacccuggacagcaauuaaacuguaaucaggcaagcacaguacagcacugacucgcagguucaguccggguuaaauuucuccuucacuguucagaccccaucucucaccuguccgaggcugucccaaccugccagugccaccaacauccaggcuaucagccccugugccugaguaccuuaaagugaccagccucaagagagccuucucugucuuucagacuaagaaguacgcugacgugaucaucccucgaggaguugauaauauggguaagaaaaccccagccccacacccaaaccaugaagcagagacucucaucuccugccuuggcuacggaggccgcccaagugugugcauggggccagucgcuguuuaucugggacauggguucauguguacuuuccaaacacauagagcugcugggcggggcaugucaggcuguugagaugugcucagucccacguacccucacagcagaccaagccaggacguuggacugcgccuguccgguugguugccuucugccuggugagacauaaggcuggcugaucaggacugcugugagccuggaaggcccaguggcuuuucugcaccaugaguguuuugcaggguaggggagagaggggaggcugcaguggggugggagugagccucugaaccuucccuugauuacaguggccaucaaccugaucgugcaacacauccaggacauccucaacggggaccugugcaagcggcaccgaggcgggcccaacgggcgcaaccacaagaggaccuuccccgagccaggagaucacccugggguguuggccacuggcaagcgcucacaccuggagucuagcagcagaccccauugaggaccagcauauguagguuccccacagacccaggauuaagggccuggggacgaccacuggcuccuaaaagcacagucagggaucccucucaaugagugggaccuaggguggcaucaggaccaaagccuuccuugcacggagggcagacucaugcugacagagcauucugggguccucccauuccucucauuggaggaggccacaggucucugggucacugucccaaacagcauaguaagcccaugguaccagcuuccccaggggaugcgggacacaaaucauggugcaacaggaaacagcccgggcacuggcuggucugguguugacagugagcccaagggaagugcuuccccguaugguguggcuuguguccauguugcagaaguaaagcuugcagagauguuagaucccuuguuuguuuuguggcaggcuguuugugagcucugaaccuaguuuuacaaccgaccacugggcuaugguccaguuuaaggagccugaggcagggacccuaaggacuacccacaugacucuaucugggggccuggaucuuggguagaugggagugggccaucaggucucuuguggcugaaacauugucucccaauucugcaggcagccuugaaccagggggcugccuguguacaagucacuuggguacaguucauggcuagcaugccaggcaggcucucuccagccagggagcacuucagugcagaggcaggugaccguggcugccuaaagccagcuagucuccugcacacccagcucaagcuccuggcuucacaaacgcucccuucuguguugucaaguuugucgucccuccccaugggacggcuguuuuuggaagugcccuuugcugucgccacaagccauggcacgggacgucucguuuuauguucaauacaacuguggaucacagcagcugagcugugaugagcucggggcugccuucugcuagugcugggcugguuuuguugaacugaaaccccucuuuggagggagaaucaauaaauaacauaaaacauuaacaauuuguccuguuuuauuuacauuaaagguaaggaagugaauggacgacaccuuggccguggcaguuagguggcugcagucucccaggacucuuuagaguuggcucaggagucuguggauggcuggcagcuuucaggguuuacagaggguggcugugccugugcccaaugagguguggcacugugggccccauaaaugacagggcuaaggcccuauaguaggcccgcagcucguccugagucccccccacuccuucccuggcugggugccccuccugccuuggugguuccuacacuggcagcucaaacucuggcugggucagaguugggccucauggguaacgcuguggcugggcacauucuucacugugugaagagaaaucaauugcuucaaacaaggaaccaguggacagggcucuugaggugaaauuggaauuagucccuggaguuccuccuggacccuggcaguccugccugcugaggcuccuguuggugggagacaaacacaucuuugaggcuuuguccugugugcuugucuucuguguucuuguucucuauuacuuucggaucagaauaucccagcugucuuuccagcgaagggcccggagcucgccuggugagagugacguguccccauagguuagugggcguagcauguuggacacauggcaugcggaggaauaccaugcuacaaccagggcacugaagacauuccucugcagcugggaccugugggcagcaggguacagugaggucagagaccuggcucaucuccccucagcaccccugccuggcugucucccaggaaucuaugcucuaccugcugacacccacugacaccuguggaccccccuugcgcuccuuagaccucccugcuugugugccccccacccuuaccugcuuauacacauugugcacaacccucaucacugcuucuggcuuugccaugacuacccacaaugccagagguaugucccacuccgacuccacaucaggguccucugcucuaaccaaaagcuuucuaucugccacaucccaccaggucugggcggcccugcugcuguccuggaaugaaggcuaagcucuuccugguuucacagccccacaccugcacagauggucgcuggcgugcugcaggacaaucgggagcagcaggaucuggaaggugagugccggcaaguagugguagaggaagagcacccucuccaucaggaagaagggcagguaguugagugcccagccgccaguacacagggcuccagccagcacccagcgggaccaggcaucugugggaggguagaucucagagcagcaccaccacauuccuaagucacauacuguccucagcaccucacccaacccccaaagacuaagugggcugauugaugacacuggugauuccuccugggucuugacaacccuuucugcaagucuccaggauugggaugaggucagacccagcacuucaaagucacagccagccuuaauuaaggacacuguaaaggccagguuguuuucaucugagaauucugcuggcagaucucuggcagccacaaagauacauuguauucagcccagaaagaagggagaguguuucucaguguuucugagaugaacagagauuacagggaaggagccauacugcuucccauagccuuuggggguggggcggggggggggggcugcugcugcugcugcugcugcugcugcugcugcuguggcugugguuuucuuuccaagugcguuucugucagcugcucagucacugcccuuaugccucuugcuggcugccugguucaucccaaugcuuguagcgcaugucggugcccuggaaccagggcucugucccucuuugcuaaaguuuccauugugauguggagcuuaacugccccaguucagggccccuaccuguaaaaacaggggcccagggccuuggguccuaggaaaggugccugucacuuaugcacaauguguuccuauccagggaggguacacuaacccucagggaggucacagaugcuccuucgccggcggagcagguaccagaagaagaguagaguguagaccacuguggcaaggcuggcugaaguccagaucacaauguucccaagcaaguggaucugagccugaaaucacaggcagucagggcuggcgaccugccccucacuccaagcagagggcaguggccauaggagagcacaaauguacuuuggcagaguccaaagccacacaagagcaucuggaccuccguagccugagaacaaaucuggaugaaccuguucccagggccucucuucuagacaagaacuaacuuccucucucuuguuugucaaaacugaaaaucaggaguaauggagauuuggggcacuggacucugugcaugcugugcacacacugccgcucagaucuacccacaaaucccagcucauuugaaauuguguccuaagcagcccagccuggccucaaacguaccaucccugucuaccuauggagcugagauugcaagagugugucugccuggcugggaauuccucuuaacaacaaaacuauucauaggaaggucauagaaaagaccagaaagagaauccaugguuacacacacagcugcggggcagcccugggacuggcucaggugcacuggcugugcaggcuggggagguugguguuuaccuagugagcccccgccagcacugcuuccaggcaaccccaccccgcucgaucccagucugcaguggcucaaggaagcagaagcagaccccgccagcuuaguggcugggugauacaggggaaacauaaaaugcucugacaggagugggcaaaagugggcuucccucugcaggcagcaggaaagggaggccuugcucuuuggccuucaacugccccaguguccaaacaaaaaaaagcaccuucugagccucugcuauggagaaauccuggcaaccuacaggagcccaacggccccacacaugcuuacuuacacugguccugggauguagccaauaggcgauguugguguccagcgugagccacuccagcgggguggagcuguacugguguuccaaguccucauucuucagcgucagcaucuuccacugccacaggauaaagcacacacagguugcagaagaucauugccucuagcugccacgaugucauggucuaucacuaaacugcuaucccuuguaugccaaccgcccagccuaaguucaaucagcaagugcugccggugggggcccugcaagcugaccugggcugaugguagggguccugacugcacacauuccagcaucugcccugcagacugcgacaggaaucuugucacagaguugagugucugacugucuuaccuagggcucugugaguugaauguggcccauucugaccugacgggaggccugaagacaucccgacuuuauuguaaugucacaugaguacaguaacuccuuggcccugaccuacuaggugcagguccauggggccugaagucgggagagacacucauucugcugcagacucucaaguuccagguucaaguccuuugaacuucagagcccagcaauagcacgcggcgccaucaaaggcagaaaucagcucccaccgagcaagggcaggcgggcgggcaucccuccaggcacucaucaccuguaacucugagaaucuggccaugaagcugagguuccugcugauaucgagcugagugggcgaguggagcuccagcucccucuccuucugcucauggccugacaguagacaaggacgagacacagagaggcugaagaggggaggacagaagcuaccaccagccuucccguauccagggggacaccucaccaaaccacaucaccccauagguucccacaccccacacuccucggccaagacaggauuaguguacucugggaugcaggagccuccuccgcaggcccguagcacaaacgccuuauuacucauggaugggugcaagggacucagccaaacagaauggaggaaccuaggucccuccaaacccagcguugcuuuggcguuuccuugaguggcaccagauccacagagacaagcagaugcccauggcccagagcuuugaugacucacuuuugccauaccgguguucuuccacauuccacaccaugcucucgugguagcccggugacaacuucuccccaacuaccuccaacugccggaacccccagucagggaggugagccccgcucagcuaguaaaaccaagaaaggcaaugagcaugacagagagucggcugaccccacugcugugucagcaggucccugccccaggucuuccuaggauucuucucccccugcguguacuauaaaacagggagauguucaucacuuggcagcuaugugagcacaggccugaacagcuccaggaauagucugggugaggcuaggccugacaggcauaccugagcuacccuuuaccuucaagauggcggauguguucacauguacaaagcgcacuuccgacaagauagucuuccagguaucccgguuggacucucuguucacaauguccugcagaaccagaaccugucagccuggggggcuggcaguggagcacuugccuagcauuggugaggcccuggguugcauccccagcaccacaaaccauauaaaccuaaauaugacuagucacuugugcaucccuuugcagaucguacguguuaaauagcuaccgaaagaccagacacccauggcuucuuggccuuuugccuaagauaagugaggagcagucacacagcuauggaaucaguuuggucugggcuaagcucuccagcaaaggaagcacaggucgcuagcuaguccuuggcacuacagacccuccaugaccccauacgcccuuuacaacacagcauuugagcuagccacggggacucaaaagauaccuauucagacaagaggacacagaacucuagccaaaacagggaugguuccuagacaagccauccugggccaggcagccgcuccugaggccugcuccccuuucuggaggcuccaucugacauggguaagugguacucaaagggcugcuaggaagggggcaggggcacaggucagcaauggagccacuggcagcaagcuggcagggaggucagugagacucagugccauuccuccugagacagcuuccaacgagaagggacgccggccuuuuaucagucaggcccacucgggagggauuaagcagcaggauggaaacggccauggaagugugccgcacauccaaggggaaaacagguaaaggugggucaggugugccaaugaaagcagcccccccagacagaccugugcuggcgaaggcaguaaacuggcauggugcuaccuagguaggcuguggagagcuuuugggaccgcuugguaggaauuugacauugggccaggacgaggaaguaggcuucaggcaagaauaacacuuugggccaggacagggaaggagcacuagcaggagccaggagagcagaugacugucaccagaaggacacugucgcagugaaaucgcccucugauggccaaggcccucaccaggaaacugcuugugcuccugugggcuauggguaagaacuggcugggaggcuuccccugggacacaggaguggcggaggcugccaugucuguggugggagggugucuuacuuagcuuuaauuaucaaugugacacagcccagagacuuuugaggagggagucucaacugaggggcuguccagauuagacuguccuacuggcauauuugugagggaguuaccuuggcuguuacuugcugugggaaugcccagcccauugugggugguucuauucccugggcagauccugggcaggaaagccugaaugugggagugagccagugacagugcuccuccacgguuucaguaaguuccugcccugacucgaagagggguggacuguagcuuaacccuuuccucucuaaguugcuuuugacacagcaccagaaagaaacuaggccagagggugaaaaagugaacaguccaugaggcagcugcagcuggaacagcccugacccgaaaggcccuggcagggaagacacagcacuuggaacuuucccaauccaugccugaggcccagaggacucucggccugaugaggugacugcuccccauugggacaucucagacuugcuaaaucaaaguuucuuauccaaguuuccauuugaacccuucaucugaggaggcauucuggguacucugagguagggagcaggugcucccacugaccgccaugagacccugcugcacccaggccagcacggaacucaccaguuuccagagguucugggcaggcauggagauguuauagucaauguagcaggagacuucuugagaaugggggcucaguggggcugcgacaucgugccugcaagagcagagcagagcuauuccuuagagugucacuaagggaaaaacagugccuuuggaaaccaagccugcucugccugccaaggcuagggaagcuggccacaaaugcagcucccacagaggcuauguauccgggaugugggccaccccaaggcaggcuuuaauggucaacaugacacagccuaaagucaucugagaaccaagacucaacugcaggacugcccagauccaaccgccuuguugguguaucugugagggagggucuucauuguguguguccagaauugaugucaaacaauuggaugggugucacucacucuuuggacaggugagcaaaucucugagaauagaaugucuguuccaggaacuggaagucugagucuaagaacuggccccaguguaucacuggucuggcagaacucggaaaaucaguauaguacuguugucucugggcgagaugggcacaguggucucacgcugagacagcaggcuacucugugugggucagccucaguguucacaagcagccugucaccuccaggcuacucaggcaggacucacuucaucucaggaugcaccaggcgcccgaagaggcccagcagugagcaguggaugaugggcugccagacagagugagugucagaauaagaucuauaggagggacaguacaggcagguuucugguaaggugaccuuagguaccccagcaguaaagagaguggggaaacccugaggugcugugcugcuuacuucagggcuaccagggaggccaagugauggggugacacuagucagggucacuaggagccucaggagagcugagagggucacuagagagagggcugugggcagaaaagccaugaagcccacuguguauucucacgggagugagguggaggcagaagucaggaugacggaaacaggcugagugggauguagacagagugaaggagacccugacagaacaagcacuggggcacucacguguuaaggaggcggguggucaugccgugaacgagcuguacaaugucuccaugucuuacaggccggggaggguuguuuaccaccagcuggugucuaggaagacagugcugucaggcugacacgcagcccccuuuugauaagcucuaugggaugcugagacugaggucuccgagcagacacuugggaaucgaggcacuuguguuuccucuaaagcuccucaaccuaaggucacugccaagugugaugccaucugccacugucacacuaucuaugaagaauacacuaacugcuucccccaccuuauaucuucauguugacagcauacucuuuuucauaccucaaaaaauaaauaaauaaaaauuaagcgccuaucugggugggggguacacacccgcagucccagugguuaggaggcucaggcucuugagaggacugagaguuugaggcaaggcuuggcuacaaggagagaugcuaucucaaagacaaaacaggaaaaagaaagacaaaacacaaaaccaaacaaguagauaagcacccuaacccuuagaacuucucaaguccccagugcuggggaaacagcuggacaggacagacagggucagggucaggguggccucacucacuguugugagucagaaaaacagacaugcagaugugcaaaccaagucagcaaccauaugagauuggaaacgggccagccuggggaaaagagacaggagaggaggguacgcauuuguguagacuggccuaggaggccuccucaaaggacccagccuucauauucuuggcaagaaggugugcgagugcagagauggccaagggccugauguagugaggugcucauggagguuaugguagcagucucgagggcaggaacuagaguccauagggccaggacaccggggaaggcagggaaggagagugcccaguguaaggccuccuagaggcugccugugcuggcaucggagugagggauggagggugaaugcugguaaaaaauuaaucucaggccuggagaaauggcucagagguucagagcacugacugcucuuccagagguccugaguucaaaucccagcaaccacaugguggcucacgaccaucuguaaagggaucugaugcccucuccuggugugucugaagacagcaacagaguacucacauacauaaaaauaaauaaaucuuaaaaaaaaaagaagaagaagaaucuuauugauaggcagacuaucagccaggcugcacacagaaugagcacagagaggccuccacacuagguccucuugaggggagcagacacaauuccugucacaguuccuaagagaagcuaagucaggucaccgaggaugccgacccggcccuggccucacaauaacaauaacagcuggcagcagauacucaagcucugggagaaagaggucucuagccaggaagcacucgugaaaagaaggccuaggacucagcagagcgaucugccaguuaugauggauggaccaaugagcucugaggaaaccacacucaccgcccaggauccuugacgauccaccaguuauugaugucuuugaagggauaacaggucaccuguugcuggugggagcugccacggccauucucauaucugugugagaugucaacaaagaagacaccugaagcggguggcucucuaguggucucugcagagaacacccaguaggaaguuuuacucaacaauauaggggccagagaacauggaacaaacagugaggcagaguugcucugaggcacuggaggaggaguggcuggcaugccucaguccuccuaguguuucauacuggacaccacaaaaggccugggccugggccugggcccugcugccuuugucucucuaaacuugaucacagaaaauggcagcucuuagcaaacugggagaauguaaaacauuugugauuacaaauuaaaauugucacuuuccuuacaucaugggauagguguucuugugcgaaugaagccagcagggcaaggguuugccagagacgcucuucagagugaccugggaaccaaaggccaccuccaggggcuggccuugggugaugcgggcaagcccucccuaagacacauagaaaaggucuuagauaagcucaggaggccaagcaucccacccgauggcucuacagacaggaggaggggucgggcucagcagcagcugcccuuucuauggggcugucucauuggaccaaggccaacaauccgaaacugacagauggggugguggcagagaugaucagauaauuaguuguaacccaucaacuuggguccuacugaaccacaaucauaagugggugugugcucccuggcauuccggugacuuucccaccacacacuccuuaugacuaucaacgcugugauugaggcaagugacuguguuuaagacaugaaaugagaccaggguacagugacaugcagaugugaccaucaguagagccagcaugagcaggccugcucaaggcuacacaccucaccaccacaccugguacauuuuaugggucaguacucuuuuagcugagauguuggaaccagaaguguucuaauuugggagaguuggggggccacccacaaucugaagguccaaaaugcaaaacacucuguaaucugaaggugucuugaguguccuugcaagcacucagaaaguucugaagaucucaccuuguuaauugcagacuuccuuguuaggggcgcucagccuggguacacccguagcuagcuagugucaugugcacgggcuugagucugucucaugaggugucuaacugcaagucaggcuaugaaagcagcuucucuuccucccacacaaucaguauuuuacaauuccuuuaaaaacaccaacaugggccgguugaugguggcacacgucuuuaaucccaaacugaggacgcagaggcaggcagaucucugaguucaaggccagccugauccacagugugaguuucaggacagccaaggcuacaaugagaaacuguuccuuacaauaaacaaacaugaacaugcaacauggcugccucaguucuugacguuugcagcacugcucccucacgcuguauuuuuaucuauuuaucuaccugauauccacucauuugguuacugaaaacaaagucucgagauggagcccuagcugcccugccccaccuuucccucccgagggcuacagaucccgcauugcucacagagaagcugagccugacugucuuugcucuguguguuucuuaccuccaagcuggccuggaaggcacuggacaugauuuggucauggggcccagagcgguagagcagcaucagguggacauagaagaagaguaaguacaggaagacugggacgaccagcagagccacgauucuggcgagcaagugacugagcacgcgcaucugccaggggugagaggauaggucuuucgaucugcagagugcgguagccauuuccagaaccugcauggaggcucagggaaguuccugagaaacccugaagcccuuugucccagguagaugcugcuagaagcucacaggggcgccagcuucccuacucccugcuccugaagccuugaagauccucuucuucuccuucuccuucuccuccuccuucuucuucuucuuuuuuacuuuuuaauuuuauuauuuaucuuauguaugugaguucauugucagccucuucagacacaccagaaaagggcaucagaucucauuacagaugguugugagccaccauguaguugcugggaauugaacucaggaccuucagaagagcagucagugcucguaaccacugugccaucucuccagcccugaggauccagaggcuccacuucuuuaagccaacuacucccuaggacagcuugacacccuaauccccacauacagcagauucacgaggcccuggugugaccaccuacauuugacaaggucuggucuccgaucagauuccacgcguggacagcugcaaugccgagcacaagcagguaggugaaaauccccauguauuugauccugaaaaagacagaauuaaaaugagguuacaagacagacaaggccacagacaggaagaauacuauccaagucaggggcucuaacucacccaacugcacaggaacaagagaccccggucagcaguagccacagccaccagugcacugagaaagggcugaacaaaacaggagaaaacagaagaacaaggaagcagucacaggacucaucccacaggucagggccauggagcuugucugagcagcuucuaguuggccaguccuacuggguaccagccacaauauaaagaaccauaccuccccauuugggucucagaagaacuuuccuuuuugucaggaaaacaaauuuccugugaguuaaaguuaaaaaaggauguacuuaugaagccacgggcuaagggucaaccugaaggauuaaguaaccaaaaggcacgcuguaagcaacuccucaaagucacccagagccaggugcagguuccccugcaccaucgcccuggaggcugacaugaggcauggcugccagcuaaggcuccgcagucagacccugacuaaaaaaugaaggaaacaaucuagaaucccuuuuuucuccuaacaagaagugugucucucuuuccauaccugugugucugggaguugaagaacuucagauaggacaacacagccaacagguuaaaaaauaucaguauggacuccaacagcaugagccuggacugagugaucagggcguucucugucacagagacaaacaguugucagcacugagcaguccaagcugcugugaauacagaacuagucccaggaggggcacacagccgugucuccagagacuggacagagagcauccucugcagaugccaguuucuguguauacauaaaaccuuccacauauccucugcacauuuaaaggcauuauauauuaucaaaaaucccuaauaccauguaaauggcacauaguuacuuuauggucuuaagggagcaacaacuuauuuuaugcugccauguacguaugugugugcaccaugugugcggugccuguggaagucaagagagggcauuggauucccuagaacugaaguuaguaagucauuacuuggaagcuaggaaccaaacucuacaagagcaguaauugcucuugaccucugagcuacuucugcagucacauagaagaaaaucuuuauguuggugcagaaggaaguuuugaaaaaaaaaaauuggggcccuauucuugcuaugcugcccaggcugaccgcacacauaagacucuucugccucaggcgucccagugcugggauuacaggccagcaugagccaccaugggauauuuuugcuuuugugcuggggcugcacccaggaccucguaaaugcuaggcaagugcccaaucacuggguuacagccccacgcuuggggcuguuuucuuuagguauuaauuuaaaaaaaaacuuacguguguguaugaauuguaugaauguguaugaaggccauggugucuaugugccuucaaguacugucuggcaacccccaccuuuaauuaccaccauggccauauuuccacuuccaaaaagugucugaccuuacaguccaucaauccuccaucaaagagcaucccagaguggggcgcaucuggaaucuggaugaagcagauguauucacuagggcagcacacacauacuagggcagcacacacacucucaacacacacacuagggcagcacacauacuaccacaggcacuacucccaagugucauguugaaaugccccaaagugcuugguuuucuuuuccuguucucuucacaggcaggugggcagugacccaaggcuuaccaaugagcaucagcagggcggcuccaauggcagcaccgugggaaaaguggagcucuagcacuaucugguaggccaugggcacugacagggccccggcaagcgcuggcagcaggcguaaggaccauauaggcacauugcuacuguacucuggaaaggaaucacauagcagagcugagagcuugccuacugacacagcagcucacagacuggcaaaugcaaucuuacaaaacugggaggcacaugagcuacugaggguguacacuugggguaaagucuuugaaaugagcuugggaauuugauugguggguaguuuuuaagagacuggguuucaccacuggguauggugaugaacaccuuaaauccuagcacuugagaggcaggaugaucaugaguucaaggccagccuggucuacauauugaguuccaagccagccuagacuauauagugagacccugcuugucuaggaugucagucuccugaguucaggugauccuccugccucagccucucuggguaguaaauaucagcucugcagccguggugccagcucucaccgagcauagauguggugagggaggguuccgaaauuaaugcugauuuagcauauguaccccaaggagcuucuaaaaacauuauggccacaaaguuuauacauacacaguggcugccaaaugccacaggacacauguaccaagagccagggauggaauaguuacaaucacaaagcacuuaaaacuuuaagcagacuuuucuuucuuuuuaucuuuuauuuauguacauggguauuugcauauaugacuguauaugccuggccacuguggcaaacacccuggaacuggaguuacggaugguugagcaccaucaugugggugcuggcaaccaaguccugaaccuccagaagagcagcagugcucuuaacugcuuagccaucccuccugccccuuuaaccagauggucccuugaacauaaauacccagcuguauccuggcucagcguaguaaaagguuaagugcugggugggggaugggcauccugucucuauucuuucauauguagauucauaaggagaguuaaaauccuuaccugcuccaauucgguuccacagaaaguuaccaucgaaucccccuaaccaaccuaaaacaaaacauuuggaacaugggccaaacaaggugagaaaacaaaucaugauuugcgcccuugaaaaauuuuauuugauaagcuuauauugcagggccuccaaggcccugacuguuucucuuacccaccuccuaaggccaguagcauguggccaaaugguggcccacugucauccagaaagaagaugcgcuucauguagaaggaaauguacugcccauaauauacuucaucgaaacuauaaacaaacacaaaacccgccuuuauauccaacuagaaaacugaacuguuauuuaagcuuuuuuuuuuuuuuuaaaagauuuauuuauugauuauauguaaguacacuguagcugucuucagacacuccagaagagggagucagaucuuguuacggaugguugugagccaccaugugguugcugggauuugaacuccugaccuucggaagagcagucgggugcucuuacccacugagccaucucaccagcccccuauuuaagcuuuuaaaaauauuuauuuuuuguguauggguauuuucccuguauggcuaugcaucacauguguguaguguccaccgagggcagaagagagggucagguccucugggacuagaguugguggcaguugugagacucaaguagaugcugggaacugacccagguccuuuguaagagcugccaguacugagucuccaacccucgagaagucuuaacuguaaacacagacaggaaaauaaaaccucguuuccagcugacuucagguaagugaagcgugagggucggauccuuuguuccaacuguauucuguccccaaacacaaagacacacacagcaucauuuaacccacaggaacauggugggaaauuuaccaagcccagugagcaugcaugucuuguagagagccuauuucuuucucuagucuuuuucuccccugcauggauguguaugugauauacaggcaguuauguguaggcaugcucguguaugaaagugugugcacauacgugcaggcccuuggccacucuccauuuuaucuaccgagacacucaucagucugaggcuugucauuuggcuagucugccuagcuagcuugcuccagagagucccugccuagcuggcagcaugcugggauuacagauggaacacacugcccacauggcaugugagggagucugaacucugguccucacacuuguauaacaagugcuuuacccagcugagccacuuccccagccuccccacagcuuuugacuuagguauguguaggucaaccuccugaccaggagccuugaggcuaaucccaucucauacucucacuggccaccagcaccuuucuacagcuguggacuggagcagaacugaagaucuaauugaaagggagucaaaugcggaaggaagaaugacacagaagcuucuucagauaaugaaagacauuaggucuuaagugugauaacgcuaccgugguuauguguucuuuguuuucaagaauccucaucuugccaagcaguaguggcacacgccuuuaaucccagcacuuuggaggcaaaggcaggcagauuucugaauuugaggccagcguggucuacagagugaguuccaggacagccagggcuaugcagagaaacccugucucgaaaaaccaaaagccaaccaaccaaacaacccccaaccucccccacaaaaaagaauccucaucuuggagcuggagagaugguuaaggcaugugcugauuguaaacggaggaccuguguucagaucccagaacucaggcagaucucaaagaccuggauuuugagcuccagaggaucugucaucuucuucugagucugaaggcacaugugcacaugcacagauggacagacagacacacguauacucuuaaauaauccucaucuuucagacguauauagugaauuagucauacauaugucuagaaucuucuucaaauuaaucucuaagggggcugcugaggucaucagucuacccauguauauaucugaccccuauaacaaaguaggagagggcuagcgagauggcucagcggguaagagcauugucugcucuuccaaagguccugaguucaaaucccagcaaccacaugguggcucacaaccaucuguaaugagaucugaugaccucuucuggugcaucugaagacagcuacuguguacuuauauauaauaauaaauaaaucuaaaaaaaaaaacuuaaaguauuuaaaaaaaaaacaaaguagaagagaaugccuguauuagcuaauauacauacccucucaauaacaacagcauaguuccccuuacgaacaaauucaucaaaccgacaccuuucaacuggcuaaggaaaagugaggcuggaaacugacagaccaaaacuuucuuacuauaguccuauaagguaagcccuaaaauguauguauucuagugguuguucugggggacaaaugggccauacccacacugcuugcgaugacuauuucugguugucaccuugacuacauuuggaaugaucuacaauccagaaguuaaguguacaucuaugagagaucuuuugcuuaaaauggauggauccacuucucgucuggaccuuuaaggcaggaaggaacacuaguuuaauccagauuuugaggugggaagacacaccuuuaauuugcaccacaccugcugaaaaucuauuuaaagacacagaaguaggaaguuuuccucugagccugcuugcccucgccuugcuagcaagaccauuccuuccuuggcacuagagcccacuucuuugggaagccagaguauacugaagaccagcugagacacccagccauguggacugagcagaaaacuacuggaguccuggacuuuuccauucacagucagcgauuguuggauuagcuggacugcagccaguaagucgucauuccaauaaaucauauguauauauguauacuauauuauauuuauuuacauauacacacaugcaaacauaguguucuucuuaaguuguuacucuagagaacccugagcaauacacugcuaaaacauccaucaccaagagauccaagaaacccagaaugucucucuuuugcacuguacggcaaggugauuccugucacuaauuacaaugacucuuggaucauugacucuccuccccgaucucuacuuacaccacagcccgaggguaggagaguugccauagucggguaaguagucccaggccagucagagcuaccaaguucaaauugaugucaacagucaccacuagaggccguuucaaaaaucuuaacauuuugcagaaaagccagcucgggaggacucccuggaaaagagggaaagaacuaccauuaaaguaaacggacagcagcccgggaaggcacaaacgaggccacaggguccuaaagccgccuggcgucacgaugaauuuacagcauagcggguuggguuaauagaaccagaaggacucuuccagaacauaccuguuggagaauuacaguuguguucaagcacaggguauacauaaaaacaucugaggggugaauucaggaaucucagaacuggauacucauuucuacaagucauuccaaaaacaccugcugggcacuugcuaggaacaaggcugcuaaugaaugaaguggccucuccugucccuucccaaugugguugaaaacuaagacccugaggagcucugggcacugucauagcccagugaccuggauggacuuuucccucuucuggaggcauuccucuccuccuagaguugcuugugccccgagcccguucuuucucuacaguucuucccacucuggcuuuuacaagaggccgcccuggaaacgacuugcucagccaggauccgaacauccaccgucccuagcgcgccgccccuaagccggaucccagaccccaggagggcucucaaaucuggcacuccaaaaccuacgagcguuucuucgagucccguagaguggcuccccauguggagccaggccugcgaaccgccaggcaggaucgaccguugggggcgaggccgcucgauuacucugcagcggccacggaucgacgcucaacuaguugugucuacgcggccgacagacucug

SEQ ID NO: 758 - RNA, 5252 nt, Mus musculus
uggucuaguccagcacuugagugugcgucucgucgggagguggagccccauccaggccccgccuccagguaaaggggucauucuggagucacugaggcucuucagggacacggccuugagugccgcgccucaugcgcgcaugcgcucauguccccggaagcgaugcgcacagcauccgucacuacguccaggcgggagcgggcagagucggugaauguauguccgucgcuccggauauggcuucggcgggaggcggcggcucggagagcgccgcgcccgaggccgaucguccccagccgcggccguuccucaucggcgugagcggcggcaccgcuaguggcaaggugagcgcccugcgccugggccucgcggagggauugccaggccgcugguuggggcgccauugccucuggcccaaccgcggcaccuguugcuagcagcuaagggggucguccccaggggcuggcgggucacucagugcacaagcucacuuuuggcaccuucuguccccagucaacagugugugagaagaucauggagcugcugggacagaacgaaguggaccgccggcagcgcaaguuggucauccugagccaggacugcuucuacaagguucugacggccgagcagaaggccaaggcuuugaagggacaguacaauuuugaccacccagguaccuggagaaugucugccuggagagcuggggguagaggauaaacugcugugagauaugggcucuacagagauugcagacugccagacagauacagagauguguauggaugcagacugcuggaccagggcuguaggagauguuuguuggaugcagacugccaccgaggcuguccagggauguguacauaggaugcaaagugccagacugaggcuguccagagagaacugcuggacaccaacugccaaggggggcggggauugaaugcagcagcaauggggcuccgugaaacauuacccucauuucccuugguagugggcccacagaaagguaggguuugcugaauuccaugagccuggagugacucaagauuuuugcuagagccacuuaggaaggaggagccaggagauguugaggaucgcuucuugauguguugaaaucucugccuggcaccuuguugcugaggagcccuuuguacacccuaccuaccgccugccugaccuuuggauuccccaagcugucucggggcagucagucuucagggaggccaguuguagaaacagagguuaaucuggggcucaggccuuggagcuuccuggccugguaggggccuguguuccugaagguuuaagcuuuccuagggacuccugaaggucagagaauaggacucuuaacuuuguuuugccagauacagaggagcagaggcucaaaugaucucuuucccccagugucagccaaucagaaagucuuuguuccaguuucuggugggacaaccuuacccuucauccuggggugugcugugggguccucagcaccccuggcucccagcugcgcugcccuugggcagaggugguccuccuccucugcugcaccagagcaaaugggcaguuugggcuucuccuguuuuuguagaugcuuuugauaaugaucugaugcacaagacccugaaaaacauuguugaaggcaaaacugucgaggucccuaccuaugauuuugugacccacucaagguaagcaggugguuccugggagggcugucacacccagucccguggugggucccaucgcagucuguuuccauggacuguccucuacucaggccccuuguuacuaaugugagcgggccaucaagcagggccuagccuggucucucccuggcagguuaccagagaccacuguggucuacccagcugaugugguucuguucgagggcaucuugguauucuacacccaggagauccgggacauguuccaccugcgccucuuuguggacacagacucugauguuaggcugucucgaagagguaagggccucugggucccuggcugggguugggguuuuccaggagucccaaggaggauggcauaugauggugccuuguuccuguugcugcaguucuccgggaugugcaacgaggaagggaccuggagcagauccugacucaguacaccgccuuugugaaaccagccuuugaggaguucugccugccgguauugccuuuaugcauucaaacucaaaauugggggucagcucuguccaccugggagcugucugcacuguuugccagugugucucaggcuagacccuggggugacugcauggcucucagcucuguccgccugggagcuaucugcacuguuggccuaugugucucaggcuagaccccggugugcccguaugagcuguucucuuccaagucuggccugugugucuugcucacuccccugugaacuaggaaaacgggacccaaaucccugugcugccgcugaaagagcugccuuccgggugcugggacuaaagugcacaccauugccaggcagugguggcgcacacgucuaaccccagcacucaggaggcagaggcagguggaucuccgaguucuaggucagccuggucuacagagugaguuccaggacagccagggcuguuaaauagagaaacccgucuugaacugcccccacgcaccuaaagugugcuaaccuauuuuuuucuuuaauacuuaugcucucugaaguuucugcagagugcaaugugugaaguccaggcuguugcagucucuuacuuguaggccuuuugcugaguagaugaugaaaggcagcgaaaccccagcccugcaccugagcgugagcugagcagggacaacuggcuccucuguccuucuuccugugguaccacugacacccccaguuuccugacucagcucuucccauccugcaagccgcuccaaagcauuucccaggcuggugggaaggggaguggguuucagucccucuucaccccaccuggugauccugccacaguggguaccagcucagguuugcucuucucaccuuucauggaaagagucucuacugccuucagcaauuugucugccacaggggacaggccuccuugacccaaacccacagcaucaggacccacccuggguccacaguauacccucaccuucucugggcuuugucugguucaaccagguucucucagcagccuuucucucugcuugucucaguugugugugcugcagugucacuggccuaaaaaacuaaauccugagagcaugcaggugccaagugccaugcaugccuccaugcaggcccaugcauggcacagcucuugcccugucaggcucacuccuacaggacauuugcaacuuuagucccaauuucagaggccaggaacuguggguggugucaccuacccuggacagcaauuaaacuguaaucaggcaagcacaguacagcacugacucgcagguucaguccggguuaaauuucuccuucacuguucagaccccaucucucaccuguccgaggcugucccaaccugccagugccaccaacauccaggcuaucagccccugugccugaguaccuuaaagugaccagccucaagagagccuucucugucuuucagacuaagaaguacgcugacgugaucaucccucgaggaguugauaauauggguaagaaaaccccagccccacacccaaaccaugaagcagagacucucaucuccugccuuggcuacggaggccgcccaagugugugcauggggccagucgcuguuuaucugggacauggguucauguguacuuuccaaacacauagagcugcugggcggggcaugucaggcuguugagaugugcucagucccacguacccucacagcagaccaagccaggacguuggacugcgccuguccgguugguugccuucugccuggugagacauaaggcuggcugaucaggacugcugugagccuggaaggcccaguggcuuuucugcaccaugaguguuuugcaggguaggggagagaggggaggcugcaguggggugggagugagccucugaaccuucccuugauuacaguggccaucaaccugaucgugcaacacauccaggacauccucaacggggaccugugcaagcggcaccgaggcgggcccaacgggcgcaaccacaagaggaccuuccccgagccaggagaucacccugggguguuggccacuggcaagcgcucacaccuggagucuagcagcagaccccauugaggaccagcauauguagguuccccacagacccaggauuaagggccuggggacgaccacuggcuccuaaaagcacagucagggaucccucucaaugagugggaccuaggguggcaucaggaccaaagccuuccuugcacggagggcagacucaugcugacagagcauucugggguccucccauuccucucauuggaggaggccacaggucucugggucacugucccaaacagcauaguaagcccaugguaccagcuuccccaggggaugcgggacacaaaucauggugcaacaggaaacagcccgggcacuggcuggucugguguugacagugagcccaagggaagugcuuccccguaugguguggcuuguguccauguugcagaaguaaagcuugcagagauguuagaucccuuguuuguuuuguggcaggcuguuugugagcucugaaccuaguuuuacaaccgaccacugggcuaugguccaguuuaaggagccugaggcagggacccuaaggacuacccacaugacucuaucugggggccuggaucuuggguagaugggagugggccaucaggucucuuguggcugaaacauugucucccaauucugcaggcagccuugaaccagggggcugccuguguacaagucacuuggguacaguucauggcuagcaugccaggcaggcucucuccagccagggagcacuucagugcagaggcaggugaccguggcugccuaaagccagcuagucuccugcacacccagcucaagcuccuggcuucacaaacgcucccuucuguguugucaaguuugucgucccuccccaugggacggcuguuuuuggaagugcccuuugcugucgccacaagccauggcacgggacgucucguuuuauguucaauacaacuguggaucacagcagcugagcugugaugagcucggggcugccuucugcuagugcugggcugguuuuguugaacugaaaccccucuuuggagggagaaucaauaaauaacauaaaacauuaac

SEQ ID NO: 759 - RNA, 708 nt, Mus musculus
augcuuuccucuggcggcagccaucaggugagccaagaugggugcauacaaauacauccuggagcuauggagaaagaagcaguccuaugugaugcgcuuucuucugaggguccgcugcuggcaauaccgccaguugcacagggcuccccgccccacccggccugauaaagcucaaagacugggguacaaggcuaagcaaagcuaugucauuuacaggauucauguccgccgugguggucguaaacgcccaguuccuaagggugcaacuuauggcaagccuguccaccaugguguuaaccagcugaaauuuguccgaagccuucagucuguugcugaggagagcugggcgucauuguggggcuuugagaguccugaauuccuacuggguuggugaauauuccacauauaaauuuuuugagguuauccucauugauccguuccauaaagcuaucagaagaaauccugacacccaguggaucaccaaaccaguccacaaacacagagaugcgugggcugacaucugcuggccgaaagagcuguggccuuggaaagggccacaaguuccaccacacuauuggugguucccaccgugcagccuggagaaggcgcaauacucuccagcuccaccauuaccgcuaauacacaugauauuuguaaaauucauauccaauaaacaauuuaggacagucaaaaaauauuuagaagaac

SEQ ID NO: 760 - RNA, 578 nt, Mus musculus
uuaauagccugucauuuucaaguucauuuuuuuauucauauuuauguucaugguugauuguaccuuccugucaucaccugguggggcaugggaagacaagaugggaaaguggcuacagagugaccuugccugcugcccacacugacaguguguccgccccaccagaaacagagggaacggcacagggaagaccacccaggccggguaggguaguggggaagguggcagcuugacauucuuuccuggaccgggaggauuucuuuauuuugcccuuuggaacgacaaggcagugaggugcuucaccaggaauuugguuugagggugaggacugaaggacaggguggccugccuuccccaacccgugaccuggucucccuccuggcccacagcugcccaugcucaaugaguggccugcuggccacuuggcaauugugccuccauugccccagaauggccugaugaggaaaauccaaacaggaugcaaagaucaaugcaaaaaucaccggucugcauagucuaugcuguaacuggaguuugucaaaggcaagcagccuucuaauaaagucgcuucaaaugug

SEQ ID NO: 761 - RNA, 6509 nt, Mus musculus
guguguauuuaaaaaaaagugauauuucuuuaauuuaaaguugugaccugggaagaacaaguuagcuuaaguaaucuaggcuuccucuuuaugcacaaauggaacagauacaacaauggcucaguuuuccaacccuagagaagaaccaaacuaggucacaaaaccuuaggaggcuccuguagcaacccugcuggggccccaccucauuccacucucugcagcuagcauuacacacgccuccucggagaagggacaguggacagccaccucacugucuccaggggaccucuuccugggacagcaguggagcuaagcaucucaaagugugcaugcguggaaaggcaacuuggccucuuugcuuggcuaagaucuggaacuuugaguuguugucauuggucaugagugucccagauguggcagcaacauggcgaaugggguagaaacgugggagccugaggccucagcaucgaaaguuugaaagugauccagauaaaccuugccuggcagagccucggagagaaggugggaagccgggcaacauguacuucagcccucugagcuaugaccugcuagagcacaggucucaaagggccacuuccuaucuuccaccucuuacauucagggaccguccuugcuuuggauucgcucagccaguggggggcagggagcaucuucagggcaccagacacugagaagcagaguaagggagaggaguacuugggugggaugcugagcagggcucuaugugcaguggauuucggaugugugguccagcggaggaggaagguggcgccacagagccuggaguccucccagaaaggguucagcuguagaauaaauaugacuggcuagaagugagcuuucuaaagaaaaaaaaaaaaaaacugauuauaaaauaaaacuagagguucaccucaaguacacugcagcaggaaacaggacuccacagggcuuugccuucuaacacugacagcaccagaggcucuccugugucaaaggcuggggaugggucaaacuauagaacagcuacccagaggugucauggaagacuagagaguggcuaacccaccacacacagcauuccugagccaggccaggcuggcugcauaagucucagggcauauccaagagcugggcugugucugggugguuacagcagucaagagaggaguccccugagaauggaggcacagugagaaggagaaaggacugggaacucccaguggcgcugggagacauucuuauuuggguguuauugcauuucugccagcgacauuggcaggguggcacucagaaagacggugcaccugagguggggcagcucgcugaggaucgugugcugagacauagccccagugagaaccagucugacuuuaaaguuguucuaaagagugugggugaugucucaagccuucgaucaugucaacccaugucccaucaccagcauacauggcucccaacuaaaaucuucucagcaaggcagcuccagagguugaagugagauauauuggguuccaggagcccaacaaauuaguuuucccagucuccuucauuuuucucacaccaacaaaccccauguaucuauccaagagggagcuauccacguggcccacuuaaagccgcccauagaaaccacuuaaaauuccauagacguguccuucaaucacaagcagaguacuggcuugaccucugccuucacuggaugaugcugucuggcugcccauucugggccaccgguccaggggcagaggcuggggcuggguugggaguguuauucuguagguagcgucggaaaucuuuaaucaugggccggaggaccuggaugaggacacucagggccgccugagugcccuccauggccugggccugccguuccugggcacaggccugcaccuccugagaacgccggaucaucuguagcaggccauucugcugcuccaggugcugggcgaucuccuuuaugugcagguuggugacccgcugcuccuggaucagcuuggcugaauugagggcaauacggcuuuuaagugccugugguuugacagaugugucugggggcugggcuaucaucuccaccggggccucuguuggcaggggugggggcgcuucagcugugcaguacuccaccacucccuccuccagcgugugguagguggucucgguggggacugccgggaagaaagaacaaaacaagaggugggucaccuuauggaaggaauguggcugacucugcaacacagcgaggaggccauuaaacccugugcagcagcgggcaaagggaauucuggccuccccuggcuguauucacauaaaaccacagaaucugagagguucagcuccuuuguccuucaaggcugggauagaacccaggccuuguacaugcuaaguauauguucuacuacugagauacuucuccaaccagguuucaggauuucccuccaccagaucugacaaacgcagagaugccaacaagaauggcagcauuagaacagcaaauccuaagacugauacagguugccacacuagaauauuugcauaccacuccauacucuuuagcucagugaauccuccaagugacaagagguagacacuguccucuucaguuucagagaagacaacagaaccacugggcugcuuugagccugucuguaugaccaaucaaagaaggaugagggccauagcagcucacguguccagaaaagugucucccugucuccuuaaacacauugguccauaagaucccugagcauccuugcagaugcuguucaagaacaguaccugacuuagaccagugcuuuucacccauuucugaccucauauggacuaaagaaauaugcagaggagagcaugcacccacauaccccuggagagucugguugauccaguucaaagcccgucaugacuaagcagaauucagaggugagggcagacacaaaaccuuauuucagacacaaaacccaaccagcuuguucuguuaucauucgucaaagagaaccucgggaggaaugcucauuguuugggccuuuguguaugugggagaugucaaucuuguuuaccuuuuaagaaacuguguauacauguucauguauaugcagguacacaugugcacacacacacguguuugugugcauauggaaggagauuaaaagacaaccucaggugcuguucauaccuuuucuuucuuuuuuuaaaguucauuuccuggccuagaacucucuaaauaggugaggcucccuggcucuugagcccuagggguuucccacuugaaugcuaggguuaccagcaugaaccuccccaccuccuaguuucccuacuucucaaugccaucagccauguguuccccucacaccaggaaaucccuuuuucuugugaguccuuggcuuuuccuaucucauaguaaagccacacacauacacacacacacacacacacacacacacacacacuucaucugcccuaguagaauauaauuggucuauauauuuaauuucuugcaguguuaagcaaggacuuuaacacugagcuaucucucuagccucuagggaauguuaacuauuuugguauuucuggugcccagcauaaacagcuugauggacaaauggauagacagguaucacgaagcuccugagaaaugccugguguuuguuuguauacugaaaacacagaaugucuuuguacagaaugggugucucacuugggcaguauuaguccuaguuagucauucaacaaguauauccuggcugccuauuaauaugagguccuaagucccgaggggcuacagacaaucucugccuucaacacuacauaggucagcaugugggagauccagcuagccacaugcugaggaagacccuaaaagaacaagaucagucuggggaguucuuggaagaccucauggucuuuccaagaucgccaucugacuuuugaccuuuggcagccaauuugccccaggcugucccaguauugcuggcccgucccauuuaugcagcugaauugagcaggagagcucacucacucugugucagggugacgguggcugcggcuguaguggccguggauccgagggccacgggauggaucucugugguacuggguaggcugaugaugguggccucacccaacagguugcagauccucuguugcauaggggucagcaguacaggagcuauggcugugccacugccaccacugccacugccugucccaggcccaccagcuccaucaucuucugugggcccuggagcuucgccaccuucuacagcagcucggacuugggcaaccuugcgacggaccucggucuugaggucggaccacuucuucuugacuucgggcagcucccuacggcagguggccacagcguugacccuucucaggaugccaugccaggcugcacucuuggcagccagagggaccccagcauugaagugguucaccagcaggugcuucuucaguuccaguuccuccacgaugaucuccacuucccgcucugaaaaguucaucuuccucuucuuggcugggacagccauggccuccccuuuccucucuuuuuaaagaaauuauaaugcucuuaacagccccaauuucucuucucuucuuccucagccucgccucucuuucacucccacccccuuuagggggacaggcagggcuuguucaaggccaaguaccaggccuuaaguaaccccccucgcuacgcaaagugcguagggcccagcccugaccggcccgaccgccgccagccagcugcguaauggcuuccugaaucugccucuuccgcuggggugugcggagauccgcccacuucccuucuucccgccccucggcacaucccugagaagccccgcccuccagguuuggcguggcucaaauaucuggccgaucacuggcucuccaggccugccauuccuccuagaggacacaccucuuugcuagaacuggccuggucauuggucuaaagucuugucugucgcuucaggauguccgcccacacggacauuauucacuuccauuggaaaagcagacugucguucaguucgugucgcgacuauuacguuguaaaauucaguuguuuuauuggcaguuuagaagacuccuaaagcuuagccuccugauuuugauucguguucucgguuucgagucgucagcccguuaaauuuucauuuuauucaauggugcuguguuuucuaacuucaguccacaguuacccucauauacauuucauuuccacuguuagcuacgaucucuccuuacacaacgcuccucucagccucaucauuccgcagucuaaauagagcuucugaaugggaauuggacacaaggcuuucugcuugccuauuacccagcuucagccaauccccggcucccucaguuugaaucgccuucgagcuggcacggugacuccgcccccucauugaucccggagccgacauaccggccuaugauuggucggcagugcgccagagggcgcggucagcgccucugcgcgccgcggggcggggcucccggaagcggccccucccuccagucggccggcuucucggagcccgcgcucgcugucugaggaaagccggcgugcuuccgcgcucgggucgcucuccugccgccuucagcccggcguccggcgcccccgccucgcgcccgauggugagcaguguguugugccgcugcguggccuccccgccgccggacgccgccgccaccgccucgucguccgccucgucgccggcuucuguaggggacccgugcggcggcgccgucuguggcggcccggaccaccagcuacgccuguggagccucuuccagacacucgacgucaaccgcgacggcggccugugugucaacgaccuggcgguggggcugcggcgccugggacugcaccgcacggagggcgagcuccggguaagucugcgugcgccguccgcgcgggcggggaggauccgggaggucuugaggagagagaccgacgccaaggggacgggucgggaccgcaggacuucucgggcugcuuucuguagccugucagguuucgacggacgcugcuagagcugagcggaaccccugguguugggggggauagugucccuccacugacagauggaaaggaaauucacaccuuguuaguguggggcuccucaggugggagauggggccgugagaaaagcucgucguggcuacagaugggcacccuugggucucuuugauggacagaaagcccccucuacuucccucuagauagaaggacagauagaucucaagauugcccuacggaccucaaggccaaguuggugcccauccucccucaacaccuagguuccuauccacccauucucauuggcaccccuugucugucugucugucucucgcucgcucgcucuucuccccccacucucguuuccaugccaccggugccucuaaucugguugcucacagagacauguggguguuggggaagaaaaaaaugggaacugggguucuaggcagaucaguguggaugugggugaugaagacug

SEQ ID NO: 762 - RNA, 14140 nt, Mus musculus
aggaaacuuccagugacauacuaguggugucgcgagccccugugggcacacuuccaccuccauguaaaggcugcugggaaacuggauccugugucugcauagaauuucuuccacgagccucugcucacccacagguggguguucugccuguuccacccguccaccuggggcguaaccguccugucccuuuucaggugcugaccuauggaggauccagcugugagcugcaguguggcuggccuagggucaucuaucccucccccacucucaccccagugggguuugcuuccaagcccugggauucuuucuguauucaaaauauuuaauuuuuuuucacuaugcgucugugugugggcauguacauaggugugcagguagccaaggaagccagacgugucggcuucucccagagcugggguuauuaacuguuaugagccaugcaguugugauuggaacuaaacccgguuccuugggaacagcaguguguacuuuuaacugcugagccaucuccccagcccucaaaagauuuuucaguauuuuaaacuacuuucacuuuuauuugcuuguguuuuagaauuuucugguuauaaaaugacugaaacugagggcuggagagguggcucagugguuagggagugcuuguugcucuucaagaggacuuggguucaauucccagcacccaccucaggacaucugaugcccucuuuggccuuuacagauacuugcacacacaugauacacacacauacauaaaugaaaaauaaaagccagcaggguggugcaugccuuuaaucccagcauuuaggaggcagaggcagguaggucuuugugaacuuuguuaguuccaggacagccagggcuacauagacacaccuugggugggggggaggaagaaaaaagaaaaagacguucaggggaggggugggagugaggguggcugcuggggauacggauuggugguuauaagcacuuguucuuacagaggacccgaguucgaguccaaauacccacgcgguagcucacaacuggggcugccacuuggugcuuaagagucaccugagauuccauuuccagagacuccaaagccuucucgugacuucugugggcacuacacuacacauacauacaugcaggcaaaauacacaugaaguaaguaaaucuaauuacacaaaaaaaaaaacuuuuuaauuaaagcacagagccggugagaugacccagucgguacugguugcuuccugucaaggcugaccaucuaaauuagaucccuggaauucacacaguggaagaagaggaccggcccuugcaaguuguccuuugaucuccacgagugugcuauagcacaugugagcccacacauucaugugcccccacacacacaaugaaugugaaagagaaaaaaaaauagaagagagccuguggauacagcccaguugauauagagcuuacuucgcagaaagaaguuucuggcuccauccuuagcaccaagaaaacugggcaugguggagugugccuguaaucccagcaacccagcaggcagaaggauccaaagagaugugugagauuaggucucaaagggaaaaggggagaggaagaggaaggagaggggacaggaagggggaacacgucuggucugcccagcuccacgggggacacggcaggagaggcacccugagccaaggcacguccauguuagggugccucuucuuuaucuuuuaauuuuuuuuagauuuuuguguauaugaguguuuugcuggcauggauaccugugugccaugugugugccuggugcugucggaaaucagcuccccuggaaauggaguuaacaguugugagcuaccaugugggugcugagaaucgaauuagaguccucuuuaagaucaagucagcuuuuucagauagagcgucucuguguagcccuggcuguccugaaacccucuauauacaccaggcuggucugaaauugauaccccuaggaugaccuugaauuucuuuuuuuuucuuuuuuuuuuaaagauuucuauauuauauguaaguacacuguagcugucuuuagacuacccaaaagagggcaucagaucucauuacagaugguugugagccaccaugugguugcugggauuugaaccugggaccuucagaagagcagucagugcucuuaaccacugagccaucucuccagccccagcucacucuuccuuugaccucauccuucccucuuggcuuuguuacuguuucuucuccuugagcugagggcuugccucaguucuaauucuccagccuuuuucuuuuuccaaccgcugagccaucucuccaaccccagaccuggaauuucugauccccuucuguaucccucuaguaccaggaucauagguucaagcugccuuauccaguacacauggcgugagcccagggcuuccuacacugggcacuacucucaccaaguuccaucaccucuauccagccugcauucagaaucauuuuuauucaggugagauuggaccugggcaggugugcaucaugucucucacaggugccugcuaccccagcaagugagguuucccuucucacccagagcugcucugagugaguagcagcucccaugcacccuucugugcuauggccccagucaguccccgccacugggcuuaagaaccuuccuguguaaauccuguuccugaauggguuucugauguaggagcugauaaaaucaaucugcuuuccccgaaaguugugcaaugcacacaccagccuaaguauugggaguagccuuucaggccagcacaggacagauggcccaguccaucugcccccacaguggcaggaccuugguaugcaggcugcuacugguguucaggcaccacccaaacugguugucuguggcucccaagcauuuacaaaaguuuccaguuucacccuauuuugcuguucggagccaugcuuuggaggccuuaugugagccgaucccucuguccugcuaugcuuugagcaccagcacccuguaccacuucuccuguagagagcucccuaauuaggcacauggcuuuccacacggggagucucagguggccucuggguccugcucugugcuuagggguucccugggcacagcuggagucugcuguuggcaucaucgugcuccaccggguacucagaaaugagaguccucauucuuagcaaaccccaaucuggauacacaaagcuuucugaguguucuuucuccauguucaaccauggagaguucaaggcuggcuuaucaucuaccuagccaccagauagucaggauccaggaggagcucaaagagucauuuccaauaggggagaugucucaggguagggggucucagagccugaggauggugacccuggaacaacaaaguuuacacccuggucccccucccuccuuacuucccuggucuggucuccuugauuaaacgcugagauuaaacacaccaacuugucugagcaucagcugacccagcuaaagaacccuugucuguggagagucgugcgggcauagagugguggcagacacacugugugcagguuuagucccagggagugccugguggggacgcucacuccuaagcuuuccaugagaguuccugcuuucuucucucuccuccuccuucccccggcucccucccuccucccuucucucugccaucucgccagagugcuggcucccagcaugccaugcgugcgcgcugacagccuuauaaauagucgccuuugcaggcggcugagaggacaggcagggcacucacuggccccagcgcccaccacacccucccccaggucagugugugucugcuccauugucugcccgcguggaagccucuaagagguguggggagacaucaccugugggaaggugggguugcugguaucaggcuacccuuggguucugugugucuugaauguuuguauccaugguuaugagcuguguguguuugcauguguauccuaucagcuaucagcucugggugcauguacccuguggcaaugugugugcaugugugcucaaguguguguguguguguguguguccugguacucucagcuucccagacccucuuugucccagcugguauuccuggggcuucaguuccacccaugcccuuggcaauucugugcugaggcccuaagggacaagggaaggacagaggccuaucuccuugucccagaggaccuggauagggucagccuguguguucacaagaauuguaaugccaccaaguguugugaggaucuggggcuccuggauguuggagcucugccagcaccuccugcccaaucaggggcuccgcaggaacccuccugccugacucacagguccacucagcuuacccaggaugcuucagcaucagcaaggcuggccagagaggggacaucagcugcccaaggucacacagcugagugauaggguuugacuugaacccugucugauagcuagccucuaugagggcuuuugcugagcaagcaccugggacaaacaggcauagagauuggggaaguguguccccuggggccucugcuccuugagccaccuagaagacagucauauuaggagcacuggggcccugacccagggaaccuuauaaggccuggcugcguaguccuguaaccuuacucuugucugggaccccuggcuuuccggaggccuccucacgacccaaguuauuuuagaccaaagaagcaggugucugugggacagagggacucagguuaccaggagggguggggcauguagaggggagugaucuccuaggacaugcugguggcuguccaggcccugggacacuccucccccccugggcagcugccgaaggacuuggcagccccaugccuccuccugcacacucuguaggcuuagaggcugcagcucaggccaugggucucaagguucuuguguguuugggggugccaggcuugagcuugaccccagccagagucuggagcuagucugugucccucccccaagcccaauucccuccccagauggcaggcaggguggaaugagagucccaggccagugcuauccucugccaggcccaaucagggacaggaacaagauccauggugcuaaugaguguccugacaccuuaagcuggguaccuugcaacuugaaguucagagacagcaccugucaaugugggacccuagggugcaaucuaggaaggcauccugaaagaggugacauuugagcuggggccuccaguagcauuuggaggaagacauccccccaagcauuuggugugugacgcugcaaaggccuggcaggagggaggcauuaaaguggaugagaaaggaggggacagauuguccagaccuggccagguagguugagggguucaguuuugguuuagggagccaagaggaccacacauagaagccuaugagcaggagggucacacgauuguugcuugccaggggaaauacuauugcccugucugcccgugcauguguuugugugugugugugugugugugugugugugugugugugugugugugugugauuuagaggcucuguggaggugggcuaaggucucgguuggagagaagacgguugggauacaagugugaugggcagaggugagguggguugugggagcaugcaugauauaggacugaccgcacaguggggguggggaggucccuugggccugaacccagggugagaggaccgaagcgugcaccugagacacagaccagaacggcauggguggucuugggauggcgggacagguagggggugaggacauaguuuugaagaggcuggaggguggguggcuaugaagaaagaaugggcaagcugggggcggugagugaaguaaauuccccccggggggggggggugagugguagagccacgugugagguggacuugggccugcuucaggcaggagucaggaaccagcuuacauucagaauuggaaaggggcuacagggcuagagaggcagcugcgagcacugcugcuucucccaaggaccuguguucuguuccuaagauccacaagguggccgcagcaaccaccuguuaacuccaguuccgugggacuccacaccccuuucuggccucuuugucagucaggugguacacuuacaugcacgcaggcacaccgccauacgcguaaaauuaaagacaacaaagagaaaccacgcagggccaguaccugcacaccugcaggcccagguagugaggcugaggcuguaggacggcuguuaaucugaugccagccugggcuacggagaaggagcucugucucaaacaacaaaacaaaccuugcuggauugagcaccaggagugucucugccaccuguccugucuguccccaggcaaggaggagacgccugccugccagcauccuguccccuggggaguguugucaaagcgaggcagacacuccccucacacacuagggacucaccugagagauucccuggaguuaguuguucacgcccucuuugaccucuaccaggugucugcagcagaccaaagcacacacuagaggggugacagaggcaggagaagccagcaggaaggugacuuucccaaggucauucugccuccuggguaucucucuacacucuuaguuuggaaauuacaagccggagccugacacuuauugcuguggguggggcuugguggagcugagucagggugggaggagaaccccucaacccugccugggccuugucuugcagagugcugaccuagcucccagaucucagcaggauggaagguaugugguccccuccuggccuuaggguccuggguguuaaggaaugggcucucagagauugagaggguuggaggaggccccaggcuuccucccccugccuguuaggaugugcucggauccuaaucuuagaagcaacaaggcuugccugagguuucuggaaccccagagcucaccuaugcugguauuuauagccaagccuccccuuuucuggggaaggaggguacuggggaggggcuauaccggacagcaauuccagcuaacugccgagcagugugggaugggguggggguggaggguugauuggagcagugggcaggcucaugucuggcccuugcugggacucagugucucugucagcuagugggguggacccuaaagucuugucuuccuggcuucuaugcucuaggaugugggcagagugccuggaaugggugggcccuggcuucuggcagcgccaugcccuggcacugggccucugccugaguggcucuuuaaagacagacgcugcuaccacugcuaccgccucaacuugguggucaaggaucuaccccuuagcugccacacucagccuuaggcacacucagcccuggcagugccucagggccuuagacccucagggccuucaagcccaccuccuccuggaaaggcugcaucccaaugggguccccgcccagcacccuaaugggagggagcucaggagaaagcccgggauaauaguuugggcucagauguucccuuggcuaagccccucccucccucccuaggccuugguuucccucucccuuuuucauagccucagguauggggcccagggccucacucccccuagcuaggucugccacauagcuucuccacagcaggccaccagggcuguggguccuaaggaggcaguuugggaaguuugcuuaacucccugucugaguaagaguuccauuugcccacagcagcccuccucccuggcaaccaucucuauggcaacacguugugguugccacaguacugcugggucagagcagccauggcagggccaaagccagagagaggggaggugacagcgggaacaggauaggaucaugggcugcugugugucuagugaaccccaagaagagggaggcagaaagacuggaggugacugacaccuggggucucucgucuggcccucccccacucaaggcgcccaucucugucccuuaaccucugaauccuuggcugaguucuuagccucugggcuuugucugggccuguccagaacacccacugucugucccagcucacucagcccaagucugggucacacgugggcucugccugcuugucuagccagugacugauucgugcuucccguucauucuucccacagagaagcugaagaaggccaagaucaucuuuguggugggugaguuguaggcaggcgggcaggcggaggguaagcagggucugagggucugagcaggcacugcaggauuuggaggguuuuguuuuguuguguuguuuguuuguguguguguguguguguguauguguguguguuuugagacagggucuuucuacauaguucuggcuguccugaaacucacuguguagaccaggcuggccucaaacucacagagcucugccucccaagugcagggaugaaaggcuugcuugcgagguuucuucucucauugaggaccgugguggugucugccuggggcuguguuguuuugcaggguggggugaaguuucugaaugcaugggugcuuacaggcggaccuggcucaggaaagggcacccagugcgagaagauuguacagaaauauggcuacacccaccugucuacuggggaccugcuucgggcagaagucagcucuggaucggagaggggcaagaagcugucggcuaucauggagaagggagagcuagugccacuggugaaugagcgggccugcgggggggggggggggggaauugguggagggucugagccugagccccaggggucagccauucuccacccccuaguguccuggacuuucugucucuaccacacuccuuuauggcuggcccuaacuccccagccuugaucucagacccccuagauuaauacuggaguggccccuucaguuacuugauuuauuuauuuguugggagggguaugcauguucugugggaucaacauggccgucagagggcaaugugaagggauuggugugcauccuggcaguggaacucugguuacaaggcuuaaaggcaaaugccaccuuugagccauucugcugacccguuuguccccuucuuuaccuuacuuuaccccuucauuuuaugccaugcuuagagucaccagcucauuguaccucagucuguccccucccuguccccugcccuggugaggauagggacagcaaaggccuguagaagcuuuguguccaggcccaggacauuuccgggcuggaaagggguuugcugaagcccaagccuggagagaggggcuugcugggacuucacacgcucccggaaagagggcaagcuugggugggcuaacacaggucgugcucccgaggggcccccggggagagaaggcucaaggguccccugugcuggacaacaggacacggugcuggacaugcuccgagaugcuauguuagccaaaguggauucuuccaauggcuuccugaucgacggcuacccgagggaggugaaacagggagaagaauuugaacagaagguaagacccuugacuggucaucggccuagagggaggggugauggaggcggagucuacagugugcaggugggaaggccgcacaggaccuaccauaaccaccccaaagaaaggcgggaggaggaggauuugagagacuuuauccuguggggcuugucaccccacauguacacaggcagacauuugcgcacaugauccauaccuauacaagcaauaggcaauguaggaugcacacaugcacaugugcacaugugugugcaccuggaugaagcucacacuacacaggugcugaggagaaagggguaguagguguugaggaggggagggugaagggcugacuggcacccuggugggcuggggcagaguaccuccagccucacuccugcccaccucugcgcagcucagucagaauaggagagauggcaugucacaaccucuaagugaaugaaagaccucaagaaaauguuugucuugcucugagucucagcaugccaaucauugaaaugggaguuggucuagcuuccuuuaggcgcaacucugaggcacaucuugguuuuccucagcugcaugaagucauuugccacccucagggccacauccagcaaaccaaagugccuccuguccuguauuagggaguuuccccaccucccuacagucagggcuuggaggcagccucugggaguccgaguaguugaaguucucagauguuggcacuagggggagccagaacugcacugacagagaaggggcuggccuggaagugacuuguccuacugcugacacaaauccccagagcuuccuuggggugggcagucuucagggcccacuccucuaguuagaugccuauuuccauacugagaaacugagcuccagccaggggugcguugcucagagacaagccucacuaccuccacccaaaguguggauccagagucuguuguguuuggcccuggggacucagaggaccuuggcagcugauggccgauggacagauggcagcagccuuggucuggccuuugccacucuaaacugguaaaccgucuacggucagcagauacugucacacugaaucugcaaccacccaggagacagacaccagacucagagggcccaguagcuugcccuagguuacacgguuggacagaggcaggagaggagcugugagugacaagcuuaugugauguuagcugcguagaggcuggggcugacucagcuguggacuaaagaacagaggucccaaagcuguuagaccuccuggcccaggcccaaggcuaggaagacccagaauccuccugccugcccucacaagcccagccuagacuaggccaggcuuagggaucuaucgaugaccccuacucugaggggucguguagccagaaaaggggaaggaagccguugccugcuucaaugcaaggcccagccugggcagggccaguguguagggcccugguggccaaaccgaggucuggaacacucaggcccuaauccuuuauaccucuucaagccaucuuugugacgaguggcuuaugacagugacagucauuuagauguccuuaaaguccucaccuugucccucugauuccuuucaaucaagucuuauucagcccuuagcucccauccuggcugagggaagaggaggucgcuaaguaaauaccuagaggcugucaaggggagacuaagggaccaggaauaguggaggucacaucugcgaagaccaucuggaaggagugagggucuagcugagacucccacagucucaguugugagaaaggguaaugggaccugugcuggccuggcgugggauggagacagauacaagcauagaucaauaugguggaaggaaggaaggaggguugaggguggggaucaggagagcagcuggggggggggggaggacaagggcacaacacauaggugcucuagaucugguaaggauuuugggcuuccucuugaaaauucuaggagcccguggaagagguuugaccugagugacagaggaguuacucuaggaaggcgcguucugggugggucucauguagguagggcuugggagauggaggcagggaugauggagucccaaugauccgauuuccacccuacgcagauuggacagcccacacugcugcuguauguggacgcaggcgccgagaccaugacccaacgacuccugaagcgaggggagaccaguggccgcguggaugacaacgaggagaccaucaagaagcggcuggagacuuauuacaaugccacagaaccugucaucuccuucuaugacaagcguggcauugugcgcaagguggggagcgccucucuuuucuagcugcagcucacggugggaucuuaggccaucccucucccucugccucaguuucucccucaguuuacugaguuggggcuguguggauccugccauggcgugcgucucugcccucaucaucccucuccccacaggucaaugccgaaggcacgguggacacugucuucucugaggucugcaccuaucuugacucccugaaguaacuggaucccuuggccagcucccagcccgccccacccuugcucccugaccccaggcagccuggcucaagcccagcaccuccacccugccgggcugugcacagacacaggaagccauguuauccugucccauggacacuaaagaaauugccaaggaggguuaggauugcuccuuuccuuugcuuccaguuauggugauucaugcugccacagccggaggccccagcguggccggcccauucuucccugugccucagcccagcugucuugucucccucuggcucugcugggauccuaggcccuuccuuagccaggcugugucaaagccuaggggucccuggguuggcaggcugcucuggggggucugguguucacccuguuucucauagccucguuguguggcuuuggcccuaagccauugucucucuggagugaguuuucuuuuuuucuuucuuucuuuuucuuuuuuuucuuucucuguuucuuucuuuuuuuuuuuuuuuaagacagcaucucgugugacuuaagcuggccucaacccuguuauguaacuaagggcaaccuuaauccuucugccuccacuugucuuccugugugcugagauuacagguguguguguggaccuccaccacuccugguuuugggggcacugggaaucaagcccauggcccuguauacgaggccagcacgcuacagagugagcugcaucccgggcugggcagguuuucugugccugacuggggucuggcaugggcaaagggcaaagggccaugggcucaccagcuggggccacguggucacugggugccaaggagcugugcaaugggcauacagcuaggugggaagcuggggucagggguggccuuccugaagaaggcucccuugguauagaccugccaggccuugccauccuuuggcugguuuuaaagcuuguccugucacgcuaugucccaacccuuauccucggcguuaagacaagagcaugcagauuaaggagugugagcugccauagacaaggaugugggaucaaggaccaggccugggacccggagaggacacccagggaugccaagaagagcuggcaucucucuucugcucuuuauucuuuggucucauuacacaggaagccucuguugguacucacuuguccuggggccccgucuccaucccuagugacuuccccuguaagcccagauagccuguaagccagcagccauggcugucccagggacaccugccccugggggugacggugcucacuccuuucuguuuacuaccaguggggccaccuuuccuucugcauugccuauuuaagcuguccuuuaaaauaaauaaauguauuucaguuauaagaagugaguguauugaaacacagggagguucagaggaagagggcaggcaucaccaggcacagccuucugccugaucagguuugccucugucccccagggugacuucaggaaagcaaaaggcucuggagccccgcaccagucugugacagcucugcuccaaugcugugugcaugugcauauacacacagacacgcaugagcgcacauaggcaugugcacacaugcacacgcacacugcagccccgcugaacauggaucucuuaaggccggccuaggagcagacagaggaugcacagaagaggggaaagcuggagaaaacggccugaaaaauccccauuaucuuaaugugcuaauuacagcucaauuaauucaagugggucccaguuuaugaagaccuggcugauuaaacuagaaaauucuccagaaucagaucacagaguccauuaguaucugaggggaccucauuccgggacccccaaacauacccagagcucaguaacccuaaaucccguauagaaugcugcaggagaaaaccgcaggcacucgccugugggccugcauagggauagggauguagagacaggaggaccagaaguucaaaguuacccucaaugagagagagagagagauuaauugcuggccugguagcuuauaccucuauggaaaggcagggggaucuuacaggucggugggggccagccugggucauaauguaagaacugauguaaaaggaaagaaaaaaggaaggccagcuggccucccuuuuauauguccaguucuaggccagccaaaguaaccccagcauuuuggauacagaaauggaagg

SEQ ID NO: 763 - RNA, 21539 nt, Mus musculus
uguaguggggacaccagaaaguuacuggacugugcacaggauggaaaugcgaaccucucagguaaacacuccugguguagagggugagagggcccugggagcccccugcagucccaguccagcugggcagagcuggcucagccggaagcuccuguacuuggagucauuugugcccuacccauuaggaagccaagugaugaugaaaagcaccaggugccugccuauguccuggccuguggcugagaaguucuggugggaagcagccauggaguggaaggacccaucagggagugcuuacgaagcuaagacugccuccuuucagguaggagcuccuuggaccucaugguggcuccucuugcuuucuuguggguaaauagaccuccaggcucauggauagcagacacugcaggcucuagaaaaaaaggccaugucaccaggagcucucuccugagcaggugauguuaggaacccuacucuauugggacuuccucagaaacccugcccgcuauaucacuaggugaucuggagucucaagagcgggcuagugucuccuguguuacacaggaggcaggugagacaccagcucaaggccagaucccugcugacagccaucuuggagcagguggggcaggagucagguagggccuggggcagagccuggguuaacacccugucaaucacuaaaccgcuguuugcuguaggccccguugucuuccuuaguaaaugggguuccaaacacaacuuuucuccgaagcaaccauaaggauuaaaugagaccggacaugugugcuacucccagagcagggcauugucuagaaaggacuugcuacugggacuggaggauuucuguagcucaagugaucgcuugucuaccacgcacuguaaaaccagguguggcacauaccugcaaucaaaaugcuccggaaauggaggugggaaugucugaaguucaaggucaucuccauccaaucuacaugaucuugucucaaauacagcaaaagcacuuugcuguuauuuagggaaacucaacguacagaugauuaacuacagccagguugggguggcccacgcuuucaaucucaauacucagaaggcagaggcaggcggaucucugaguucgaggccagccuggucuacagagugaguuccaggccagccagggcugcacagagaaacccugucucaacaaagaacaagaaaacucgaggccggagaguggcuucgaggaugugccuacugcucuugcagaacaagauuugcuuuccugcacccacaucaggcagcucaaaagccugucauucauguuccuaagggcuugugaugcccucuccuggacucugugacaugccugaacaugauuguugcacauacaacauauguugcacacacagacacacacaaauguaaauaacucaaacuagcauggcggugcgugccuuugaucucaguagucgggaggcgcaaccugggcuacauaaggugacccaauugcaaaagacaagacacaacaauauagacuaaagugcuggccugggacucagggguguugcucuucuuuccuuucucccugccuucuuuuucuuuaggccaggguuucucugcguagcccuggcuguccuggaacucacucuguagaccagguuggccucaaacucagaaaucugccugccucugccuccugagugcugggauuaaagaugugcaccauccuuugcuuucuaugugcacacguguauguguaucugugugugcauacaugugcaccugagugugguauguguaugugaucuuauaugcauaugcauaucacucgccuggaucccacaaggaaagcagagcaggaggaggccagcgcucuucuucccucaaagacucucgaucucuuguugaaccuggaccucaccuuucugagaggcuggcagucaauagagcuuacagccagggguuuuaugcuguguagcauggugcuggcuuuuuucaugaucaaacucagcucccuacacuugugcagcaagcauaucacccccacacacaccugcaucaucuccccagucccugccuucugcuuuuucaucauauguauuccauuuuccucucuuucccucuuccuugaagcucucucuuaugaucugcuuucuagcuuugugaucacucgccuggaucccacaaggaaagcagagcaugcagugaguccuuguggguggagccuauuuugcuuuguauuauuuccagccgcaucugcuuucuacaaccaccuuggauuccugaagcuccuuccuccaccucucaagugccaaaccccugacuguaacaccuauuauugaggcagggucucucgauguagcccuagcuguccuggaacucaccaugucgaucaagcugccguuaaacuuagagagauccaccugccucuaccucccaaguauuauguggucugucaugacugcagguacaucugcccacuugccuggcccagaaaaauguuucuuuugaaauggcaacacaaccguguacuuuaaaaucucaacaguacaaaagguuaacaggcaaagggaaugguugcgucagguaugcccugaaacaggggucagucgugcaaauguuugaaugguccagggcagagggacauucauuuucugugugacccuaggcugguugggcaacuucguguaccauaguuugcugcucuguguagugagagugguauuacugcuauccaggcugcuaacaggauuaaacuguuggugcuaagugaucaugaagugugagcaucagccaaaggggccuggcugaugguccaaguuggggacaugcagaguuaagaguuuaucacucgggcaguagaacccacaaggacugaacugcacugaaaaugagaacuuucagggcucaggaaaggcagcaagaggaccgucggauagaucuacgagggaaaaccgguaggggaguggagagccuagaguggguggggcuuggcauagggugugggacaaaaaaaugggaucuggcccagggcucaggcuacugaacaagguggaugugggcaguuugacugcgaacaugccauggcacuaccaggacucugcuccgggggugaggaaggugcaguuugggguccccacauacuugucagagucgggcuccaacucuagggcaccacagaagcugcuggguaccgcgaagacccaguucuggggucccuaagccgcaaggaggccaaggacgucauguucucaguccuggacacugcagacgcagcuggaugucgcagaagaccugagaauaggugggggcccacgguagaacucuggccuggaggccaaaguuaaaagggcagggggagagcuccaugguuaccguggggaggagggucuuggcuggcucagguggcuugcuugaugggcgucuuggguuaguggcagccguggcuggagcucaaggaggccuacuggcgggguguuauacgggcugccaguuaggggaaagacuuaauccauugcuccagcauggcggaucccaaagagaagaggcagucgaugguuuuuagacauuuauuguagaaaggcagagagggagagaguagggaaguagagacuggccauggccacauggagagaggaggaaagggaagauggagaaagggggaguaagagggcaagaaucaagagguaagagagcgaggagggggcaagcagcuccuuuuauugugagcugggccauccugacuuuugccagguaacuguggggguggaguccagacaauaccaggagcuuggggcauugccuacgugacuuauggccacacaccucuaugggggguggaggguugugcgaggcuggagccaggggcccggagggcauagccuaacaccuucugucccuuaaggucaccuggguuccaggccugugcucgacuguggaccuggcugucuguacacagcccacugccccacaauagggaucccgagugagcucugaguggcucuaagauggauggguguuccucagcuagauuggccugggccagcuugagcaagcuucaacaauuucagaaggcagaugucauugucaugagcauaccaaucuaagauacuguggacacugugggugagagaccagaaggcugcuggauggaccugccugugacacggugaaguuaucacaggaccuaggacaccagugugccagagaggccugagaugacagagcagagagagcaaggccagcaaaauauacccuuaggacaggauggcucugggcacaggcuagaugccccgcccccagucauucuagaaggcacgaaugcaggaccuacuuuuuagcggaucauugcccucggaagaggggagacagucuccucaguggugcaaacacugcuaaucugcuggugcuacuguaacaugucacucacgcuccugugggagcccuaguuaaacccaugcaugggucaccaaaaaaaaaaaaaaaaaaaaaaaaaaggaugaaaagacaugagggcuggagagauggcucacugguuaagagacuggcugcucuuccagaggaccuggguccaauucccagccccuacauggcaggcugcagucaucugugacugcaguugagggaaacuggcgcuuccuuuuagcuuccucugguauuggcacccauacaguucauagacaugcauguaggcaaaacauccauacacacaacaggaaauaauuaagaaaguaaagacgcgccgggggggggggguggugguggugcacaccuuuaaucccaguacuugggaggcagagacagguggauuucugaguucaaggccagccugguauacaaagugaguuccaggacagacagggcuacacagagaaacccugucuugaaaaaacaaaaaacaaacaaacaaaaauguaaagacgugagaguauaaggggguggauuaggugggaagagggagggaggagggggauuggaggaggaugagagaggauaguagggaucaaauaccuuauauccaugcuugcaaguguccuaacuccuuuguggccacaggcaaagcgaaggucugaauaucagaaaggggaggugcugagggggggugucucuguaguccauuaguauagacauuggaacauggaggauccuugcuguaccagggguucagaugcacucgcuuguuuuuucuuuucuuuuuauaaaaagauuuuauguaucagauagguagguagguagguagauagauagauagauagauagacagacaguagcuguuuucagacacaccagaagagggcauaagaucccauuacagaugguugugagcuaccaugugguugcugggaauugaacucaggaccucuggaagagcagagccaucucuccagccccacuuuucauuuuguucaaggcaggguuucucuguguagccucaacuguucugaaacucacucaggaaaccaggcuggcccaagauacauagagcuucgucuaucucugcuucccgagugcuuggauuaaaggccugugcuaccacugcccagcuugcaucccacuucugaauacuacucuucuucaaaaaccuccugauguguuugccucuccuuauucuuuuuuuuuuuuuuuuuuaagauuuuuauuucauugacaugaauacauugucgcugucuucaggcacaccagaagagggcaucaggucccauuacagacaguugugagccaccacgugguugcugggaauugaacucaggaccucuggaagagcagucagugcucuuaaccacugagccaucucuccagcccucuccuuguucuuuauagcaguccagguauagagacccaggugaggaagggacagcuagacuucuucauucagaucucagugugcuauagaggagaccaaucagagacaggggacgcuuuucuuagcaucacacagcaaauccaggggcugcagagagcaucguggagcugacagacuggggugugugugugggguggggggauuguugaacaagaguagauguuaaucggcaaguuuggguuugcugggugugugcauuaaucucccugagcuucaauuucuccuccuauaaaauaaggacaaucucuaauuccccgaaggguuaugagacuucugaugcccaggguaguguuagcacugcccugggaagcucuaaggaugcccuggaaauuaggaaacuaguuccaucuccccugcuggguauaaggcaauguguaugagcaugugugcugccgacugcauugaguuagucacugcacuucuuagucuggaguuucucucauguguagaagaaauaaacaauguaaaugauaccguuacaucaucgcacgugacagcaaaaagccgggaacagccaacaggaaccagucuucaacagccuuccaccacauggagcacaacaaggcucagaaaagccagucagccucagggacauacaucuacauaucaacacaguccagaguaagaacuagauacaaagccuuguggauggguuagcaggauggcuccguggcugagaggcacuugcugccaaauuugauccucagggcccacauaguggagggaaaggaccagcuccugaagaguuguccccugaccuccacagauaugcaauggcauguaugugugugugcucgagugcaugugugugcaugugcaugugugcaacccuagcaccagggaggaaagagaauacagaaacaguaugguauagagucaccuauauauguaugagacccuaccucaaaauaauaaaauuaauaaguagaaaaucaugaaaaguguccuuagacaacaaaggacacacagguccaaggcacaggugacaugcccagaaccaaggcaccacuuauaauuuccuguuacaacuggaauaaaaccaguuuagauuggcagaauuuccagugcuccauucugcucugugucugcauuuguuuccagucagagcugaugucuaccguccaaggacucagggccucagcccuggcucuagagaaagccuguggcagguacugaagcuccugucugccaggcaaggauucugcugcuuagccaaagacaaaaggaaucagggcugcagagaaggcucagcagcuaagagcacuuaacucuuccagaggauagguucagguuccagggcccccagcauggcucacagcugccuguaauucuaguuucagggggucugagcccuguccuccuuucugcccucuacugaaauuguacagaggugcuguacagaccuaaauacagacaaaacacccgcauaagagaggggauaaauuaaaagggaaaagaaacuaaguugaguaaccuggcuuacaacuguauuccuugagccuuagauauauuucuagcacuuggggagcugaggcaggagaauugcugagaguuagaggcaagccuuggccauacagggaguuccaggccauacagggaguucuggcuguuuagugagauccagucauaaacaaacaaacaacaaaaagagcaaagaaggagacaggaaagagggaggaagagagcuaagucgcguucugccucacuccaccgaauacacagaaauaaguucucccuugggaugcuguauaccuccaguggcacuucuuacaggucugacccuuuggaggacagaaccagguacaagaugcuuuuauuuuaauauuauuguuaguagcacuaagggaccaaucccggugccuuugcauaugcuaggcaggacccccccacuuuuugaggcagagcuucucuguguagucuuugcuguccuagaacucacucuguagaccagaauggucucgaacccacagagacccaccugccuuugcuucugggauagagguucuccuagaggcacaaacugauuuugugauugucagagagaagaaaaggggggggggcacaaggguuauaauuccagucaguggguagaggaagguucugaaagcccauagaggggggaaaaacuagaaagacugagaggaaagugggccaagaaugagugaagcuguucgcugaaauccacacuuggggaacaagcaaaauggcaaaugccuguaaucccagcacccgggugguggaggcagagaauuaaaguuuuaaauuguccugggcuacauagugaauuagagguagaccuggguugcaugagaucuugucucaaaacagaggacuauagcuuaguggcagaugcgugaggcucuggaugagaucccaguaggguaugaaaccagcccugcugguguagacgggauccucugagcacugagcuguggaagugaaagcaggaccaggaguuuaaagugaucuuuugccacauaaagacucugagacuggcuaggugcagcuauggugucucagguccaccuggguuacagaugaaacuccaugggggcgguguggggggagugggccaagaaugagugaggcuguucacugaaauauaugcuuggacacuuugauuccagcacucaggaggccagagcaaggagaugucugugaguuugaggccaggaguacuuucagagagcaaaugucuagauuucuccccgaacaguccuugcuuauuuaaaauagaaaucucugcuaaauauuuaagcccaauguagaaaagcaggagagauugaaaacccauugcuguuguccagugccuuccacaaauggaaguaccucaccuacaauaaggugagacuacuguucccucccccagagggcccucaaauccacuuucuaccacgggggaguuuccaacgccccaauaagauuacacaccuuccccuaaagccagcaaauuuacuccaauuuauuuauuuauuuguuuguuuguuuguuuguuuguuuucgagacaggguuucucuguacagcccuggcuguccuggaacucacucgguagaccaggcuggccucaaacucagaaaucugccugccucugccucccgagugcugggauuaaaggcgugcgccaccacugcccagccaaaauuuuuuuaucuuuacuuaauauuuuugccuguuugcauugugcuuuuggaggccagagucgggucagauccccaguuuggagucuacaauugugagccgcaguguggguccuaagacuugaaccuugagacuuaaccacugagccauuucuccaaaccuaauuucauacggggcuccaggucccugcugaugaagcaucccgggagcaacccgguccaaccaaauggaagucuuucccacugucuccuucuuagccuggaaaucccccccccgaaccccacaggccucgauaggggugucauucuuccgggaagucuuccuaggcuucuagagugaguuaagagucuggagaggccgggcgugguggcacacgccuuuaaucccagcacuugggaggcagaggcaggcggauuucugaguucgaggccagccuggucuacagagugagcugcaguucagccagggcuguacagagaaacccugucucgaaaaaccgaaggggaaaaaaaaaaaaagccuggagagacggggucauauucuugaccgaaaaggcugcauccccacugucugcgugagccaggacauuucggugcugggaauugaugacacaggcaucugccagcccuguaauucuauuccagcucagagcuucucugccaaggagucgggacugagaacugcuggcucggauuggcuauuuuuggauguacagcgaaguccuuaagaccuggcacagaccuguggaggauagcgacgaaaagaguacagaguuccuuuaagauggaggacccccucccaggaacacccucuucccuccacccuccccggcagagcgcccccuagaagcauggcgagagcagcgcaccuccggaccaucugccccucacaaagauggccgugauaaggcgcugcuucucauugguccgggaaaaucuagagacucggauuggugggucuuaggauggcgucagggcggggcggggcgaagcggggcggcuccggcccaggccuagcuugcgguggcauuaagacuaugucgugggcgcggagccgacugugcucgacucugucccuggcagcuguuucugcgcguggugcaacgacggagggcgcggcgcggcgggggaugagcgcguggccagcgccacaggagccgggcauggaguaucagguuucugaccguucccgcgggcaaacggucccguacugacacgugggcagcaccggagccuugcuccgcucuccgccagcugcugggggcaccggagcaugaaguugcggggcucgagaggcggggacaucccagagcccaggggaggugacagagaccggaaaguugagcucagguggcccgaugugggaauucugagagcgcguguccgguguugcagagggaaugggcgcaggugacacaccagaacguccagaaucugaauugaguuuuagaaguuccaaugcagggcaaugcaggaugaagggaagggaggaguucuggaguacagaguggaaguacccaggaggaucugggauuggggucuccaagacucgaagacuggaaucuaaguauucagaauugaccggcgggcaggcagaaaaagaggcaauaaagagaccaagaaucuagaacaaacuguagauuacaaacugugccagggucaguugucaaugaccagaacuuaaugcuggccaggcagguggcaccgguuuagggcugugaggcuuccagccaagccuugaggauaagagggcaggcgacccagcuggugcccgaaaggaacugccuaagcacagguuucucagaauguaggguaauugaaacacacgacuggauuuauauccucaaaugccucucauuuaggccucucuguuuauuuucuguuuccacucccaucccccaaagccgucuccugaggcugucuguacccaccuguggauucuggcccgacaacucuugaguguacuuucccucccucuguaccuccucuuccagaucuaauugcuuacuuacauugucuugucuuaggguuagaagguggaacucucaaauauuccaaaauucaaaguuccuagauuucuaacguccuggcccccacucaguggguguccaguauagugguagagagauuaaggaaaaaaccuuccuuccaggguuggucuugugugugaaggcugagggcauagaagcuuggggaaggcagcccaggaaaugaagguccguuaaucuugccagcuuuaccuggcacucccuggguggggcuagcuugcccauggcucccaucuuugcuagaacuggagauaugccagggcugucccaccaaauagcugucggcaaaggcagcguggcugguauaacgggccuguugcccugguuuugccacuggugggcugggucucucuguccuuaaggacccucacugaacugggacuaugguugcuaggaugcugugcgcacgcucaacacccugcaaaccaaugccagcuaccuggagcagguaaagcgccaacggagugacccccaggcgcagcuggaggcuauggagauguaccuggcacggaguggacugcagguaagguuguacauccugcaagacaucucgacccuaucugcgcgugcgagcccaguggcugaggcgaggaccuuucugucuguuguagguggaggacuugaaccggcuaaacauuauucaugucacugggaccaaagggaagguaagagcaauccaggaguccaugugguggacuggugcccauccaccuuuuuuuguuuguuuuuuugguuuugguuuuucgagacaggguuucucuguguagcccuggcuguccuggaacucacucuguagaccaggcuggccucgaacucagaaauaugccugccucugccucccaagugcugggauuaaaggcaugugccgccacugcucgguucaccuuauuuuuuuaaagauguauuuauuuauuguauguguaggagugcacugucgcuguccucacacacaccauaagagggcaucagaucccauuauagaugacuaugagccaccacgugguugcugggaauugaacucaggaccuccgggagagcagucagugcucuuaacugcugagccaucucuccagccccugccuguccaacuuuauuaauugauucucuacaugcugcuaccaaagagcaccuuaggguguccuguuagggucccgauugcugugcugaaacaccaugaccaaaagcaaccuggggagggaaggguuaacuucacuugcauuccauagaacaguuucucacccaaagaagucaggacaagaacucaaacagggugggaaccuggaggcaggagcugauacagaggccaggagggaugccgcauauuggcuuagucaucagggcuuucucagccugcuuuuuuuuuuuuuugagggggggggguuugagacagguuuuucucuguauaguccuuguuguccuggaacucacucuguagaccaggcuggccucgaacucagaaauccgccugccucugccuccccaguagugggauuaaaggcgugcgccgccaccaccacgcccggcaccucaugcuggagcuuauggaggcucccauaagcuggaucgcugagguuucccccucucggauggccagcuuuugccaagcugacaucagacugucaugucgggcauguaggaaagagaguuuacuuggcugugaguucugggagauguggucccccauggcaggugaucacaugaucacauugcauccucagucaggaagggauugaugugugcuugugugccucggucaacccugucgagaaacuccuccccaggccugcccggcacgucucccuggugauucugggcgacaaccagcaguacccaucauuucauccuacccaaugcuuuccagggcuccaccugugccuucaccgaacggauccugcggaauuacggccugaagaccggcuucuuuagguacugggcucugugugagugggugugggugucugugucucagcucuagaaggcuauggugcuagagccaaggucagccucucugccucucccccgguauuuguugauucagcaaacauuaaauccacagugccaguguuagcccacuaauagcagccaucaguuuccauaaggaauaaauuggagggagagaggcgaccugugucucaagguguggccuaaguaccuggcuggaagaaccaggugaccuuuuauuaauuuaaguuccaaauguaauuuuugcccguuaaauuuuuaaauuauucuucuugcuuuauguguguguguauuuugcugcauguaugugcuaguauuggaauuacacaggguucugagccacguguguguuaggaaugaaacccaggucuucugcaagagcauucagugcucuucauugcugagccaucgauccagucccuguuugaggcaggugucacucuagcccaggcugaccuggaacucacuuugucccucaggcaggccuacaaccugggcucuuccuaccucagucuccugcuggaguugcgggugugagccaccgcacugcacaacuugguuuugucugcuuuuuuaauguuuguuuuguuugggggguggggugucucucuaugaagcucugacuggccugggauucuauagauuagucuggcgaagaauucacagucuaaccugucucugcuucuugauugcugagauuaaaguugugcaccacuuuacccaccuuugaguaugauuuaugugugcaugggcacacaagcauauguuuaucucaguguguguuuuucugucuuuccuuccuuccuucuuccuuucccccucucccuuacccucuacccucccucucucccacucucccuucccuccccucccccuuucccccucuuccucucccccuccuccucuccuucuccccucccccucuccccucgcccucuccccccgcccucucccccuucuccuuccccuccccucccucuccuccucucugccuccccucucccuccccucuuccuccuccuauccccauccccucucccuccucucuuccuccuccuaucccccuccccuccuccuccuccuauccccuuccccuccuucucccuccccccuuccccucccccucuccucucugucuucuuccgagauugggucucucacugaaccuggaguuccuagauucagcuggauaacuaugcauuagcaaccccagggaugcuccugugucugcuccccagaagugggguaaucaauucacagccgcuggcugguuucuuuuugcagcgguuggggugggugaggauggagugugagaauacuggggaucugaacgcaggcccucauauuuguguggcaagcacuuuacugacuaaaccaucucccaggcucuccagauccaguuuuuaagcauagagauauuuguuggcuaagaugucucugcaguaaggaacacaaaccugacucauaaaggugcagagccaguuuggcuauggcccccaugucagagucuccacagggaggcaguagagcucugccagggauagcugugguuucuucuggagcagcgcccccuuguggugacucacagacaucagaagcccacaagauguggagcuggcuuacugaugcgagccucuccuccccugucaccuuaaacagaggacguuucagaggagugcauaugaguauacuccuggggauuugucccuugagggagaagcguauccgacauuagcuuugucaguucugucaggccaccuccauaagcaccugaagccaguuggcuggggccaauucagaucaacugacaugucaguuuccuggaacuggugauuguucaaaauaaagacauggaagcugggcagggcggugguggcguacaccuuucaucccaccacucaguaggugagacaggcugugaguucaagccuggucuacagagcgaguuucaggacagccagggcuacacagagaaaccuuaaaaaaugaaacaagggcugccgagauggcucagugguuaagagugccaacugcucuuccaaagguccagaguucaaaucuuagcaaccacaugguggcucacaaccauccguaaugagaucugaugcccuccucuggagugucugaagacagcuacaguguacuuacauauaauaaauaaauaaaucuaaaaaaaaaaaaacaaaagaaaagaaagggagaugacuuggugugagagggucuuugaggacuuaaaaugcagacaugucuuaggaggcuugugugauuguggccaccgcaucgauaggacacaguauaugugucauugaccaaagaauaauacuuuugaagcuugaaaacauguaaugacuuuuucauuaccuugggugucuuagugcgugugcauugcuguagcccacgagagaggucaggagacaagcuuuagugcguguguguuugcccgugugcauugcuguagcccacgugagaggucaggagacaagcuuuagugcguguguguuugcccgugugcauugcuguagcccacgugagaggucaggagacaaccuuuaggagaaguuucucccgugaguucuuaggaugaccguagaucaucaacguuggcagcaugugccaugucgcuggucccugauaauaaagcucuaaccacugaccuuggccuacgcggccagccagccagccuacagauguggaugcggcaggggaaugacuccagacaguuccuuccucuggauuuauugcuuugagacugaaaggcggacggcuguuaauaggcauguguuagcagaguuacuaauccuuuggggcccagagacucuguuagaucaucguggggacagggcuaucucccuccuuucugaggugggggucuuaguugagagugguaucguaggaugaacccaccgacagacagacgguaggccuggcuagggacuggaggggccgccaagcugcuggggcagggcucagccuccacaggcucuggaggcccuaggcaggagcucaagagucuugaggacguacgucauggagccucgggaacagggcagacacagucugauuagggcaaggaaggccugggaaguggggagucccgaugaccccaggucucuccacagcucuccucacauggugcaggugcgggagcggauucgaaucaacgggaaaccaaucagccccgagcucuucaccaagcacuucuggugccucuauaaccagcuggaggaguucaagguacuguggcuggggacuggggagggcccauccccgugugggguacggggcucuggcccugacuggcuccuucugugugcaggacgacagccaugucuccaugcccucuuacuuccgcuuccucacacucauggccuuccaugucuuccuccaagagaaggugagugucuuuccuagcccugugucugaguccuuggggagcagagcaugaguggagggguucccugcucccugugugcuuucugcucuccuacagguggaccuggcagugguggaggugggcauuggcggggcuuuugacugcaccaacaucaucagguaagguagccgccguggcuguggagucacccggagccugcgcaacggcucggcacuggggagcaggacuuucuugucuuuuucagaaagccagugguguguggagucuccucucuuggcauugaccacaccagucuacuaggagauacaguggagaaaauagcauggcagaaagggggcaucuuuaagguaacauagcgggccaaggcaggagagguucaugggagcccagggucuguccuuuuaccgcuuacugaagaaugacuguggcaagucauuaccagguccuagccagcugcacagccuggcuucuccuccuucucccucuguggccucaguugaaaucagccccugucccuuuuuucuggugugccugcagccuggugucccugccuucacuguggugcagccagaagguccccuggcugugcugagggaucgagcccagcagauuggagugagugacuggcuggcuuggugggguggaggggugugcugacuagaagaacacagucuccuguugggcuuuggguuccucaugugcaaaggggauagcggggguagcuguuguggcuccaggacgcaucugguucuggaagcaggucuugguaggcccuggugguuuuggugguuggugaugggcccugguggucagaggcuuucuaacauaguggugguggcaggucagcugaccagcucucccccuccccccacagugcccguuguaccuguguccgccauuggaagcccuggaggagguuggacugccauugagccugggucuggagggagcacaccagcggucuaaugcugccuuggccuugcagcuggcccacuguuggcuggagcggcaggaccaccaagguaggugggccagugugggcgugcaggugggcagcuccaaggcaugaguggagccugccuuggaggggucugaauccagacucacacccuacagacauccaggagcugaagguauccaggccaagcauacgguggcagcugccccuggcaccuguguuccgcccuaccccucacaugaggcgugguaaguuggaauuuccuccccaauccggagucugcacaccuccguucccccugagguguauguugaguuccuauuguaucugugugcccuuucagaugucucuuuugguuuccuguuuggggguuggggcaguuguagguagugccucggggugagcauuccucucuggccuagaguucacagcucaguuuuccuaccugccaaaugagaugcugauaacacccacugccaggggcuguuuggaugguuccuggugugacaucauucaggugugagcccagagccgggaagccuggagcagagugccagucagauugagggagggugccccugcuucaguccucuaaacugcuuucaucccagaguaaggcucaaacuguuagaccccuguagaacagcuucagugugccaggguugcugucagggacagcccuggagcagaucuugggucaaacuccagcccuagcccucacuugcugugugagcacaacacugacugucacuuggggaauguaugauuguguaauagcagccccaucucagggcugucuggaagauuucacagcaggacagcucauuccaggaacccagagacagccauuaguaaguggaucugccuguagggccaggagaucacaggccuuguuguggaucccagagcacugucucaucugccuuugccagggcuucgggacacaguguggccuggccggacacagauacuccagcggggaccccuuaccugguaccuggauggcgcccauaccaccagcagugugcaggccugugugcacugguaccgccagucauuggagcgcagcaaacgcaccgaugggugagcucucuugcaagucugucugagcaugcaggguggguaauaacccccuuagggcugauuucaguagcuaucagugggcuauaaccugcucuuagaaaaaaaugcucuacugauaauucuuuagcagugaugccgcuacaugguacagauuugaaaauguccuaaaugguguuucuacgauaaagucuauacccuggcgcuggagagauggcuguuacaucgcugcucuuacagagaacccacauggguuagauucuggggaaauggcuggaaugguguaggaggaagggcagaaggcauaucccacccauuucuuccugaugcagaggguccgaaguacacaucuugcucuucaacucuacuggugacagggacucugcugcccugcugaagcugcugcagguaaaggacccaccuggagggugggcaggcggcagguggcccuggcucuggugggcgccgaggccuggacguccucaccuguaaauggagccaaucccugucaugcuuugcuugcggggcugcgucagugcuaggcugccagggccagaguggcuccucgaaucacuucccacuucaggacaggaggcuggagugguucauauccagagacuacuccagccuggguuuggggccugcuccucagcucggcugcccuaaguagguaccaccugacucugcacucagaacaguacauguaugcacgagcuuccuguacagcaggcagugcacugaggcagauggggcagcuguggagggcuguggcucguuacuacacaucccagugcaggggcgguugucuccagagguguggccuggggaguauuuggaagucaagugggggugagggacaucuuucagaagacugauacuaauaacgucuccccuuggucucccagcccugccaguuugacuacgcugucuucugccccaacgugacagagguuucauccauaggaaaugcaggugagagggggcagaugguauggcuaaugccaggcacccauggcagacugcucagugaggaacagggacuuccaaagcaugcuaggagacagcggcuuuugguuuuuaagauuuauuuuuauuguuugugugugucugagugcccagcuuuguggaggccagaagucauuagauccccuggaagugggguuaagaugguggugagccaccauguggguacuaggagcugaaccccgguucucugcaagagcagcaagggauguuuaacaacucagucacgucaccagccccaggguauguagauuuuauuguagaaacaccuuuugguacauuuucaaaguuauggcauguagucacagcacugugaaagaauuaucagguauagcauuuuuuuaaagggcagguuacagcccacugacaccuacugaaaucagcucagugagacucaacuaagauuuauugacuggaagagaauagaaaaccccagugugcgcugcacgaagaugggcagguacugccugcugaagacucagcucugggucccuauggaagaguguagaacuagcuugcagugugaaguacguuuuuuguuuguuuguuuguuuguuuuuguuuuuguuuuuugagaaaggcaggguuucucuguauagcucuagcuguccuggagcucacucuguagaccaggcuggccucgaacucagaaauccaccugccucagccucccgagugcugggauuaaaggcgugcgccaccacgcccggcuuaaaagcuguuuuuuuauuacauuaauuaauuuggguuggggcacgugggugaaggccagaggacaaccugggggagucaguucucuccuggcgccaugugggucgugggccauggggauuauauauaggcugccaggcuugguggcaagcaccccucacacuaaaccaucucacugacucccagaaugcuuuuuguaugcauuguauuuuaaaagcgugugugugaaccaugcagauagaccuccagguuccacauuggaccaacuggggagaucugggaccugugucuuuaacaggcuuccugggaaacacucaugcccacacgugagggaccccaggggacaguuuguaaaggugagcgugcuucccaugacagugagcagguugcacuggucacaguccaucgugcagacagccagcagucuggugaaguugugcuuguaaggguuaagcagaugcucaccgugcucccuuucccuucccccuccacugacaugccugguucuggaccccacagaccagcagaacuucacugugacucuggaccaggugcugcuccgcugccuccaacaccagcagcauuggaacggccuggcugagaaacaggccagcuccaaccucuggagcagcugcggcccagacccugcugggccaggcucccugcugcuggccccgcacccaccucagccuacuaggacgagcucccucguuuucagcugcaucucccacgccuugcuguggaucagccaaggccgggaucccaucuuucagccccagagccuuccaaggaaucuucucaaccaccccacagccaacagcggggccagcauucuccgugaggcugcugccauccauguacugguuacaggaagccugcaccuggugggcgggguucugaaacugcuggaucccucuaugucccaguagccaaggaccauccuacaucggucugccuuuccacagacucuuauacucagugccuugugauuucugcucucagauuuuuucggacuggcccaggguccugggcucuugguagaguguagggaugggagaggcucucuguaccucggccucuccuuccucuggcagagacagcagggugcuucccagaguccccaccaucguagcaggcuuucagccuggcccaucucccugcugccuccaggcucagguccagcuuacuguugcagcugccugagcagccuggauccugccugagguuagaccagagaccuccuccucccucccaaugcuuucuggcaaaagagagggcccuugccuggcauuuggggacuguguugcuggaacuaauugaagcuuuuaaacccuuuuauuuuuuauuuuuuguaaauaaaugacaaaacuuuugauugac

SEQ ID NO: 764 - RNA, 5013 nt, Mus musculus
caccgggagcuguaguucacagguucuggcggugggcggccucugaccgaaaucgggccucaaccggauggcgguggcgaggcacggcuaccggcccuggggcucgauccucgggcugcucgggcuggccuuggcugccgccgccgccugggacguggcuucucugcgcugcaccuucggcucguucugcgaaugcgacuucuggcccgacuugccgggugaggggugggagccggugcggacgggcgggcagccggcaguucgcaggggcucgaaacaucugccgccccgccggccgccggcggagguggggauccgagagccucuggugcaaaccugaggagaggguuuggagggggcccgguggagggaagccuuugacagaggggcgcccaguggcuugugguaggccucccuugugcggacuugucacaccgggggagaaaccugccgucgccugaaccuguagacagcugucgucuacucggggcuggugcaacccggagaaccgccucgagggggcggugccgcacuggcccuugccgaggugacugauccugucccucguuuggacacaaguaucccagaggucuuagacacaugccuucgacccucugaugcuuuuuguuuguuuguuuguuuguuuucccgacagaaucuuucuacacugauuugacuguucuggaccucacuauguggaccaggcuggucucaaacucccagagauccacuuagcucugccuccagagugcuaagagauuaaggguuugcaccaccauauucuggcucuuuuuguuuuuuguuuuuuuaaagauuuauuuauuuuuuuauuuauaugaguacacugcgacugccuucagacacacacuagaagagggcaucagaucccauuacagaugguugugagccacaugugguugcugggaauugaacucaggaccuuuggcagucagugcucuuuccaucuuuccagccucccccuuuuuuuuuuaauauuuaugcuuugccugcaaguaugguuacauccaugugcccauggaaguuugaagacgguguuggcuccucugggauggacuuacagauaguugagagcuaccaugugagugguaggaaucgaacuuaaguucucugcaagagcagccagugcuguuuguuuguuuguuuguuuguuuguuuugagacaggguuucucuguguagcccugcuuggcuggccuggaauuuacuauguagaccaggcuggccucgaacucaaaagagaucucccugccugugccucccaauugccuggauuaaagguguguuggaauucaccauaaacccaggcuggccuuugauugggaggauuacugcugccucugccucccaggggcugagcugacagacaugagucaacagccugucaucugcuuugauaugcguuccuucuguggcccuaggucuggaaugugaccuggcucaacaccuggcuggccagcauuuggccaaggcccugguggugaagucacugaaggccuuuguacaggacccagcccccagcaagccguugguccuuucccugcacggcuggacaggcaccgggaaguccuacguuagcucccugcuggcacagcaucucuuccgggauggccuucgcagcccucacguccaucacuucuccccuaucauccauuucccacaucccagccgcacugagcaguacaagguaggccagauguguccuggucccuuuucuccauccuaauccagagagggcuccaaaacacacagccaguuggaggcucagccuucagaaccuguuaggaacaggggugguggcagucuuguugccugugaguccgagacaucaugagccuuggggauuaccccgggcagauauuacacaggguaccugugucuguguuagcauccucucuuaagcucuuagccccauauggugcuuuggcaagcauucccuggugacugucagcucugauaucuguuguuccugaucugucuuagcugucaacacuggggggcaggucugaccuccccugucagaagucacuuagcucucaugaacagacaauugaguacauauuuguaccccuguucuccuguugacuggcugugugacuuuggacaagucucugcaccucucugaacuacccuuuuaccaucugucucaagggguuggugccaucuggauauagauugugucucuucggaaauuuuucuuggcuugggaagaaguuccggguugcggggaguggagugucuuggacuccuuuggaauuccugucucuacccucauagaaggagcucaagagcuggguucaggggaaccucacugccuguggccgaucccuuuuccucuucgaugagauggacaagcugccuccuggccugauggaaguccugcagcccuuccugggcccuucuuggguuguguaugggaccaacuaucgcaaagccaucuucaucuuuaucaggucuggccucuauugcaagcaaguggggguggaggggcacuuguuagaggucuagcuguccagcgugggccugugcucccagcagggugcucucccaggagcgcaugcaugcucucuugacuccucacuuuuuuuuuuuuuuuuuuuccagacaggguuucucuguauagcccuggcuguccuggaacucaacuuuguagaccaggcugaaauucgccugccucugccucccgggugcugggauuaaaggcgugugccaccacgccuggcucugacuccucacuuuaucucugaugacucucauuugcaguggcugacuucuccuuugacauucucaaagcccuucugggcucugacuuuuagauccuugcugcuguguagaaucccagccuggucaacagucaucccuccuugguaguugagaggacacaugccugagagaaugggacugugugugucccuacucuccgaccucagccccauuucccagcugugaguccuuaggcaggagcguugagccucucugagcucugcccucucucugcuucugaagcuggagcgauggcaauucuucccugcccuccucaggaaagcuaguuagaggauaccaaaggaucuuguagccugagggugguaacacuuuauucgcagugcucugaaagguguguuggaggauggcuucagaguugaagguagccugggcugcaguagugucagccccaacccuagauggcucugugaauuguaaagugcaucccacauacauguuacagugacguggcugucauggggagaaggaaaugggccacuuugcugacucugagucauguuacgugugacccucuaguucuuccaugaaucucagccuggcuucuugugauuuuagcaaugcugguggugagcagaucaaccagguggccuuggaggccuggcgcagccacagggacagggaagaaaucagccuacaggagguggagccaguaaucucccgagcugugauggacaacccucaacguaaguuggcucggggaccaaugucgguagggccuucacacuuaaguacaccugaaucugaagcacuguccacugcacuguagucccaucucucccgccacauuguccacugcaccauagucccauuccccccccaccaccacauuguccacugcaccauagucccauucccccccaccauauuguccacugcacuguagucccaucucuccugccacauuguccacugcaccauagucccaucccccccaccaccacauuguccacugcaccauagucccauucccccccaccauauuguccacugcacuguagucccaucucuccugccacauuguccacugcaccauagucccgccccccccacuacauuguccacugcaccauagucccguucccccgccacauuguccacugcacuguagucucaucucucccaccacauugucuacugcaccauagccccguccccccaccaccgcauuguccacugcaccauagucccgucccccaccaccacuacauuguccacugcaccauaguccuguccccucccccaccacauuguccacugcacaguagucccaucucucccgccacauuguccacugcaccauagucccguccccccaccaucacauuguccacugcacuguagucccaucacccucugccacauuguccacugcaccacagucccgucccucgccacacuguccacaaugaagccuggauucccgacuagaaaugcucaccauggccucugugccucccugcagauggcuucuggcggucuggcaucauggaggagcaccugcuggacgcuguggugcccuuccucccgcuccagcggcaucacgugcgccacugcguacucaaugagcuggcucaguugggccuggagcccagcgaggaggugguucaggcggugcuggacagcaccaccuacuucccugagguagaacagcucuucuccuccaauggcugcaagacaguggccucccgacucacauuuuuccucugagaagcccagguggcaucgcugccuccucugccuggucagagcaaacacgaaaggccuggguggcuccuggaagaaaucuuuccuaagcugguuggcaagugggacccagagcacaauguuaagaugaagaaagguguuggccaggccaaggaagaaaggucuagaagcaucuuugcuaagaaacuccuggguaccccgcaaccucacagccgugccauugcccugcagucugagccugagccuucucaaugugaacggcaacucagggacgaaggcuccuggcugcuuccagcuggggacucuuacuggcaugccuugucuggcuccuuucccagaccucagcccacagacuguggcuggacccagcaauccagcuaggccaggcuagcaccucacagguuccccaaauggaaggacucaagcuacuacaugggccugaauuucaaaguuuuuaauuuuguacaagagaacagagauuaaauaaacuuagccuugguauuagaac

SEQ ID NO: 765 - RNA, 14618 nt, Mus musculus
ugaaugggagucggcacguugaaguccggucuuuuuaguccagggaugcggcggaguugggccuugagccggcagguuuccgaggcucgguuccccgggaagcgguggcuggugaguggggcguggguggcuacacagggacgcggggcuuggcuccgcagcuacgcuuacauuuaaguguaugcguuguaugcaugugcccuguggcugucagagggcaacuuaggagaggguucuuuccaccauguggguucuggggaucgaacccagguugucaggguuagcagcaaccuuaccuucggaaccaucuuuucgggauaguugucccuuuuucuacuuagucaaauaggcgcaauacuaacuggcuccaaacuuuuaguuuugcucuugcaccagggagcggcauccucuggcugguggggccuccaggaguucccagacccuuaagugcuccuucccaauacugucgcuucuguuuccuggucaauguuuuggguccugagugaguguugccuacagguggcuggccuggggaaccacggaaugcccggcacccggcacagugugggcauggcggugcuggggcaaauagcaaggcgacugggaguggcggagaauuggacucgugacucgcgcugugcugcugaccucgcccuggccccgcucggggaugcucagcugguacugcuccggccgcggcgccucaugaacgucaacgggcgcagcguagcccgagcuggugaguuguagguuucauggauaagagggcacagggaccagagagaggguucaauugugacaagugccuggugagccccaauuacuacagugaaggcuuggggaagccuguuuacauauggggguuguugugaccccucugagcagauaugcaguaacuagaguguuguuucccugugccaagcggagcuguuugggcugacugcggaggagaucuaucugguccaugaugaacuggacaagccguugggaaagcuggcucugaagcuggggggcagcgcaaggugaggcucuuaugugcguagguuuggguagggaugcuggccucuguuggaguggaguaagauuguugagacuaucuaucucgauaggcugggcugcucugaagaaggccugggcaagggaauggaggaagggcacugccucagaaaguacuaacugcucuucauauccccucaaggggccauaauggaguccguuccugcauuagcugucugaacuccaaugugagucuacccuucugcccugcccuggguggggguggcuagcauugacauuguaucucaccaaugcauccucauuccccugggacccuacaggcaaugccaaggcugcuggugggcaucgggcgccccacacacccuaauaugguggagaaccauguccugggcuguuucuccccggaggagcaggagcuacuguccccauugauggaucaggccacugaccugcuccuggaccacauccgugcucgaagccagggaccauugucaggccucuaauaccaguggauauaucuaccuguuugacugccugccggugccaugaagccaagacagggccacagaacugcaaugacacagugguacccaauguuuauauaacuucccuggguuuccccaggcuacuugcagauucaaggagggacuguggccacaucagucuguuucugcagcagcuuggucuccccguucgcuauuugcgguguaggaaaggucuaggaaggguaaacuuucugaaccuuuugagagcuccagauggguagaucugcaagauuaaagauacgaacuugaaauuggaagcuuccugugggguuaggcaccaguggguagggacaagagggucuggcaaacccuauuccuaagggaucauggguauaaugcuuuagccuuuuuccauugggucauuuucuagguggggaggagcaaagagauuccaccauaucccugaggcuacccaacuauagccuggcagaaccagggacagcugucagcuugcugugccuaggguuccuggcaccccuaccucauucguguucuggcagauccccauucgggugauauaggagaggggccugagauccugggguuugagugggaugcggaccggacgucgaggcaccagcccaagauccccuggcuuauagguugugauggucgagagcugcugcagcagagaaacagccccuuccuuggaugucugggugaugcguuggcuguggagagggauccagggucauccccuccauccccacaagaggaaaaauauuggagagccagggucugcugaggcccccacagggcuaucugcucaccuuucuuuggauaggcccuggggcugcuuguccuggugggaacccauguccggcuguguuuucaaaaccaccccugagcugagcaauaccagcaguugcugcagcagcuccuugcgcugcaguuggaacaccacaucaaagucgccguccuccgccucuguuugcaucuguugguaugaugugagguggguuaaaucaccacaggggcccagauacccacccaccuccacaugagacgcuccagggccugcuuucucagugcaccugguuugugguggaacacaaguuaucaggcugggaagacugaggcuugaagcccucucuuuggagguuuuuuuuuuuuguuuuguuuuuuuuuuuuuuguuuguuuguuuuuagagacaggguuucucuguauagcccuggcuguccuggaacucacucuguagaccaggccagccucgaacucagaaauccaccugccucugccuccccagugcugggauuaaaggcgugcgccaccacgcccggcuucuuaugagcuuugaauggaaucuucuguucuuccuuugucugccacugccucccagggauuaaagguguucacugccacaccucuauauuuuauaagacacuugagaugcccacuauggccuucucauucuauagcuccagucaggucuugaauuuggaauccuccugcuucccccuccuuagucccugcuaugauuagacccaacucauuuagaucgagaaugagaaaaggagucuggccaucagccucuccagaaagaggcccucuacgauuugcccuggcagccucuugguaucucccacacuguuugcuuacgugcacaauguccuguagcauggaggucgccuggaucaggacuguuuuaagguuugcccgaauuuucuguuccuuggucagcuccuccuguagccgauuugccucugccugcuucuccuucaguugcgcuuccagcuggucuuucucacuccugcuccgggacaaaacagcaugcagcuugccccaucuuugugcuuggggcaggcaggcaccaccucuucccugugccccgccuuuucugugaagccuuucuaaauccaggcuucaacuugucugacaguccaaacccugaggcucuaggcaaaggcauccccaggcugacuuccacccagcuccggcucgccucagggucugguugucccucugcacauucuggaaguucugcuccaguugggacagcaggaggcgcaguugcuccgucuccucugugcccuuucucuguuggcggcacuucucggucagcaugaggauaaucugcaggggugggcaggugucacagacccaucgugggacccuagcccaccccuagcucacuuuugaagauaugacauagggcuugcucccacauacaggcaggccaacaccaccucuggacaacagcuaggcaggaggugggcuccacuuaguuauggggcaaauagacuccagagcuagggccagcaccccaaugaggaaagccugggaccucacuguaaacucuucccacucaugacuugguucuggcauaggucacacgaggagggcauggcauggugguccuaccuucuuaugcccuauguucuuucuggccaugaucucuuggguguucuccagcaucuccagcuguuggcacagcuuguucugggugcccuugagcugcucauucuccugcagcagcugcacaccaugcuuggacaccuuguuuagcugcagagucacgcuguuguucucuaggauggcccgccuggucgucucccacaucugguugguggccaucuuucggaacucuguggccaccagguucacacgcuggauaaucucuuuccucagccuugccaggagggugggguugggagucaaguagauggguauaagucuugguaucccuuauuuuggggcgguagucccaggguacccagacucuuccccaaagaaucucuggaccuuugaaauuugaaccauugaaacauucuagguuuuuuuuuuucaagacaggguuuuucuguauagccuuggcuguccuagaacucacucuguagaccagacuggccuugaacccagaaaucugccugccucugccuccuaagagcuaggauuaaaggcaugugccaccaccgcccggcaaaaacuuauucuuuuuguuuguuuuguuuuguuuuuuuuccagacaggguuucucuguguagcuccagcuguccuggaacucacucuguagaccaggcuggccucgaacucagaaauccaccugccucugccacccaagugcugggauuaaaggugugcaccaccacugccuggcccauugaaacauucuuaccuauuaaauaaacaccauaacaagaagugacaagaaggcagggaguguccagugccagcuugggcacuuucauccccacccccauacaucccagucaggguucugggggacagaggcuguggaguccauggcucccuucuagaaagcugaggagagccguguggccccggccugcccaccuguccuuguccagcacagacuucuucuccagguuguacacguauuccuuguacucgcccuccugccuauggagcugcuccuccagugccaaguacuucuccgugagcuccucuuucugcagccggaauucuuccagggaacucagcuugaucccugcccaucaggggccacaaggcuggugaggagcggcugcugagagccuugacccacaccccucugaggucguaaacuuucuucuugucuuaccucgccaccuuccccaacaggacuggucugcacgugccauggcuggccccgcacagccacugcauuucugccuuaccacauacucuaagcucagcaaaccuugcucagauccuccucagaaaguccccuuugaaaccuccccacauaagagugaccgagacagcagcagcugacccugggcagacaagucgcaaccuccccuuucagauggguggcauagauaaaauccuccauuguuuugaagcauuuccucaucuaugagcugcgggagggagagcaucucuggccuugggaaugcaaggacaauuaaggcagauaguguuugaaguggcauacagcucuuauuacccaagggagcugugguaucccuaguucccaggugaggccccgccgcagccagugacagcuguggauuugggccuugcugccuuuagugugugcccauagguccccuggcccccucaccgagggcgauguucucuguggugagcugguccuugauuuccuggaauucauggcgcaccugggccaguugggccucgaacgcguccuucuccauauccuuggccaccuccaggcucugcagcuggucauuaaggucugugaucucauccaccuucugguucagcgugcgcuugaggaaggccacaaucuccuucuuguuguuggccagcugcucgaacuccugauggaacagcuucucccgcacagccaguucaucccauuuccgcugauaccuggggugggucagggcagagacgcagggucaagccagggccugcucucccagacccuucuuccauaaggggccaccugaaguuucccauagucugcaccccccauugugcuucacgccuggaggccugugcucagcauucagacugucuuucuguuuuaaagguguguguguaaguaaaucuaagguguaacaguuuggcuaggcuggguagcuggugagcggcagagagccccacccccaucaaggucagggugaaggacaccugaguaugugagcacacuguagcugucugcagacacaccagaagagggcacuggauuccauuacagauggucgugagccaccaugaacucagggccucuagaagaagcugggcguggugguacacgccuuugaucccagcaaucaggaagcagagguaggcagaucucugaguucgaggccagccugguccacagagugaguuccaggacagccagggcuacacagagaaaccuccuucucgaaaaacaaaacaaacaaacaaaaaaacaacaaaaaaaaggaccucuagaagagcagucagugcucuuaacugcugagccauuucuccaggcaucguuuguaaauuuuaagagggccuuauuuacugguuucaaacaagauuacugaagcauuuggagaauugcuuuauuuguaaggauuucuugauaaaccuuuugaaugaguagugcguacaagguguuucaggguaugggugccuuuguguggagaggaggcagucugccauaagaggugucaaaggucaggacugucauccugcugccucuucuuccuggggugauuuccccaguuccccgugugugccuuucuugugggaugguguuaagcagagacgcacggcccugccuggguacacaacugcucagcgccagcugugauuuuucucagcaucaaccauaugagcuuccacugccuuguugucuuauacccauuuuauagauaaggagauagagguucucuucuuuauacauugaacccauauauaauuaaacccagagcucccgaguucaccagucuagcuaguuagccugcucuagagcagugauuguuaaccuuccuaacacuguauucuuuaauacguaguuucuccugccauggugauccccaaccauaacauugcuuucauugccacuucauagcucuaauccugcuacugcuacagacugugaguaucugcacuuucugguagucugggggugucaaggcccacagguugagaaacacugcuccagggggaccuuuuauuuccacaucccaugcacugagacugcaggugggcacuacacuuauuuguaugaguguuggggauccaaauucuaguccucacguuugacuggcaggugucacugggccauuucccugcccacuuacuuuccuauuuaaguguuacacuuugggacuggggcaggugcuuccugucagcaaguuaccuuuguguugcuuguuuuuuugaggcuuguucuuuugaggucuuacccuauaguccaggcgaaguuccuuuccuucuggaacuuagaacaaaccuucugagacuguaggcaugugccaccaugcccagguuagaugauauauucuuuugggggaggggauguucaagacaagguuucucuguauaguccuggcuguccuagaacucacuuuguagacuaggcuggccccgaacucagaaauccaccugccucugccuccugagugcugggauuaaaggcaugcaccaccacgccuggcagaaacuauauucuuacagacauuuuuguugugucugauuuauugauuauguguguacaugcguaugugugcgcagcagaggucagaggacagccugcaggaauugguucuauuccucuaccuugggaguccuggugaugaggggcaagugccacugagccuucuccccagcccuaaagcuaguauuaaaguagggaaaacaauaagcaaauaguaucucuaaaugcuaagaaggaccccucccugcuaucugucacaaaggaaccuagccccaagagggaguggcacgaguaggaaaauccccuuccuuaguucccauuugggaaccuauaaugguccacacuuauaauuucagcacuugggaggcugaggcagguagaucaacaugaguuugaggcuauccugggcuaaagaguaauauccugucucuaaaacaaaacaaauacuuagggaaacagacccagccuggagaaacaagaccagggucuuggcauaagggacuagggaaugagguguccuccugggucaccagggaaaaccauuuucaauuucuuccaccaauuaaacuacacuuuucuaauguuuacagugccguccuguggggguggaccagagugggggugggguguuacuugggauuuagcagugugcuccccgagcucugggaauccccuuacccucucagcacucgcaggguuaccugguuacuugagguaaaugaagcagggaaggauagggccuggccagagcccaggucuaaggcccuuaucugaaccugugugcauuuggccugguagcacuagcuucccugcuggccacccaccgggccagccuguccuccaggucuuggaucuguuugugguagaauuccuucagcuccuccaccauggccaacucuggagucuuggucccacuggcauccuucuugcccccuaucuucuugcccugcaucuccuugccuccuuuguuuggcuucuuuuuuggagccauggcugauggcaaccacuuuuuaaaguccccuuuaagaagccagguaguugcuaaggaaguuguuuccauacauagcaacagugaggcuggguuuuaaagggcuacuguccucuuccugacaggauccuguguccggccuaggccuagcuuuuucagagcaggauaccaggcucuugaguacaaguuuggguuccaggaagaccuuuccuucccucaaauggaaauaaauuagaaucauaaaggaccuuagccuuugggacuuugggauaaucagaaacaauugcugagcccccaggcuagugugugccucugccuagaccaaccugccaauucuuugguggcacagccacacauuuuguauuggaggcucccaugcuggggucucgggagaucuuuacuuguguguguguguguguguguguguguguguguguguguguauuuguuuuucgagacaggguuucucaguuuaacccuagcuguccuggaacuuacucuguagaccaggcuggucuugaacucagaaauucgccugucuuugccucccaagugcugggauuaaaggugugcgccaccaggcccagcuugggagaucuuuaaagcuuaguggcagggaucaaucuguccagugccaucccaaguagaugaaguucuucugaagcuuugaucuuguccccuggagucaggggucagcauacagguaugggaugggagccagugggcauccugcuggcagcugcucuagcuggcuccucgcgucuccagccucucagcacugagccaucauaccaggcacacugggcuuuuuuugguucaugauggugucugcucuuugguccccaggcuuucuuggggacggaccaucacuauacucagugaugacuggacacuuggugucacuuugaggaugucacagaagggaauaucuaucauaugcaaagcccuagaggggaugccgcucgggucugccagauucucucagccccuguaauuccgacuccaugggagccacagcuuaugguuugggauccagggcuacugggcuagcaguuucugcuuugacugugcuuuggccugcugcaguaucuuccacacugaaggugugcuacagcuuuuggaggagcggccccagguuuccucugagcucugggacacuaagagcuaaggcuuccagaggacaguaugguacagaggacaguaugguacagaggacaguaugguacagaggacaguaugguacagaggacaguaugguucuuugcuguuugguggaauuacgguggagaggaauaaagaaagccugggccaauagaugucagaaaagacgaggauagcccagcauggccaugaauaccuguagucucagcuucuuugagugggguggggggugggggcacaacacaaguucaaggucaguuugagcaacuuagcucgagucugucucaaaauaagaaaacaugggccagcaauauggcucacuggguaaaacugccuguaaugcccagaacaguggaagaagaaaaguuguucucugaccucugcaugcacaucacugcacacacacaaguacagugauaauaaaacagaacaaggaacaagugaacaaaagccuaaacagcagaaagaggcuagagguccacucccacagugcgagggagaaggaauaagugguauuuaugcugcuuucuuacucaguuuagaauucaaguccgcagcuggagagauggcuuagagguuaagagcauagcugcucuuccagagguugugaaaucgauucccagcaaccacauggagguucacaaccaucugcaguggaaucugaugccuucuucuagugauucugaggacagccauaguguacucauauacauaaaauaaauauuuuuuaaaaauagaauucaagucccuguguuggaucccauuccaggcauucugaugaccugacauuggcccaguuaucugaagucucccaggagugagcuugaccaaagccugcaucccuccgagccccagcuuccucaucuguaguggcaggggacccaccuaacaccuaucuaugagaggccuggcgugauugcuccauggcugucuucaccauagucugcuuagaaagggaaucuuggaggagcugagugggauguucuacaagccacauuugcaaccauccacauguguucaacugggauugcgaagcucacuucagcugagcuuguucacuguugaccuucccuuuuaggaagggaugggggcagucccugggcccaccugugcauccagcugccccucccaaccagcuguaugcaguucugcccuaacugcauguggcuucaggguuugggggagggggcugguauauguagguuggggaagaagaaggagggaacaccaucucuguagacaucaaaucuccagcgacacagcuuugggcuuccccaggcucccaguugucgcccucacucaagcuccgagcccaguaaacucucauugguucuccaggggaaccuuugguggaaucaaacuuugguuugucuuuaggaccuaagaaagguguguauauguuacuuuccucugcuccccaacacacuccccugggcaaaaauuuuggggacaggugcaaaaucuacaaaguaaccucgaguugauacauuccuuccugcagugaaagugucauuuucuguuacugugacaagagagcugaggcuuuacagagguuuaguugacuuaaaaaaaaauguagcugggcgugguggcacacgccuuuaaucccagcacucgggaggcagaggcaggcggauuucugaguucgaggccagccuagucuacaaagugagcuccaggacagccagggcuauacagagaaacccugucuugaaaaaacaaaaacaaacaaacaaacaaaaccccccaaaaaacaaacaaacaaaauguuguguauaucuacauguaguucccaaggacgccagaagagggagucagauucuuggaacuggaguuauaggccguugugacuucuuauccugugggcaucaaacuccaguccucagaagcgcuccuaacugcugagccaucucuccagcacuaacuagguuuuuuauguuuuacaagacaggguuucucuggcuguccuauaacucaaucuguacaccaggcuggccuugacagagacccgccuguggcagaggcauucuagacgguugaaaagaagcucuucaugucaaggcagguccuuauuuauuuuuauuuauucauucauuugagacagugucucccuauguugccuuggcuaggccuguaacuaauuauguaggccugacugguugaacucgagagaucccccugccucugccucccaaguccugggacuaaagauggaugcccaucgccgaggcagcaucuuuuuucugccugaggcuagagccaagcuuuguaccccagaugggagauagguacagaugcaaugcaagccacaacccccuggauccagaagccuccaagccccagcugugggguggcuggccuccucuauaguccucaaagucaaaccagcucugcagugggcccaggcaccaugagugagagcugacgucuuuauuagacucaaaugcugcaguacaggacgguacagagcgguacacgguugugcuuccauacuuuaaacacugagauucaagaguuucaaguuaacaaguuucaagacagacuagcuuuuuuuuaaauauccauuugagaaauuauuuauauaaauaacauaaaggaaaccccacauguucgacaaacaagauccugaagcaugagcauugcuugaccggaggaagggaugggagaagcgcuacagaagaaaucaaccggugcuagugugguucaguccuaagggaaaagguucacuggagaggagcaggggagaggccugagaacuaaggagaagagagacucuagagucagggagggagaagggcacaggacaccugcggcaggcguacaccacguuugcgaagacagcacgagacacaguaauacguacaaaucugcgggagggaggggcggggacugggcuggggacauuuuugugacuuccacugucuuuguuucacgacuacagcagcagggugagcagcaugcucagggggcugcugcguccugaggguggagaccauccuuccagcaucggcuucuggaauuucugcuuuauagcuagcuauguuuuauacagugaugacuaauacaaagaauaaaaugauccuuuucauacaaccacaaugacacaugacuguacacuacacaaacuuaagauugaugaaguaucuuaaacugaggggacucugacuaagcagcagggcccccauucuucaggccuagcuccuacagcaaagcacccuugaccagagugccaaacucacagcuuccagcccaccccugacccuuggccucuauccaaacuguguucaagcagggggcuggucagaccuaacucuggaggcuccgagggcacuaggcaggcugauuuagccugaagggcuuaacuuguuacaacaguauggacacagaucagggaaagcagugccaggcucuggagaccacacuggccggcacucagacuggcuuccuguggacacccuaagccucccccauaggugcaaagaggaggcucguuccacgccagccuccagaggugucugcucaucgcugagaacagggagcgagcaggggcuagcgagaacaucacucccucagcauguccuauccggggaacaaacaccaacaaggacagaaaugaauccaaccaagcuuggagagacacccacacaucuaccuuuccauauucaagcaaugugcacacgcgggacagggcuauauacaggucacggggucauaaauaagggagaauucacucgguccggaguucugacgcuucugcaguguggagcuugcaugugaacuuacugugggauacauacagaagaugcucauuuuuaaaaaacaacacauuacucucuugcuuuucagaggacaagauggggugucaucgcacaggagaagaacucagcacggcaacgggguggccagggcgugcagggcuggggaggcagcagaguaaccgagguggcgcacgggggagcugcagagcauuuugggaagggagccgggguuuuggggggcagcuuauuuuuuaacugcuuauuucuucaucuguuuuauucagcuucuucagcguguccagcaguuucuguggggugagaaugugcguggauccugggaaggcagagaagacagugagcucacucaccugugguggccugaggcuucuguccccgacucuccauccccccaacccuggucuggguccaguggaagcugggaaggguuuggggauggaacccuuggguccccgucaacuaggcuaaggaagcauuuaggcucacgcagggucccaggaugacccagagccaucugucaggugaugggugacugcuucauucucucuugaaguuaaggugaagccagguagagaaauuucaaauauggcaagagacaguggcugagaagggcagaggcuuggaggugucucuauguagagagaauggugccuggcagggcauggggacccacuaaccucugggagccggcauguuggugcuggcacagugggggaccucaggugugagggaaagggcggggaccugaggccuuaccuuguggagaccguauuguaagagacuuguauuguaagagauuagaaaugcuugcaaaaguuuaagcuaauggaaucagauauacuucuagagcaaagguuaaaaaaaauacaaauaaaauuuuaaaugaaggccuuuuccauagagauguaggugcacuaaaaugaugcauggaccaagugguuugggcauggacuugaucaaacagaaugaaggugacgguggugugagcaugaggcgugcaugcgcguggcagugggugcaaagcaggguccugguggaacaggagagccaaaggaaaggucuguucuugaaaaugugccuc

SEQ ID NO: 766 - RNA, 1985 nt, Mus musculus
ugagucccacaagcagcgagacugcagacugcggcgcuggcuggggccacuccucccgcgacacuccgaaacugcuccccuuucccuugggauuucuaaggguucggaccagcuaagaccccucccuuuaaguccagcccggggaaggggaggcggagagagccuugcggaagcagugccacaggaaaaccccguguccccugcccagcuggcaggaguggcccuggcggcgcgcgcccagccgcucccaggugggucucugcagccggggacagcgcccugcucccgggagagggaggcagggagggaggaggacgcaggccaggcuucguucgucacgauucacgagggagggugggaaagagggagggauuggagacagaaagaaaggggggggggagcggaauugagagcucuggauaugcagaaggcaaggaaaggagacgguaggaaaggaauacgucuggagaagaguuggggugcagaagggugaugcugcagaggaggguggugggcuggaggggauaaaggcgcgggugggggaggugaacagggagagagagagagaggagagggaugggaugaagggagagauggcgugauggaagugaauggaugaagguaaaaaggaaaacgagauguuuaugaaggcgagguaugaggaggagggaugggaugaagagagguggaggaauagagacugaggaggcgucuggggugaggaggaccgaggugaagaggggaucugggugaagcgugagucagggaagccugcuggccgcaggaagccagaggggcaucccucccgggagggcggcgccugaauaacggguuucgccggccccggggcagcacccggacgccacuuacucucuccgaccaccgccuugaggccaaugggggccauggcguucuucgagucuucgggcuccgaugcuccucccgcgacaccgucgccucccccgggccgcgcgccccgcugucugcagcccgccgccccgcagucgcgcucgggaccgacugacgcgcggacuccgcgcgggggcgcgacucgggccaaagcgaggcuguguagcggccagcgcgcgcgggaggggcggggcugcggggcggggccucgcgccagccgucaucgucacccgcgcgcugccgccaauagaagcgcggcccgggcgcgagaccccgcccuccgggaugcaggcuccgggagcgcccuccccugcgccucacgcucgcgccagggccucaggguccuaaaauccccucgccagcccugcacgggcugcccaggucaugggaaucucccuaaagccaggcugugaugcucuuccugcuuuuuugggagccuuccauuuucuccugccaaaaaaccgaacucugagagcagauucuuauuaacuguagucccauucccagccacaacauaggcuuacaguacacugacacuaucccugugucucuguggucuguuuaccauugauggagagcuaagcucuguguuacacaccuuucagguaucauuuuacuaaauucgcgcaauaaccgaacaucauuucuaaucuucauuuucagguacaaaaacacacccgaggcgcuugcuguuguaccauuuaucuaucagucacuaaugaauauuauucucccauaacuauguauaagcuauguauaugaauuacuauggauauucuguauacuggagcugcacucgugcacaagacauggaacaaauccaguaguuuccaaaguccaaaucuaauuaggaaauacuacagaaucaacucuggacucagcaucuccuuccuccugucuacauggucacauacugguuuucgagguuccaucuuugcuaaugaagaagguugcuuuggaaauacagaacaagaguaggagacguaccucagagguggagcacuugcuuguuauaugcaaggucuccacuuugaucccugaugguggaaaauaaaauaaagugcaaagaaaaaaug

SEQ ID NO: 767 - RNA, 49143 nt, Mus musculus
cuggccuggccuggcggggcggggcggggcgggcgccggggcuugggcgcgggcuagagaggcagcagcggccggagggagggacgcgguggggaucucggugggagcgcagagagagcagccgaggcggcagcggggcugcggggcgacggcggcagcggggccugcggacuccauggcgccagcggcgucagucugaguagcggcgggcggauccggccgcgucuucuccucgccaugggagacguacuguccacacaccuggaugacgcacggcgccagcacaucgcaggugagcaccgcucagcgcccggccggccuggggcuccccgggcaccccgggccacgccuccgaucucauggggagcgguacucgagagucaaggcccaggucgggacgagagccggccagacccuuacucuuccuccgaacuuguucucucucggucuggacggcccuuccaggcccuucuguaugcuccuuucacccuuugaggagccugggaucccauuucucuacuggaucccacugcuccccuuggagcccagccuggccagaaccaugcacuuacaggcguggcggaggggucgcgccccccaucuuucccaacaacguuccaagccuaaccucuacucuggacucugccccacagagucagaccuuccagacuccccccucagcugccuuguuccuccucgcccuggccucaguccggguacacguggcugaagcuuacagggggaugggcccuuagagagccggggaccgaauguggagaguggggcuaaggagagauggggugcccuugaaggggcgggucccugucuuugggcuuuaccucagcagagugcuggcacuacagccuagggggucuguuuauggccagagcugguucucucagagccagaguucagucucucaguaccucucaguaccuuccuucugccagccuugcucucagccugucacugcgcgguggacacuucucuagagggaguugcucccaagucuguggagugcaggauccugggcucauuguagggagugggagauggggugagaaucucaggcuaucccaaaacaaagcuuggcugaccacaggcaagucaggccuggcgguccugaauguaauuucagcuucucucccaagugugugauccugagccagucucuuuuguuuugguuuucccagccagggucucaccauguaguuguggcuguagaccuggcuggcuucgaauucguagagagccacuugccucugccuuccaagugcugggauuaaaggccuggggcaccacugcccugcuugagccagucacaauguccaagagcuucgguguugccuuccuaaggggcggguguugacuucuugggauggcugcugagagcuuagugagcuuugcuuaguacaggaggcccugagaccuggcgugccaaccagcuggguuuaucagagcacaggaagaggagacaguuccuuugguuucauuugucucccuguucauugaguguggugucccuacauuaucuugauguccuguugggugcuuggcuauauuuccccuugauagcagggacccuagaauaaggcagguguccccacuuccagggcuucacuguggccgggcacaaagaaggugccaaagaaggacuauccagucacuuggccaggccuggaguuggggacaggaugggugauauagaccauuucucaccucugaacagcuagggguuaaguccuggaaggccuccuuguaggacaaggccugggcucaggaagggcagggcggagucuuccugucccuucccuguugguggcaaccuccugggguucuguaacagucucuccauucagagccuccucucaggcucucagcaagcauggguggggugugcccuacuucagugguuuuuuuuuuuuuuuuuucuuuuccccacacccagaucucccaccuucccaagucuuaggcugagaacccaccccugaccuccuggccaacucccugaguggagccgaagccaggggaccgaagccaggggacgguggaguggccccuuccggagagggcugaguuuguuuuguggauacaggcuggggagaauaggguugugcccacucaaccugcuuaccuuuccuccaaacacuugaaagugcuauuaauaaucccucuucagaugcccuagaucccagggcaggcucgccagggaggcuccugaguguaagggugggugcuacaagaagguaguccaacagagagagagagagagagagagaaagagagagagagagagagagaacgaacuaauuuccuuaagaauuuguuggagggaaaugggguugugacuuugccaccuccagccacccauucaguccccucaccccacccagcagguacaugauuaagauuccagagcccucccucccuguggaagugucagcugugagaacaccccucccacagggcccuaagcucccaggccuguuagggugcuaaggcuuggcuggccaccuuccacccucccuuagcaggugagcaggugaauaccagccugcaaguccuggcaaaggucaggcgugcucuuacccagggugcagguuugcugccccggcaucuuucauccugagauuucaaagccucuggcaagcaaggacuuguuccaacccagugcuggagaugcugguagcagggugguuucugcacauuuaguacggaaggggccugagagcaauugagccugugucaccuaggggcugcuuguuuucucuagaucucaguuucccuagaucugaacagaaugggguguggcaccugguggcugaggugccuucuagcuccaagggucuaacaauuccuuacaaacuuugaccggagcaagguguuagcuggcucaccuugggccagcaucucuuuuuuagauuuauuaauuuuauaugugugaauguuuugcucccauauaugucucugcauggaauguguuccugguuagaagagggugggcaucagauccccuguggcuggaguuauaggugguggugagcugccauguggguccugggaacccacccauguccucggcaggaacaacugcuccuaacccuggagugcucucuccagccuaccccccuuuucuuuguaaguucuccaccacugaucacaucucacaucuuuucuauauuacuuauuuugggauaguuuuacuaaauuucccagguugccuugaauucaguuuguagcccaggcaggacuugaaucuaaacucuuuuuguuucucucucggacuccugacuagcugggauuacaggccugugccaccaaacccucccgcccccacaauuuacugagggcuggaucucaguuuucuuaucagugagaugggagucgcaaugguagguagguacugcugggaggaucuaguagcuuaaagcagagaagauucuguccagccuaguacuugagcagcagugcucagcaaacaucugauuauugugauugcuugugggcuucuguaauuggcuucccuaguguuggaguucaaaggguuggggcaguggcugguuuggguucuccuggguuuguccugacucuggagacgguguggcaaguucccugggugugagugggcauaaaccagaguuuucagaagcuuugauuccuuccuggcuuccuucugcuguggcgguuauuuguguguuggaugugagcugucugguguggguugaguaacugguggugacagagacaggguagaaggagcuagaagacagaccggugacugagcugugccaguccauccuuuccaugagauacgggacaggacucucauacagguucugagcacuuugaggggauuuuauaccaucgccuagaaccccaaaaucaagaugguauaggugaggggcagggccuggagccugagcugccaaugggagggcuggcauuggcugagauggaugagggaaaucaccuuucuccaggacauccccaaggggcuccacuacugugguucaccccucaguaaaggcaugugaaugcucccacagaggacagacugucccagcaccucugaucagccccacccucccuccucucucccuucuccuggcuaacuuuuuaaaagacaacagcuuuccugaggcccaguuccacaccuuguaccgcccacccacagaaaaggguuuucuguguauugccugagauguggaaccacccccgcccguacgucugaggacuuuuugagcccacuugaaacccuggaugcaucagcagccaccauaccccauccuugccaguccccucagcucuaggcaguacuggcugaacugccaaagcagugagugucaggaccccuugggaggggaagucuauagaaaccaugucuucugccuuucauucucgccagcagaaaucguuuguauggucgccucuuccaaaccaguguccacuccucucugggccuguuccuucuacugaagaugcuuuucugugcccgaggcaauauuauuuguguagagcccugguaauggcugcuugguuuuuuacuggcaucuggcuagugugugcuguguugcuuaagccucccucccuguguggauccugugcuaggagcuggcauuagaggcuucaaggaaaacgucugggggaauauacugaccuauccauacacagccuuuggaaggcggcacacauuucauaccccucgccaagaccuacuucauuauugagguuaucaccuuccugauaaccagguaugaagacgggaucguguuuauuugucaagaaaagcaaauaauacugaaaauugaucuuagccccaacacccguucaccccucccuucuaaaaguggcugcaggugcaggaguaaagggggccguuccacaggaguaaagggggguuuucugcugucacccucucuuugcuuugcugccuagggcuuugcccaggacuaggcaggcaggccggaugcuugaccaggcuugggucagccucugggggugaagcugucuagggacucugcuaucucuguguugagucuuacauaaugugcuuuuguuggcuuugacccugcccuccccuccccccaaccucuagucuucuauuggguccucucccacccuuuagccugugcucuggccuccugggggccucccaccucacccuccaggccuucccacacaggcugccaaaagagaccuuucuaaucccaaacugggccauagcccgcccucccugccuccugccgccugaggaaugaagcugaaagacaagacgggcugcucacccaccccugccugaccacgcugcccucugugggguucacccgccugccccuguuuauccucauagguugcuggcguugugauucgacgacacugggggucuugcuucuuuuucaaaaccauuugcaacaaacaucucuuccaaaggcugcauguccauccaggcgaggacacacagauacucuuaggccuccucccagaguuggucuuuggguugcuccugcugugcuggcuucuggagcacacagagucugcuaggucugagcucucccuggccgccuuugcuuuccugcugaagacgacucaucuugcagucauacccuuccccuaccccgccugcuuuuauucaucuggagggacauguccaggaagguuccccuuugggagcccaggggacccagggaccccugagcaucuguuagaugcuacccuugaagccacugccaugagcugcuaguguggacugaaaucuguggccucgggacaugugaccacacaguaacugcuccccuggcuugcugcccacagggacugguccauuuccugucugagaauggcgggugauagagaagggaggggcacuucucagacugugagugcuaaaauagguuauuuuuuuuaaaaaaauggucuccuguaaucuggcuggccucaaacucucuguguaguugaggaugauuuuagucaggaguuucacaugcucuaggccagagcucuacugacugagcuacagcccagaccaaaucuuuuuucuuuuuaaagauuuauuuuauguaugugaguauacuguugcucucuucagccacaccagaagagggcaucaugguugugagccaucaugugauugcugggaauugaacucaggaccucuggaagagcagucagugcuccuaaccgcugagccaucucuccagcccccagaccaaaucuuuuuaacugagcacauauuaacagugccaugccauccugcuuggauuaucucacagaacgaccuccagggcaggcagggagcagggagagcaaggccuuagccgcuaaguccaaacccuacugugacugcauagcuacgauggacagggggacagugugggaaaggcccuagagagacccggacaggggaugaggggcguggcgugggagugggaggaaaugaguggggacuguauggcuugugucaagagacugcacagauacaucccaccccguagucauuacucagccagaggcuuugagcaacacccuucugccgccguaccccccaccccacgccgccgccguguccccccccccccccccccccccggggcuugacucaccacucacugucgcagaagcaucauccugcgguuacagauuccugugcugccuuuuccuuccccggccccacccccacccacuucccugccuggggaagcagggcuuuucugaagccugaguggggagcaaagccucacucuugcugaguuucagggccugagucacggaggaggcuggaccugagagaaccggaagugcugcccuugcagugccuugcccaccugggaaccccgcuccuuuaggaaaugcacugacuccagccagcccaucuugagcugcccccccagccccccccccccagcaagauuuuucuuguguagcuugggcccaagucuuggcucugccucugugugaguuggguccuugggcacacuggucugucucugagcgauauggcucuuuggaaagaugaggauuguugggcuuuaagagggugguucuuuuuuccagcuuuuguggggucuggggacucgaacaccagggcaguugggaggauccgggauguagucuuuggauggugcuguguaugguaggugggugguaacaguacagugagugacagcugcuuuucuguuuguuuagagacagggucucauguaucccagguuggccuugaacacgcacuguagccaaggaugacccagggcuccugauccucuuaccuccaccaugugcuggcuuuaccugucuaugugguguggagacuggaacacauuuccuaaugggcaccaacugagcuaagcccccaucuggaaugguagcuuaaauuuuuguuuguuuuuuuucgagauggaguuuccuaguguagcccuggaaagaacuauguagaccaggcuggccuccaacucagagauccaccugccucugccuccugagugcugggaucaaggugugcaccaucacacccagcuuuuauguauuuauuuuuuuuuaaauugacuguguaugugugauggauaugugugggcacgcgugugccauggugcgcaucuggagacuggagggcagcuuuaagggggugguucucuuuuuccagcuuuuguggggucuggggacuugaacacuuugccaugcuuacaugacaggggccuuuaaaacgucugggcuuguccaucccaagcgacaguuuuuugguuguuucugcacugagcuuguuugacaucucuggagacauggcugauuugucuguccccucaugaauggccagcuuuguauuccaggaagcaugcgugucccagccugaguuacagcaccagccuuugguucgggcgggaugccuaaguauucggccuguaugugaagagcugugagauaggaugggguucccagcauugaccacucagugucugccgugaggcgggacacagaggauaaaaccaccgugugucuggaguuagauuuauaaaucugaaccugguccuguugacucuuugcugugugauccugaacaguggcugugccucucugauuguucucauuugugacuucaagaucaaaaucuucuuuagggaagucuuugccuuugaaaacccuuucucgggaccucaaggugcccuuugagggcaggaccacauagcuuacucuauggaaauaggggugcaugucucugagaccuucuaaaggugaugugcgcuggcccuagacacgccuggucauucuuuccuuuguucagugguuauggaauuucaucugagcuucauggugcaugccuguaaccccagcucucaggaggcuggagaaggagggucaggaguucaaagucauccuaggcuccauaaccaguuggaugccagccuggguuacauaagacccugucucaaagcaacagcaaagcaguaguuaggacccaugagugguccagcaggugccacacccaccgugcaagccuagcuccugaguucacuccuagaaccuacgguagaguaaaugacugaggagcugucuuccagaguugugcccugcuacucuuuagggucucaccccaaauacucacauacaauuaaaaaaaaaaaguucugguguuucaaaccagcgguagagugcuugcuuuaaauaggaagcaaggcacaguuacaaagcccuuccugugcugggaccggcuagccauaauucucaguggucgcugauugccuggagcuuccuggcuggcuaaguucucacaggggaggguuggggaguggggggugggaggcgccauaagcguuggccuugaaggggaggagccuuguccugagagaccuggggaagucuuggguccuuuccugguggaagugaacauccaggcgugguggugggcugagcauagauggggaagguggcuagagguggaguguugucagagaggcaugucccuguggggggccguggccaaggucucagugacagagccaggagcuuccugguaugcaccaguuuggacccugcuggguugaagaaaccucugcagggcugacauccugcagauuguuggauggaggaugaccuccccguggcucuuagccucugcuucuauccuucugaugucaggaggcucgcucuguuccccagcagcucugagucugagaagugggcaucagagugccuacccaggccugcuggguccccaugugggggcagggaagcuguggaggcuuuccuggggucucagcuacagcugccauauagagacuuuggcucaggaagucucuccucucaagaggaagugcggggcagggggcccgugagaugguucggcagguaagggagccugucaccaagccuggugacuugacuuugaucccugcaacccacacacuggaaaggaaagaaccucugauguguguauguguguguguguguguccccuccccagacacacaaaauaaauaaaauaugaaaagaaacaaaguagcuggguggugggugcacaccuuuaaccccagcacucaggaggcagaggcagguggaucuuugagcuagaggccaaccuggucuagagugaguuccaggauaguugggggguacacagagaaauucuggagagagaggggggagagagagagagaauaugagaauaagaaaguucaugggauggagagauggcucaguguauagagcacugacugcucuuccagagguccugaguucaauucccagcaaccacauggugacucacaaccaucuguaaugggaucugaugcccucuucuggggugucugaagacagugauaguguacucacauacuugaaauaaauaaauaaaucuuaaaaaaaaaaaaaaaagaguucggaucaggauuucugugaggauggggguggguggggacucuaguagguaccugcacauccaggagggagaagaauaaacuaugguuguacagugcgaaccccacuuucccuuucccuguaggguacaggccaggaggcaagccacacagucugagugccaaggaacaugugucagcucuuuccucuuguuugugucccuuccucugccuaccugcgcaguggucacuaggcccguguugacagcucagccgugugaaagcgcagaauagcugcaguggauguuaacugcacagagaccuugccgagggacauagaacucguucagaaagcugucauaggcccaguguaaaccaugugcuggguacgaggcuguaacauaggcuuaauuuugugggacucuugugcaggccaaggagguuccaacaagaacugugguuugugugacaggcaaugcauguuuaugccuuucuaaguccauggcugugaacacaccgucagcccuguccagggggcucugugucugccuguggugaugggacaaagcuguguggcuuuggucauggcacucuccuuggagcuucaggugacaguaaggugggaacacuggccccauuucuugccucugggguacccauagagugcuuggcuuaugccauguacaugcgauaacucuaaccagauggcucugaacuuccgaauuuuuuuuuuuaguuucuuuuuuucuuucuuucuuuuuuuuuuuaaagauuuauuuauuuuauguaugugaguauacuguagcuauacagaugguugugcgccuucaugugguuccuucaugugguuguugggaauugaauuuuuaggaccucugcucgcucaagaccaagcugguaaagucagcuacuuacuccggcccaaagauuucuuuauuauuauacauaaguacacuguagcugucuucagacgcaccagaagacggugucagaucucauugcgggugguugugagccaccaugugguugcugggauuugaacucaggaccuuuggaagaacagucagugcucuuaccugcugagccaucucuccagcccugagcuucugauucuuuauuuuaccuccccaugcugggaauacaggcaugggcucacaucccauuuccuauggugcuggggacagcgcucagcacccugugcgcgcucugcaagcaucccaccaagugaggcacuaucccuuagcauugagguuuauuuugagaccgaaugucaccaugcuaucuaggcuggccuugaacuugaagcauucuuccugccucucagccugccucaacuuuccaaauccugaaauuuacaguguucuauguagcugagcuuguuguggaacucacuagguagaucaggcuauccuugaaaucauagagaccuuccugccuuugccuccugagugcugggauuaaagguagaaccaccaugcccaucucaaucucucucucucucucucucucucucucucucucuguguguguguguguguguucuuuggaaugaauggaguguggggugagcuuaagcuuugggcauccauguccuacuggacucaggaaaguuugcucauaguugacaggcaccugaagucccugauuugaucuugaagcuucugguggguauuggaugauuuuuuuucucucccucuagcuuggacucuucuggauucucagaugggaaaacugaaaugaucuaaauguuaggaggcuaguagggucacaaggucaaggccagccuggaguacauaggagacccugccucagaaagaaaggaagaaagaaagaaggaaggaaggaaggaaggaaggaaggaaggagagaaagaaagaaagaaagaaagaaagaaagaaagaaagaaagaaaggaagaaagaaaggaaggaaggaagaaaagagggggaggaggaaggagguaggaaagaagaaagaagaacaaaaggaaauauuuaacagucuuauccuuuauuucuucacugagaaaacugagacucugagagggaacagaggagcccacaaucucagaggcccagggcgccugacugcccuccaugcuguggcccagcccagaagcagccaggaagggugacugggcucggccaggcugcagagguuauaauuuugaaaauugaguaaauaaacaaguucucagcaagcaaggcaggcucugugcggcaucacagacgggccugugucugaggacagccccagcuuguccacucagacagaaaacugcaucugguuaaaaauagccaacgugccacucuccucccaccccacccccacccguauuuaaggcugccaggaaaaggggagggggacagauugcccuuccuuauguggaguuggucucagcucucugggaacgaccacgggacagcucuccaggcuaugcucaggacggucacugugugacuuuggucaggucuccucgaguuucugggccucaguuuccuccuucuuuaaaguaguggugaucccauuucagggugacaagaugagaagguggugugggucaaguguguacacacagcaggcccuuugugucucucugaccggacuggagccucaaaggcugcucuuuuacucuugggcugaggugggggcuccugcaucaagcagagggguuauuuucuuacugauccagggcuccccuagugcuaggaggccaagccuccuuccaggcagagcuguugcaggcagcacugcuuggcuuuccuguuuuccuguggagaguguaguggaauccaagacuagcuacuugggguccugcccugcuggcccgggccccuccacccacauggggcccagcagacuuccuguacaauuaggggcugccaccgccuccccacccccugcccuggucacauggagagcuuuuaagaggcuagcucuguguaucaagaggccaaucagcaauagauggacugagagcuguguggugccuuggacuacaccugccucuagucugagcccuuuccccauaauacaauguacuaccuucucuagacccuucuaggcgcuucuguaccuuggagucauguuauagauacuaaaagacacuacaggacucucagccucauucugugguccccaguggggcccuuggccacccggguggcccuccuuacuaacauuuguagcaucugaggguuggcuccucugggcuccuccugggcuucccuggguggacaguggcuuuggugaugacagccugcuuuuccagcuacuggccaagcaccuuuaggucaguuaagugucuccuuugaaaagggugucacugauccuuaaugguugcaaagguuaugacuuugugugugucugggagucaucacucccgugaugauggcaccgugguacuuacuacguagguaggugggaauaaaaagaagccacauggggccggagagauguuucagcgguuaagugugcuuguugcucuugcaaaggguccaggucccaguguggucacucacagucaucccuaacaccagauaggagggagccgaagcucucuccugacuucuacaguugugcagcuguuguacccauguacacgcaggccaaacaugauucagacaaaauauaaacuuauaaguagaugauagagagacagauggagagauugggggggcaccacuuuccaaccuggaugcauaagaaccuuggaacccucugccugagggcuugggguuugugguccacagggguggaugguuggaggguaugggcuuggcugcuuucagguguaggggagcccgggcuuucucucuguuccucuuggaaggagcacucuggccuauuguguuugcggccacaggcacaaggugcgugcauccacacgggguuuccuuccucugccucauucuccauaaugugacucacugccuuucagaucuuuguucucguucuggaggguaaggccagggauuuggacagccuggcccuccuccugggcuccugacuccugucucuggacuuggcugaacucuuaggguggcaggcaggggucucugccccauuugagaccccuguguacuugacacugaguugguggcugccaagcccagagcccuagguucugccugugcaaagacguguccaguugacugcugugaaguugccaccuuuccuugagagcuugcuuuuguccugugggauaauuauugucguuugcucuccugucacagauggaacagcuuccugauggccuaggguccccugaguggguucaaggccaaggcaagcacuuuuacccucuuagugacuuuauuccuuguuaccugucuuagagagguguaguaacggggggggggggucgucagguugcuggcuucacacagugcugagguuggggagcuaggaguuugugucccucagcagaaagauaagugcugaaguugcuguggcugaagccuugagaacuucuaaaggccaggcaggaagugguaaccugaagagauugguggucugugcacccacaaggcuuagaggaaagagacuaagcccuggguaaaccuauguagccaccccacaaggagauuuaaccguagccuaguauguagccaaaugguauggcaggauacugccuaaacagggaaguaaaacaguguaucagaagguaucauccagcagugaaaauuguagcagcaagggaaagaauaauccccuacccccaacccccaaacagggcuucucuguguaguccugccuggccuagaacucagaucuguagaucaggcuggccuuaaacucagagaucugccugccucugccucccaaguuccagaauuaaagacaugaaccuucaccccugccugccgcccccugcgucccuuccugcucuuacccggucgauagaaaucugagcucagaucaucuugcuugcacggcaagcauuucaccuguugauccaucucuccauuccuuuccugauuuuuuucccccuaaagcaguacacauaucacauuuuaaaaaaagaauagugugacccuguugguuauauuucuuggagaacaauuccaaguuucucucugacuccaauaucagagucauccuagucugacaagagccaaaggaaaguugcaagugcagggcagggucuagagaggaggaggaggagggaggaagaggcugggguucucugucuguaaggugggcauggugguuaacuacuccuuguaguuccaugagcugcaugaaggaugcugugcuuggcacacaaugaccacucuggaaaaugagcugaguucccuggccuccauugucugagccccugaggcuuuggcggaggggccucugagauaagaccugaaggguggaggagggaagacguccuaaguacugguaaaggaaaaccuuccaauagguugugcguucuugcugaccgcagccacagcagcagcucuguguacaggacacuugauaguuguuuugcuaagugccaucacgugucccugggaagggcuaggcagguggacugccgugccuguccaggugagugacugcguaccccagccuuucaguauuggggagacacugcuugcagagcuggccugcugccguuccccaggcucuucagguucaggagcccuugacagugacggaucaggaagaggaaacagaucugggcuuaggugacagcuuuaguuggcaugcaggguggugaccuuuucuaccauugaugugugaccuagggcuggccuggcucuaugcaggcagggcccuaccuuuuaggcaguucugggacuguccggcccucaguuaaucuagccccaggggcugggcaggggcugagccacaacuagaguucagcuuucugggaaaacccaauugucuuucuguaucuuaggguuucugggagagggaguuguggagcucugaugugaccucacguagucagaggacugauaagugugucuuugaggcggcuuaacaguuaaagguguuugcucugcaagcuuggugaccugaguuugauccccgaagcccacauaaacauggaaagagagccaaacaugguggcacaccuuuaaucccagcacucuggaggcaaaagccagccuggucuacagagugaguuccaggacagccaaggcuauacagagaaacccuguugggagagccuggacacuaccaaagaacugaagacaauaagugucccuucccgugacaguggcaggcccaagggaucgcaaguuccaucauccaccuagggugcagaaagggcccugucuuuaacgguuaccaucccauuauccaggacagaagucugaccucaaucaugaauacaacuuggcuuauuuuauuaauucacuuuguuuugaggcagggucuuacuguguggcucuggauagccucaaacuugugauccuccugccucagccuccugaguaacugguacuacagcuucaagccaccauacauagccuuuucucuacaggaaugucuuugugcuugaacccacagcuugggacugaguuucugucagcgcagcugcaagcacgugaguugugaguugcgugaguuucgcuggcucaucuuccugucucauugucuaugucuuccucccugacuuggaguaagccgccuccuccuccucucgugcucacgcuguccgcucucaggaucuugggaucuaucugaaaacuguagauaagagucuguguguuagauaagugcaugcgugcgugaguccaugagugagugugugugcgugcuugugugugugaugggugggugugcagggaggcgccugacauuuccaggcagcuugggaagaaacuaggcguggacuuagagaaggacagugguguuacaggcaucggcagauacaugguagugguguguggucccuucagucguuuccuguuggggcugaaguaacuggaauuuucuauuuauugguuccuaucggagcagcauuggcauuuacgggcucucccugucagacagacagggagggugccaagugcuccuggcacaucuuacuggguccuugcaacuuuuauuguuguugagacaggguuuuugugauguagcccaggcugaccuuggauuccuaauuuuccagccccaaucuuucuggugcugagauuauaaucuuaccagugaugcaccuggcuuaggugggucauuuaaaaaaauuauuaaaagaaauuuuuuuugagacaaguuuuucuguuauguaacucuggcuggccuauauaacucacuagguagaucaggcuggucucgaacucacagagauccaccugccucugccuccccaguccugggauuaagguaugcaccaccacacuugucuggaagauucuuuucucuuuuuuuuaagaaguguuuauuuuaugugcgaguguuuugccucuacuucuaugugcacugcaucugugcuugaugucugaggagaucugaaggacguuuaugggaccuccuggaacugugguugcagauagaugugagccaugguaagggugcugggaaucgaacccagguccucugcaagagcaacaagggcucugaacuguugagcccucucuccugccccuaacuuacauuuuuuugggagggaacuuuuuugagacaaggucugccuacauagcccuggcaguccuguagaccagucuggucucaaauucacagagcuccaccuauuucuggcuccagagugccauuaacccaggcugucuggaccauuuuuaaugaucauuuuauggaaagaaacugagacucagaaggcuacagccagugguggagcugaacauguguggucccaaagucugaacuguuccugcuuaccccucuggggcacaguccucuucagccucugcuugcacgucucuggcgucugggaccuuccucucugcaggucaccugcccuguucugggccucagaugcagguagagcccuugcugaggccaugggugcugucuauguucacauguaaucuagcuugcguuuggucaggccagacuuuauccagggaauuuuccagacucugugauugcucauggcacggcgccacccaagcacgauccuuucucccaugccuggagcucacccacuaggagaacacuggugggaaggggcuuagacacagaaagacagacagacaagaaacuagccuggggcacaagugacagaugaucaaggucuugaggaucuuggauucccagcuggugcugucucuggggaugaugacccagccucucuggugacaugcugugucugggauggggugugugugagguggcacccccauccacaguacugugggacgagggcugugguugggugaggucugcuggcuguuuuucuguuggguccacuuccccuuucugauuaauuaaccuuugaaugacaagggccuaggaaaaguagaucauaaauauguuguuucuuuccuacuucucgaccucccaucuccuccacccugagauaagacagaugccacuagagauccaccugccucugccuuccaagugcugggauuaaggacgugugcuguggugaccagcauguuuuccaucucucuuuuucguguuuuuuuuuuuuuuuuuuugagacaggguuucucuuuguaacccugacuguccuauaacuugcuuuguacaccagacuggccuugaacucagagguuugccugccucugccucucaaguucugggaucaaaggcgugcaccaccucucccggcuauguuuccuguuucuugauugcucugcagaaggacuggguagccccugcuaaccgacaggugcccuacccuagccacuagugcugggcggaugacacaacuccuuucaacacuucaagcgcugccauuggcagcgccaacuccuguuugucagacucuguggaguuacucauuucaucucauccuucugacaccuggcgaggcggggcugcuucuucagguguacagcagggaaauggagguucagacagacggaagccaugugcucucuccuggagccugugagaggugggcuuaucugaaaaugccaucucagucuggagcuugcugucccacggaaaggccuuggucuaccgaggggugggauaaacagauucuugguucuugugugucugaagacuuacccauuguggggucgcuuuuacaagcuuugugucagagggugacucaugggaguuaauucuccuucuauccugugggguccucacugaacugagguccuaagccuuuaccugcugagccagacaucauuuuguuguuguuguuguuguuuuguuuaaaauuuauugauauuuauuuuauguauggauaccacaugcaugccugaugccuguagaguccagaagagggugucugagcuccuggaauuagaguucuggccacuugugugcaccauugugguuucugggaacagaacccagguccucugcaaaaccagcacaugcccuuaaccguugggccagcucuccagcaccauuaugguuucucauugacagucagucuucuucauuagauuccuagggcccagcccuggagacucagagagcuuggagggugggcaugaugcuaguccuguggcgggccggggggcgggguggggugggggggguaggcuguccugcuguggguggaugcugcugcuggaggccugggccuccuuuuucugucugcucccccaaacgcaggggcguccucauccugcccuccuagaacaggcugccagcuggaggcugcgggcacagagcugaugccaggcaagugggcggggcuggggcgggaugagaaggccuuuguuucuccuguuuguguccagaugggaacugaguuucccaacagaaguggaggaugugaagagaagucccaggugcuccccugccccacccccagacauuuccccagucuccacccuggcugcccucuccaccccuuaggcccucccggcucagcuguuagccuucaugagaccuguuguugcugaguucugguuaaauauuugcuaacugagaaguuugcaaggcggcuuugugcgaaguccugggugacuacucccaaaucugucuuuggauaaggagacccagcccuccugggccuucagaguccuuugcagguggccuucuuggcaucuggaacuagauaaccucucccccugggggccauuguuuacacgccuguuuaauggaucagggagagaaggcaaggcuaggcuuggauccuggggagccaguguggagaaaaccuggagaccugcuuccuagucuccgggccucaguccccaucuauccacggucagcucuccuggguccaggagggaccuucccaaagugccaauggccuguuaacaaggggauguggcagcucaggauucaguugguacagcccacuagauaccuuaaccacuaaaauaggaccccucucucucagaguucuucauucccguuugggguagcagggggcugugaugucaugccugguuugcucucuuauguaaugcugggcaagucacugaauaucucugagcuguggaucccucauccagagaauggguuugucgguuuguccugguggggguuaaauaaagucaucgugacuauucucugauucucagcuaaagugcuucagaaaaccgccucagugcuggcucugggcaacuguggcaugcauuagcucaugcugugaugauuauaauuagaugcaaauggagaaccagagagccuugugguggggagcagggcaaggcaggcugacuaagauucuaagccugggaguugagaaaggguguucugccaaagggugcuucauaggagagagugcagaguggggguacacuugguaucagucggacccagccagggcaggggcugggaagggcaaggggacugagaaccucagccuuggauuccauucauugcuauccgcucgugaacugcagcaugucaggacgugggguaggagcugugucauugcagauggggaaucuacgcucuccuggggcuguugaaggccaacucauccuuaacaaagcaagucaccugaucuucuggacauuuccacaguccuuagaguccagggccuguuggccuggcggacaagucucugaucucccagcuucugucucuccaguggcggcaaugcuucuagaagcuucugggcucugcuaggucaggacuugcucugcucuucugugaccuacaugagaaaugcuagguccccagccauccuggugccucuccaccugugucuaaauaaaaaaaaaaaaagguuugccauuuguaguucugggaauugaacccaguccucgugcacaauaggaauaugcucaccacuagccacuauacugugucccuagccuugugcucuauacaucucucacagucuguccucagugagacaguggucuguccucagugagauggcagagucucuauccaaacauccuugucauuuacgcgugaaccguagucuuggcacacuugguguccccagcccacagcaagcacauucacaggcacaccuuggagcuguguucagaggaaggggguuuucuuuguuaauuccugaucuucaggaaagaggguuaacccagcaggucucuucaggacaccugcggugagaagggagagaaagcucgugugacauccacuuucccaacaaagaagaucuguguuggauguuucuucauccucgggagccuccgaggucccagcuucuaugcuggccuuucagugugaggagucuagggugggcguggagcuugugagagaguucucacacgguguagauaaguggggagcacccacccagccuggggauuuccaaaggaagagaaugggggaugggaugggguggggcugaaggaucagcuucgguacugugguuauaauaggagccauaccuuuaccccaagggcagaaggagccuuaggacguuugugagcaguggaggaccaggcagcucccuccuucuccugguaugggaagggccagagggagucaggaguaaguuggaggcugaggcagguagugacccggcugggggcaauggcagguggugcaggcugagcugaggugagcuggccuaagucagcucacaguucugauggugggcccagaagcuggggcccacugccgaggacaccccuccuucuggaucaauucaccaaggggucugcaucagccucugcucucuggagcagcucccuucuggaccagggugacugucacacuuucucuuccugacucuggcucuacauggucccugcccgcuggucccagcucuucucuugggccgguuaugccccucccccaugcuggaugaugaagccugucauuacuccuccuccccccaacuuguaccugauuacaggucccaggcaggagcccugcaucagcccuccugauaggggccacccacaggcugcugcauccuccucagagggacauccucuccagaggcugacagugacagucuuggugguggguguggaaugucuuuccccaauuuuguuucccuguuaagacucaaacugucccaagucugugucguguguguguguguguguguguguguguguguguguguguguguguauggcucaguuggcagugcucuccuugcaugcgggaggucccgaguuugauccucaaugcuauaagaaaaaaaaaugcucauacuuugagaugggugugguagcucauguuuuuaauccuagaauuugggagguggaggcagagggcucaggaauucagacucauucuugguuacauaacaagcuugaaaccagccugggcuacaugagacuguagcauuuuccugggugccgaggagaccuaggugguccaggagagagacuuuaggugagacacugagacccuauagacuccuguccuuaucuguugggcugugcugugugacucuagcaguaugugacuaccucucugguccucaguuuuccuggcugugccagucagaugguguaguuacugguauuugacuucaugauauggggaaccccaucuccaccuaccucaguccuuaguuucuggggugggugggucaucauccugguuacccccccccccaucucccuaucuggaguccuccccagugcuccaagaaccaggcaggccaguucugagucugccccacccgacaggugcugucaccugcuagguuucaguccccaugaaacccugaaacugggcugggccugguagugaggcuuguuccacgagcccacuggagggaccggccagaccaggaugaguuuggcucagugcccacaucugaguccaaaucagggcagggcuugcgugaagucccugcgguccacaugaagucggcuacccuccugguuggagguugucuucuuuguccuaaugccaucguuguggaaggggacucaggcacagguuccugggucucggaccugggcuaagcuccugcuuucuguacucguuggugaggggcugaguucuuugcacugagucuccuuaagugaaacgucugacuuuagagucagugcacccguggauagagaucaugucagguuucugcaccggugcaggaugcccggggcucaccaaguagaaacugcuuagaccagcauccaagcauuuaggguaaugguccucagccuaugggucucuaccccuuugguagccaaaugacucugucaugggggucgcauaucagauauccugaauaucaggcauuuguguuacgauucaguagcaaauuuauaguuaugaaguagcaaugaaaauaauguuauggccgggggucaccaccacgugagaaacuguauuaaagggucacagcguuaggaagguggagaaccacuggguuaggggcucuuccugcagcaugucccccaaaggaucccgcucugcuuuccccauauacagcuuaacuugcaggaugggccugguaccccucucccagauccccaaggcuucagggaacuucaggacacccaaggacccuuguucuucauggcuucugcuaucuacacaggaaccagugugauccccagaacugucacuuuggaaaaucagagaucagcacucuuccggccacugagccguuguuaguauuggucaugugcacuguccuugugagggccccgugcucucugcucauugguccucugauuuccuccccgccuagucacugaugugccaucuugcagagaugaaaacagagagggaaagugccuuggccggggccucauagcccuguggguggaacugggacuugaacccagagcuuguccuugcaagcccauguggcaguggagcccuugcugugggguguauccuguccaccucucagucccucuguccagccugagguggcuguggucagccccuggucugcuugacuuaccaguccauuaguggaggagcugaggccaguaucuugguuugcucccaaagcaagggcugagauuuucauuaaggccuuagggcaucuaagaccuaccugcccauuuuagcccagggaggaucaacaagggaggggaucuccaauaggcaggaaggugcccugccagccuugacuacaugggagcagguagggggcuaggccaaaggcuacccuuucugaucugacauccacagaugcaugaccuuggggaaaucucuuggcuuuucugagccugguguccucaucuguaaaaaugcaccagcccccuuuacuccccccugggccugggcagggaccuagcaaguaaggcuggagccccacaaagccaccaugucucgugugaaaugccccuggagaugggagacucuggacaggcuuucggggaaguaagauuuuaaagcugacuuccugcuggccuggaauguggcucacuggugcugugcccaccuggugugcaugaagccauaguccaguccccagcaacggaaaaaacaaaacaacaaaaucccacuucuaaccugguaugguggcacagcuugguaacaccaguacuugggagguaggagaauuaucucaagucggaggucagccugggcuccauaguaaguucuaggcuaaccugggcuacauggugaaacucucuucacucaaagaaacaacucuaauucuuccucccaaaauaccucuucccuuuccucccaggcugugugccucagaaccacgugggcugagaacccugugugggcacacacacggaacucugggaauucuggauuccauagcaggauugacgggugaggugucucucugggucgcccuugaccaugaccaagggguagcccuugaugguuccagcugugucaagacucauguggcucuguagucaacuggcucaacugcaagacuggggucuucaaaacuuguccguaugcacacacugagugagagagagagagagagagagagagagagaacacuuuauuuguucuggaccacuguccagggaaauggccuuuccagagcuugguggaguacccucccuucuuagacauggucuagagaccaaugccugcagcccuggugcccugaggcuaccugacaugguucuguauucuccagcugcccucagggugacagagaaccaggcaggaacccugggacuauccacauggggcccaauuugguuuuggcugccucccagaggaguaaucuucccugagccuccccuuguaaccuggauagugggaauuuguauguaacacauuccccuggggccagccgaaaaucugugugcuggaggcagagacagguagcccagcaucugugugaggugaggccacaucugagggauagugcuggcagaggggagcagagaugggacacccagcccagguugggguggucaggggaaccugagagugcacacuggggacacacacccacacggcccuacuuucuuaacuccuauuuuaucaggucuuuggguuccuuccuuccuuccuuccuuccuuccuuccuuccuuccuuccuuccuuccuuccuuccuuucuuucuuucuuucuuucuuucuuucuuucuuucuuucuuucucuuuuucuuucuuuuauccuuuauuggauuuuuuucaagcuauaaaaguuauuccugguaauaaauaguucagcccaccguuugcccucuaguuguaagcugagcacuguuauaauuaagacuaguguuuuuggugcccugugcuguuaugacccugcccauguccugccggaucuggcccugugaugcuugguuucuaaaugaagaaccugagggucugagagagcuuggcagcccacgccucacucucacccggccgcuggcagcuggaaggugggcccaucaguuuucagguccccacggcucugugagcaacagugucuggggcugagucagugcacgaggguggaugaaaauaugcaaccuggugggugaggccaacccgcacccauagacggccccacccaggcaucuggagcauuguacuagccucagguucuagaccaggguccgugagguuggcucucucucaucaggcagggccacagccugccucuccacugcccucugagguucugugggcagugaucagagcccacucagguccuaagugcucccgucuucuguggucuagugagucugucacccuuucugguucaggguuaucuucaagguggugaguuggccuggaaaauccuacuuagugucugccccaaaccugugcacuggggugucuccagaggccuggaggagauaugaagcugaugugggcagguguggagagaggucugcucugggcucuaggugccaccugcagguacucaggcuggaugcugagucauggaauccugacuggagcuagcugugugaaacagggagacaaaagcaggaguaugugaucucaauacucaggagggugaaacagauugcuaugaauuucaggccauccugggcuacauagugaguuucaggcuagccugggcuacauagugaguuucaggccauccugggcuacauagugaguuucaggccagccugggccacauagugacuuuccauccuggacuacauagugaguuucaggccagccugggcuacauagugaguuucaggccauccugggcuacauagugaguuucaggccagccugggccacauagugacuuuccauccuggacuacauagugaguuucaggccagccugggcuacauagugaguuucaggccagccugggcuacauagugaguuucaggccauccugagcuacauagugaguuucaggccagccuggaauauacaguuagacacuaucucugaaggguugcuaaguagcauuuacgggguuggcacuaugaagagccccuaaggaaaggggacagccugggcuuggguuccagagcccaguagacagggaggugaggaaucuucuaggcccauggcaccuacucacaccuucuccuaugugcccaugagaggcuuaagucuagguuagagccccauggaguguugcugacccuugggguccucuuugccucccaaaucccaaaucuucauccuuuguguuuuaggggcgcuuccuuaguuccaaucacaugcuaguucuuuuccagcugaccggcacaucuccagagugugccuguggccuucccugccaaggcucuugcgugacucuguucaccacugucauccucuacccauuuuuccugggguggugccaacucacagauuaucacgcuuccugccacuugcuugacacugcccuuggguucuguuguugucccccacacagacauucuuaucuuugcuccauaacuguugggccauugguguacccccuagaucccuacccugggguuagcagcaugucagcaguagcccugggggugcaggucccauggucaucucccacccucccccuuucccugccuuacuauccccagaacaaccccgugcucucugagggacugguuguuucucagucuuuucacaaacaggcgcugcaaaugcauccuuccaacccccagaucagaaucuagccagacacgaccucauuccagagaagccugcauggcaggcuggcuuuguggaguggugggugagcuacccccagagugcacgccccucucuccugucacugagguaggcuuaggggugcagacuggagacugagcgugguaaugucagggugagcccuggguucucccuggccaccaguuccuggcugggucccaggguuacaccccaguuccaucacccacuuucugugugacuuuguaccaaugacagaacuucugugggucucaguucccuucucuauaaaguggccaugacacgggcccugccacacaagcccacugagcgucuucucauugucuuaggccacugacucuggaaccugcagaugaccggggguccagaugaaggaccaggucuuuagauagaacuuguaauccaagauugucagcgaaggcaggguggucuguccuugcauuuagccuucucaguggguggggaaacugaggcaggaguggagcuucauaacccccagggugagauccauuuuuuuuaaagauuuauuuauuuuauguacaugaguacacuguugcugucuucagacacaccagaagagggcaucggauccccauuacagaugguugugagccaccaugugguuguuaggaauugaacucagguccucgggaagagcagucagugcucuuaaccgcugagccaccucuccagccuccagcuugagguucuaauggagcuuuuuaggaucaggaggcuccucuucugagcccucuuguugucucaguuuccccaucuguaaacagggacgcgcaggcaggaucaaacugagccugcugccugcugggcccuguucuggaggccacagacccacccuucucuguugugaaaccagauaagcaaacagcuaggagaagcaagcuguuggguugcuggacuggggccguagcgcauuguggaauguguagugaacauggacaggucucuggguuugacccugacucaugagcagggcuugguggcacauaccugaggaucaggaguucaaagccaucuuuugcuuuguugagaguuagaggccaaccuggcuucaugagaucuugucucgaacgaaggagaaaaagagguuaauuugguagauaaauucgagauguguguuugaaucacgagugaaugacuucaguguuugaaagugaggagguuucuguaccccaagcccuccaccccaaggccugagccugcugccuguccgucgucuuuccuuuucacagauaggaguccuuguucagcccaugagacuguuaccuuccaucugucacagguuugccaguugcucccaccacggccuggcauuuuucuguccugggagaauugguuugugcugguuaguccugcacugcaugguuagcuggugcuugcucaccugcaggguauccuaggugugagcacgcagccacaccuuuaggggcccuggccccacucaccacaccccagucuacccaggggaaaaagcagucucgcccacuuggugcugguuuggucacuggugaggcuaacucucucauaggccugaugggugugguuuucugugacggccacucaccagcuuccugucaggaauggguaccuaccucauacaggcagcucaugaccaaagcccucgucuggagugcgagagaauaaggugaccagccccgguuugugugaaaggauauuugugcuuuguguggacgguuuuucaggcgggacuugcaggccugauuccccagguuucuguggcaaccucacacucucaugcauccuucccuugcagagaaaaccgagaagauccucacagaguuccuucgcuucuaugaggaccaguauggugucucccucuucaauagcaugcgccaugagaucgagggcaccgggccaccgcaggcacagcugcucuggcgcaaggugagaggcauagagaggguccagccugggcucuguaccccuucugcuaugggccuuugucuucucugggccuuaguuucccuaugcugcugguuuggucucuaagggccuucauagguugaggauaaccaccccacacuugcuucuuagucuccacuaccagugccaccccuaccccacugccaguguuaccuacccucacugccagugcuacccccccacugccagugucaccccucucccacugccagugccacccacccccacugccagugucaccccucucccacugccagugccaccucuaccccacugccagugccaccccucccucacuaccagugucaccccucccucacugccagugccacccacccccacugccagugcaaccucucccccaaucccagugcaaccccucccccaaugccagugcaaccucuucauugucacagcuacauucugcagucuugacagcucaggccacacaccugucaagagagaugugacaaaacccuuguccugcuuccuccccuccaggguggaaguggcauggucccugccucacagagccaucgacacugucccaggccacgugcucuagguucccuccucgcaggacuaugagagcagaugcucuccccaaccucaucauuaauauaauaauaauuauccuguuauuagcauuaggccuggguuugcugagaacgcugccuggaucuacccuggggugucaguguggccuggaguggggauccuugugacaggccuggaggugacagggcuagggugaggucaggaaggaaacaguggguuuggcugcugaguuacccaacuuaaggcagaggguagguaaguggcuggaauucuacccuggaggcucugcagggaaguuuugcugcucacugugcuggcggcagggucaggugcuaaggcugcguggucuuuauagcucuacaaaccgcucaaggugacagccagcgauggcuguuuacaggauaagauaggagcugggaagaugacuggcugauccagacaccagagucucaacuggucuggagaaggcugcuucagcaaggcccugggggguggggagggguugccugugagacgggauugacagacagagggaagggacugacagacagaaggagucuuuauguacaaaaaguuccaaacuuagcccagugacucugggggcagacagagcuggcuuagauuccuagccuacgauccuuucucccccaucucagccugcccugggaggagagaaaggcugggcuguuugucuccgcuccgggugucaugacugacuguagagaagggguguuuggauauggccgcucucaggccuggcagguguccuccugcaccuguaauucagcccagaugagcagggccucggcuacuucuccuaucuagaaugaaggucacaggcaaauccaguguggugacacagaguaagcacuaggccaaggagggcuauauccuaaaacccuguuuuaaaacaagaacaaagccaaacaaaaacaaacagugcaggcagcccgguucccaagagcccagggcgagugggagcuggugcuguguuaagcauuuucuguguuuggcuugucaugcucacagggcugugugcucaucccgccaaacaggcuauguaggcagaucaguggccugaaggugcucauggucccugagauccuuggugucucaugagccugaccaccacgugaagucaugacaccgauagaagggaaaucacauuagucaccagaacgaucacagucauuuucuaaagaaacaauuauugccguaauaagagcaagugggucugggugagguggcuggccugugaucccagcacucaggaggccgaggccagaacagcccaaguucaaggccagucugcuguaaacucaccucacaccccagcaagcaaagcaaucaauaguuguuuugugaugaacaguuucuuucagucucuugucuacuccuugcucugagggucacuggggaacagaggggcugggguuggggcugaggcuggggagucgcuucucuggcaccugugagggguggccaggcuggcccugaguuguggcgucugaaauauuuuguaccuucugcaggccugcucaaaacaggacucugucauuugaaaaaaacccaaaaaacaaaaaccaaaaaacaaaaccaauuuuccccuuuugagauagggucuuguguagcucaggcuaaccucaaacuccauuuguaguagaggaugucccucugccucuaccucccuccugaaccugggauuacaggcuuccuuguaacaccucaguuuaccuuugaagaaaaaucuucaaaauaaaaucuaaggcagcagccaggcagccugaggaagguggcucaggaucuggggggggggguaugcuggguggaggggugcagagucugucuucagggcucaggcauugccucugcagucccuguaaggcuguccccagucucggggccuuccgguucaccaaacaugcccagcugagcuagcggggcggggucuuuccaggguguuaggaaaacccuggcugcucuuucuagaaaagacagauuggagggcuggguuucagaagucuaaauauagaccaccaagugggagucuccgcucuugggcagagcccguguagggggaggggagcagacccuuuuuuuuuccuguaaauauuuucuucuggagaggaaacuggucuuggguucuauuguuugagcacaaugggcucuccuuuuaggagugcagcuuuccccugaggagcagcagggggcagcuagggaaaggggccagggaagaaggcaggaggggccccugcauucugagaggccucagagcgggcacgcaaagucacacuuuuccccccaucgauacauauagcacucguccauuuuguaacugguaccgugcuuaucauagaauaaacagaacuugcccagaauuggcaaucucuagauuuuucuggcucccauaguccauugcagcuuuugucccucccuuccagaagcuuccgugauccguagcuucagcuucggcccccacccuugguguaaauacaucccaccuccaauguccagaucaguccggaagcugggagugcuggagugcaucuccugcacuuggcagguuccuggcguggccacucuuugucugcucgcaagugcuuugccuggugccuaccuccuucuugucagcuacugucccuaguuuacagaugagggaacuagccgcugcuggcccccucgucuuugugggguuucacaggacugucccagugugucuacagcccacacaggucuccucucugccuggaugcuggccuagcaucucugccuacccagacucaggaaugccagcuuggccaagcugggaagcucuggauacaaguucaagucuucauugcacugaggggaaacugaggcccagagcuggcagaggcuuucccaggcauuaggaccauccaguguggccuguggguguggccuccagcuaggcgaaagcccuggguaacaguggcagguagcuaggggaagcagccugcugaccgcuugguugccuucccaggaccccuagucuggcauggcucugaaugaauguccagacuggguuccacucuuacccuauuugaacccugaguaagcaccucacuacccugaaccucaggcuuccaucugugcaguggguacagugcagucuugcuucggagucccaacgaggucagggauguggugguaguggugguggugguaguggugguggugguggugguggugguggugguggugguggugguggugguguguguguguguguguguguguauguguguguguugcaugaggaguuauauaacccaggcacugauggcugugcucccaccuuguugggaccgccccuguucccuccugcccacaggugccccuggaugaacgcaucaucuucuccggaaaccuuuuccaguaccaggaagacaauaagaaguggagaaaccgcuucagccuggugccccauaacuaugggcuggugcuauaugagaacaaaguggugaguucggggugagccagccacccuuccccacgcuccuggcagccgcucacccuccuccaggcuuacauagcuauuuuuuuuaaacuuuugaaaaaaaauuaauuuauuuuauuucauguacauuggugucuugccugcauaugugucuauaugagggcaucagauccucuggaacuggaguuacagacaggugugagcugccaugugggugcugggaauugaacccagguccucuggaagagaagguagugcucuuaaccacugagacaucucuccagcccacuuaccuaguucuuacuuggcgacccuauuccaccaucugaggcuccggacaccacgccuuccccuucaugccuaccacgggccaucucuccauggaaguuccaggaccaaagcaaccuuccugauccuucugcauuucuccaagucugcuuggccucgggcuccccucucagucauuucauccugcgucccacugucuguccucucagucauuucauccugugucccucuguccucuuaagcccuccuugagaucacccugcucucuggucacugccaagcacuaaaaaucccagcaucaccacagagcccacccucugccugccucagucuccucccaccucucccagacccggcuccuucugccagugccgcgcagucuggcccucugugccaucucuggaugggguuccugaaaucuccccaauccuccaugcucugaugugucugagaagagauggggacugacugugagccuuugcuuugggccccuccaggaagucccaccugguuauauuacaaacuuuauuucaucggccaaacacuuguccagcgccgcccuaaagagaggccugucugaccuguuucagagcagaucugucugcccccagugagcagaguacccuccccguuguaucaaggagagcugcaugcucggagucuccuuugaagcacugugaugcucagagccuagacauuuggagccaaggcaguggucagagaccuuggguucuggggacaguccugguucauggccaacaucuacuuccuaucgaugugaacuggaaggagccaccuccugagaaacgaagcaugcaguguccccagcacaauguagacucuggucacagagguauuagugacagccaucagugucacuaauaggcagcugccccagcauggcuccuuacaugcuaaggcacugcgcugaacauuuuauguggcugcuccuucuucaucuaguacccaccuccaaaccuugaacuaguagcugaguagcccauggggccaacuggaagcgagguuuguguuugacaacauucugaccuugaggccccauuucucuugcucucuucaggccuaugagcggcagauaccaccccgggccgucaucaacagcgcgggcuacaagguucucaccucugucgaccaguaucuggagcuggucggcaauucccugccagguaaagaaccaguggucuccagccauccuguccuguguaggccuaaggaucggccagggaaggggaugaccugagccugugcuugggcgccauucugcagcacagccagcggggcuuagaaugucuacacaucucuugaacaacccgagcccccaaagaggagacucgaaggccuacaagguggaguccccagguuguguauagauagggucuagaccuagacucgguuggcccagggaaagaugaugauaacucugcaaugcggugccaaggguuuuuuccucuucuucucagccugcugaggcuuccagaggcuuacacaguccccaccugggauuugggacugaagcuuauguggcaguagaugcugggcagggauccaacuuccuagguuccaggacugucucaguccuuuuaagccccuccuccccugacaucagguuccuccgcaucaauugaacccuggcgcugagggagcccgagggccuugggugggcugugugagcaacuguccuaucccagccacccagagcugggccacgcacaacuguuacugucauguauauuacugaccacagcagugagcccagggccugcuaucuugcuggaucuaaaauaucaccgagagccaaagagauagagaaaaauuccuuuguauuuauuuuguuugcccacaugccucccuucuuuccuggauauuuaaaccaccagcuuggccucugccauugaaauuugaagagaaacuuaagaacguaacgagccugaucgugucauagugucuuacacacgagcaagguagaugucaccuguuuccaguucuaggaaaagaauccacaccgaugccagguuucucaguuacuguggcugggccauggggucaaaaugaaggcgagcugcuuccuugcugaugugacguccccaggacagggugucuucucuaggccucagcgcagcuguucacaucucucuacagggaccacaucgaaaucaggcuccacccccauccuuaagugcccaacgcaguucccucucauccuguggcauccuuacgcccgacacuauuacuucugcaugaugacagaagcggagcaggacaaguggcaggcagugcuucaggauugcguucgacacugcaacaacggugagacgccagcaggcggcaguauuugcuaaugugcuagauggcgacaccuagugguugcguauggaauggcuagcuugcucuaggaucugcucacauuuuuucccugcugagguuguaagaaacucuugauuaucacucuuaauagucuuccuugaugaaauacuuuuguguugccaagggaacauuacaaaacuguucucagaacgcugugacuguugaucccauggacccccaaucccaaaaucauuuugauuuugccacuuuuuuuuuuuuuugaggcaggguuuuuuucuguauccuuggcuagaacucacuguggaccagucuagggcuagaacucacuguggaccagucuagccuugaacucacggagauccaccugccucugccuccugagugcugggauuaaaggcaugcacugccgcugcccggauuuugcugcuuucuagcaauugauguuacuguuguuuauuuugucuuuccuuucaggguacuguaguccacuguggcggggagggcaugguauauguaugaggugcacugcguuuauagucagaaagcagagagcaauggacgcugcucucugcucccuucuuauucagucuggaagcccaacgcauggggcgccacccagauuucggggacucuuccaccuuagcuagccuacucuagaaacuuccucucugauauguccagagguuuguuuccacagugauucuaaacacugucacacugacaaccaagguuaacuugcauggagacuggcuucccucuuggguucuaaguaagacagugauaagugugccuguggauuugaggguacuggagcacgagucugcuugugauuggucaagauuuuuguuuuuuauagcuggauauaaugguuucuggaggaucccugugaauuccagagcuagccugggcuauguaguguuucuaggauagccugggcuacacugggauccugucacauuacacaccaaaauauuucuuaugauguaguuucuuuccuucuuuacacauaguaaucuggaaaggcuccucucuccuccccucauuuguaaaccuacgcucugacccuucggcucacucaugcguuccacuaacauuuauggccucuauucugagcugaugaaggaagagcaaggcacgcacccuaccccauacagccagcugugugauggagagacagauggggcacagaugagcggccaggaugguguucuuuuuuuuuuuuuuuuuuugguuuuucgagacaggguuucucuguguagcccuggcuguccuggaacucacucuguagaccaggcuggccucaaacucagaaauccacgggccucugccuuccgagugcugggacuaaaggcgugcgccaccacgcccugcucaggaugguguucuuugugcugggcacugggggauguguugggggaggugcugcccugaauggagggaggaggugaugggguaggcuccaccuguggaggugauggauaggcaagguugggcaagugcuccccgaaagaggcuguggcccccauaaaggguggcugggaacagagacaauacugugugugugugugugugugugugugugugagagagagagagagagagagagagagagagaacacaacagagacagacagagagagacgaagugaggcuggaggggagccaucaggccaggucuggaagggccuucuagaguucugaggaauuauaaacguuuaggcuugucccccagugugagguaguagugaaggccuuucugcccuguccugcugauguggucccagaggcagagggaggcccagagcggcuuuaccuugcucucaggcacagcucuaccucguagugaggggagcgugggcaccugacugaacccaguucaccccaccucucuacagaggccuccacccucuggcaucuguccacugggaggcaaccggcucuucagccaggccaagcccugccaccugggcugggcccugcccugcugcccacaaagagcuccuguucccaggucccuggggcuguggcucuggcucaggcucuggcugccuggccugggacacccuccuuccuugcuggcccaugaguccucugaaaguucccagggcugcuggcuuaccugcugugaccgaguaggggacccuaggucagguaggggaagggugaggacaggacugaguaggaaggggacacuguucaguuccccgugggauauuacaguagggacugggaauauuggugugugugggggggggaugagcuggcucagagcugugagccuccagucuggcacacagcaagcuggaagguucuguguguccugggcuggaguggacacauaaaagacugugacagaaagucccacccccaggccagcucucuuuacccccugcaggaacugacaaggccaguuccaggcauggcccuucccuccaacccaggacugugagaaaguucucugcuuccuccccuguugagacugggccuggaauucauggggccuggaauugcucaguccuggcccugccaggaaguggggguggaugggucagggaaggaggccaagguggguggcggcuagccuggcuagggcccccuucacacgcugcauuccuggagcagugggggugucaggaggcagcagggcacucacuuuuguccuaggccugguguccauguccugcuccggcuugggcucugccuagacuaaggagguccuggguuccagccccauuuaacuagcccccacccccagccaugugcuugaaagucaguggcuuugcccauccuagucucgauuugagacaguuuuuuuuaaauuauuuuuugaagauguauuaauuuauguauaugaauauacuguugcuguccucagacacaccaaaagagggcacuggaucccauacagaugguugugagccaccaugugguugcugggaauugaacucaccuuuggaagagcagucagugcuccuaaccgcugagccgucuuuccaaauguccugauauuugugacagucuugauacuuaaccugggcuggccuugaacuugcuguauuccuccugccuugacuccccccccaccucccucagugcaggcaugauacacaucaccaccagacacacugcacacgugcuagaaccucaguuucuuugaagcugagacuagcccccacuccaucccauucccccuccuuuaaggaugaaaugggcugaugcaagugaaguuucaggcugggccuggguggcuuacacaacagaaaugugcuuucuucuaguccaguagacuggagaggaccagguuggugucuguagcaggcucauuccucugcugaacacacugguuuuucuuuuuuccuuuuuucugaggcagagucuuguccaggcuggccucaaacuucuauguucagagugaucauucugccucagaucucugucaacucaacgccaagacuacauagugagucugcuuccaguagaccauccauccccuccuuucugggagaggugugauggcucagaugggagcagcauggugaguuccaggccauucugggcuaaggcugucucaaaagcaagcgagggagcaagggagcgagggagugagggagugagggagcgagggagcgagcacagggcagccucggugaaugaaguuuugcugugaagccggagggucugagucuggaucccuaacagccacaucaaaguccgacgcagacgccaggggcucccuggccagccagcccagcugacacggacuccagguucagugagagccucugucuaaaaacauaagguggaggggcugagacagcucugugguuaugagcacuggcugccuuccagagggccuggguucgauucccagcacccacauguggcucauauccaguuuccuaugucuaguaccuagacaugcaugcaggcaaaaugcucauacacauaaaauuaaauuaaauuuaaaaauaaaugagauggagaaugguagaagacacuucacauugaccuuuggccucaacauggacauacauggaugagugaaagcauacacauguauucacacacauacauacacacacauacauacauacauacacacauauacauacacacauacauacacaugcauacacagacacauauauacacauacauacauacacauagacacauauacauacagauacauacauauacgcacacacauauacgcacacacauacacauauacacacacauauauuuacauacauacauacauacauacauacauauacacacacauaugcacacuaaaacaaauaaauuugaagcugggcaguggauaaguaugcuuuuaaucccagcucuccggaggcagaggcagaaacagguggaucucugugaguuugagaccagccuggucuacagagggaguuccaggacagccaaggcuacacagagaaacccugucuugaaaaaccaaaaauaaaaucaaaauuuccuuuuucaugaagauaucgguuuaacuagauguggcucagccugaccucucuguugagcuucgcucuuaggaaagaugaguuguucuaaauucagcccuguucuggggugcguugcccgugaacacagcaggcucacaaguagcugguugugcagaauggggaagguccuuaguugggagcaucccugcugcugccccgcccauugugccacccaccaagccacccucccuugcuggggcacccuugaccugcacgcucgcuugcuucguugcaucuuccuugcuacacgcaggauggaaauuucuagccuugguaauuuauauauugccagaucucccagacagaacucagacuccaggagagcguguccuucugagagccuggcuggggcuuccucucaggcccacauuggcugcccugacuuggguacuacuucugcugauacaccucugcucugccccgagccucgcccuguggguccuccaaugcagggaugggugcuguuggcucugagucucugggucccgugguagaauguccucuggcucugacagacagugauuccugugggcggcuggcuguggggaagggaggggcucuuuucuguagggugacucagccuguugucacugcagugggcgcuguggcuugugacgcaugaacugcaguuucuccuucuuggguuccggggacaccguggucagaggcacguggcuagggcuagcguguuaaccauccucucucccuacuugaauguggccacuucccgccucuuguuuccucuuguuuuccuagcuagguaaacaacuuguuuauuuacucuccugcccugugacacaggccaccaucaccaccaguagcaacagcaacguagaaaaagcauguuuuccuacucguuagcaauggucacgcucccaauuuucucuuccauccuucuuucccacccaggaacugaacucaggaccuuaugcagauuagacacacccugccacugggcugcagccccagcccuucagucaguaaaguuuuagcgucuguacaaauaagguacauagacaagccagaccuggggcccauuucuaaagagaaauagcuccucagcuucugauagaaagugcacuugaggagcugggccugcagcucaguggucaaguguuugccugacauacucagggcccugggucccaucuccaggaccucaaaaaaaccaaaaccacacaaaguguuauucaagaggcccuggugcuauccuucuggacuuccuguagcucacugucugcacauugcagcucagaggucccuagagcauguugggggggggcaggauagggucauuguucccauaagagcaaauugaggcucuuuugggguucaagguccagaaagcagugcacgggucagguucagcccccggccuacuuuugcagcaagguguauugacaaagaaaagcucuguuguuugcaaccuggauguuaggucuagcguugggacagaggccgucuggcuugugcagcuggaaauauuuaccgucugucacaccacgggagggucacaggacacgaaugcagccacauguggggagcagggcuagaaugugagucucagguguccuagagcuaugccgugcagucuuuagggcuggauggcuuuucucaccucguuuggcuguucauuacucucagcuguuuuucugugggguggguuaauggcugugcugggucaggguggugguaucuuggaggacgaaggagauucggagagggauggguagcagggguugccauggugcuacagggugaaccacggccuucuccugcugugcaugcccuggcuggguagucuuggcggacgacuggaagguccauugcugaccccuuucucuccuucuguccugggcagggaucccggagaacucaaagguggagggcccugcauucacagacgccauccgcauguaccgccagucaaaggagcaguacggcaccugggaaaugcuguguggcaacgaggugcaggugaggucagagggccgugugagggguccucgggagucacccuggggcuuaguggguaaggcugcaucagaaguggggcucuaggguacagcagguuugggaagagauggcaagaacagauuuggguaaaugggaaccccuguuaaucuguccacucgugucccugagucccggagggcagggcaguucuggacaagauggccacagcccccuuccucaguagcuuugccucacaggagaccgacaccacaggcagacaccuguaggaugugcuugggagauagcgccacagagcaaaguccuaguguggcuggagagauucagagaaacaagccagauggauggacagacacuaacccugcuccuucuccugucucuccguccuagauccuaagcaaccuggugauggaggagcugggcccagcgcugaaggcagagcuuggcccacggcugaagggaaagccucaggagcggcagcgacaguggauccaggugugugggccugggaccccuuggcggggacauggguguugacagggaacagccggcacucgguccccagccccggcgccgacaccuccauugucuccguagaucucggacgcuguguaccgccugguauuugaacaggccaaggugcacuuugaggacgugcuguguaagcugcagcgggcccggccggccauggaggcagucauccgcaccgacauggaccagaucaucaccuccaaggagcaucuggccagcaagauccgagguaggcgggucagaagccacuggcagaugcuugcacacagccagcccuccggggccaggccagcuuccucagagugcaauccuucacuugccugccuguuauucugcugaagaaucagagucaaauccaugaccguccgacuccugcagauucuucucuaaguuuuacuucugcaaacccagauuugauucuggcaugcuggggaucgaaccuagggcuucacucaacucucauccacacuugaugagcacucugucagcgagcugcgacucuagucuccuuuacucuuugagacgaugucguacacgcgacccaggcuagacuuggauuugugauccuccugccucagccucccgaguuccuaaggugacaagcuuuugacgcuaggcccagauuuugaauguggagauuuuugucuuugaggcucaaaccucugucaggucugaugacgugucgcccugguggaccgucaugucaccuugggaauaccuagcuucuccagguggcauaugcguccuccaucauccacguuguguuucuuugacucugugccagcgggugguggcuugcugauggugauugugggucagccacauucacugggaguuuagugggaaacuaagaguugaugcuuacuguguguuauaaguaucaucugggcagaagcgggguagacuucagaaugcccucuggguaaaacaugcugggguugggauguucugaagaacuggcuggaaagagccaggccacccccuccagggcagggucagcuuccacaaagcucacuggauccccugaggcaucuguguuacaauucuuuuccuuucuucccuuccucucccccuuucucgccaggccagcuucagacuuguaacucuaaauauguaguggaggauggccuugggcuucuaauucuccugccuccacuucuggagugcugggauggcagaugcacuucuucugcuuugaucugcugucuuuauugaucccucucuaaggaugggauauccaugggcugggaugauggggugggguggauugugucccaggcucugucaccaacgaaauucucucccuccccauacagccuucauccuccccaaggcggaggugugcgugaggaaccacguccagcccuacaucccauccaucuuggaggcucugauggugcccaccagccagggcuucaccgaggugcgggaugucuucuucaaagaggucacagacaugaaucugaacgugaucaacgaggguggcauugacaagcugggcgaggugagaccugggcucgggucuggugucccucagagcaucugcugugugucucagggugggcugcccuuucucagcauuacagagaccagaauccaacagggaucugucgccuagaggaaagaguggguauuuuuacccuguaccaucagucuuuauggagcaagaugguugcuaaguugaaaauggcuuauacagagagggaauggaggaaggagguggggagggcaagcuucagauguggucugcaucguuuacaagccacacaccccauacagugugucuguccuaugguucugcugacucagcucuccgggugaauguuucuuucuuucuuuuuuuuucuuuuuugguuuuccgagacagcguuucucuguguagcccuggcuguccuggaacucacucuguaguccaggccucaaacucagaaauccaucugccucugccucccaagugcugggauuaaaggcgugcgccaccacugccuggcugaaugucuuccuauaguccccuguuggcugccuuugucuagagucuguccugaacuuuagccgccuccuucagacuucaaguuugggagucccaggcaauaauaaucagaaugugugcgugacacagaaggaacucaauaauccuaaagagaugucuauugaguuggggccuaaagacucagagagaguaagugggugucuuugcaaggucacuagcauccagagggcaugagaacugucuuccagugccuggccuuucuccucaacgcugugacagucugccuuuagguucccucucccuuuucuccugggcuugcccgaaugggcaccauuuccgggaggccaucccuggguagguauggccugggcuggugccaggccaggcaguaugugggugugugggggcugugugcucacccauguggcccugcucccuacaguacauggagaagcuaucccagcuggcauaccacccccugaagaugcagagcugcuaugagaagauggagccacugcggcucgacgggcugcagcagcgauucgacgugucuagcacuuccguguucaagcagcgagcccagauccacaugcgagagguguguccccugagcccacaccccgcuagcugccuuccauggcccccuagcaccaggagagggagaccucccgccacaugccucccagaacacccguugcucacuuagcugccaaucaggucuccauaggauccagcccuucccccaggaagcuguccuugccaccuagucucuugcugggauuucugcauucaggcagacaccuguaucuagauucccagagagcacacaagcuacagaccaccccugacuccucugccacgggccuaggaugggcacuggcuggggaugcaggaagaaagggucucaugaacucugccguaugccuuguagcaaauggacaaugcuguguacaccuucgaaacccuccugcaccaagagcuggggaagggacccaccaaggaggagcugugcaaauccauccagcggauucuagagcgcgugcugaaggugagccugacuccauugggcuggggucgacauggccagccaagcccagggcugagcggccagacaccauccccaggaagcaccuggcgcauaggguacacgugaaugcuccaggcuugagucugacccuccugccagcugagccccuuacccagagucccuccugcccuccucccugcagaaauacgacuaugacagcaguucugugcgcaagagauucuuccgagaggcgcugcugcagaucaccauucccuuccugcucaaaaagcuggcccccaccugcaagucggugaguccccgccuugcccuuagccccucagggaguggcugguggugcagccucugaacuuucucugccugcuuccccggcaggagcugccacgcuuccaggagcugaucuuugaagacuuugccagguucauccugguggagaacacguacgaggagguggugcugcagacggucaugaaggacauccugcagggugagcagggaggggcagcccagaagagacaggcggcagagagaggccaagacuccaggaagaggcugcguccagacacuggcuucucugugccuuagguuuccucucuggguggaguggucagagugggacauaguggucugccagcuugagcucugggcuugaguuauacuuuugcggcaggaaggcccagagcaaagcaaggcccaggaggcugucugguuugccaugacuguccaugcugagugugcugugucucuuuggucuugcagcugugaaggaggccgcagugcagcgcaaacacaaccucuaccgugacagcaugguucugcacaauagugaccccaaucuacaccugcuggcugagggcacaccaaucgacuggggcgaacaguacggugacagcggugacagcggcgguggugacagugguggcagccccugccccucugaagcagccacccucacagaaaagcgcaggcgugccaagcaggugauguccgugguccaggacgaggagucggggcugcccuuugaggcuggcguugaaccgccaucaccugcauccccggacagugucaccgagcuccgaggccuguuggcccaggaccugcaggcugaaagcuccccaccagccagcccucuucucaauggggcuccaguccaagagagcucccaacccguggcagucccagaggccucaccgccagccucaccccuccggcaucucccaccuggaaaggcuguggaccuugagcccccuaagcccagugaccaagagaccggagagcaggugucuagccccgguagccguccccccauccauaccaccacugaggacagugcgggagugcagacggaguucuaagcauggccuccaggcuucuguuggacucugcaccagggcgcuccuccuugggcaccacagccucucaccucuggggagggguacuccaguuugugccuugugggaaagguggcuggggugguguggcaucuccaggggucuggccuacccaagucacuuuaugggguucaguacaccuguuacugccccguuuucugugggcugaucuccaaugcugggucugguuuugaggguuuccucuuugugcaagggucuggggagccccuccaucccgcccucguacuguuacggcggcagaugaaagcagugguggugugacucacguauaggaagcuaggaagcugucaucucacucuggggcuccuugggaccaacguggcaaggaaaaggcagaccaggccucugucccgcccacucccugcaggucccaagguuagacacuggccucacuuugcuagcuacugcugugggagggcggggcuuaggggucuuacaggggagugaugcuagaggucagaggucaugauggaaugagaaaggcccagaauguguuagucugugcaggggaaguguccugagggggagggagcuugggagugucuuugccaggauggcaaagugaagguagcugaaguuggagugucuugggugacccguuccugcucaucuggcugacaacgcucauuggcagggcuuagcugugggcuguuucacuacgugccaggaagcugguggggcuccagagggacauugagggcuauggcucucugagacacugcugaccauucauggccucugcucccgucaccuaauccugauaauuccagaccccucuuccaauguccuugugagccauuugggcuugucuuucccucuuagucacaagggucaaaccaagagucaguuagcuagaugacucuccccagacucugucgccagaguugggagaacaaagcagagacugccgcuccaaggcccccaggacgaggucccucccaguccugugucccuugcucuguggaccugcuccccagacgcaggccucagacccacaggauguggccggugcucagggacacccaguccccugcccucacuccgaguacugacuucuuuccauguucucuagugccuuggggguuuccaccauccuuccagauaugguaugaagaaucuaugcaaacuguguaagcuucugcucaucaauaaacgcuuuauuuaaagcucau

SEQ ID NO: 768 - RNA, 38188 nt, Mus musculus
cagcugugaaggaggccgcagugcagcgcaaacacaaccucuaccgugacagcaugguucugcacaauagugaccccaaucuacaccugcuggcugagggcacaccaaucgacuggggcgaacaguacggugacagcggugacagcggcgguggugacagugguggcagccccugccccucugaagcagccacccucacagaaaagcgcaggcgugccaagcaggugauguccgugguccaggacgaggagucggggcugcccuuugaggcuggcguugaaccgccaucaccugcauccccggacagugucaccgagcuccgaggccuguuggcccaggaccugcaggcugaaagcuccccaccagccagcccucuucucaauggggcuccaguccaagagagcucccaacccguggcagucccagaggccucaccgccagccucaccccuccggcaucucccaccuggaaaggcuguggaccuugagcccccuaagcccagugaccaagagaccggagagcaggugucuagccccgguagccguccccccauccauaccaccacugaggacagugcgggagugcagacggaguucuaagcauggccuccaggcuucuguuggacucugcaccagggcgcuccuccuugggcaccacagccucucaccucuggggagggguacuccaguuugugccuugugggaaagguggcuggggugguguggcaucuccaggggucuggccuacccaagucacuuuaugggguucaguacaccuguuacugccccguuuucugugggcugaucuccaaugcugggucugguuuugaggguuuccucuuugugcaagggucuggggagccccuccaucccgcccucguacuguuacggcggcagaugaaagcagugguggugugacucacguauaggaagcuaggaagcugucaucucacucuggggcuccuugggaccaacguggcaaggaaaaggcagaccaggccucugucccgcccacucccugcaggucccaagguuagacacuggccucacuuugcuagcuacugcugugggagggcggggcuuaggggucuuacaggggagugaugcuagaggucagaggucaugauggaaugagaaaggcccagaauguguuagucugugcaggggaaguguccugagggggagggagcuugggagugucuuugccaggauggcaaagugaagguagcugaaguuggagugucuugggugacccguuccugcucaucuggcugacaacgcucauuggcagggcuuagcugugggcuguuucacuacgugccaggaagcugguggggcuccagagggacauugagggcuauggcucucugagacacugcugaccauucauggccucugcucccgucaccuaauccugauaauuccagaccccucuuccaauguccuugugagccauuugggcuugucuuucccucuuagucacaagggucaaaccaagagucaguuagcuagaugacucuccccagacucugucgccagaguugggagaacaaagcagagacugccgcuccaaggcccccaggacgaggucccucccaguccugugucccuugcucuguggaccugcuccccagacgcaggccucagacccacaggauguggccggugcucagggacacccaguccccugcccucacuccgaguacugacuucuuuccauguucucuagugccuuggggguuuccaccauccuuccagauaugguaugaagaaucuaugcaaacuguguaagcuucugcucaucaauaaacgcuuuauuuaaagcucauuuccucaugugcugcuggggugggggagaucugggccuaccguaucuagggauccauucaucccagaucucuugggcucaucauaugagcuaccaggccccugaucugaguguguuccugcacguguguacagguacaaauucacaugugcauguggaagccaaaggaucucggaucauuccgccucguguuuugagaugaggucucauuagccuggaacucacuaacucgguuagcuuggcugacuggugagucccagggucugccggcuucagcuuccucaguacuuugauuacauguacuggccuggcucugugagaucuggggagccagacuuccaaaugacaacuaauguacugaggccucuuucucuaacucauucuuacaauccccuauuuuagagggagaaacugaggcucagaaagaaggggagaggccauagagcuuucaggugacuagccuucugauggcucaucagucccauguguccaccaugaggguggccuccaggccugagcuaggugcuaaugucuaguucccccagagccagucaaguaguaauauuuguugagcacaugcuguaggccauauacacuauacuggggagggcaguagggugccaugucacauggaacccuucacuacagcuggugagggugggcugccccucugaaaguuaacaugccuuccaguugccucagcagcccccucaccuaggauaaucauugcaggaacacaaccugucccaugagcacaggcuacuuauaaauaaauaaugagacccccaucucuggcucuguuccccucgcccucuuucaagaggguguugccuaacucuccauggggcaauguuucuguugccuucccucugacccaggggcagcagcucucgcccuuuuccccagaagagcugcccucuccccggacucugccuacuccuaccccucccaaguucucauggaccuaggggugacucugcaaggagucagauuuacuggugcuccuguuuugaaucaaccugccuguguaggcuaaggaugcagauaugggaggguggguguucagaaagaagcaaaagggugcuggggagucuugcacaacccaccccuucccagagacacuggugcaccuuaggacgggauggcugauacauuccacagauauggacaccuccaggaggggcagacagcuggguguagcgcugaggcuuggcuacuaacauggauuccugaguccugcagggccaccucccuacgcuggaccuuggcccccugccccaaggcuccaccaccagcagauuugcccugucuuuuguucacuguucagaauagcuaugucacaggccaggaacauuccaccugccugccuagugcucagagcagugggggucgggguggcagguggugggugacaaaggccuauggcagucuugcccuagucuggggaaugaggguaggugggaguccagcagugguggagaugguaccaaggaagggccagggcugguaggugcugugccuucagcugcugugguagauccggaggcgcugggagaucuccuggcggcacagugggcaggugcgcagaggcuggcagcacugcugacagcagcagacguggccacaggugaggaagaccaucugggccugcggagagagcagcagcaacauccugaccgcucaguucuggagccaugaccacaucaaagccccgagagaugccaguggaugugaaaaccuagucaggccuguuggcaguuuuguaccuguuuuuccauggauuguaauagcauucaaauaucuacaaucuaaaagcucuuuccuccagugcaugccaggcugagugcccugcuacugagcugccuccacccccagcugggaugccaggcguguacugcuuaccuggcccuccaccuauuuguaauuauuuuguguucacacuugccaaaguaugaugccuagccuaaaaugacuuccaccuuauagucacuagccucguauguguucccugacucugucuuagcaagaccccucaguaugcacauggccugagaagucuccaauugcuucaaagucauguaucauaucaagaaauugggagucccuuucagagccugaggacagugccuugguuacaguucuaaccacugugcccuccgccgcauagcaccccggagucugcugaaggucagagagcuaccgagcugcuacagcagcccccuuaguaacucauguguguauucuacucgggaaguguagaagggggugugggauccccugacguuaugagccacccgacaugguacagggaagggcagugagugugagccaucucuccagccccuuuuggguuucuugacacagggucuugcuccauagccucagacucacagggcuuuugccuuuuucaucucucauuaaguacggcugcaggcauaccugccgugcccugccccggcucccuuagcaacugugcaggagggaggaccugugcuuuaagcacugguauguuuacuuuuugcaauaaguguuaauuuugcaacaaucuuacaaaggccuggccgggaaaaccauguucuuggugagucaugccugaggaaauuuucccuaauauaguuaauaagcugagggaaaaauccuucucuggggaaaauggacucuagacaaugucagcauugcgcauaucugggucauggaacaugggucauuuuggugucuccccacacuuacuucacguuccaggcacacaacacacucugaggucggcauguccaguucagcugggggggcggacggucgcacugacucuuggagcucccggggagcuguggggggcucgagggcaccaaggaccucauucucgagugguuucaacucugaagaaaucagagggacaggcuaagccauccccagauggucccagucuuagcuugugugaguaaucggggguggguggaggggagagggggugccuccguccaugagcaggggaaggaucucccucucggccucauuaauucuuccguguccaucugugagaugggagcacccagcuaccacacacucugcuuguggagcucagaggugagaaaaaccuuagaagccugaggcucugagagaggacaucgcaugccuagagccguaucgccacccagugguggaacugcaggacagaggcccugggcuaguggcugagcuucuuuaccaggcuccucaggaaacagcauggguccaucaggugauggcagaaugggaccgccccaaggcugccuccucaguccccaguccucccccagcauagcccacacugugccuacagcucugccuuggagccaguagccccuagacugcuaaguacagccucugaacagcccagaaaagagcuuagagucaguaccuggcuggacccuaggcacagcuagcagguccugggcucuccguaggaucucauguugcaggccugcuucugagacgcccaccuguggccaaacaggaaaaagcagaccaagggcugagggcaaggagccagcucuccucuacuaagcugucauaugcuguccagcccauaggacugccucagccuccaccuccggcaccuucacuggaaacagggaggccuggaccuuguggucaguaugaggcaagguagaaccacagcccugcagguggcucaaucgggccucuguggcagaggggagaacugagcccccaaaggaaaccugugacauguguguuuacugaaugcuuuccugacacuacugucacugugccuggugaccuuaggacagagagcuacugaaacuccucugcugagaaguagcagggucagagccuucuagccgacaccccagagccugggcgcauagcccagaacccugcaucuauccgaaggucaucaggaacugcccccaagcaugggcccugcacuguccuggaugaggcaggacaacagaacggaugagagcagggacccugaggccagaccacucagagucaaguucccgguucaugggcugccgugagacacuaagaaugaugccaggcauguauacgucccagggaggugccgguggauuaacuccacaaaaggagcucauguuguguucaggacguagcuauaacugugugacaccauugcacaggcugagggcaaaggugagcagaggcaauggggcagcgguucuggccaugagaagcucgagucaccugaccuggacagaccuugacucacuacaaacugaacaaauauacccccuuugugacagugaguccaggcacacugggccuuccugacuucccccaagacaauggcugcccaccuuagccagaucuccggggcucauucggcucagcauguccagugagaugcgguggugggcgaagaggggcagguagugcucugcagaaagcuccaccagcagggccaccagccgucgcuccaugccuucuuccugcaggauggccccauggggaaggccaaggguguuagaguggagggaaccaaagauacacugguuucaagaugggacugucagagugcaugacacacaagcgugcuugggcucuuccccaccgaagggugugugcuaaguguauggagauccacccacagggagcucacugcuguucuacacuugaaauagucacguaaacaugcagcuccggagggagcuggcugaagaagccgggugggccacacaccgggcacaggcagguacugagaacaacggggagaggcguggccaugggcuggaagcucucggucaguacagaggagagaaaaacaagcuaccagaauggugugagugaggcucaguggccgagaagacccaggguggauucguagcagccacagcauguagcucacaacucucuaacuccaguuccagggggccugaggcccucugggcuagagacuaccuguauccacauggcauacauagauuuacauuaaguaaaaacuaaaucuaggcuaggcuuaguggcacaagacuuuagucccagcacucaggaggcagaggcaaguggaucucugugagucuguagaccuacagggugagcuccaggacagccgggaccuuucuuaacuguuuuguuguugugagccugaugcuccucaaaaauaaaauacaacaaagauggcucagcgguuaagagcacugacugcucuucugaagauccugaguucaauucccagcaaccacaugguggcucacaaccaucuguaaugggaucugacucccucuucuggugugugugaagacaguuacaguguacuuacauauaauaaaucuuuuuuuuuuuuuuucuuuucgagacaugguuucucuguauagcccuggcuauccuggaacuuaauuuguagaccagguuggccucgaacucagaaauccaccugccucugccucccaagugcugggauuaaaggcaugugccuucacgcccggccuuaauaaaucuuuuuuuaaaaaguauuuauagaaugagucaauuuuuacuaaaaauuuaagccgcaaaaccagacauaguuguccaggcuauccccuaggacuggacguggguuuaucccuggagcucacugaccagccgauguaccugaacuaacgagucucaggcucacugagggauccugccucaaaacaacaacaaagcaauaaaugaaugauaaaggugaagaacuggagagagggcucaguggugagagcacuaauacucuuucagaagacccgguuugauuuccagcaccagcaucguggcuccuguccuauaacuccagccccacgagcuaauccaugagccaaucccucuucugaucuccauggguaccagguguacaagcugcagacacacaagcaggcaaaacacucacacacauaaaauaauaaaagacagcgacugugaaaacgcuuccagucacugcauguacaccuacacacaccugcagacaccuguacaccugcacacaccugcacacaucguacacuuacugcaacaugcacacacacaccaggcauacacauaaaauacaaacguaagccaggcaugguggcacacuccugucacucuagcccucagaaggcugaaacaggaggauggcauguucgcaaacagccugggcuguaaagugagauugucucauaaaaaucccaaaccaagcuguccacggugcacauuuuagucccagcacuuagaaguuggagacauguggaccucugugaguuccaguccagccugaucuacauguugaguucuaggccagccagugauacacagugagacccugucucacaaaaagaaagcaaacaaacaaaaacauuguguguguuaggccagguguguuggagcacagcuuuaauccccgcaggcagaggcaggggcaucucugugaguuccaggccagccagagcuacacagggagaucuugucucaaaaacaaaaccacagcugggcagugguggugcaugccuuuaaucccagcacuugggaggcagagacaggcagauuucugaguucgaggccagacuggucuacagagugaauucuaggacagccagggcuauacagagaaacccugucucaaaaaacaaaacaaaacaaaaacaaaaaaaacaaaaccacaccugcgcaugcguguugagugcaugagcccaaagggagcacagcugcagcugccccgcccaccugcucagcagaggccaaugucugccuccucucucaucagaguacucacucgcuuucccugcagggagcuggcacacuggaguggggcugggcugaggugccuuuggaaagagccccucuaagcuccugggccagaugaguaccacgguccuuaccugcaguuucaaggacaaaggcuucugguuuaaaagccguugguacuggaugagccaguaauuuuccugcuucguuucgcucuuggccucuaauuccgccugccaagaacagaagcuacugguuagcuucuggucaggaaacagagaccaccagaccacgggguuuccuacuaugcuccugugaguacaugacuuuucgcuguccuugauuuaagccacagagcaaaagcuggaagcccagcugugcccaacaacagggagugggcauggggaagggcaaggagcugcgaaggccacacauguggcaccaggagccugcuccuggcuucccgcacuaggucccacauucugcuacuaccucugagagggacuccuuuugguccauuugugggacagcaaagucuugcuagccaccucuguccccaacaagggcaugccuacuuuuggaugccaggcagguggcuacaggacccccaggacuucuuagagagguuguuuugcuggauaaggcugacacuccaauggcagagaggucuccacucugccguguggggaauguucguaaaggguuguucugggugggcgauaccccaggugccaggaugagacagugagcuagugauuuugaguaaugaucaccauagcaaccauugcugugggccacacuggguccuuuaaugguuccuccugagagagccaagaacucugcuuuucuuccuuacauuuguauauuacacuaacgcauugugcaugcacuccaccccaguaacacaugugucaaagucagagggcgacuucggggaauugguucucuccuuccaccacgugggugcccaguagggacucggcucacugggcuuggcaacaagugcucucaccgcugagcuguccugucucugcauccuuacucuucuggaacagggucucgcuaugucccugcacugaccuggaaaucaccaucuucccccauuagccccugaggggcugggauugcaguguagcucugugccagcagauuuccuucugugaccaugguccugccuguaugcuagccuggggcuuccucccuuagccugcugagggcacgggcagcaggcacacacuacugaggcgccaugggggccaggucacuuuggaugggcugugugugcuccgcagaagccggccucacucacucuucucaacuggccuggggggaccuuugagacagucacagauagcagugauuccaucuuuccagcccuggcccucaguguguaggcaccagacacucaagugucuggagcaacguuaguaaguggggcccagcccaccugauguacaucagaguaaaaacaacuagccacagagaaggguuaggccacuccugcuaaaagugcuggucugcucgcagcacggcacguccuguccuggagagcccaguccugaggcccggggagcgccgugcgcagaggcuaacaucugcugugcguucauuacagugugucuuggauacuggagaugcugugcugucucagcucuggugcugcgacuuccccacaggauggaccguugagugaaaguaaaugcucucucuuauaacaagggugcacaagaaacuaaagcaucugccaaguggcgcugucccuugcccuuuacgcuccccuuuggugagcuacaaugggacaagcguuugaaaagcagugagcauguccaggcgugcacacagaagcccacggacauaccaggaugccauggaguuccucuucccgcugcuucuucucuuucaggagcugcuggagcagguugcugagugcccagcgcugcucugagaccaucuccuguaacacaggauccgaccugaggccaccgugagcccucagcgcuccccaccaugcagccccacaucgccugaaagccccacugacuaacgccucaaggcugaguugagggacagagcccaaaggcaccccuacucuacuaugccacccacuuccucccaagccgucaacccucuucuuuguggcuucaggccaggaugggccucuagggauggugagcacaaauggugagaaacggugaacaaaagaaacaagucaugggucuggacggaccacaguacacggaggaagcaaacggugaggagggugccacguacagaugagggggcugccacacagggagacacaugcaaaccgcccuguguguguggccacacacuuauccucuugucucuggaacccauggugguccuaacagggagaggccuguggcuugaaugggcugggaccaacauggcagcagcuuccuuggggaagccaguuccucaucuauaggaaccaucagaugccaccaagaacacucuaauuggcugaugguacaggcuagccaugaacaguggaaagagaggcccaggagugacucgucuaaggccaccuagcaaccuggguaggccuaggggcagcagcacucucaguacuggaaggccaugggucaacucagacuugcccugggcauaaacagugacagugacaggugagaacacucagaagccuggcacaagcacauauccacugccauccuaccuugucccuguguacgucuauccacauauccacugccauccuaccuugucccuguauacgucuauccacauauccacgugccauccuaccuugucccuguguacgucugggcagacugagggucagggaagggagaaggguacccgcuuuuuuccaugugccaaccuguacugcccucggggucugugagcucacaugcccuugggacaccagaacucccuccacaggaaaugucagcccagagaggaggacccaaagcccaccugaccacacagccaccagcccagucaggggaaugcagagauggugauggcccagcgggcccggcaaugaaacccuccuuccucugacccucucgcccagcacaaagcuagcuuugcccauggaccacaucuguucuaauggggcaggacuggcucucugucugcuggagaagccugggucugcagcugaagaucagccgcccuggguucgggaguggaaugagggugucuggcugggagccucacauaccugaagcgucucuguguccagggacuuccucuuuaacuccagcugugucagcugcaguaacucaguuucuauuagccuaaucuaaacagaagacgaaacagggacguugauucacaaucaccacggaucccuuaugugccgccgcuuggcuaagcagggacucagaaaccugucaggaggcugggcagcccuggacagaggggaaccugugagucuugggaccucacugaagagagugaaaacaagcuaccacggggccggaggacaacaaaaugauccaaugacgagccucaguuauguguugaucaccuacuaugugcuaggcugggcugcagcagcagcucccuggcucuugggguguaacugccuuaguuacaaggacaaggaaauggacgcuuagugucguuaguuugccaaagaguagguaacugagagaucguuugucuggaauaucccaacucagggucugaaacggaacagggucauugagaauaucuggggucaccacaggcucacagucagugacuucucuaccccaugccagccaaggacccuguggccucucgcaacccugaguaucugacgccaccaaccccucccuggucagaggaaugagcuucaugucuggcaaugugggauugaaauuaaagagggagguuuaaaaaauuaaguuuguuaaagucaaacaagaaaagaaaggaaaagaaaagagagcaugcaaaaauguggguacagugugugaauccacagcgacguguguucccauagccugacagcuugcagcgccucuggucccagccccccuccacccagcaggggccccgcccaaggcuacuccauggaugggaggguggucuccuccucccaggccaggguccauccuuagaggucuuaggaccuggcuucccaaucaauugggaauuccaacccaccccaagaagccauguguccaucagugauauugagcugacgcaggcacuggagucugagccggcaaguuucccagagaguccuguaagcgcugcccuuccuccagccaggcauuagggaaacacacugcacuugcccagcaggcuucuggccaggcucugggaugaagccaccaccuucagugcuguucaaggcacaacccaucagccccauuguggaauguugaggaaaaggaggucuccaaagugguaagccauggguucgaguuuuaauaacuguuaccccgugagccagaucugcaagcaggagcaggacgagguggcccggccagcacucaccugguuccugaucugccgaugcaucagguccuucuucaccuggagagccucgaaggcagccuucugcauuacacucugcaagagacaacgcauacacugcuuagauggccaugcucccuggcucuuacaagggugcucaugccagccacggggaagccacaucugccuaaaaaaauaccuuagaguaugauuuuacaguucucagguggacagaaaaauaacuguucucucucuuuccuuucuuuucuuucuuucuuuuuuuuuuuuuuuuuuuauaaauuuacuuuauuuauaugaguauacuguagcuauuuucagacacaugagaagagggcauuggaaccaauuacagaugguugugagccaccaugugguggcugggaauugaacucagaaacucugaaagagcagucagugcucuuaaccgcugagccaucucucuagcccucucuuuucuuucaaugcagggucuauguagcucaaguuaguuuugaaucaaagcaauccucuugccucaacuuccugggugcuggaauuauaggccugugccaccacacacagcuggagaagcaacuuuuuaucuuauacauuuaaaauaaaaaacaaaacaaaacagagguugggaaguggagguucugaggucaaauagcugaucagaauccgaaucugugugauguugccugacauucagaaagaggagaagagcaccaggaaccacaggugggaaaaggacagccccaaacaccagggacagaaggacacagggggccuccaguccuggguccuccaugggggaaggauaauccacagucuuauccacuuaugaccuccccacccccaugguacuagagauugagucccugagagaagucugcucagcuaagaaagugcucauauuaaacaagaacugauacccauuccacacaagauacuagacuuuuuguuuguuuuucaagacaggguuucucuguauagcucuggcuguccuggaacucacucuguagaccaggcuagccucaaacuuagaaauccaccugccucugccucccaagugcugggauuaaaggcgugcaccaccacugccuggcuggaaagaaagauuuugaaaaaacaaaaaucacagaaaugucugacuuggaaauuucaguaaaccaacacacauccugucaccuggaugccuggugacuaauguauacaaauauaccauguacauacacuccuaaauuaauuaauuaaaaaccuaaaacaguggcccacaccuuuaauccuauaugugaauacauauacaauauauaucaauacauuggcacgcauauuucauguaauguauuuaugagugaaaagaaggagccgaaggggaccaggaaggcugcgcuggcaggagugaaugccugacaucccugugucaguggccacgggaagucagacccaccaucucccgagggcggccaccaugcucucugcuucuuuuuuccccuugcuuuauuuacuuacuuauuuuuuaggacagggucucucucagucucccuggcuguccuggaacuuacuuuguagaccaggcuggccccaaacucaagagaucuuccugucucugccucucuagugcuggaauuaauggggugcaccacaacacacagacuuucuuguuuauuuuuuugaggugagguggucucaugcagcccaggguggcuucccuauguagcugcaggucaagggugacuuucauuuccaggccuccagaagccgccucccacaugguaagauuacaggugugcauuacucacccuuuuauguggugcuggggauggaacugggucuuugggaaucugggaaaucccucuaaccaccaagccaccucucuggccuugaacagugcauucuagaacagguggcaugccugcuucugcugcccauuucacagaugaggaacuggugacaaaugcuaaaucuacccagauccccagccagcccuuagccacaggcaggugcccucucugagaaacaggguccuuggucccagagguaaaucauaucagcuugggagaggggaggagccagaaagggacguggaaaagccugggaaagccggcugagcagggcugggaugacccauaggcaaaggccgugacaagcacaggaagaaccaagggcuagcuucagggaaagccuaagggagugcgguggggccuugcuuggugcaucucaggcuccacauggcaccugcagagucucagcaaaggagaaagcugcagagagcagcagugugugugacagacaagagacagaugccccgcaggcucccugagcaggacgccuggaguccuacagaagggugcagucaggccccaggcaaaggcucaccuccugaaggaucuggcugauggcuuuguucugauccaucugcugccaagacagaaucugcuggaaccgcuuguccauuucagccaugcugccagaaaaaaaaaaaaaacagcacaguuacucacugcauauuucuugagcaccuacugugugcugggcaccuacugugugcugggcaccuuagaggagacagagauaaacaaccacucaacauuccugacagggcaucaaggacgaggaugucaaggaggguggcagagcuuccauuuggcagagucaccgggccuugaguccaacccuccacuggaccuucuucacuacacccccugcgguggaugcugggcuccucccuaaccacagcaccuuggagagucacacagcuucuggaauguuccuacuagcauuuccucacuggccguacucuuuguauagcccuacaacacgguugguaauuauggcacagaaccuguaaccucaggcugccaacaucagcacagucuuagcuuuaaguuacuuucacauuaccuuaaacuuuuuuuucuuuuauuggcugggcgauaguggugcacaccuuuaaucccaacaucucuaaauuagaggccagccuggucuacagagugaguuucaggacagcuagggcuacaaagaaaaacccugucuugaaaaacaaacaaacaaacaaacaaaaauuuuuaaaugacuuuaaaaauuuuuauuuuauaugcauggguauuucgccuacauauaauguaaguucguuauauguguguagugcccauggaaaccagaagagggcaccagaucacuucaaacuggaguucauguggguguuaccaaaugaacccauuuacagaagcagccagugcuuuuaacagcugagccaucucugcaggaggguggggagggaggagggugcggugcuggaaagcaggcaaguacucgcacuugcucgcuugaguucuaaggcagggucucaguagcucaggugcugaauucacucucugguuugcucuggaacuccccauuucccggccucuacuuaccaagugcuaguauuacaagccugagcaccaagccagcaaagauuuuacuuucuuguuaguuuuuguuuguuuguuuguuugugaccaugcccccgccccguccccaacuucagcuuugauguagagcgggacagauaacacuuccauccccauacucaggccagcacuuggcacacaggugggcuuggagguagaggccacccucacuuuaucacugucugacccugacucaugagucuggauggaagaauccggaggcuggccguccaucaccugucccugguaaucuguccaaacccgggacggcccagggaguucaguguccagcucucgcucccgucucgggaccccagccaacacccucggagcccucaccugggaacacacauuccuuaccuuaccuggaacaggccugcugcgccaggcucugccucugagacucauaggccaucuggaugagccggcucuuacagcucuccgucagcaucugcugcauggcggcuguggagagaaggcugugagccgcugagaaaaggcuagggaucccggguaaggccaaaggggucaccugcuuacugguggacaguuauccuaaacaaaguccccccgccccccuuuccuuccaucacugcuagauagcccagccuggccuugaacucucaauccuccugucccagcauccugaguuccgugauugcagaugaguaucagcacccagcucuaaaaaauaccuacauugcugggccgugcuggcgcaugucuguagucccaguacucaggagacagaggcaggagaaucucugaguuugaggcuugugcacccuguacaugcagagccuggggaggccagaugauggcacugcauccccugggacuggaguuacagauguccugagccaccauaagguucugggauuagaauccagguccuuuggaagagcaguaacuacugagccagcucucuaguuuuuugguagauuuauuagagcaguaaggggaugggggucaaggcgggggugggggggagcuagagagauggcucagcaguuaagaguacagauugcucuucaagcgguccugaguucaauuuccagcaaccacaggguggcucacaaccaucuguaaugggaugcaaugcccuuuuccaguaugucggugugucggaaaacauuaacaguauacucauauaaauaaaauaaauaaaucuuuaaaaauagagagagcaguucagggccgggaguggcucaguggccguguacuugcccagccugugcaaggccuguucaaucaaagcaaagcacccaggaagugugacaggcuuagaaacucaaaccccuggauguggguccugccucuguggaauuaaccuaauaaacaccauucggugacuuucacagcuguuccuuaacugugaccuugaacagagcugucagugggcugagcccucuguagguguggugaacaccugugugucaagugucuggcucugucugaaagcccuuccaggacaaaggccccaaagauaaggagagcccaucuccauuuuaacuaagggcaagcucagcuucagagacccuccucagcucccggcugcaggcucucagaccugucuggggcaggugccacugguggguacauguggagcucaggaccacacugggcacaccaggaaggggaagucugcccaggagccaagugagcugaugccagcucucggugacagguuugugacaugcccaggcuugaccccugggauccuccugaaggucccauguuuucccuguguaguuucccccacucuauagacagaaaauucgagacucagaauccaagcuuggcugacccuggggccugagcuccaggacagacuuggcugcccuuccacagaguggacacucaguacccugcccggguaacagagaggcuaccugaaagcucuguccagaaaucucccacaacucaccggcgaucucacgcugccugagguucucugucuccuccugggugauggacaucaacugcuccauucuuauucuggagaaaaagcaaaagcaaaacgcauccacucauucuucaaauacauuucaacaagaaucucaccagagccaggcugugauggugcacaccuucaaucccagcacuugggagacagacacaaguagaugucugugaguucaaggccagcaguucuaagacagccagggcuacacagagaagcccugucuugaaaaauaaaauaaugaaaauaaaguccauguaugguacauaaacagacauuggccuaaaagcagcucaaacaggcuuuuauucauccgaggagggucuaucauguagcccugacugcugccuuugccuucagaguacaaacaagguuuuaaaacugauuauggguaugggucuucugccuacgugaauaucuauucuccacauuugugccuggggccacagaagccagaaggcaucacaccccuuggaaccggaguuauagcugguugugagccaccaugugggugcuagggauugaaccagguccucuggaagagcagccaguguucucaucuacugagccauuucuccagccccuauaaacacgguuuuuggcauaaaacucaucuaugacauaagaaguggacacauuuaaagguaacuuugcauacaugcacgcacgcugaaacuuugcauauacacaugcacgcugaaacuuugcauacauacacccacaaacgcuguaaugugcuguuuugcauucaccagaauuggccugaucgauuagugccuuguuccugggugugacuuaguucaaggccuggagucucucagaggcuccacuugcugcuacugauacgagauuguccucugagccggucuagcccagcaccagauauggucugucaggaaggcuugaauggauggcagcaccaguuacugcucagcugcgccucaacagccacacaacaggauuggacuaggcagaccccagggaggacucucaagaucuuccuagguggugagggcuaagaugacugggggaggggagguucccaggauagcucagaaauaccauuaucguggugcccaggagaaucaggagagacacagcagacaccuugggaaggaacaggccaaggugcccuuccuaccaucguuuuguuuguuuguuucuccuuccuuccugucuuuuaaaaauucauuuuucauuuguuuuuuuggacaggccucacuacguuagccuggaacuucccauguagaccaggcuggucuugagcuugggauugucuugauugcuuggguuauagacaugccccaccaugcucagucuuaccuuguguguguguguguauacauaugugcauauauguguaugugugugugugugcgcgaguauacguguuugcagaggccgugggucaaugcuacacgucucccucucucucuguccauaugauuuuuugagacaggauuucucauugaaccuggagcuucaauaggucagcuggccagugagccucagauuccugucucugucccucauccugcaauuacaggcaugcacugccaugcuugaguuuauguggaugcuaggcuaggucugaacucaucucaugccuguguccucaucucaugcaagcucuuuacugagccuucucucaggcccuuucugguacagaauggagcgggacuucuauacugugcaauagaagcuggcuuugaacucccuaucccuccaaacuccugcuucugcuucccugaugcgagaaugacagcugugugccagccugaccuacucucccuuaggacaaauguguucugucucaaaguagccaacuugguaaauacccacgacaaagagaaaaggcaagggccacaacuguacuuccugucugucacagugcccagugguaacccugggaugggucccucugcuuuccacaugcaaaacaucugaagagugagugaggaggcugcuuaaauucuugcccuucuagcaauggagugguguggucaguccuguguaucuguggguucucugucugcugauuaacaauacuuggaaaaacccugugucuguauuggugugagcauauuuccccuaguagagcagagcugcuauuuguguuuguaucguaucguaucguaucguaucguaucguaucguaucguaucguaucguaccggguuuuacagggcucuggagaggguuuagagcagacaggggcugugugaggcucuaggcaaauacuucacauaccugagggacuugagcagcuauugcucuguugcuugggggacaaaaguaucacauucuuuuuuuuacagacaugaauuuuaaaaaauuucauucauuuauuuuugguuuacaacaaggucucucuaugcagcucuggcuguccuggaauucacuauguagaccagguuggccuugaacucacagagauccaauugccucugucuccuuugugcugggauuaaagggauacacaaccacaucuggacuaauuuuuaaaaauguuuuuauaccugaaguacagauagucauuacacauccagcuuucuuccuucauauuuuugaguuuuuuucacaaguguauauauauuuuaggaaacucaaaaagaaucacuauuaguuagaugccaagaggugacccuauccuagagcauuagggugauugcccagcacaagcuggaagggccuacggcugccuuuccccagggcugugagcacccaaggguaucuacccucagaguugugagucccccagcauguccaucucccagggcugugagcacccuagggugucugucucccagagcugugagcacucagggaacuuucucuagacauguggucccagaggcccacucaccucucauucuccagcgauuucagaaucucagaacucuucuuuugccugugggaaaaaccagagaccugugguccugugggcgccaacaaugcugcuuccaaccaggcugcccccucaccacacugacugagccaucaaucacccaggagcucugcucgagcuggggagcccccucuagcucuccugugacagggugaagcacuuccuaggcgacuggguaagcugugggaauacagcgccuggcacggaagcaccagcagggcuuucucuccugaagcucugacagaugacaggggaacaaggccuggaagcaggaagccuagagcuaguggggcaugcggcugcagccaguuucuagaaccuucugcggcggaccccaaacuagguauuuucaggcuucuugagaucucuacuuggcuccuuucucugcaauccugucaugaaguucuuauauuagacagucuguucuauauaagacagccuguugccuauagggugauuggcuaaccucaggcgacaggcuccuuggaagccaaacgcaggaaggcugugauuccugccugcugauauacagaagggaaaugagcugcggggucagcugucuggugacagaaccccauucugagaaccaaacugaaacaguuuucuugguuccuaucagaggagcgcucgggcagggaugaagaccgaggagagccccugguccucagagggcacucgggcuggccaggacugaccucugguuguccugcaggagucucugaaugcggcuggcgaugcucugcuccgucugcuugagcugcuccugcagcugcugccgcucugcauccagacagcgcuggcgcucgcucagguccugcucuagccgugucugcuccugagcgggggacacacaggaaccccacgagugggcacuggagggacucugacugggguaaggagaguggaguuccugucucacucugcagguuccuuugugaccuggggucggucccuccugugucuugugcucaaggucaggguaucuagucagggccuccauugcugcuuccaggggucggcaggacagaguaauccccugcuuugccaccgccuaggcaccacggcccgugcgggucccaggccggcugcugugcggccacacaccugcuugaccgucugcaggaucucguccuuguggcuguggcucugcugcaguagcucagcgugcucccgcugcccaagguccaggcgccgcucgaacuccagcuucuccagcaucuucugcuccugcggggacaagaugucugcccuucaugccuaaaucagaggcagaaggacgccaccccucagcuucugaggagcugcaauccucagggagaacgaaagcagcaggggaagcccuuaccuuccgcuucucguagucggagaaccgauucuggggagaagagcagaggugaggacaggucgguggcugugguuuccacugugcccgccacagcgcacccaaccugccccaccguaugaggagauggaaggagagcugauaaaggguccugggcuccagagcaagaaccaccaugugcugacaccacuguccuucaagacagcccuggaaggcagugcugggcagguggccugggacucagaaagaucaaaacaggggcugccuguauccuuggcuaucuguguaacauacugcaguacccaucucuggccgcccagaccucugcaaacacaaagguacuagacagguccuggagaauuauucuacagagaaaguggagguuaauucagauaaggcccaacaggcacuacagaugaguccacgcaugaaggguacagggcuccugcuuaaucuccucuucccuguccaauuuccauuaacuucuuaaagagacagucacagguacacucccauuaacaacggcaaagcagugaaaggcuuucuggaagacugaggcuacaccaaaggcagcuggaguucccaccuacggccaucaaagaccugacuuugugagcugggaugagagcagagguggcagaggcagguccugccugcugcaguagcagguguccagaugacuguggcaaaccuugccaagguuuccuccacuccugccuccugugccaugcuggccuacagcuggggacuuucuagagccuuccugccacuggcgcugaccuguguccccuucacuagaccagagucauggggcuguccuggccacugaguggcuuguggacaauccggacaugcucuugacucccuugaagcuccgucaugcaguggggauggauuguuuagcacgcaauccuuugcugaguucagcacuguggagugcuaccagggcaacacgaaggacggagagcccagagcaggucugaccugggcuggugauugucuacucugacaaccagggccagugacacggcuacugccaccaagccuggugacccgagauugaucccuaggacccacaguguggcagcaaaggacuggcuccugaggacuguccucugguguucaugugccuuccuucuucuccacaaaauagauuuaaaaaaauuaaaauacacugagaggcuggagagcuggcucugcagcaggaaauuguuucacacaggccugauggcccauggucaaccagaaccugcuaaagagcagaggagaaaaaacccuacgaaguuguccuugagccccaacauauguggcagaguggguacacgcacauauauacacauagagagauuaauaauaaauacguuuuuaaaguuuaaagucauccuuggcuaaauauaaaaaaauaaauaauuacuaagauaaaaugaaaaucaaagccugugcagggaagaguuccaggugggaguggcuugcccggagauguuguggagacaggggcaugguuuguucagggaacagagaagaaaccgggacagcugauguguggugagcugguggccuggggcagccguggucgcugggccugugguucugagggggaaucugugggcacagcucugaacacuucuuuugcuggcagcccucgaugcccaugcaggcacgccccccccaccggcacgcccaugcaggcagcucaucuuaccugccauucagccuccucccuggagaaucggcuugcggguccaucggggcugucuuggguguucucugcuccaucuugcuccaggacuggcagcagguacugagaagguggguaauaguccaguccugacucugugggaagaggcacaggcuggccaggagaccccagcugcuggcucaguccacucucaucuuccugagcugggcugcccugcugucuaacgaucacugccuagugucaggccuggugacauaggcuuguaacccagcuacucagaaaccagaauaacugcaaguucuaagccuucgagggcuacagagcaaguucaagaccagccugaguaacagcaagacccugucucaaaaugaaaaacagaaaaagggggcuggagagauggcucagagguugagagcacugauugcucuuccagacgucaugaguucaauucccagcaaccacgugguggcucacagccaucuaugagaucuggugccucuucugacaugcagauauauauguagaacagucaguguguauacaguaaauaaauaaagcuuuaaaaaaaaaagaagaaaaacagaaaaagggcuggaugaaugguagagcuguugucuacuaugugugagggcccagguucaauccccuagggaguacacuacauaaugucauguauacuugagcucuguagucaggauaugcauguauacucguucauuuuuauuuuucuuucguucauuuuuaugucuguugcuuauauaaacauuagaagaucuuaaaacauuacuuugggccgggcguggugcgcacgccuuuaaucccagcauuugggaggcagaggcagguggauuucugaguucgaggccagccuggucuacagagugaguuccaggacagccagggcuacacagagaaacccugucucgaaaaacaaaacaaaacaaaacaaacccauuacuuugguauugauccucaguagguggcccaggcuggccucaaauucacaaucuuccugugucuguuuccccagguguauaaacauuauagguguauacuacucuauccugauuauuuuuuuccuuuauuuuagcagcuagaaacugaagccaaagguucauguacccuagacaacugcucugcuacagcuggaagaacauuuaaggcaaacacacccuuacaggccagggguggugcuggcccgguacaagcguacuucccagugccugccucucccucuacucucccacagagacucuuccagcuugcuguaagcaguuugcucuuuucaaugcggugugguauucacaugugaguaugaaaucauucauucuauugcugggcacugcuacuagggacagugcgguugugagcggcugcagacaacauggcuucucuuucugucgccagggaacugaguugagggccugaguguucagccugaacagacacugacaacauacagagagggagagggagacaaggucuugcuacauagcucaggcuaaccuugaacucacuccauaacccaggcuggcccaggacugacacucaucucccugucuuuccaagaacucauuaucauacucagcaauagcuuauuauuuauuuggaaacagggucucaaaugucucaggcuggcauguacuauacaccucugcuaccucuggagugcuaggauuauaggucugggcugcuacauacacaguaugugguccuggggcucgaacuuagggcuucacguacagcagccaaaacccagcggcugagcugcugcuccaguuaagacaggucuguggggugccguagccugaccucgaacugcggaucauuuugccuugccuuuucgagacaggguuucuccgugcagcccuugccaucuuagaacucacucuguagaccaggcuggccucgaacucagggauccaccugccucugccucugagugcugggauuagaggugugcaccaccacugucuggcucuccauagacuuuuaauguaacgauuguguagacacugaagucuggcuguuuguuuacauuuuaauuuuauuauuauuugaacaauuuauuuuacaugucugaguguuuucugugucuguguguaugucuggugccuuuggaggccacaagagggcauuggaucucuuagaacuugagcugccaugucggugcuggguccucuagaacagcagccaguguucuuaaccacugagccaucucuccagcccuggagagugugcuuuugaaggacccaaacaguggagcgcaacuacagccccaguacgcaggaggcugaggcaggaggauucuaaguucaaggccaauauaguaaguugguauaauaagaagucagaauacaaauaaaaaugaguccuauugggcagguacacacugcaaagacucgcucgcugacugacuuuuucuucccuagaugguacugucugaagagaacuuuuaguuaacgcaaaggcuaucagccuuacuguuggcgcugugugccuccuguuuaggaagauaucaggucugggacuuuccucaggggauggcauccagggccugacauaucaggugagugcccugugcucuaugccacccccccccuacagcuccaggcuguagauguggccucuuuugcucccugcgcugugcaccauuaauaauucacaugagcagaggcuguacccugagacugucccaggugacaggagccauagcugacaacaccugaggcugcucccuccugguccuagaccaaugggggcccuaagcauuagucccuagugaugcuuaaccucgcuuccuacaagcucaggccacuggggucuccccuugguggccccaggggccugccuagcuggcugcccuccauuuucuuucgccucucucuuugcgugcguuguuacucuacaaugugaucuuugugaaaccagcucuccugcuggacacugccccuccccuuagcuuugcuccauggccuccagcaccccagcuacaccggcccucucucuaucaugcccaggcucuccuacuuccucuaggccccuuaucacugccuccaagcuagaaacccagucuuuuuccuggcccucaggcgucagcugcauucucacaccggccuuccccagccuaagccuccggcgccucugcucuucuaggucacccugggugcucagucccugugaucguucacugugccuguuucccucacaggacccugaccuccagccagguggucuguaccagcuagucucugcuguccccauccugguggcaggggauggcuuccgggggugaccugguuuaccuuugcagaggaacugcugcacggccgcagugccagcgccacacaccucuggugggggguagaccauugccaaggcguugaggcucagcgucuguggacacagggaaccccuucuuuacaguguacaguugaaagucaccugguuuuguuauuaacuugggugcugacugucuccccugacuaccaggagcacccagggggcagagaaggccagguuuaaagagcauugaucccaccuuggugacuuuuguuaucauugguaaaguguaguagcugcaauguggacucugggccacacugcccagucugguggcugcaagucacgugugugcaugugucgcauguguauuucuuguguugugugugcaugccuucaugucugcaaguguggagggacaggggagaacccugaguguugaucauuaggaacuauccacuuugcuuuuugagaugguuucucaccugccuguaacuugguaagcuggcuaguaaggcccaggacccaccugucuccaucuccccggggcugggaucacaggcuccgagcuuuuacagcacuggcucuagggcccgaguccaggcccuuugcaagcacucuccccacggagucacugccccagacccacuuuucuuuccuugagacaagaucuuguuccgugguccaggcugcauugaacuuguggccuuccaagugccaugauuacaggugugcccugucacagaugccaugauuacaggugugcccugucacaggugccaugauuacacgugugcccagucacaggugccaugauuacagguguguccugucacagguaccaugacuacaggugugcccugucacagaugccaugacuacaggugugcccugucacaggugccaugauuacaggugugccgucacaggugccaugauuacaggugugcccugucacaggugucaugauuacaggugugcccugucacaggugccaggauuacacaugugcccugucacaagugccaugauuacagguguguccugucacagguaccaugauuauaggugugcccugucacagaugccaugauuacaggugugcccugucacaggugccaugauuacaggugugcucugucacagaugccaggauuacacaugugcccugucacaggugccaugauuacaggugugucuugucacaggugccaugauuacaggugugcccagucacaggugccaugauuacaggugugcccagucacaggugccaugauuacagguguguccugucacagguaccaugaucacaggugugcccugucacagaugccaucacuacaggugugcccugucacaggugccaugauuacaggugugcccugucacaggugccaugauuacaggugugcugucacaggugucaugauuacaggugugcccugucacaggugccaugauuacaggugugcugucacaggugucaugauuacaggugugcccugucacagguaucaugauuacaggugugcccugucacagaugccaggauuacacgugugcccugucacaagugccaugauuacagguaugcccugucacaaacagcccucacuucaguuuuaauuaguuagggucaccuuggcuauaugagccacauguuggcuugguagccauuaguucuugggcaccagcacagaugacagcauuucuauuaccugaggggaggaguagccauggauucugucucaagagacacucagccuggcuuuaaacccccgcacagucugcuguguguccuagacagguugcuuguaugugcugggaccgggcacucagguaguguacuggcugguuuugugugucaacuugacacagcuggaguuaucacagauagaggagcuucaguugagaaaaugccuccaugagauccagcuguaaggcauuuucucaccuagugaucaaggggggagauccccuuguggguggugccaucucugggcugguaaucuugguucuauaagagagcaggcugagcaagccaggggaagcaagccaguaaagaacaucccuccauggccucugcaucagcuccugcuuucuggccugcuugaguuccaguccugacuuccuuggugaugaacagcaauguggaagaguaagcugaauaaacccuuuccuccccaacugcuucuuggucaugauguuugugcaggaauagaaacccugacuaagacagguagagaggguagcuccagugagcagcacuggagagauugccccugccucaccuccaggguccgcacgugcgccagcaucuggggaagucucugaaucucguucucacuaaugucgaguguccgcaggcuccgcagcucccccagggugucaggaagcuccuucagcuuguugucugcagagacccagauggcaaacucagugccccagagccuccggccgcccagggaauguggccgggaggcugucacugcuuauuagccgagcagcucaggacaccuggccuucccucccggggccucgucucuguaauacagcaccacugucucccaucagucacaggaugagcugacacugugcagaggccaggggcagcaagagaacgaugaagagcuuggaccacggggaggccaguccucuuuggaggaugaaaacacuacccuggcaccuggcuagucacuuaccucacugcagggugggaguccugugcaagcuacugcucugagccucacuuuccucauguuagcugggcaugccccauccucugccugccuugaggacuugucaggccagccacagucguggggccagcaucagucggagugucccgagccacaaggaguggcuacagcagcaccuccuucugucuugcucaucacuacacccuguucccgucacuuagcuuacccgucacuacauuggccugucuucugccccacaagucucugauucugagggucauggaacucuuuacagauauauugccucugguugccauggagacagagggaucuagcgggaggucagucuggccugcagcguugcccucacacucaguggccugacucuggaguugccugaggauggcgcgacagggcuuuguguccccaccuuuuacauugagcgucuggagcugcagcagguucccaauagagcgagggagaugcgugaguugauuucuuuccacauucaauaccuaagaaagacaacagugacaugagccccccccacgggacaacgguggcaucugcacacucagcccuguuccaucgagcgcugaauaugccugcagcagcccugagagggagguauagguugcuguggucccauuuaagacaugggaaaacugagauuuaagucacguguccaagcccuuggacacacgugagggcuuaacauugauacuaaugcaggaugccuaggaauugcaugagccaauguggaaggagaaagguguaagggcucugguaugguuucugcuggugagcaauggggacgucuagcucagggcuagcccuaaaucaagcacucaggcagagcagaagcagcuguagacaaagcaccagggagccuggagugcccagaaucuguccuuuuaaaaaaauauuuaaaauguucuuuuuuacguguauugccuacauguaagugcaauacuugugugcaccaccugugugcaguaccugaagaggccagaagagggcauuagaacuucuaaaacuggaguuguuagcugccaugcugggaacccaaccaggguccuguguaagaauagccaguguucuucaccaccaagccaucucuacaguccuuggacaaaggcccacuggggauuuguuuuugggaggagaagcuaaagcuaugaagccaugaaauaguguggaguauaagccagguucuggaagauucucacagccaggcggcauccaugcugagcauagacggggcccacugaguguggaguacaagccggguccuggaagacugucacggucaugcggcacccacacugcgcacagcuggggcggggcccacugcugacuguacaucagaaccucccuucauuauagaagucuaugcccugcagccuuaccugcaggacugucagcugccccaugucaucaggaagggcugucagcugguucucauggagauccagaaccuacagaacaaacaugucaggcccccaaaucccagacuccagagcagcugacaggugauaaggccaccucguacccuggcaguuugguggugccccuuccuccugcccaccgguccgcauucuaucucacagaucuuuuauauauuauuauuuguaguguuuugagaugggcucucuacauagcacuggcuauccuggaacucacaacucacacuguagaucaggcuggucucaaacuccgagacccaccagccucugagugcugggauuaaaggugugcaucaccauaucuguguuuuuuuuuuaaaagacuuauucauuuauuuuaugugaguacacugucacugucuucagacagacacaccagaaaaaggcaucagaucccauuacagaugacugugagccaccaugugguugcugggaauugaacucaggaccucuggaagagcugacagugcucuuaaccucugagccaucucuccaggcccugccccuuuuuugaagcaaggucucgguauguaguccuggcuggccuugaacucagagaucugcccgccucugcugggacuaaagggauaugccagcacucccaacuccagcagcucaccagcucauagucuucuuuuaagguuuagagcaaggcucuuaagauguagcccaggcuagaucaauucucuugccucagccucuuugucagucucaggauuguagauauucgcuaccaugucuggcuucaguauucucauuuuacugacuauaaaaauuaugcauggccuggggugggacucagaggcagagcggguaaucagcaugguaaaggcuugagcauagccaguucuaggccagcuaggacugacugcauagugagacuacugcuuaacaaaagaaccgccauggagccaaaacuaccccaaccccaccugugggagcuagcguggaggagaguguacauuuucagucuuuacuccuaggguaaaggacccacccuaccagcuucaccuccauacagaauaaucuguggcugaccuguaacuauacuaugaucuaccauguccaggagggauccacagggaggagggaggccaugcuggucacugaggagucaaguugcccucucuuuaccagccacacacaacuauaaacuuuaacagagaacacuaggaggguguagaggcucagcugccaccuggaccccaguccccgaugccuggaggacgcccaguaccuugauggugacaaggcucaagaggcugcaggacuugggaagcagggaggugaggugguuuguauggacaaucaacaccuaggaggaaaggggggaggggagagagagggagagggagagggggggagaaagagugagagagagagagagagagagagagagagagaacacacuguaagagagcagcagacaggaaggcuaagggccuaagggcaagguaauuggcuuggcacagggcggccauguugugcuccgugggcacuucugaaccugacucagagggcuggaaguccuagggugaaagggagucugggagucuagcuauccuuugauucugagaaggggucagcuaucaagagcuugaccuuuccugcuccauggaguaguaaagugccuuucugcaagggcggccaugacaacuaauaagcuaacaggcugaauaguuaguguuuaucccaggcugucaugugauuguuacucagccugugucaaccauggcuguuuuuguuagacguuaacuccugcucagagguaagaauuuugaugcacuauaggcagggagcacguuuccagaccuggugguguucauguauccaccuguguguaaacacuuucaucuccuucuaacugagggaguggcggaacgcauugaguguccuuucuauuaauggcacugguggugguguguguguggggggaaugaggguuccucuaagucucaugugguucccccaagcagacauccagcaagugagucugaacaagacugcucaccuuuuucuguagaacuuugcacguugcaaaagccccaaauggaaucuaagauaagacaaagacggguuagcaccucgucaccuaccagugucucaccuaucucucuguggcgcugguguugggaggugacuaaugacaguaagucacugucugggagaacagugcugagcuaggagagggcuauggaagaggggagcugggggcguugucagcccucuucagucagcuggcaggacugcccagccugcucuggccuaccuauucugugguaccaggaaccaucgacagguggagccucaggcaucuguagauguaguuucccucccccgacuuucccguccugguuaaaugccaggcaccucgaaagcauggugaaugcugccaccgacuuuugccuacaguuuucuguccugccuuucuccaggguuuuacuauguagcccagguugaccucaaacuccccaccucugccuugcgaaugggaugcugggaauacaggugcguucuaccccaccugccucccuuucuaaguaggcccugacuuuugcaaguuauguugaggccaaaagaucaucucaauucuuuuggaaaagaacacaauauaauuucuuaauuagugcuccuggaugugucugugugcgcaugcuugcacacaggugaggcagacugugagcgucucuuucccuaccuuaugcuuugagacagucucucacugaacauagucuguugacucaacuggauggcuggcuagcaagcccucgugcucacagguccagcauuucauugguggagcuaccugcccgucuuuuacuucugccauuuucaaagucucaugccauuaucuguuuuuuccccaaggacccaagaaaacaggacagauuaaauucacagccugcgucauccuguuuaccucagagagcucacauuuagagaugucgagaaugucaucugccccagcuucuuuugccuggggagaaaaagauguuuuuuuaaaugaaauguuuuugagaccgggucucacgucgcuucaaacucaucauguagacaacccugguuccgacuccugucuuccugcugcacuucccaagaacuagcucugcacagccucaagggaaaggcuuuggaaagucaagccuucugggcagugguggcgcacaccuuuaaucccagcucucaggaagcagaggcaggcggaucugagguugaaggcagccuggucuacagagcaaguucuaggacagccagggcuacaccugagauaaauccagccccaccuccuguccccccaaaagucuuccacuccuucuguguguuuacaaaauucugcucauccugugagcauucacuguguuuugcuucuuaagauuagugguggggcuggcaagauggcucagagguuaagaguacugacugcucuuccaaaagguccugaguucaaaucccacaaccacaugguggcucacaaccacccguaaugagaucugacgcccucuucuggugcgucugaagacagcuacaguguacuuauguauaauaauaaauaaaucuuuggggcugagugagaagggacugagcaagcggggcugacuggagggagcagagguccuaaauucaauccccaacaacgacaugaaggcucacaaccaucuguacagcuacagugugcucacauacauaaaauaaauaaauaaaucuuuaaaaaaaaauaaagguuagugguaacugguuaugguuuuucagccuuuuuguuuuguuuugguuggcucucugcauucccuuccugaguucuugcuuucucacccugcccucagugacuggguuaggggcugucugagcacaugcaacauuuuauuuccuggugcaacugaggcuauuucugcagacaggaucucuauagcucaggcuaaccuggacucacaguguagcccucuauagcacugaaccuggggcagucuucuugccucagccucccagaggccaagaucacagguauaagccaccacaccuaguucucaaggcuuuaaaagaaaaaaaaaaguauucagguaaaacauccuuguagaauggagaaaauaagggaaaagcccauagauguaaggagcuggaaggggccacagccacagugacugagguccagcagggaaagaaaccaucagguagugccacacacgcauccugcgaggaagggcacucccagggcugggaaggcagaguuacccagggugcaaaaggggagccgaggagcccgagagaauacgcugagccuuaccagacacaucugguacuccaggcguuuucgagccuccucacuggguuuccgcuuccgaaagaagaggggcauccuccggugugagcucuucuggacccuagaggacggcagagagaucagcgccugggaacuugcacugcguccgaccugcagacaggcagcucagcagugcagcagcugucugcaagacugugcguuccaugugggccgggcugucuaccucauccagcugggcccugagcccacacgacagagcccaacacuuuguuuuacugacaaagcaaagccuagaguagaaagaacagaacacgccaaguacucugggcucgaccuacuuugccacugccccucugcggcgccggcaucacccucccagugcuaagcguuucccccaccaagggaagauucccccaggugccuuccaaggauguucucugaagacucuggacagacucagcugaugagucacuuccagcucuggaaauugucaggauggaaccaucaagaccaaacuggagguagccgugacuugggggaacucaacuauaucaauacuagagagaucuaugaguuaagcaaaaaucaaaaugcaaucuucaggcaccuuagcaggcuuccagcuacugcucauuugguucuccuuacagccccguggagaauccgaugcugaguaaggucauucaucuggugauaugaccuggguuguagaaacaccaggcugggacacuugccuuucaaguccugauccugugccgcuugcacggcuccuuggaccucccaguuuagccaaguuaaucauuguguccugaauucaguagcuggcugcccauagcuggcugcaacuuccagugcugucuaagggccagcaauaggaaggacauaaucauuuggaggaaguguguaacucacggcaugggcucugacaccuaagacauuagcugugucacuuugugucacuggucggagccgguuuccucauuuguaauauggagcaauguugccaaugcuggccucuguggggucagugacuucauguaugucaggucuaugccauagacucugccacaggguaccacacacaugacaaaugcacucagguacuauuacaguugcuaaggagaagagggcuggaggagccuugcaguagaggacacaugugguccugagggauuucaggucuccauuugugggcgugggcugucagaggagguugcugggccugcagggccugcucaggacucuccgcacucaauugcagcacuccugagagacagcucccuccaucccuaucugauggccacgacuuaaaucccuuacagauggcucacuaaugacuagccucccucgcccccauccuccagaucuacauuuccaaauaccuucuucaaugacuaucucugccaauucccccucccucaccguucucagcagggcucguucaguucugguuugaacuuuccugaugguccagcuuggcugggaagaaccacacccauccuucccuggcagggcuggccagcggcuaaccuggcucuguggauggggagguccuccaccgauguuccgauucuuggguggaccucaagguaggccagucacuccgaagacuuggccacagauacaaaccauuggcccccaaaagcugagcugguguccggucuccuucaaacauagaagugagcaccgaaacuuuaaauuucagaaagacacgcaacucaggaugacaaagucucgagauucuagaaaccaaggaauugcagaauuaaagacucgugauuagacucgaauaguuuguuucuguaacuaacaugcacauaccgcaaacagguuaggaggguacuaggguggcacugguacuagggucgcucaagucaggugcagaucccuuaggggaggggcggggcccugggcugggucccaggggcuccagagucaccgucaagagaagggaacguggaccaggaaccaggaccucuggugcagcccuacucuguugcccaggcaaggugcuccgaacauuuaccccuuccgaaucccgagcucacccacagaccaagcucugcaguccucugccgcagacgccugcccauaagaaacag

SEQ ID NO: 769 - RNA, 3925 nt, Mus musculus
uagaaaaauguguuacggucacaugugugcagugcccacagcagaaaagccauaaaauccccaagggcuggaauuacaggugauagccucuugacaugggugcugggaaacacucagguccucugcaaaaggcaacuuaaagacgccagcaaauccuugggaaccagggaguuguggaucagaaauugacuagguccucuggcagaaaaacugagacaucuccaggguucuauuuuaaaugguuucuccuggggugaccuuguacuuaagaucuaccucagccuccaagguggccacaacuauagccugugccaggagagagcuugugugcucuguggcuuguuacugauauugcauuuucuccagagaauugguuucuagaaacccauaccuacagagaaagcaucacauacaaccaagugcuucacaguauggugacauugcuuggaucuugguagcacugacccacagcacaacgaccuggggacuguaaccucaguuucccuuuaugguaaagaggacuccacaaagccgggggugguggcgcaugccuuuaagccagccuggucuacagacugaguuccaggacaaccaacaaccagggcuagagaaacccugucuacaaaacaaaacaaaaaagaaaaaaggaccccacaagacagcacaggccuccuuggcgccucccuccuagccaccagacuagacuggugagcaggauguggcuuagguuaaugcugaccaugccuauuacccaucuggaaugguugugaaccaccuugagugcugggaaucaaauucagguccauuugaugucccacucaagucacugcugcagccccaacaauugcacuggguuugcuucucuaaauacaauuuuauuggaaaaaugcaaaggucacaaagcauuauuuucccuuguguuguuacugcuacugccauugguccagguuuacgcugcucuuucaauaugcccugcuguacuuaguagcuuuuguuaauuguagauaucuaccaaaaccacauuccccagacuuauggaaaauguuaaggauuaaugcaauugcuaugccagagaucccacuguaccuccaggauggggaggauccagagcaagcuuuaguguaucauccaucugacuuaagacucauagcucugaaccucccagccacgcccacagaagugccuuuccuucuaggcuguacuaccccaggacuuugaaucagugcuuucuagauccugcuaccacagccauacugaaccucccaaaacccuccccuggccccaaaaagcagccaagcccauucacugguuaucagauagucuuuuauuggaauauuuucuuguugcuucuuaacucugugggaaaagaaauauugucaaucacaacagggaauauaaguuaacaaugccccaguaaaacaccaaaaguaaagcaacaaaaguccagcuuucccccagccuaacugcuucccccuuauauaacagucacuuacagcugggcacuccacugcaccacuguugaugucaucuaugaugucaugaggguggcggccauccacauugcagcccacagacugugcaguacccaggaucuccuugauaguuccuacaguaagaaugguggccucagucacaggggaaagaauuccaggguuccauugcaggaacacagggaaaaaauauggauccaugggaaaauccaaaucuugaaccuucaacagcaaaguggcagccaccacucagggaaaauagcgugcucuuaccagaaaguucucuagccaaagaccggugucucaucugccgggcaauguugacaaucucaucaaaaguaauguucccacuguguuuaacugcagaaagcaaguacagggccuuuuacagcuuccccugucuucugagaucauggcuccauuuuaccuaucgcugggcuguucccaugcuuucggcacagagccauccacauguaggacagcccuguuuccuaaaagcuggggcucacugucagcucaccacuggauugcaccagccaacaauacuggucaggugcaguggcggguggcuggggcacaagcaaguccucaccagcagcccuaacacgauuuuagggauggaaacagauaaaguuaaaccccugaggcacuguuucauuucugcacccaggaaagggaacagacaacagacgccuacugugaucucauuccaccccuaggucccaagaaaggggucgacacagcugaguagcacacugcagcggaaacccagggaguggggccgacucacuguucuucugcuucuuccugucucucgguggcuccuugagggcuuugaugaucagggcugaggcagaaggcaccaccucgaucugcaaagagacuugaugugaacacagcccagaaaaccaaccaccaccagacacgcuaaagggccccgaaaaaacagcucggcuagcuaaggugcuuccugcuggccucaccuccagaguugaaucccuagcauggcggacuccugcacccuggcaccuacuacugacuuacagugaacccugucguauagcccucccacaaggauaaaauccgauucaccgggacagggaaaucuuugccaagacccaugauuccugagggcugcuaucucaacccuucccucaaccccccacagcaagcaauguaaauaccugggccugucuguucuggauggucaguuucacuguaauucugagacccuuccagucaccgguagccuuggcaaugucaucgccaacuuucuucggagacuguagaaauaauagcauucguuaccaugugcccaaaguugaagccaggaccuucaagcucaccgccagcccuccucaccgucccacaggagccugcccacaauggcuccacauccuucuucacuaagacaacucugcaguaagggcuaacaaagcaaaacacuuucugcugcaauggggaacccucggagcuuuaaacacuagguucccgugcguuacccacggaggcuaguggauuuaagcaaguccaauggcugccucaaccgggcuguggcacgagccuccgugcacguguuaucucaguuuuccuuugcgucccaagucccagcacccacaucccggccugcaccagggacaugguggccucuucugcccuccacggggacagaacacaucuacaggccaaacagcaugcacguuagaggucuacggcucgggagcgacgacuuaccagacccagaggaccgaucuucggggccaaggcggauguggcgccgaccucgccuccggugcaccucagguacacugaagaaaaagcaaaaucagaaccucugcggcgcaggccgcccugcgcgcugccgucgggcuucagaugucccgggccaggccuuacccuaaggcgcacgggccgccagagcgucgggcucccuccccucuuacacacguggcagccaaggcccaagggagacccgccaggccccgggacagcacccgggcgcggcgagggcacgcaccgacuuugaccucguuggggucgaacuugggcggcaugguggaggcggcuggugucggaugaacccggauucgggacgaccgaagaaaguugcaccguugccuccuccgagccgaaagccgaaaagacggauccugcuccgcccacgccggauauaggcggaaaagcucagcucucgcgagaaccgcuggccccacccagucucugggcgacacccuggucgcccuguuucuuaugggcaggcgucugcggcagaggacugcagagcuuggucugugggugagcucgggauucggaagggguaaauguucggagcaccuugccugggcaacagaguagggcugcaccagagguccugguuccugguccacguucccuucucuugacggugacucuggagccccugggacccagcccag

SEQ ID NO: 770 - RNA, 9109 nt, Mus musculus
uccacugaaguugaacaguaagaggcuuuuuauuuccugaaacucaacaagauaugguggcuaaugacccaggacacggagcccaggaaagagccagaaagaaccuguaagugauggguaagcuggcuggccccagggugaccccggagagucucugcgcagcucugaggagggcuugguuggcaagaacauucucucuucuaccugggcucaccugaccuuguuucugagcccauauggcuaagucccuuucugaucucccagucaagugagguacaggcggcugcuuaggaccgggcaccccagccaggaaacgggagccaggagcccucaggucccuucagcugccucagucuuaagaaggagacaccugggucaggugaggaugcacagcuccucagauguccugugugugaagcaggcugcagagaccgcacucagagucuggugggccucacggugggaaucuggguugagaucugggcaaagagggcccugaggugaggagucagggggccuccaggcucaaacugagguguggcuuaguuacaggccacuccacuccuucugaaacccaaaggcagcucagcucggggcucccaggcacagaaagggucugucaucgucccucgaaaugggcugugacuuguuccagaguccugccuuuagucucagggacaacggucagugugaauaggacacugagagcgcagaaggcagcggugagccagaaggcaccguagggucugagcaucuccugcagagagagcaaaggcaugugaggcagcagaggacagacugacugaagccugcccugacaggccugucacgucucugcagacccagguauguagggaauagcucaccaccacccauggcaaugugugccugggaaagcgaggcucaugggaauguugugacugcccugagaucagcagugucaagggacagcuaggugccuguuccuggccggcucaggcuugccgccauuaaucuucucccuuagccccugcgccuuuggcucugccuuccagugucccaugcuaugaguucucugugugaugacgaaggggggaagugucacucuugagagaggguaggguaguggggagguaguuagucugugacccugcaaaguccccauuccucaguucgcugcgggagagguuacuaggugacccuuccauucucagccucuuagacagggugcuggccugggucacugauggguuugucugucuccuccuuucuaugcuucuuuccccagguccuuugcugucuguccccucucacgugccaugaugggucucuguuugccuuccucugggcacccuguccgccugaguacaucucuggcuagcuggauagacaugccaccuacugccuucuuggcaccugucaugagauggacccugaucaacucaguugcuaccaucucugaagccuugaauaggccugggcauggcacaugccaggagaucuguaggguaccugugaugggacagauggcaugcucaucugcccaggaccucucuaguggcugggaagccagcggguucgagccucagcugacacacgaguaacgagagggaaauaaaguacugacuggaacgagcaccucuucagcccacgaggaaggcaugugcaccccaacacagacuuaagacuuaggggaucacgggccaaguucauuguuuugucuagccucuggcugcaugucaccccugagauggccaugcuccaggcaugaggggaccucagccuacacucaaggucagggacauggaaucucuggcaauggaaacugaaguagaggcgagccuuugcugacggugugagggaaggcaugggccugcacucaccaugacgcugcugaacucuuuggucacuagaaaggccaugaaccaguuggugaggacacagaugccgguagccacacccuugacaugcagagggaagaucucugacaugaggagccaggggauggguccccagcccaccgcaaagccugugggaacaaggcagaguuacagcgugcacacugggcuaggccuuagggguccuaucugcucucaacccugcugggaggccuugggccagccccugcccuuucagguaucaagacaaggaugggaccugcuugcaagcugucauggagauuauaugaaaggauuuaguucagugcccaguacauggucagagccauuagcacagaagucaugcgccuaggggcaaagggguaaaaccaaguaaaacuagaugugaagcugagugcuacagaacuuggcacuguggagggacaacagccuccacccaggcuccccugaguccccuuuaccagcaaugaagaggcacaugcugccuacagccagccaggccagucccacuuggacauccacaggcuccgccgcgaugggcaccaggccuacgugggaggaguugcuggggaggcucugggucaguuugaaguagguaccaaaggcacucauacugaacaccaugaucacaccugcaggcaaagacagcucaggcuagacaggaugcuggggaugcggcagcacccaggacuuagagggcaggguggcucucugagagagucuugcacggaagccccugacuggccagcacuccuacccugcuuuggaccucagaccucagcaaaugcugggaacuucccgaggagucucucugcagcaugagcaggagcagcagugucaaaccccacacccacagggaucgccacagcugccuggggcuccaugcauguggaggcccaagcuacugcccagagccugacaucaccacagcccuuucccuaucucagaguaggaaacgggcuuggggacagucacuugcucaaaagaaccagucauaaaggaucaccucccuggcccugucuccccgugggagcuggggaggcugagcccuccccgucaggccucacccgacaaggccaggagcagccuucgcccugcucuguccaugaugagggccgccacagcagugaacaggaccuggauuaugcccacagugaccgaggccaggcugcuguccugggggaggggagaagcuagucugcuagagagagacaaguccuuccccucucuggcugagcccuaggcuccaggaggcgugaggcaagcuggggagaagccucuuaccuugaacuuggccuccucgaagaugcuguuggcauagaacaugauagcauugaccccugacagcugcuggaagaccaugagggaaaugccgaugaugaggggcuuguagaugccagggcgccucagcagggccagcuggaagcccugucacaaagacggccugucagugcucucuccugacccaaggacccuucgguggaggggacugagccuccuugcuguccccaccccaccugcugcccugagugugcagauaggccccugcagccuccucacgugggaggggagcugugaggggcugcacacuccagcaucuggguaaaggauucugcugcccgagagccgagcccuuugugugcucagggcuggccuccagcagccauguacacagaucucagcacuuccgggugauggugugggcuagcuagagaugaaggcaccaagacucggagauggccaggccacacaguggcagugucugugugcuacugccucugagaucuccucugccuaugguucccauuaaaucuaagcccucacccauuucuucucgcaggccuggccauucacuuguugggggaugguacgaacuaaaguggggcuccagccaacccccaccugcucagacagcacugguccucacugaggguggggguggggcugccagucagguguguggccuugggaacaggcucugcauucugcccuguucucagucucucaccuggugcucagccccaacagggggcucuucccagcccuccucagagccccacaggaagcgcaaggcagccauggccuccugguacugguguugagugaggagaaaacguggggucucgggcauguagcacaugagcagcagcaugaggguggggggcacacagcccagcacggccagccagcgccacucuaggacccagccugcgaagacagaugucaaagccagggugagccagccuagcccccuugcaagccccgggacucacuccaaugauaggaaucucacugccucugcccacauguugguuaaagaaacaguugcuacuaggacuguuccaucaggacguuaggugacaucuuuuaagggaaauacagauggacugcacagaagauguaaauuauaacagcuggaagaugcucauuaacaagccaugucuuguagccaugguaacauaucauagcgcacagcgguagacaugcuaggguaaggcaaaugcuguacucugucaugcccaauggugcaaaauacuugcuacugccaaaugacugcuacagcuuugauguacuugcuacauuauacuuuuaaaguaauuuuuaauuuaugugugugugugcaugcacgaacaugcacccaugcaugagcauggaagccagagggcauccacugggugugcuaucgcugucugccuuauucccuagauugggguguuccaaugaaucuggagcuaagcuagugaucagaaggugccagcaucauccuguuucuuacuggccauggugcuggaguuacaggaacucacgacuacacuuagucuuuuauguggguucuaggauuugaacucagguccucgugcuugggcagaaagcucuucuauuugcucaacgauuucccaaaccuuauguuauacuuguaucauaauuuuaucuuuuauucaacuaucuuuugaacgagaagggcccccacaugcucauguuugagaaccugguccccaguugguggaaugguuugggcauuccacggggcaaggggcgggggaaaguccuugccauucccaguuagaucucagccuacugucuguggagugagaugugagcccucggcuacugcuccaucaccacgccuaccugccugcggccaugcucccauuauggggauccagaggugauggauccucuggaacuacaagccccaaauuaaauguuuacauuuauauauagauggccuuuggucauggugucuugccacagcaauagaaaaguagcuagaacagagugugggugcaugggcauucaggguacagcacucauggggaggucagaggucagccugugagcaucuguucacuucagcaguaaggagcuuauagcuggccccacaaagucuagugacugaggcacuacuguucccaccgugucacuuucugcugucacagcuaacucauagcagugggucaaaaggacaccauaggaucaaugcaaggcaguaugaagccacacuggaguuaacacugugguugauagacaccgacuaucuccacaggacgaugacaacaucuguucauaguaggggcucuaguccccuagagggcucccaaggcagccaagcugcuggcaagacacugaagagccaggacaauaagggaguuaaaaaugaaagaccgggaccuguguaagguccaccgggaagagccagugugcgcaccgcaaacuaggugaagccugucagugccccgaccccaguucucacuggggaugcguuagcaggcacuuuucauacgcuacuaaucaccugguccuaacagcucuggagaugugggggugagaaugaagcuggggggaggggcagugaaacccagcagguggccaugugucaggucugaaggcuccacgccuagugagauauuacaggauauuaguuuauuguacauaaaaacccacuuguuagcaaaauuauaaaaugcuuaguuugucagaugcacuggauauguccagaagagaugcaguuagggugugucucucaaagccuccauagauaagaaugcuaaagaguggaaagauccuuccuauuuuaagauaaguggcuugggagaagucgugaggccuuugcucuguaaagcgggucagcuggauagccugggauaccuccccccauauuuuacaaggcaaaauaguacaaccccuacuggcugggcuuagcugugaaggagauguggcucggccugccaaggggacagggaggaccuggaccucugagaacaaucucucucacuggcucucacucuuucuuuuggcuuggaagaacuucaugggaagagcuccagauaagagacagagauccugccgggcgugguggcgcacgccuuuaaucccagcacuugggaggcagaggcagguggauuucugaguuccaggacagccagggcuacacagagaaacccugucucgaaaaaccaaaaaagaaaaaaaaagagagagagagacagagacagagauccccucuuugggcuugcaagagccacagagaagcaguggcaggacacagguaaaucaguauucuaggaaggagaagcuaagggauuucuaaagagcgagcaguuuaguuguaggcuuauaacucgacauuuuguacauaguugagaaaauaaaaucaccucauugagcucacaggucucaguuaacaccucccaugucuuuauugguauaaauguuuguuaaguuuaaaagaauaaauauuacaaggagguaauuucuaaagccuccccaggccaccagcucugccccucaucuuuggggagcagccuccuuuaugugacauucuccugagaacucagugccagcaugcagaaacuccagcuccccaagugacugagcuaaaguguuucccuauaucccacccuuccuugcacuggaacccccugacucccuccacagcgcggugggauucugggacagagaaaccaccugcucuaguucuuccuggcaccggguuaccaggccccuccccccagcccuccaagcugugugaccgagaaccuggcacccugaccagcagcaccaggcaaacucuuguccucugugaaccucaguuuccagagugaccgcauagccucuaacagggaucaaagaaagcacacaaaucuaccugccacauaggccaggaggaugccagugacaaccaucagcugcacacaggagccgagcaguccucggacagcuggguaggcgauuuccgagauguaaaccuauuggugguuaaggugagauuuuacuuggcucuuugaaaggaaagguuuaacuguacgcuauaggccagcagagugccccuccccauuuccugcagauuuuuuuuuuuuguuuguuuguuuguuuuuuuuuuuuuuuuugguuuuucgagacaggguuucucuguguagcccuggcuguccuggaacucacucuguagaccaggcuggccuggaacucagaaauccgccugccucugccucccaagugcugggauuaaaggcgugcgccaccaccacccgguuucccgcagaguuuuaaagaggauuguggguaauggguugccauuaugugugugagcacugagagaggagugcagagcuuuccuacccugguuugcuugcuugcuugcuugcuugauugauugauugagauagaguuucaugaagccuaggcuagcuucccgagcugaggaaaaccuugaauuccugaucuucauguauuuaacccucaaguguugggauuacaggcaugugccaccaggcccagcccagcacacauuuaauaugcacagaugugaguuagaacgaaagacuucucccuugcugucugauguguccuuguucagcccaguccuaacaggggugccaucacuucuaaucucaggagucacuagacauuauccauacauacuucuagauuauccuauacuuuaugcucuaguaaaaacaaacaaacacaaaacaaaaacaacccacagguccccagucucccuuuccucuagcuccuucacgccuccaacagaugaagaggauaagcaggaggccauggaagugaaggagggauggguggucauccaaguguguagccacagguugcuggugacccucaguugcuagggucuaaaucuuuucagacacuaucccgggccagcaguuuccugugcaaaggccgaaaccaccucgggacuaggccuuacuuuacaggggggcacugaggcugggagagaagccuguguccagguaagugguccaggugugugggcugcaagguauauguagccuucacugcaagcagugaagggagccugcagccuauccuagggacaaaccagaguagaacugcccaguuaacaagaaaauaggggcauucccguuaucgcugccuagcauacagugacaccaccauaguagaguaaaagaucaguaaggaacugccucgcugcugaccggcugcccccugccuggcaaaggucaucuaggaggcucaaaccacucaccggugccacuagugaggcgacuccgcaggcaaggccggugaggaggcggccuccgagcagcauccacacaucccgggccgcggugaugacagcaaagccagucacgaagggcacggugcagagcaagaggcucagcuugcgcccugcacgguccaggagccagccgcccaguaugcccccugcagcagcgcccagggucacgacggccuggggacccgggacgggcugaagaggaggccaccaggggccauggcccacgauccuuccaccccacgcccccuagucucagaggaaagagaaugaggaggauccuggggugcggcagagagugggggacccaggacuccccagagggcucaccccgaaccaggaggccgcauugucuccgaggcgcagggccgggggugcggugcgccgcaggcuggggauggcgggggagcuguagccgagcgcgaagccgaagcugaggggucccagagcggcggcgaaggaagcgaggaagacccggcggccgcggggaguccuacggguacaaggcggggcgugagcggugucgccgggcgugagagagugaccgcggccccugggaguccucaccuggcuuccgguggccgcaauagcggcugcgucuccuggggguccucgggagacaugucagcaggaccugacccgcgaacugucgccgcucgggcgagcgcggccuccgcugcaggagugaccaaug

SEQ ID NO: 771 - RNA, 9109 nt, Mus musculus
cauuggucacuccugcagcggaggccgcgcucgcccgagcggcgacaguucgcgggucagguccugcugacaugucucccgaggacccccaggagacgcagccgcuauugcggccaccggaagccaggugaggacucccaggggccgcggucacucucucacgcccggcgacaccgcucacgccccgccuuguacccguaggacuccccgcggccgccgggucuuccucgcuuccuucgccgccgcucugggaccccucagcuucggcuucgcgcucggcuacagcucccccgccauccccagccugcggcgcaccgcacccccggcccugcgccucggagacaaugcggccuccugguucggggugagcccucuggggaguccugggucccccacucucugccgcaccccaggauccuccucauucucuuuccucugagacuagggggcgugggguggaaggaucgugggccauggccccugguggccuccucuucagcccgucccggguccccaggccgucgugacccugggcgcugcugcagggggcauacugggcggcuggcuccuggaccgugcagggcgcaagcugagccucuugcucugcaccgugcccuucgugacuggcuuugcugucaucaccgcggcccgggauguguggaugcugcucggaggccgccuccucaccggccuugccugcggagucgccucacuaguggcaccggugagugguuugagccuccuagaugaccuuugccaggcagggggcagccggucagcagcgaggcaguuccuuacugaucuuuuacucuacuaugguggugucacuguaugcuaggcagcgauaacgggaaugccccuauuuucuuguuaacugggcaguucuacucugguuugucccuaggauaggcugcaggcucccuucacugcuugcagugaaggcuacauauaccuugcagcccacacaccuggaccacuuaccuggacacaggcuucucucccagccucagugccccccuguaaaguaaggccuagucccgaggugguuucggccuuugcacaggaaacugcuggcccgggauagugucugaaaagauuuagacccuagcaacugagggucaccagcaaccuguggcuacacacuuggaugaccacccaucccuccuucacuuccauggccuccugcuuauccucuucaucuguuggaggcgugaaggagcuagaggaaagggagacuggggaccuguggguuguuuuuguuuuguguuuguuuguuuuuacuagagcauaaaguauaggauaaucuagaaguauguauggauaaugucuagugacuccugagauuagaagugauggcaccccuguuaggacugggcugaacaaggacacaucagacagcaagggagaagucuuucguucuaacucacaucugugcauauuaaaugugugcugggcugggccugguggcacaugccuguaaucccaacacuugaggguuaaauacaugaagaucaggaauucaagguuuuccucagcucgggaagcuagccuaggcuucaugaaacucuaucucaaucaaucaaucaagcaagcaagcaagcaagcaaaccaggguaggaaagcucugcacuccucucucagugcucacacacauaauggcaacccauuacccacaauccucuuuaaaacucugcgggaaaccggguggugguggcgcacgccuuuaaucccagcacuugggaggcagaggcaggcggauuucugaguuccaggccagccuggucuacagagugaguuccaggacagccagggcuacacagagaaacccugucucgaaaaaccaaaaaaaaaaaaaaaaacaaacaaacaaacaaaaaaaaaaaaucugcaggaaauggggaggggcacucugcuggccuauagcguacaguuaaaccuuuccuuucaaagagccaaguaaaaucucaccuuaaccaccaauagguuuacaucucggaaaucgccuacccagcuguccgaggacugcucggcuccugugugcagcugaugguugucacuggcauccuccuggccuauguggcagguagauuugugugcuuucuuugaucccuguuagaggcuaugcggucacucuggaaacugagguucacagaggacaagaguuugccuggugcugcuggucagggugccagguucucggucacacagcuuggagggcuggggggaggggccugguaacccggugccaggaagaacuagagcaggugguuucucugucccagaaucccaccgcgcuguggagggagucaggggguuccagugcaaggaagggugggauauagggaaacacuuuagcucagucacuuggggagcuggaguuucugcaugcuggcacugaguucucaggagaaugucacauaaaggaggcugcuccccaaagaugaggggcagagcugguggccuggggaggcuuuagaaauuaccuccuuguaauauuuauucuuuuaaacuuaacaaacauuuauaccaauaaagacaugggagguguuaacugagaccugugagcucaaugaggugauuuuauuuucucaacuauguacaaaaugucgaguuauaagccuacaacuaaacugcucgcucuuuagaaaucccuuagcuucuccuuccuagaauacugauuuaccuguguccugccacugcuucucuguggcucuugcaagcccaaagaggggaucucugucucugucucucucucucuuuuuuuuucuuuuuugguuuuucgagacaggguuucucuguguagcccuggcuguccuggaacucagaaauccaccugccucugccucccaagugcugggauuaaaggcgugcgccaccacgcccggcaggaucucugucucuuaucuggagcucuucccaugaaguucuuccaagccaaaagaaagagugagagccagugagagagauuguucucagagguccagguccucccuguccccuuggcaggccgagccacaucuccuucacagcuaagcccagccaguagggguuguacuauuuugccuuguaaaauauggggggagguaucccaggcuauccagcugacccgcuuuacagagcaaaggccucacgacuucucccaagccacuuaucuuaaaauaggaaggaucuuuccacucuuuagcauucuuaucuauggaggcuuugagagacacacccuaacugcaucucuucuggacauauccagugcaucugacaaacuaagcauuuuauaauuuugcuaacaaguggguuuuuauguacaauaaacuaauauccuguaauaucucacuaggcguggagccuucagaccugacacauggccaccugcuggguuucacugccccuccccccagcuucauucucacccccacaucuccagagcuguuaggaccaggugauuaguagcguaugaaaagugccugcuaacgcauccccagugagaacuggggucggggcacugacaggcuucaccuaguuugcggugcgcacacuggcucuucccgguggaccuuacacaggucccggucuuucauuuuuaacucccuuauuguccuggcucuucagugucuugccagcagcuuggcugccuugggagcccucuaggggacuagagccccuacuaugaacagauguugucaucguccuguggagauagucggugucuaucaaccacaguguuaacuccaguguggcuucauacugccuugcauugauccuaugguguccuuuugacccacugcuaugaguuagcugugacagcagaaagugacacggugggaacaguagugccucagucacuagacuuuguggggccagcuauaagcuccuuacugcugaagugaacagaugcucacaggcugaccucugaccuccccaugagugcuguacccugaaugcccaugcacccacacucuguucuagcuacuuuucuauugcuguggcaagacaccaugaccaaaggccaucuauauauaaauguaaacauuuaauuuggggcuuguaguuccagaggauccaucaccucuggauccccauaaugggagcauggccgcaggcagguaggcguggugauggagcaguagccgagggcucacaucucacuccacagacaguaggcugagaucuaacugggaauggcaaggacuuucccccgccccuugccccguggaaugcccaaaccauuccaccaacuggggaccagguucucaaacaugagcaugugggggcccuucucguucaaaagauaguugaauaaaagauaaaauuaugauacaaguauaacauaagguuugggaaaucguugagcaaauagaagagcuuucugcccaagcacgaggaccugaguucaaauccuagaacccacauaaaagacuaaguguagucgugaguuccuguaacuccagcaccauggccaguaagaaacaggaugaugcuggcaccuucugaucacuagcuuagcuccagauucauuggaacaccccaaucuagggaauaaggcagacagcgauagcacacccaguggaugcccucuggcuuccaugcucaugcaugggugcauguucgugcaugcacacacacacauaaauuaaaaauuacuuuaaaaguauaauguagcaaguacaucaaagcuguagcagucauuuggcaguagcaaguauuuugcaccauugggcaugacagaguacagcauuugccuuacccuagcaugucuaccgcugugcgcuaugauauguuaccauggcuacaagacauggcuuguuaaugagcaucuuccagcuguuauaauuuacaucuucugugcaguccaucuguauuucccuuaaaagaugucaccuaacguccugauggaacaguccuaguagcaacuguuucuuuaaccaacaugugggcagaggcagugagauuccuaucauuggagugagucccggggcuugcaagggggcuaggcuggcucacccuggcuuugacaucugucuucgcaggcuggguccuagaguggcgcuggcuggccgugcugggcugugugccccccacccucaugcugcugcucaugugcuacaugcccgagaccccacguuuucuccucacucaacaccaguaccaggaggccauggcugccuugcgcuuccuguggggcucugaggagggcugggaagagcccccuguuggggcugagcaccaggugagagacugagaacagggcagaaugcagagccuguucccaaggccacacaccugacuggcagccccacccccacccucagugaggaccagugcugucugagcagguggggguuggcuggagccccacuuuaguucguaccaucccccaacaagugaauggccaggccugcgagaagaaaugggugagggcuuagauuuaaugggaaccauaggcagaggagaucucagaggcaguagcacacagacacugccacuguguggccuggccaucuccgagucuuggugccuucaucucuagcuagcccacaccaucacccggaagugcugagaucuguguacauggcugcuggaggccagcccugagcacacaaagggcucggcucucgggcagcagaauccuuuacccagaugcuggagugugcagccccucacagcuccccucccacgugaggaggcugcaggggccuaucugcacacucagggcagcaggugggguggggacagcaaggaggcucaguccccuccaccgaaggguccuugggucaggagagagcacugacaggccgucuuugugacagggcuuccagcuggcccugcugaggcgcccuggcaucuacaagccccucaucaucggcauuucccucauggucuuccagcagcugucaggggucaaugcuaucauguucuaugccaacagcaucuucgaggaggccaaguucaagguaagaggcuucuccccagcuugccucacgccuccuggagccuagggcucagccagagaggggaaggacuugucucucucuagcagacuagcuucuccccucccccaggacagcagccuggccucggucacugugggcauaauccagguccuguucacugcuguggcggcccucaucauggacagagcagggcgaaggcugcuccuggccuugucgggugaggccugacggggagggcucagccuccccagcucccacggggagacagggccagggaggugauccuuuaugacugguucuuuugagcaagugacuguccccaagcccguuuccuacucugagauagggaaagggcuguggugaugucaggcucugggcaguagcuugggccuccacaugcauggagccccaggcagcuguggcgaucccugugggugugggguuugacacugcugcuccugcucaugcugcagagagacuccucgggaaguucccagcauuugcugaggucugagguccaaagcaggguaggagugcuggccagucaggggcuuccgugcaagacucucucagagagccacccugcccucuaaguccugggugcugccgcauccccagcauccugucuagccugagcugucuuugccugcaggugugaucaugguguucaguaugagugccuuugguaccuacuucaaacugacccagagccuccccagcaacuccucccacguaggccuggugcccaucgcggcggagccuguggauguccaagugggacuggccuggcuggcuguaggcagcaugugccucuucauugcugguaaaggggacucaggggagccuggguggaggcuguugucccuccacagugccaaguucuguagcacucagcuucacaucuaguuuuacuugguuuuaccccuuugccccuaggcgcaugacuucugugcuaauggcucugaccauguacugggcacugaacuaaauccuuucauauaaucuccaugacagcuugcaagcaggucccauccuugucuugauaccugaaagggcaggggcuggcccaaggccucccagcaggguugagagcagauaggaccccuaaggccuagcccagugugcacgcuguaacucugccuuguucccacaggcuuugcggugggcuggggacccauccccuggcuccucaugucagagaucuucccucugcaugucaaggguguggcuaccggcaucuguguccucaccaacugguucauggccuuucuagugaccaaagaguucagcagcgucauggugagugcaggcccaugccuucccucacaccgucagcaaaggcucgccucuacuucaguuuccauugccagagauuccaugucccugaccuugaguguaggcugagguccccucaugccuggagcauggccaucucaggggugacaugcagccagaggcuagacaaaacaaugaacuuggcccgugauccccuaagucuuaagucuguguuggggugcacaugccuuccucgugggcugaagaggugcucguuccagucaguacuuuauuucccucucguuacucgugugucagcugaggcucgaacccgcuggcuucccagccacuagagagguccugggcagaugagcaugccaucugucccaucacagguacccuacagaucuccuggcaugugccaugcccaggccuauucaaggcuucagagaugguagcaacugaguugaucaggguccaucucaugacaggugccaagaaggcaguagguggcaugucuauccagcuagccagagauguacucaggcggacagggugcccagaggaaggcaaacagagacccaucauggcacgugagaggggacagacagcaaaggaccuggggaaagaagcauagaaaggaggagacagacaaacccaucagugacccaggccagcacccugucuaagaggcugagaauggaagggucaccuaguaaccucucccgcagcgaacugaggaauggggacuuugcagggucacagacuaacuaccuccccacuacccuacccucucucaagagugacacuuccccccuucgucaucacacagagaacucauagcaugggacacuggaaggcagagccaaaggcgcaggggcuaagggagaagauuaauggcggcaagccugagccggccaggaacaggcaccuagcugucccuugacacugcugaucucagggcagucacaacauucccaugagccucgcuuucccaggcacacauugccaugggugguggugagcuauucccuacauaccugggucugcagagacgugacaggccugucagggcaggcuucagucagucuguccucugcugccucacaugccuuugcucucucugcaggagaugcucagacccuacggugccuucuggcucaccgcugccuucugcgcucucaguguccuauucacacugaccguugucccugagacuaaaggcaggacucuggaacaagucacagcccauuucgagggacgaugacagacccuuucugugccugggagccccgagcugagcugccuuuggguuucagaaggaguggaguggccuguaacuaagccacaccucaguuugagccuggaggcccccugacuccucaccucagggcccucuuugcccagaucucaacccagauucccaccgugaggcccaccagacucugagugcggucucugcagccugcuucacacacaggacaucugaggagcugugcauccucaccugacccaggugucuccuucuuaagacugaggcagcugaagggaccugagggcuccuggcucccguuuccuggcuggggugcccgguccuaagcagccgccuguaccucacuugacugggagaucagaaagggacuuagccauaugggcucagaaacaaggucaggugagcccagguagaagagagaauguucuugccaaccaagcccuccucagagcugcgcagagacucuccggggucacccuggggccagccagcuuacccaucacuuacagguucuuucuggcucuuuccugggcuccguguccugggucauuagccaccauaucuuguugaguuucaggaaauaaaaagccucuuacuguucaacuucagugga

SEQ ID NO: 772 - RNA, 31786 nt, Mus musculus
caggcggcccgccccugucuggagcugaggggaggcccagagcuuuucuggggccugggggauccucuugcacuggugggcggagagaagugccugcagccaaccagggucaggcugugcucacaguuuccucuggcggcacguaaaggcuccacaaaggaccugggaguucaacugaggcugcugcugucggccuggggauggaccccaagcccugagugguguuguuggacccaggaccugcaagaagcaugcacuaaggcagcugcggaccacacugugagggagagcagguugggagcagccccggugacaccagagccagccucaucccuaggagcuucagagagcauagacugcugccagcugaggccagugaggcagggcugcucggcggccaguccagccugagacucgggaccucuccuggaggccacggccaggcugugcugcugauggcaccgugaggcaugugaagcgcugcuccagggccaagcaggagagaagagguaaggggucagcucucaacugcagcagccaggggaagaggggcuugagacgggcaacccugacuccuccagcuuccgugugcagcuggaccccacaggggucaaaccuugcuuuugcucagagcugaaucaagcaucugaccaggcagaggacugugaauacuugggcagggugguguagaggcacaagcacacugggcugggauguugaggacuucaucggugagcuccacucaccucuuucagacaaagagccucuggggugagccgguuuggcugucggacacaggcugguagccggguaugugcauguguguaggugcggauuugaaagggcagcaggcugagagucgcagggcaguguaggacugggcaaguuguguucaagcuccggacuccugcacacccagccagcuagaguuaugcuacagcagaagcagauguaaugcggaccugaggcagugggggccucaguucagaaagugcccugggccaggcagcacgagcugccagcgugccaggagcagaggcguccugugcgggacagaacaugucacccacaaguuucugucgguaggacuggggcaaagugcugcccugacuuucccucugcgcccaaggauacaguagauggaucccaggucuccagccagcaggauguggcugagagacuguggaggaccugcuuucugaacagccuagugaggggacacagcaggcgccacauacagagucagucccuugaaagcaagcgcuucagcaugagauaacauuuccaaacagaaauucucugcugaucccuccccucucccugugacauccgugucacgggucagcuauugccucugcugugggauuaggagaguucccagaggccaguguuguuacucagaaaaagaucccuuugaggaagacugagaacacaaguuccaaagcuagcucagugcucuccacauggguucuuccaaguacaggccuaguauggcagcgauuaugagcuggcuccugucugaacucuguuaaguggcagaucacagcuuuucuaaaccucaguuuccugaucugugaaaaagagggcugagagcccagcucagcaacagcccagcagacaccugcagcaaccccacaacacacaucuaacuaccuccaucucccagaugaggaagccuggcaugugacuucaggguuucuucaagucacacaucacucacugcucuccagggguggcgcacgagauguguucagagucucuaaagcccugguuaccaguuauuagagcccaaccaucagcaugcccagagggaagaaccaguaccccaacucuugcccugaccuggauacauucucuaaagcagcgguucuuaagcuguggguugcaaccacaucagauauccuacauaucagauauuugcauuacaauucauaacaguagcaaaauuacaguuaagaaguagcaaugaaauagcuuuaugguugggggggcagucaccacaacaugaggauuaaaggguauuaaaauaacuuuauuuuauauuuuauuuaucacauauauuauucauauauuuauauuuaaauauaaaauaauaaaagaguauuaaaauguauuaaagauacuuugcaucuuggacugggcuugagccaccuguagcauuucuacauccuagaaguauauuguaagaaaacauacaacuagaccaaaacuucuaacaccacucucccaggcaggaugcuauccugcaucacccuugggaucugccuacuggcaucccugucagagccacagggauaggaaaauggagcuuccuuggucccgcaagagggccaccggcugcaccuguugcagagggacaagcagagaacagacuccagcaagccuggccgugguaacuacugccacacaacaccagcguaucugagcccagggacagagguuuccugaguuccugguggcauuuggaaaguggcugugaaguacaugcuuccaacucaggcuucuggggugggugacacugaagguuuccuacugcagugugaaccugguggcuuucuggccucugcaaagguucugccuaacucugugaaucuggcuaagacauacagauuaccacugggcaaggggaacacagcggaaagagauagguggacggcauguaggagucuagcgacucaugcccagcauggcugugggcucacaggcaagaaccccacaacaguugcccacugggcuuggugagcaggcacuccaucuuacuccauccuuacuccuacccuagaaaauggguuccuguuucagaugaaggaauaaagaaagcuaacuugcccaagcuaacagcuaugugauccauaggcuuugaaccuaguacuguguuuccaaagcccacucccccuuccauuguacuccacuacuccacacggcauccugaccucucuguccugaugccgcccuauggcccucccuggcugucaagucugcuuuugcugaccuuaaucccuccaagaacagugugcuucccuggcgucccugcugccuucucugcagggacccacaucugcagcguggggaguggagcugcgcgguccacacuguucccacccugcguguggagggcagagccugggguucauccaccugacaggauaggcgugcuggcagguauucccaucacuggccggggaauccugugaggcugcugugugggaguucagcaccuacccugggccacaccuaacagcccuugaggcagcacaggcaucugaaacaaacacagcagacagccagucucugggaagggcagguauauucagccucugccucucacugaaucacagccuacuuuaucuggaagguucucaucuuaggugcacaccauagaacagcugugcagaaccuaagagcacuaggaugagauaggcagacuguaaacaauucuacaaacacccagcagauggcgcgagucauaagagauggcccugggagcugauacagaaguggaaacugaggcuccggaacacaguaccucccauggccucuccaucgguggcccacaaaggaggaaccccagcuuuaagcugccccuccagcucagcucacagucugcuacagccauacaguagaaaucucugugaagaacuagauagagaagugaaucuuuccuguaaacuuacagaaaacgccgaagagguuacuuaagcucgggcagcuuggaguuuacggugguagauaguacacaucagaauccuuauuugggggaaguuucuguggccaagcuguauccugcuccuaacaggagcagggaguugggggaggguggggguguuacagcauccgguuccauguauacauugccaugagacacauucugaucacaggaaugcugagaugcuggguguggagccaggccucugacaauugagccauugugcagguccacucccuggugaaaccagccugucuugaggccagcagcccuagagacuuggccuuggucacucaguucucacacaggcagauggagaccaccacagaaaugcccagaagggacucuuaucuucagcucccaaagacucccagguucccgaaggcccaagccuuccagggauggauccuacuccagucucugcuguggaagguuggacugcugaaugacucuccagcauccacccuggacagcagaggagaccugcaggguggaugaguccaugaguaaugagacaaaccucaggcacuuccccucccccuagauccaucacuucuaguccccauccugguugggucauggggccccuuaguuguccugaguacugccaccugaguuaggaaugccugcugcugagggccccuggagcacagagcccucaucucuuuuuuccugcuuugucucuuacuaguagccaggagaauaaguagaacaaacguaguccuuggugucuaguugccgaggugcugcacuagcagcugggcgugcugaggcgacucuaagaagcgcacacucuggggcagccagccaguacagucugagcucugagugcuggauggacagaacuguucuugcaagcuggcguagagaggagacuucugcacagagagguggccuuaagaggucaccuuagaaaggaagacagauacauaccagauagaauugugggaaagggcucuccaggcagaaagcaugugaagguaagaugcauguaagaaugcugacuuaaugccaugugaauguuauuuaguccuggaagugcauauggagugaauuauagcguaguguauuggccuagcacaccaaaugaccuggguuuaauugccuaacacccccuaaaaugggcacuggcacacagggccugacaucucagcaggagggucaggagucucaugggcauaccagccuuggccaguccccggucuacuuggacuacacgagacuccgucucacacccacccagaugcagggagaaacuuaggagcguguggguaagaaagcuagcuugaagcccaccccuaccaucuggcagcccugguccuggcccuugucuucaucccuuggcuccauuuguucaucucugaaauggggaugaaugugaaggaggcaucucuguuggcugaggcgaccuucugugucagcuacucagcugggcucaggagagacgcuccgggcaauguccagguuuuccaggaagcugccuggggcagugguguguagccagccucagacaccucccacccuggcccccaauccagggcuccagagcacacuaggcaccacagaaaaugcagcagccaacucagaagcuggccucucaauggcuucuccagacacucccugccucugcucugcauuccgugacuccuggcacagaggguuccguguguggacuuugggggaaucucaaaaugguucccuaauaaugcagcaagaaagagcaacagcagaauccucaucccccuggcaugggcacccagcuccccagccuaaccacauccccuaugaucucacggugugaccacaguccgccuccacacagucagccuucccuggaagccaacggcucacccguggcaugugcacgagagccugggacuucaggcuugccccaccccaucuccaucacuccugcaagcacaguuggaggacgugaaccuacucucucugcuucucuggucugugccucugcccaagucacucgcaacagggccgaccccagaauggagcccgacugguagaggggaaggcuaagccagcgggugauggaaggaaggcugcauggagagggacuuauauaaggucugacgauugcuaagcugagaagugaggaggagcuggcugcagcucccugggggcccucauggucucucaugagggaugauucacaggaugcuggguugagaaggguggcaguuggagacugguuacucccacccuggccuccaggcuuggggugauucauggaggacaaaugauacacaguuccuucuccaagcuacccaaggugagucuaccaccguuugucugcgaugcccauucuggggucgcuccacucacaggaugaagaagcucuuucuaacguccaacaagacucacccuuguacugacuugaaagucaagucugcucaacaguaagaagcaacugcauccuggccauuagacaaacaaacaaacaggagucuuuauucauagugguggagaggugaccuuggagugagggcauggggcuggcacugaucaucaaauaugguucugauguuuacuccaggcgaucugacaccuuggagccugggcuuuccuugcugcucaguucaggugugaucugcauccuaggucaggcaucaauacuguguuucccaagugcuaguaauaauaaucacagagcacccaguaccuggagccaucuaugcacagagaugugaaggccaacaacacagaguguagggguacacaugugcaacaaaguagacggccagugcucacacuccugcugccacaucccccaccugauggcucuguuuagacacuuacucugcagcaggcuccuuccccauccuggucagcggcaggcuuagaaaccacugugcaggcaugcugggucuuccugcagcguuuacaguaauaaccauuugccgccgcuuaaguuuuugcugggcucucugguguccugaucuuggacuugccaucuccauucaugcucugauucuucagacucacucaagcacagaagcuggaggggagggcuagccaaacgcacaugggccuuguggccuuggcaaagguuacuuuuuaggucuccagcauggcugggaugccuccucaaguuugugcucgcagcuggcagugcagugcuagcugggguggagaaguguacucuuccagaagaauacaaccugcauugaccagaauagcccccaagagccaauucugcagaccccaagacaccccuagccuccuucugccuagaggaucagaaggcuugucuuggaguuuccugucacacugcuuucacagcagaccuacuuugguguuucuaguguaccuccugccugguucugcuacuucguaguuccaugacaacaacaagugauggucuucagucucaacaguaccccccacauacacacaacauaccuuuagccuugagugcaccuugugguaacuagauagauauaauacgcugaggauauacauggcucagcaggcagagugcuuggcuaguucucauuaauccucagcacugcauaaauggggguaauaauacaagccucacacccagcacuggggaacuggaggcagggcugauccucagcuucacagggaguugagagcuggccugagacacaugugacccuauuuaaggaaaagggcaggaauacuagaaauacauaagcccacaaagaccgugagugugagagcucaccaccaaaguuccucagcauuucagcagucaaacggaguaacugcccugcuguuacuuaggaugcagguguaggccgccagcaccuggcuacauggcuguccugaagccaugggcccuucccaaugggcugcugggaacauucaguaacaugguacagacaaagugcuugcuucccagaacuaacuggcugcagcuauuuguauuaucugaaccuuucucguccauucccaauguuugugauaagaacccagaagcauaucccaggccagcagcuucugccacugggcaggagucagcucuguauuaccaaaaugaugcuucaucccaugaaguagcccaaugcccaggcuacagugcugugauggccagagggaugcagacacgcaguguguggccccaucacacaggccaaauggggacacuaagacagcccauaggaggcugggugagacccaagcccagggaguccuccccaugugcaaaggcuguccugccacgugguuacugcagccuuacaguuagagagagggaagcccggcacaauggaaacuccucaccacacaauguggaaaagcgauuccgaucgguguuuuuauuuuaauuucuaagccaaggaaaacaguuggguuugcuuuucuuuguuggucauggggagaaagcaaggaggggcacuuugccuagaguugagcuagucuccagccuaagacggcuggaaugcugggggguuacuucucuugggaugcaauuagcugaauaaauaucaagaaagcaaaaguaaacagacucauuacugcccauucagaacugccaaacuagcagaggaugguuagacuccuuagagaaaacaaaugcuugcuauggaggcugagggacgcaccaaccacggcccugguaaagucccuugguggucuagcuugaacuuuaccugcugcaugucauguccacagacagcacacccugucugccugcaugccaggcgucucccuucccuggucacuaacacugcugcugacuuacuagagugaggaugucagccuccacggaggacucaguuccuugcauuccuuucuguaaggcaccagacuccaaauuaccucaccaagcucaggcccaugcaaauggaacuggaagcccagauacugccaggacacuugguaacugcugugucuuucugggcuuucacauccucaccuuuaagucgcauacaacacaaauacuagacucugaccucagagggaucagaacgugugugagcaucacaugucaaguuugguuugcuuuuuaguccaaugacaaucuauguucuuccaggaaaagggguucagugaccacguccccagccacccaccgugugccagcacugggcagcugcccagggugagaacuuggucagaacugagcagcuuugugacuggacguagguucucuaugaagugggccauuaguggccuuuccuccaagagggcaauggcguccuacccacagccaucaucucugcuccucaguagugcuuugcugggcuugcuaucauguggccaucauaacagucuauccucauguuucuuuacccaaugugcaauggggguugaaccaccucauuccacaaaggaagugcucagacuucaggaucucaaguccaaaggcaagagcagugaggacccacaguugaaaggggcagaagccaccauaaacaguacaccauaccuuccagguguggaugcccaagaauguuuagaaaucaaguuuacucuuuggugccaaguugccuccauggcauucugacaguuucuuggccacagcacagagguguuugucaccaaguaggcaggugagcugcccacagaagguguggcaggagggccaacccuagccuggagcccgcuucuccccacucuucuacagugggggcgugaccaucagcucccaaggaaccaaaacuuuggaaaccaggcaaacauugucaaaccauccuguuuccacugaagccccaccucuccacagagcucuccauuaaauacccucccugccuggcccaguaggccuucuuugacuguuagcccaaacaugggcucuggacuucaguagaaaacagcccagcagagccccguggagaacaggcuccgaucugcaguuacauuggcugguccacggcacagccugcagccagggauucccagaagaagcuuccuugggcuccugagccacagccacguucagcagauaagaauguuaaguauagccgggcgugguggcgcacgccuuuaaucccagcacuugggaggcagaggcaggcggauuucugaguucgaggccagccuggucuacagagugaguuccaggacagccagggcuacacagagaaacccugucucaaaaaaacaaaacaaacaaacaaacaaacaaaagaauguuaagugcacacgugacgcugcugguggcuuucaacugcuaagggccaucagcacagggcugaauuccaguugugcauccuuuuagccuugugaucuugagaguugaagacugagucccaguccccugcucugugauacgggauuaagaauaucuaggucuggugagaugggucagcggguaagaguucuugcaccaagccugacgaucugagcuugaugccugagacagacaugauaggagagaacugacuccugcaguugucuucugaccucugcaagugugucuggcgcuugugcuccuacauaugcacauaugcacauauacauacacuguaaaaguuaaggagcagagcagcugccaucaaggucacuauaagaacacagagaagaagccccagucaggcauguggcgacacccaauccaugcaugcuauggauguuaacagugaaucugacccgugaccucaaucgcacagguugaucaccuuggucccacacgggcuccuggcuuguugcuucugucuccacagcucucuccacugcacugcagcugcugcugucuuuucacacaugcaucucccaccccccaccaccacauauugaccaaguaucucuauuuugggucaggcaguagacauuacaaaugguacagggaacaaaacugacuccccggaggcgcugacauuuggggguagggacagcacaaaccuggugacaaggacucugaggaaaguaguggucacaaucuuagguuaguuucggagaugggagagagcaugucacugagaaggugaucuuugagcaaagacaugaaagagaaaggaaguaagcaccaaagaaacaggggagaggcggauaaagaauggaguucuuaguaccugggagccuaagggacagcagcuucccaaguggcugcaagaagugacuaagcagggaagggaccagagaugaaauaugggagagaacagaagcugggccagggagggccccaagaguccuagccuuucgcuuuaagaagcugcuggagggcuugcauugaagagcgaauccagacuccacuggacuuuauaaaggaucucuggcugucaggggucagggacaggguugcagguuagggggcagcugcaauaaucgaggcacacagugaaggcagggaguauaggugacaauggggaguggcugaggacagcaggggcacuggggagcccuucuaagcuauggcuaccacaccucuguggugcauuagaggcaggaguuagaggcagaacagagcuaaggagcugggaauuacuucaagggcuguguccugagugacuagaacaguugcuauuugcuaacacaggggaaaaaaaaucaguggggguggggcaggggugagggguggggaagagcaggcugagagggagggacagggaggaagaagaccucccacacagaccccugcaaacugggcagagggcagagacugauggggucugagaacugugagagugggcaagucucuggagggcucugccaaagagagaggaagacaaauagaagaguagcuggagagaggccgugagcuccagagagacaauggcagggguauaggaaaaccagacugggaagacugcuggugcccuucaggggccuggaggaaggacgccacgcauccuaaugucccucuuggccuaucuagcucaucccucaagagucaguacaaaggucacuuucucagggaaguugcuccugaccucucuauugggucagggccuugucauaaccuuucacgacacaugacuguuccuucuuacaguucuugggaacucuggugacauggaagcccugugagagcagccauacccccaacaucgaguaagcauacugccuggcacaccuuuauguccgaggaacauauggggaagggauauauuguccaggaaacaagccagagacaugccuaacuuaaucacucugcgaugaucagggcccugaauauacuugcugucgcaagaauuuggguuuagacaaggucagauuauuccuguuuggggcuuuguagcucaggaaaaacagagacacagucuucugauacuguccacuacuaagugagcacaugccauucuguguccggcagcucguucauuuagcugaagucuucucaaugcuacauuguagggaugggaggcugagagauccugcaucugcccuuacagagccaauucuugggcucuggguauggcagaucccuuuuccucucuaccucugcagggccccacuaucuauuaauauuucaacaacaaucauucucucugacuccaggagagugggacauagcguccgcaacguguauuuggggaacguccuaccuugcacaagccacuggcagauggggcugucacugaccuuaucucuccacucuuaggcuuucaguucauaaagaccaaccagcacacugcaaggaccaugaggccacuguguaugaccuacugguggcuuggacugcuggccacggucggagcugcuacaggcccagaggcugacguugagggcacagaggaugguucacagagagaguacauuuaccucaacagguacaagcgggcaggugagucccccgacaagugcaccuacacuuucauugugccccagcagcgggucacaggugccauuugugucaacuccaaggagccugaggugcaccuggagaaccgugugcacaagcaggagcuggagcugcucaacaaugagcugcuuaagcagaagcggcagaucgagacgcugcagcagcugguagagguagacggaggcaucgugagcgaggugaagcugcugcgcaaggagagccgcaacaugaacucgagagucacgcagcuguacaugcaacuucuacaugagaucauucgaaagcgagacaaugcgcuggagcucucccagcuggagaacaggauccugaaccagacagcugacaugcugcagcuggcuagcaaguacaaggaccuggagcacaaguuccagcaccuggcuaugcuggcacacaaccaaucagaggucauugcucagcucgaagagcacugccaacgcguaccugcagccaggccuaugccccagccacccccagcagcuccaccucgggucuaccaaccacccaccuacaaccgcaucaucaaccagauuuccaccaaugagauccagagugaccagaaucugaaggugcugccgcccuccuugcccaccaugccugcccuuaccagucucccaucuuccacugauaagccaucagguaaguccuuuggggaguccagcucccaugcgccucugagccccucagccuggggguacaugugggcaugugagucucaagaaaguuguauaauccucuggcaauccucugggguggcugcuggauccaguggaguuggguugaugggagcaagggauggcauugcuccaauaaggugguagaagguagaacccagaagcuagaagguaugggugucagcucuggucucugaggggagagaauacaguccuggauacucugagguuuugcaccugcccugucuuaguggcuaggugucucaccugugggcucucaugccuguguaagcccagagcuaacugucugaaaaugucacaugauaaacgcuaggcuagugggagagugcuauaaaguccaaaguuaaugcuucucggggacuagggcacuggauggaaguuuccuucaguuaggugcugccuaguuuucaauaaggcuuccuuacacucucagcacacaugucaugagacucucaagacaccguaauagaagaaugggguccuugggagcacacccugggaaguguaaccaagauacuacacugggauuuucaugagggucacuugacuaguccugcagcuccuuagggacaggaugacuaaccuguucacagccugaagaugcucagguagagcugggccccugcuucagacacauggaacagaguuacagcuucucgggacgaugucaugaaaacacaaugugcaaugaugucaccagggguugccaauacugccugugcccuccucugacuuaguggaaacucuggucccuagccuccaggaacccaguguggggagguggcaggugugugaaggcucuggcaaaucgucaggguaggggagcaggccggaagaguccucuccagaggcccaguuccaggagcugggcuucuccuuuaucuaggcaguguuguuuuccaccugugcuaaaucucugaaaaaguuaacuaaaacuaugcaugggguaccaaugucuuuguugacagggagagauuuuuacugaaaagauccuuuguaccuauuucacacuuuaaaaaauaaaccaguacugaguugaaccuguguguaugagggugaccagugggcagaucaagaauggauaggccagugggggcaggaggagccaggcacaugacacagcauaugccauagcaccuuagaagaaagaccuggacuagguguggguggagagcaggugugcagaguugaccauccuggaucgaaauccuccuccuucuauuggcgaggucuggacaggagccaagucacccuguuccugggcuccucaucuaagucuauggguaggcuuuauuucagucuguucccagcugacaguucuauuaugaaauaaugcagaauguguguguggcacuggcccacaguaaacugagccuccuuugaucacggucuuugcaucuuaaaacaaggagacuggcaugaagagucugucuucagcucuguguccagugccuaauaagagugccaucugcacccacaccugguuugcagcagaggucaaaggcaggguggagugcguucuguguuccgacagaauacccagagugacacugcccuugggcaccacaugaaggcuggugucacagucacccaggccuccuuucaacuugggaucucugguuucuaacucagccaucucaggacauuuccugagcgggaacaaaauggggauaaacaccuggaucugccgugcccgucccuccuccucccuauuugcucuggagaaaguuauuuaagucagcugaagugcagcucagcuggcagugucugcacugaggugcgaugccgugugucuguaaucugagaacucaggaggcagaggcaggaggagccgaaguucaaggucauccuugagguucucuacacacggagaucaaaaccaaaugugcaacaguuguuuguuuguucuguuuuguuuuaaacucuucugagccuuaacuuccuucacgugaggagacaggaacagaguuacagcuucucgggacgaugucaugaaaacacaaugugcaaugaugucaccagggguugccaauacugccugugcccuccucugacucggugaaaacucuggucccugguccccaggaacccagugaggggagguggcgggugugugaagguaucuggaaucuguccugccuccaaucaugucuauuccucaaauuccacagagcagguuugacaagauuucucuggaaggacccaaauuucuugaacacugugagaauuuaugaagccagcauaucaaaauaccaagaauacaaugagcauugucuggacacuauauagaacaguguauauagugugcuuguguccaccaggaaggcagaugaaggacuguggcaucacuaagguagcaugaccacgcccugcuggacagcaugaauggcucagagaugacacuucuguccugcaucuugaaggcuuucuaaguuuagcaggugaaccugggaggagggacaccugauggaagugggucuguagaaagccccaagggcauagcccuucuccuagccucucaaauggccccgguacagcuauuuauaacccaggacaggcuguggcaccuguagucugcuauaccuaaggcaguccccgugaguauccaugcucacucaccaagcaugagaugaccuguguguacucuaaugucucucucuuacucugcaugucuaccucacaagggcaggcagagcagggaggaggguggcaauggaaaggcccuaccuuuccuggguuuggacugaucugagaugaaaaagaagauggucugccuugauccaaccaaugggcagacagugauuaucagcccucuuccagcucaggcaggucugguccugaaagacaaaaccccucuguguucuccugcaagagccuuggcuugcugccgccacucagccagaaacuccuuuacaaucaaacaccuugcacucaggccgccacagccuuuggcuucccucuaguaaguucagagccaucaguccuuuguuccauuguuguggcugcucaggaaucagcaugcccuucuccagaaggccaagacagccacagccccuuaucugaagcuggccucaugacuugcucccagccauagucagacagugacaugcuggccguggccaggagguaccugcuaacagcuaagaugaaggauccagguagguccuagccucgucucccuggcaucacacauaaguuccacuucacucggggcuggucacacagggaauauuugguuuggauggugccuacagugcugccugagccaauagcccacccauggcccucugcuguuagagguccuaacagggaugcgguccugcagcuguuagaggacagcuucagcgggcauucucuaaggagcacaggaaagggcagaugaacucugaccucaccccaggcagcuaccgucacacgccagucugucacaaggcccacuguggagauggcuaagaagcauagugcugccagcuaccaggaguacagcauggcuuuccuagacagaugucuuuaaaaaccaauaggcagccaauggggggauggugcaugccuuuaaucccagcacuugggaggcagaggcuggcggauucuguaaggccagccugauguauagagcgaguuccagaacagccagggcuacacagagaaacccucccucaaaaaaguuaaaacagaaaacaaaaaaacccaccuacaacaauaaaaacuccaaaagacucagauacaucuauguauugccucuucugauuagugaguuucuccagggacaaaugaggagccccaaugucaugaaacagaacuacuaaaauaccuuggucccuggaguggccucccugucacauggccucuuggugcagagcagacucgggucacugcacuuguauuucccaggauccucaggguuuaaaguuacucaggcacaaucauacaguccccaggccagggaacaccuugagcacugugugggaaauaugugacuuagcacuggccacuaccagccuggcuucugucaguuucauguguguauauguggggguuuguggggaccuuacagugccacacagacacagcagcuacugccaugccaggcacgacaagccacucuuccuuaguccucaaaacccaggauuuauacuugaugaccaggccacaggucuuuggaagcuucaggcagacccagccauuagcuccuguagguuuggacaaaccccugggguuauauguuagccuuucauagacagcugggccauaggucauguucuccuuacauguuuacucuccgugcuaugaugccuucucagggccauacugcuucagggacaacacagugcacaugugcaaaccacccucucauccuaggccucuagagucguggcuuggagaagcugaccacuaggacuuccuagguagauguccccgugcuuugaucucacuugcccugagacaggaacuacgaacagcagacaauggcugcccagcacagcagcaugucuuaaaaccgacucgguuuacaucacuauagagaaaagguacuggucccaagguggcagagcggggagugaugcugcaggugagggguacuggcuagcucugacuuugacuuagccuuuggggccauggagacugaggggaaggccaccuggucuccaccucuggacuguguguguuuuccccuguacuauacuugcuuuuuccuaaaauguuuucuuaaaugaguuaagauuuccaaaacccauuacggccgacauuucaaagaacauuccuuguuaguuucuuccuaaacaaaagccacuagaggcaggcgguuccggggccaucuuccuugcaaccccacccccagaggucuguggaauugaucacaaagggccuuugaguguggcucauagcuaucccuccaccccucaggccucguuccaaggaugacaguggcuaaaggcccuggcuauuugcaggagauaaacuaucaacuuuguggcuguuagaaguuagacaucuggcaucucagggcaugggaaucccaauaguuuggcauuuggcaagccagaaguauucgagaaaauccuggagacugggcuucgguggccaacuuguagcuacacagauggaucaaucacuguggugaauuuacuugguugccucuacaguacagucacagcaggcugccaaauuccuuuuugaaaagagaaagcagaacuagcuagcuaguacugucccgcugguaucuaaaccaucacgcucacuaagcuugccggccaaggcauaugaugaaggaaauggcagacacuuguuaaggagggcugagagaccugcucaugggucacagagaggguuccuuccugacugcccaucaacuucagugucccaggggugacuggguccagagugccuuggcaaaaccugaaucucagaggagauggagugcugaccccaagcacaugugucacccgugcucucuucuuaagucauccugaccucuuuagauacaauauuuuaagauuuuguauacacagaauaaauugauaggaaaaaucaaauacuauuuuaaaugacaaagacaguaauuaauuucuuuuccuuuuauguugagauugaguggccuaugugauuuucuuagggguaguuucuaaaagaccaccaacggccagcacgugguacuacucugacacucagggccuccacugcacacggucugcuacagacauucccacagaaaugauuuuguuuuaagguuugcuuuggauacagaugaccaucugccauggaggccucugcuuuucagguucucgagcugagagagcuauaacuuacuacgcucaugugaagaugcacagguggcagguggacuggggaaggacuuuuaccugucugcuuaccacagacucacugcccugagaggugccugcucccacaagagcccacugccaucugcuggggacagaccucacacaacccugaugcgugguaacaagacaaugaagggaggagucuggugccagagucagcugucagcaccagugccagaucucugagcccaagcugccuuugaaucuggggcucugaggaaaaggugaaauggccuaggaggcagaugucugguuaccuggugacaggcucucugagauguggagcagacgcucaugcuauacuccaacaggaauauauacaaaggcuuuugagaagccuaggcaggaugaagacguccuggagaugggaaaggcuuucuagaggugacaaggcccugcagggcugaagcccugcaaaucugcucucagccauggucagcaacugucaggaaaccauaaagaccaggcucagugcuaggcaaauguccuguugcagacagagaaaaaggccaaaaugccacaaauuacaugccaaguggcuugcgguccagcuccagaguaaaauggcagaccagaggcuaaagagagccuugugagcaugugagagauaaaaagguaacagggaaagccaacagagguuccuuaagaagagcaaugaagcugcucccuuccucucaaaguguccauagacuggcugaccacaggagcaccagccacuugcuaagcauuuguggacugagaguccugggucugaucaguucuucuguggugucugcacuuagccuucauccgaucugugccuaccucacccaggcagcccuggaggcuaccaacagcaacaccagggaaggaggcucgacuccagcccuggagcacagagggcugcucagcucuacacaguaagguuuccaggacccugcuagccuaaacauuguucucuuucucucucuuuuuuccccuaugguguuggugguugaacccagggcccagagaaugacaagcaagagcucugccucagagcuccacccccagccccaccccuuuccuaagccauuuaaaacucccauuucuccugccuagcugccugcuggaaaccugagugggcgcaugcuucccggccugcaacaacuaacacugagcacuuuaguagagcaguaguauuuauuuugaggucaggcaggcaggcuggggcccggcaagcccuucaugggcccuaagagcucuugggagagcuggagcuguaucagaugcacucaagcccccucgccucacacagccaauauaaguuuuacuguaacaauuuugaaaggaguugaauaauucugcuuuugaaauuauuuggccagcaguaacccaauuaauuuaugguuggcucugauuucucagcaacaucaggcaugcucaggaauucuugggaagugagaaaaaucuaaccuacaaauuguuucaaaguaauaacaucuuuuauggaggugaaaguuaccaaucagugaacccgauggaugguugauacacuuuguggacauuuaaucacaggcuaaugaauuuuuauuucguaguuuucuuuucccaucugagagccagugagauuuuguuuuagguuucaaacaucauaaugaaucccuccaagcucgcucucugcccaaggcccucagugcugaggacagacuaagauugugcacauccccacgcaaggaagagacaacacacacacacugccaacacuuggcaaccugcaaacgaguccugcaguugggccacuacuuguacucugcuucaccaaaagguagccauugacauagacaagacuuuugccaaauuuacugaaaagugagacucaagaauuaucagauaaaauugcuccuuauguccuuuuacagggucugacuucaggccugccuguucaggacacccaggggccugccacuggccagggugggucacaccuacgaaguacauuugcccuggcauuaaauggauaaauuugaguaggacauuccagauccaauuuuacaucuaguccuuucuguuggcaaacagauuucacgggcacagaccauuaaugagaacugacaggguucucacacaaggaaggugucuuaaugucuagggagacaggaggauuaaagcccucuauucagccuaaggccaccacgcccugaggcucagaggcugaggagaggagccacaccugcuggccagcacugaagcccugcuucuuaccucgcccuucaggugagcugauguaguguugccccugccucaucaggaccagcuacagggccugggccaauccagccgaggcugcucauccucaggucucagagaggacacacaagauaauaguacacuugagucuagccuggcugccaggcucaacuugccuuuaccaggaagacaaccaaugaagugcucccuguuuuucauggaggcucugugccuuguaccugugaugucuccaucagaaaugccagaggagagaucacgaaguggaccgcugccuucaaucaacccuagcugauugcugagaaaccagaaccaaauuaauugaguuacuccaguccaaauaauuucaaaauucccaaggcugaucccagaguaccaaggccuaaggcuugcugcauaucuugugucccucccccauccucggccucaauccugugccuuuccugcacugcugucucucucgagggaaccacacagaucugcuugccaugguagccgaacugcucuucauguggaacauucugacuacgguguaaauauggucuuuauagaggugagccugggugcugccgaguuaguguuggccugguucugcgggcagagcuaccucucagaaggggagccaaggcaaacaccacugugcacucgcucugugccagaagaugcuuugcccacugcacuuugaacacucagcuauacucaacaaaaaagauucucauuuucuacugcagugcagcucuguagccuccacugauucugacaucuaaagugugccuaguggaaaauacuuauuaauagacauagacacaugaauagauacacacacgcacacacacacuguggacaugcauguguguauuauaauauauacauaguuuuggaacuucgagagcaagcagcauguguaucucaaggaaggagcugagcacuuccaacauaucaagcuugcuugcaucuaaggggagaaagacuuaaucuaaccccugaccugagaucugcaggaugguuaguguucuuucccuaugucacagcaguaaaacugaggcagggaccugccuagaguuacacagugaguaagaaaagccaccaagauuugaccccagcaccuccaacaaaguaucaguagucuuucuccaaccauauacuacuccagccccagaaucuuuaccaaaaguugaauucucugcuuggcccuuuguggcauuauccaaggguaaugcuaacagauucgucccaaguuauuuauaugguacaguguuggauccccauugcauuauuuauaugccccacagauuggucccugccccaucccucuuacacaaaggcuucucaucucagcaggguguugguaccauguucucaaugcaaucuaaaauucgaacugacuuucaccugcuguuuauacugaucauuuugccucucacuuacauuaagaaaggggauguguuugaguguggcgaucugugaggcuuccgagagagccucagccauuuaacgaagcugauggcagaaacaugaaugcuucuacaucauuucaaacuacuccacaauucuagaaggccuuacacaaugaccagauuugccacauacacacagaggaaacuucaacaucauaaaacaccaaaauaggcaaaggacagaguaaguaaacauaggggggacaaaauaagacaagacaaaacccgaauuaccaacaaagacaaaaauaaagggguuuaacaaccugacagauaaagucaucaguaugccaagaccagagccaggccucuguucucaaggccacacuggcuggggagaaauaacagugcaucagagugaacacauuccuaaacagaucauuugagguauuagaccacucugccuccaagggccauguagcucugggguguccccuaaggucuguggguucagaccuccucaucuguaaaugaggcaguuacaacuaccuaccaggagcaugggaagaaucagcaguguaaauaccuaagcaaggccugugacagacuggggccucggcaaaagccaugugaagauuccaaugccaaguuauugcugcuacuucugcagacaggccuuucucagagugaggcauucucaccugggccucaagagucugcuuacccucugaagcauguccaaaaccaguacaagccugcauucuucuuucaauaaauuauuuauuguauauguaugugugugugugugugagagagagagagagagagagauauuuguuuuguaucucuguguguuuuuguacuguguauaauauuuauauguauuuacacguguggguacagguauaugagugucauggcaugcaugugguagucagaugacaugcuaacacacugcccgaaacaggucucucuugggugccaggucacuguggaugccaggcuagcugguccccaagcuugaggggccucuccugucucuaucuuguaucuugcuguaggagcgcugagaucaugggagcacacugucacaaggcugugcaaugggucuggggacugaauuagggccucacgcuggacagcaggcucuuuaccuccugagccauccccaggccuuucuaaaauuaucacugcuuaaaauauuuuaguacuaaagaccucaaaucauucuaaaauacuuauccuaaaaaaaaucuaaauaaaauuuuuuaaaaaguaaagcccauuuucaagaauaccagaggcauuccacaaugaacuguggaaggcagcauagauuggucacuaugagaccaaccuaucacuuuuccaguggccuccaaacccuaccuauauuguacccccuucaagaacagccucagcauggagccacugcaggagcugcguggcugugcaggaagaggccuggcugcuggcuuuggugggcauuauucuguuaugucccaugccuucugccuuccaucccagcguucucucucacuaagcgccucccuguccugcugaccugguggaaagcugggaggccucccacgccaccggugcucugcuccagcugucagggacagacucucauucugucucagucccuggagcuugggccaaaaauaaugaaaaccuuuuucuccuuuuuaaauguuccuccugaaggucuccucuccccuuccccaggacagaaacugggggaaagcaaaagcaggaagugacaucaggggauagaggaggggagagagggcgggaagaagggagggggggaagggagggaagagggaaggaaggaagaaaggaaggagggaagggaggaagaaaagaagggaagaagggaggaagggagggagggaggaaggagggaagaaggaaggaaggagggaagggaagaggggagagaagaagggagggaaggagagaagggagagagggagggagggaaggagggcaggcgugcuuugugccuacauucagcacagguugggcacuuggggaaccugcuuguccugugugcagagcuuugaaaggcaaggguguaggaagcaccuagagaaugaagacagcagcacacugacagucagcauccagcugaacuggcacagagauggacaaagaagcagacgguuucuguucccaauaggcacuccacacugcuugcauggcccaguaaguuucccaaaucuaagcuuuagcugaaccaauaggcuagcugaaccaaagugcuagccuccaggaaccugcaaagcuaggccuucgaaggaaaagcuggaugaaccgacacagagggcuaccuucccacccauggagagagaaagagaagaucuccagaauuagcuaagaaugcugguagagucuggccaccagagacaaccuacacugcccuagguuccccaggccuagggcagccuuuagggaauggaacucaauaaauagcuggcuuuauuguuguuuuuaccuuuguuuccugagacaggaccuuauuaccaaggcuggccuagaacucacuucguuacagaggcugaccuugagcuccuaauccucuugccaccaccuuccaagugcuaggaugacuggcgugcaccacugcagccaucgacuggauacuuauagaaggaacacacaaaguaggaagcaagucccauguccuagaacauuucaucuuaacgacucagucucaaaggcguucugaaaagcacacagcaaaguauaaugauuauuuuaaacuaugcagucuacuagguaggucuuaaaaaccuccaaaaguuuccuccaaucacugaggaagaccccaacuugacuagaccugauaacucaaguaaacucaaguaaacucaaaacauaggacauuacuagaggacagagagccagggucaggggcugaaagacacauagcaucuacaggcuccuagagugguuuuggugccaccugcuaaggagaaccacagacuggauuggcaaagcauagcacugagcccacaagacacugaagaguguggccaugaucauuaggcacauacuuagugcaccaaugggaaugacuucuuuaaaaaucacucaaagaggggauggagagauggcucaaagauuaagaaaacugacuacucuuccagagguccugaguucaauucuuagcaaccaugugguggcucacaaccaucuauuaugggauccaaugcccucuucuggugugucugaagacagcuacaguguacucacauacauaaaauaaauaauuuuuuuuaaaagucacucaaagaauaaccacccaaaugaucuguacucuaauaguucuucugaaugaggaaaacaaugacucaccuacaaaaaaaaaaaaaaaaaagcaggguggaggagcagugaagaacggccuccucauggacacgagaggaagugagagcagaauggggcuuggaguccaggccuccugauucuuggccugagcucuugcuuuuauaguagaugacuucucaagguuacaaaauaaacaucugccccgucaauauguguuccuuagcucuuguuagaguguauaccugucuagaacauagcuagauguagccuggcagcaaacaguuguaacauacacauacuugccuacagguccauggagagacugccugcaagcccuggaagauggucacagcaccagcuccaucuaccuggugaagccugagaauaccaaccgccugaugcagguguggugugaccagagacaugacccuggagguuggacugucauccagagacgccuggauggcucugucaacuucuucaggaacugggagaccuauaaggugagaccacugggccuguaugcauugccuguaaggugacugcacagcaaggacaggaccaucucugcaaagccaucugagugguaaggccaggccucuccuugucugcuguacaggagaggacagagaagagacaggaucuuaucccagcuggggccucuguaagguggcucugcucuugagguccagaaggggaagguggcaggguuccagggccugggaagcccccuaaaagccacgcguagggaacucugacaauaagugggcccuaacuacaaggucuauucucugggccucccagugcccaggauacggaaugcuucuccuuguaagucaagugcaagggaucucucacaccucccacccugcucugaaccaagaggggacaguaaggagggcaugagcagcucaggucaauggacacauguccugugucaggcacuguaacucuugacuaugcccuugagggagguauuacuacaaagucacuuugcaggugagcagggaaaguacccugcacguggcucacagcuacugcgcaguaaagcagcaacggcagccgggggcucccagcagccccaacgccuccagucuucuccauccuggcuugccccauccggguagccuguauaucuccugcuugucccuccuccaaagccuagccuugagguccuccuugcacuccuccauguucucaaggugauggcacagcacagcaaggguucacacauccuauggaggccgauaguaccugguucugaaaaccacuucaaagacuuugggggucacugcucacugauaccccaaagcacauaucaaaugaguaacacaauuacugaguuucaaaccuagaagggccagguggaugucacaggccuaucacaauucuuagcuguggcagucuaugcuagagcuuauguauaacccacacacauaacccaucucuagagaaggcaacugaggcaugggggaggcaauggcucuuaucuaugcaaugcuggcugcauaccuccucggugccaggcucuugagugaccacaucuuccugccuuugagaaguuacagaauccucaggcaauaagaaauaggcucacaugacggcagggaaaaggugugcucgucagaugugugaauggcacaugacugacaguuacaaagguucaguagcucacccagacauagagccucauacacagguagcagggauuggagcccaggccugccuuacacucugacuauuccugggacacagaccccucacugaaucucucuggaucuuccccagcaaggguuugggaacaucgauggugaguacuggcugggccuggagaacaucuacuggcugacgaaccaaggcaacuacaaacugcugguaaccauggaggacuggucuggccguaaagucuuugcugaguaugccaguuuccgacuggagccagaaagcgaguacuauaagcugcggcuggggcguuaucauggcaaugcaggcgacuccuuuaccuggcacaacggcaaacaguuuaccacccuggacagggaccaugaugucuacacagguaggaaacaaagaaccaaaccuagaugcugaacagggaugagagauccaccaacauuagaggcccugaccccaaggccuggagcaagaggaugccauugugucaggcagcuuuaccaaguccuuccuucugccuacugccuucagacaaugacacuuacaaaagcggaagcaggggugcacagaucucagaugagggcugcccugggcuaaggcaugcaugcuucaggcuucucaguucugagaacacauguucacagcccacagagucugugucaugcauuccacacuccaaggcugcccccaccuccucagccaugcauccacagcaugcugcauacucuugaauccggaaguaaggacaaugccuccuagaaggucagggaaccuuacaagagcaucugccucagugugagauuaggacgcagcaugcaguaagaaucugcaugggacucucuuacuggguaccuguaaugugaaugcaguacuguaagaaagccacuaagagaagccagguaguggagaagucaucugucccuauuagauccucaaaaccgggucuagauuaagcaagaaacaaagaagaauccagaaaaauccaagauacacaaguagcucagcccuaaguauaaacacccacaagcauguccuccaucccaaggcaugguuuugaagucuaucacucaggaacauuucaugaggcccagaggcacuguagguuggcuaauuagcaagguccagggcuccagaggcugacacuaccucuagacugagucuuuguuucuuaggcaggccuagcccauccugccuagccacccacuauguucuggucugaaagaggaccuugucccuuugaggagugagcucuggaggcuaucucagaaauuugcuugugcuucaaguaauuccugauauuaagucagaggaaacucaucccaggucccuaagacacacucuaguggauaguuugcauaacuuccagggucggguggaauaggaccuaccacagagaucuagcuguccauuuugucacugaucuaacucugcuguaagggccacagaaaagcagccauugcucuguaguguauguguaggugggggcagggggcgguccucugagccaaaauuagaaaagcuuucagaaaaggcagaaggauggccuucgugugccugaugcuggaccguggcgcuacagcacguccuugaaagcuagcauaggguaaggaaacugucagaugggguucaauaguacacagggcuggggccaggguguggauagggagacugcugggggcucucccugucugccauuugguucuaguguuaggacauggcuuagcaggagccccaagaaaaucucugggaaauaugggauggccgggguuaaggccugggcguccugcugccugcaaccuccuugcccccuccucccaugacuucuauggagacagcucccccuugaggaaggggugccucuuaggaccagaccccagcuaaguccaggugacugggcucuuguccucccucugugggacaccaugccccagcaugccugccaugccccagcaugccugccugcacccugcccacacuucugauuagugaacugcuuguccuuggcaguagaaugcaguaccaugugauaaugccaaggguuucauggaaauaccccucuuuuacaaaauaacacaaaaaguuaucuggauagaauucaggcuagggaggccaagaagggcauuucaucuuaaacccucccuuuaccauugugaaagagucuuuuccagcccuuucaucucuuaacccugucagagagagccauucucccuuuccccagcccccagcaggccacuuccauuuucaccugaguggaacccaggccaagggcuaagcauggcccucauuuauccucacagcagcgguccuguguggugagcauuauucuuguccuuuuuaauguggagaacacagaaacugggagaggcgaagcugccuaucuguaaucuaccaucagcuuacaaagcuaagcugcaaaggcaggccuccuacugaggguucugcaaagacccugagcacacgcacuauggauggggcaaacccacuuccuucuaaacaugccugacaccauucucucccuacaggaaacugugcccacuaucagaagggaggauggugguauaacgccugugcucacuccaaccucaauggggucugguaccgugggggccauuaccggagcagauaccaggacggggucuacugggcugaguuccgaggaggcucuuacucacucaagaagguggugaugaugauucggcccaaccccaacaccuuccacuaagcucucccugccuggccacuaacaccauggccagaagccaucccagccgugugaccucagcacagcucuucgcuggcccaccucaggcuggaggacugugcuuuccaauguggcucugucagacgauggaaaugaacaguguucucugucccuacugcguucuuuuacaccuaacagcuccuuguauuccaggauaggauagaacugcagagucuuccaaucaguuaagucccuuuaauaaagacacaacugccaauaucgccagaucugacagacaugcacacgagccaccagguguaugcucuuagacacacaucacacgugggaugucgagauacacauauggguuuccacauauacuuaccuuuuccugcucaguucucaggugcugacuccagcaccauagcuuugcgcuuaagacaauguaugucucauugucuaaggacagaacaggcauuguagcccugauuucaaaaacaguccuuggcacugccuggauuuucccagaauguccucaagcucaucucucacauaggggcuccuggccuucucuccuugagccccaccuccccucagacuguugcacuuccccucucaggacggcucagcaucccuccguacaguuaccccucagccugcaccuccugugccuuagucucuggcugcucacuggaagucaaguccucuucucccugcuccccuggccucuccuuuucugccacacagagcuuuauuucuggcacaauucguuggccucugggcaggaaacagucugggcucagguccuggcugagaagggaaggccaggccagaagccacagaggcagcggcauagaccuguauucaguucugcaccuuccauucauacuuuagccuccacagaauuuuaaccucuacacaaacaguacccugcuuugccagagacaccccacuggagagaagucgcugccaauagguugggguccccagacagcugcagauuugagguccugugcucauggggaacaaucuucacccugucaccaagcuacaucuccucagaagaugaggccacagaaagaaaaacugacuuuccaugaguugccaugccaucaggggcuccugacacacugcagcaggguggcuuccugagucuuguuuagaguuaccagaugacugcaaugccaggggcaacauauaagucaagaaguugagacccucccagugggugugugugccaggugugugagguguggggcauuugguacuguccacaucugggugcacugcccuguuaccucagcauuucucccaguguaccauguagcauguucuguguauauauaaaagggagguuuuguucguuuauguuuuuaaaaauauauugccagacacaaaucuguguauuguaaugacacaaaucugcaauaaaagccaucaguguuacguggauacacccacacug

SEQ ID NO: 773 - RNA, 31786 nt, Mus musculus
caguguggguguauccacguaacacugauggcuuuuauugcagauuugugucauuacaauacacagauuugugucuggcaauauauuuuuaaaaacauaaacgaacaaaaccucccuuuuauauauacacagaacaugcuacaugguacacugggagaaaugcugagguaacagggcagugcacccagauguggacaguaccaaaugccccacaccucacacaccuggcacacacacccacugggagggucucaacuucuugacuuauauguugccccuggcauugcagucaucugguaacucuaaacaagacucaggaagccacccugcugcagugugucaggagccccugauggcauggcaacucauggaaagucaguuuuucuuucuguggccucaucuucugaggagauguagcuuggugacagggugaagauuguuccccaugagcacaggaccucaaaucugcagcugucuggggaccccaaccuauuggcagcgacuucucuccaguggggugucucuggcaaagcaggguacuguuuguguagagguuaaaauucuguggaggcuaaaguaugaauggaaggugcagaacugaauacaggucuaugccgcugccucuguggcuucuggccuggccuucccuucucagccaggaccugagcccagacuguuuccugcccagaggccaacgaauugugccagaaauaaagcucuguguggcagaaaaggagaggccaggggagcagggagaagaggacuugacuuccagugagcagccagagacuaaggcacaggaggugcaggcugagggguaacuguacggagggaugcugagccguccugagaggggaagugcaacagucugaggggagguggggcucaaggagagaaggccaggagccccuaugugagagaugagcuugaggacauucugggaaaauccaggcagugccaaggacuguuuuugaaaucagggcuacaaugccuguucuguccuuagacaaugagacauacauugucuuaagcgcaaagcuauggugcuggagucagcaccugagaacugagcaggaaaagguaaguauauguggaaacccauauguguaucucgacaucccacgugugaugugugucuaagagcauacaccugguggcucgugugcaugucugucagaucuggcgauauuggcaguugugucuuuauuaaagggacuuaacugauuggaagacucugcaguucuauccuauccuggaauacaaggagcuguuagguguaaaagaacgcaguagggacagagaacacuguucauuuccaucgucugacagagccacauuggaaagcacaguccuccagccugaggugggccagcgaagagcugugcugaggucacacggcugggauggcuucuggccaugguguuaguggccaggcagggagagcuuaguggaagguguugggguugggccgaaucaucaucaccaccuucuugagugaguaagagccuccucggaacucagcccaguagaccccguccugguaucugcuccgguaauggcccccacgguaccagaccccauugagguuggagugagcacaggcguuauaccaccauccucccuucugauagugggcacaguuuccuguagggagagaauggugucaggcauguuuagaaggaaguggguuugccccauccauagugcgugugcucagggucuuugcagaacccucaguaggaggccugccuuugcagcuuagcuuuguaagcugaugguagauuacagauaggcagcuucgccucucccaguuucuguguucuccacauuaaaaaggacaagaauaaugcucaccacacaggaccgcugcugugaggauaaaugagggccaugcuuagcccuuggccuggguuccacucaggugaaaauggaaguggccugcugggggcuggggaaagggagaauggcucucucugacaggguuaagagaugaaagggcuggaaaagacucuuucacaaugguaaagggaggguuuaagaugaaaugcccuucuuggccucccuagccugaauucuauccagauaacuuuuuguguuauuuuguaaaagagggguauuuccaugaaacccuuggcauuaucacaugguacugcauucuacugccaaggacaagcaguucacuaaucagaagugugggcagggugcaggcaggcaugcuggggcauggcaggcaugcuggggcauggugucccacagagggaggacaagagcccagucaccuggacuuagcuggggucugguccuaagaggcaccccuuccucaagggggagcugucuccauagaagucaugggaggagggggcaaggagguugcaggcagcaggacgcccaggccuuaaccccggccaucccauauuucccagagauuuucuuggggcuccugcuaagccauguccuaacacuagaaccaaauggcagacagggagagcccccagcagucucccuauccacacccuggccccagcccuguguacuauugaaccccaucugacaguuuccuuacccuaugcuagcuuucaaggacgugcuguagcgccacgguccagcaucaggcacacgaaggccauccuucugccuuuucugaaagcuuuucuaauuuuggcucagaggaccgcccccugcccccaccuacacauacacuacagagcaauggcugcuuuucuguggcccuuacagcagaguuagaucagugacaaaauggacagcuagaucucugugguagguccuauuccacccgacccuggaaguuaugcaaacuauccacuagagugugucuuagggaccugggaugaguuuccucugacuuaauaucaggaauuacuugaagcacaagcaaauuucugagauagccuccagagcucacuccucaaagggacaagguccucuuucagaccagaacauaguggguggcuaggcaggaugggcuaggccugccuaagaaacaaagacucagucuagagguagugucagccucuggagcccuggaccuugcuaauuagccaaccuacagugccucugggccucaugaaauguuccugagugauagacuucaaaaccaugccuugggauggaggacaugcuuguggguguuuauacuuagggcugagcuacuuguguaucuuggauuuuucuggauucuucuuuguuucuugcuuaaucuagacccgguuuugaggaucuaauagggacagaugacuucuccacuaccuggcuucucuuaguggcuuucuuacaguacugcauucacauuacagguacccaguaagagagucccaugcagauucuuacugcaugcugcguccuaaucucacacugaggcagaugcucuuguaagguucccugaccuucuaggaggcauuguccuuacuuccggauucaagaguaugcagcaugcuguggaugcauggcugaggaggugggggcagccuuggaguguggaaugcaugacacagacucugugggcugugaacauguguucucagaacugagaagccugaagcaugcaugccuuagcccagggcagcccucaucugagaucugugcaccccugcuuccgcuuuuguaagugucauugucugaaggcaguaggcagaaggaaggacuugguaaagcugccugacacaauggcauccucuugcuccaggccuuggggucagggccucuaauguugguggaucucucaucccuguucagcaucuagguuugguucuuuguuuccuaccuguguagacaucauggucccuguccagggugguaaacuguuugccguugugccagguaaaggagucgccugcauugccaugauaacgccccagccgcagcuuauaguacucgcuuucuggcuccagucggaaacuggcauacucagcaaagacuuuacggccagaccaguccuccaugguuaccagcaguuuguaguugccuugguucgucagccaguagauguucuccaggcccagccaguacucaccaucgauguucccaaacccuugcuggggaagauccagagagauucagugaggggucugugucccaggaauagucagaguguaaggcaggccugggcuccaaucccugcuaccuguguaugaggcucuaugucugggugagcuacugaaccuuuguaacugucagucaugugccauucacacaucugacgagcacaccuuuucccugccgucaugugagccuauuucuuauugccugaggauucuguaacuucucaaaggcaggaagauguggucacucaagagccuggcaccgaggagguaugcagccagcauugcauagauaagagccauugccucccccaugccucaguugccuucucuagagauggguuauguguguggguuauacauaagcucuagcauagacugccacagcuaagaauugugauaggccugugacauccaccuggcccuucuagguuugaaacucaguaauuguguuacucauuugauaugugcuuugggguaucagugagcagugacccccaaagucuuugaagugguuuucagaaccagguacuaucggccuccauaggaugugugaacccuugcugugcugugccaucaccuugagaacauggaggagugcaaggaggaccucaaggcuaggcuuuggaggagggacaagcaggagauauacaggcuacccggauggggcaagccaggauggagaagacuggaggcguuggggcugcugggagcccccggcugccguugcugcuuuacugcgcaguagcugugagccacgugcaggguacuuucccugcucaccugcaaagugacuuuguaguaauaccucccucaagggcauagucaagaguuacagugccugacacaggacauguguccauugaccugagcugcucaugcccuccuuacuguccccucuugguucagagcagggugggaggugugagagaucccuugcacuugacuuacaaggagaagcauuccguauccugggcacugggaggcccagagaauagaccuuguaguuagggcccacuuauugucagaguucccuacgcguggcuuuuagggggcuucccaggcccuggaacccugccaccuuccccuucuggaccucaagagcagagccaccuuacagaggccccagcugggauaagauccugucucuucucuguccucuccuguacagcagacaaggagaggccuggccuuaccacucagauggcuuugcagagaugguccuguccuugcugugcagucaccuuacaggcaaugcauacaggcccaguggucucaccuuauaggucucccaguuccugaagaaguugacagagccauccaggcgucucuggaugacaguccaaccuccagggucaugucucuggucacaccacaccugcaucaggcgguugguauucucaggcuucaccagguagauggagcuggugcugugaccaucuuccagggcuugcaggcagucucuccauggaccuguaggcaaguauguguauguuacaacuguuugcugccaggcuacaucuagcuauguucuagacagguauacacucuaacaagagcuaaggaacacauauugacggggcagauguuuauuuuguaaccuugagaagucaucuacuauaaaagcaagagcucaggccaagaaucaggaggccuggacuccaagccccauucugcucucacuuccucucguguccaugaggaggccguucuucacugcuccuccacccugcuuuuuuuuuuuuuuuuuuguaggugagucauuguuuuccucauucagaagaacuauuagaguacagaucauuugggugguuauucuuugagugacuuuuaaaaaaaauuauuuauuuuauguaugugaguacacuguagcugucuucagacacaccagaagagggcauuggaucccauaauagaugguugugagccaccacaugguugcuaagaauugaacucaggaccucuggaagaguagucaguuuucuuaaucuuugagccaucucuccauccccucuuugagugauuuuuaaagaagucauucccauuggugcacuaaguaugugccuaaugaucauggccacacucuucagugucuugugggcucagugcuaugcuuugccaauccagucugugguucuccuuagcagguggcaccaaaaccacucuaggagccuguagaugcuaugugucuuucagccccugacccuggcucucuguccucuaguaauguccuauguuuugaguuuacuugaguuuacuugaguuaucaggucuagucaaguuggggucuuccucagugauuggaggaaacuuuuggagguuuuuaagaccuaccuaguagacugcauaguuuaaaauaaucauuauacuuugcugugugcuuuucagaacgccuuugagacugagucguuaagaugaaauguucuaggacaugggacuugcuuccuacuuuguguguuccuucuauaaguauccagucgauggcugcaguggugcacgccagucauccuagcacuuggaaggugguggcaagaggauuaggagcucaaggucagccucuguaacgaagugaguucuaggccagccuugguaauaagguccugucucaggaaacaaagguaaaaacaacaauaaagccagcuauuuauugaguuccauucccuaaaggcugcccuaggccuggggaaccuagggcaguguagguugucucugguggccagacucuaccagcauucuuagcuaauucuggagaucuucucuuucucucuccaugggugggaagguagcccucugugucgguucauccagcuuuuccuucgaaggccuagcuuugcagguuccuggaggcuagcacuuugguucagcuagccuauugguucagcuaaagcuuagauuugggaaacuuacugggccaugcaagcaguguggagugccuauugggaacagaaaccgucugcuucuuuguccaucucugugccaguucagcuggaugcugacugucagugugcugcugucuucauucucuaggugcuuccuacacccuugccuuucaaagcucugcacacaggacaagcagguuccccaagugcccaaccugugcugaauguaggcacaaagcacgccugcccuccuucccucccucccucucucccuucucuccuucccucccuucuucucuccccucuucccuucccuccuuccuuccuucuucccuccuuccucccucccucccuuccucccuucuucccuucuuuucuuccucccuucccuccuuccuuucuuccuuccuucccucuucccucccuucccccccucccuucuucccgcccucucuccccuccucuauccccugaugucacuuccugcuuuugcuuucccccaguuucuguccuggggaaggggagaggagaccuucaggaggaacauuuaaaaaggagaaaaagguuuucauuauuuuuggcccaagcuccagggacugagacagaaugagagucugucccugacagcuggagcagagcaccgguggcgugggaggccucccagcuuuccaccaggucagcaggacagggaggcgcuuagugagagagaacgcugggauggaaggcagaaggcaugggacauaacagaauaaugcccaccaaagccagcagccaggccucuuccugcacagccacgcagcuccugcaguggcuccaugcugaggcuguucuugaaggggguacaauauagguaggguuuggaggccacuggaaaagugauagguuggucucauagugaccaaucuaugcugccuuccacaguucauuguggaaugccucugguauucuugaaaaugggcuuuacuuuuuaaaaaauuuuauuuagauuuuuuuuaggauaaguauuuuagaaugauuugaggucuuuaguacuaaaauauuuuaagcagugauaauuuuagaaaggccuggggauggcucaggagguaaagagccugcuguccagcgugaggcccuaauucaguccccagacccauugcacagccuugugacagugugcucccaugaucucagcgcuccuacagcaagauacaagauagagacaggagaggccccucaagcuuggggaccagcuagccuggcauccacagugaccuggcacccaagagagaccuguuucgggcaguguguuagcaugucaucugacuaccacaugcaugccaugacacucauauaccuguacccacacguguaaauacauauaaauauuauacacaguacaaaaacacacagagauacaaaacaaauaucucucucucucucucucucucacacacacacacacauacauauacaauaaauaauuuauugaaagaagaaugcaggcuuguacugguuuuggacaugcuucagaggguaagcagacucuugaggcccaggugagaaugccucacucugagaaaggccugucugcagaaguagcagcaauaacuuggcauuggaaucuucacauggcuuuugccgaggccccagucugucacaggccuugcuuagguauuuacacugcugauucuucccaugcuccugguagguaguuguaacugccucauuuacagaugaggaggucugaacccacagaccuuaggggacaccccagagcuacauggcccuuggaggcagaguggucuaauaccucaaaugaucuguuuaggaauguguucacucugaugcacuguuauuucuccccagccaguguggccuugagaacagaggccuggcucuggucuuggcauacugaugacuuuaucugucagguuguuaaaccccuuuauuuuugucuuuguugguaauucggguuuugucuugucuuauuuuguccccccuauguuuacuuacucuguccuuugccuauuuugguguuuuaugauguugaaguuuccucuguguguauguggcaaaucuggucauuguguaaggccuucuagaauuguggaguaguuugaaaugauguagaagcauucauguuucugccaucagcuucguuaaauggcugaggcucucucggaagccucacagaucgccacacucaaacacauccccuuucuuaauguaagugagaggcaaaaugaucaguauaaacagcaggugaaagucaguucgaauuuuagauugcauugagaacaugguaccaacacccugcugagaugagaagccuuuguguaagagggauggggcagggaccaaucuguggggcauauaaauaaugcaauggggauccaacacuguaccauauaaauaacuugggacgaaucuguuagcauuacccuuggauaaugccacaaagggccaagcagagaauucaacuuuugguaaagauucuggggcuggaguaguauaugguuggagaaagacuacugauacuuuguuggaggugcuggggucaaaucuugguggcuuuucuuacucacuguguaacucuaggcaggucccugccucaguuuuacugcugugacauagggaaagaacacuaaccauccugcagaucucaggucagggguuagauuaagucuuucuccccuuagaugcaagcaagcuugauauguuggaagugcucagcuccuuccuugagauacacaugcugcuugcucucgaaguuccaaaacuauguauauauuauaauacacacaugcauguccacagugugugugugcguguguguaucuauucaugugucuaugucuauuaauaaguauuuuccacuaggcacacuuuagaugucagaaucaguggaggcuacagagcugcacugcaguagaaaaugagaaucuuuuuuguugaguauagcugaguguucaaagugcagugggcaaagcaucuucuggcacagagcgagugcacagugguguuugccuuggcuccccuucugagagguagcucugcccgcagaaccaggccaacacuaacucggcagcacccaggcucaccucuauaaagaccauauuuacaccguagucagaauguuccacaugaagagcaguucggcuaccauggcaagcagaucugugugguucccucgagagagacagcagugcaggaaaggcacaggauugaggccgaggaugggggagggacacaagauaugcagcaagccuuaggccuugguacucugggaucagccuugggaauuuugaaauuauuuggacuggaguaacucaauuaauuugguucugguuucucagcaaucagcuaggguugauugaaggcagcgguccacuucgugaucucuccucuggcauuucugauggagacaucacagguacaaggcacagagccuccaugaaaaacagggagcacuucauugguugucuuccugguaaaggcaaguugagccuggcagccaggcuagacucaaguguacuauuaucuuguguguccucucugagaccugaggaugagcagccucggcuggauuggcccaggcccuguagcugguccugaugaggcaggggcaacacuacaucagcucaccugaagggcgagguaagaagcagggcuucagugcuggccagcagguguggcuccucuccucagccucugagccucagggcgugguggccuuaggcugaauagagggcuuuaauccuccugucucccuagacauuaagacaccuuccuugugugagaacccugucaguucucauuaauggucugugcccgugaaaucuguuugccaacagaaaggacuagauguaaaauuggaucuggaauguccuacucaaauuuauccauuuaaugccagggcaaauguacuucguaggugugacccacccuggccaguggcaggccccuggguguccugaacaggcaggccugaagucagacccuguaaaaggacauaaggagcaauuuuaucugauaauucuugagucucacuuuucaguaaauuuggcaaaagucuugucuaugucaauggcuaccuuuuggugaagcagaguacaaguaguggcccaacugcaggacucguuugcagguugccaaguguuggcaguguguguguguugucucuuccuugcguggggaugugcacaaucuuagucuguccucagcacugagggccuugggcagagagcgagcuuggagggauucauuaugauguuugaaaccuaaaacaaaaucucacuggcucucagaugggaaaagaaaacuacgaaauaaaaauucauuagccugugauuaaauguccacaaaguguaucaaccauccaucggguucacugauugguaacuuucaccuccauaaaagauguuauuacuuugaaacaauuuguagguuagauuuuucucacuucccaagaauuccugagcaugccugauguugcugagaaaucagagccaaccauaaauuaauuggguuacugcuggccaaauaauuucaaaagcagaauuauucaacuccuuucaaaauuguuacaguaaaacuuauauuggcugugugaggcgagggggcuugagugcaucugauacagcuccagcucucccaagagcucuuagggcccaugaagggcuugccgggccccagccugccugccugaccucaaaauaaauacuacugcucuacuaaagugcucaguguuaguuguugcaggccgggaagcaugcgcccacucagguuuccagcaggcagcuaggcaggagaaaugggaguuuuaaauggcuuaggaaagggguggggcuggggguggagcucugaggcagagcucuugcuugucauucucugggcccuggguucaaccaccaacaccauaggggaaaaaagagagagaaagagaacaauguuuaggcuagcaggguccuggaaaccuuacuguguagagcugagcagcccucugugcuccagggcuggagucgagccuccuucccugguguugcuguugguagccuccagggcugccugggugagguaggcacagaucggaugaaggcuaagugcagacaccacagaagaacugaucagacccaggacucucaguccacaaaugcuuagcaaguggcuggugcuccuguggucagccagucuauggacacuuugagaggaagggagcagcuucauugcucuucuuaaggaaccucuguuggcuuucccuguuaccuuuuuaucucucacaugcucacaaggcucucuuuagccucuggucugccauuuuacucuggagcuggaccgcaagccacuuggcauguaauuuguggcauuuuggccuuuuucucugucugcaacaggacauuugccuagcacugagccuggucuuuaugguuuccugacaguugcugaccauggcugagagcagauuugcagggcuucagcccugcagggccuugucaccucuagaaagccuuucccaucuccaggacgucuucauccugccuaggcuucucaaaagccuuuguauauauuccuguuggaguauagcaugagcgucugcuccacaucucagagagccugucaccagguaaccagacaucugccuccuaggccauuucaccuuuuccucagagccccagauucaaaggcagcuugggcucagagaucuggcacuggugcugacagcugacucuggcaccagacuccucccuucauugucuuguuaccacgcaucaggguugugugaggucuguccccagcagauggcagugggcucuugugggagcaggcaccucucagggcagugagucugugguaagcagacagguaaaaguccuuccccaguccaccugccaccugugcaucuucacaugagcguaguaaguuauagcucucucagcucgagaaccugaaaagcagaggccuccauggcagauggucaucuguauccaaagcaaaccuuaaaacaaaaucauuucugugggaaugucuguagcagaccgugugcaguggaggcccugagugucagaguaguaccacgugcuggccguugguggucuuuuagaaacuaccccuaagaaaaucacauaggccacucaaucucaacauaaaaggaaaagaaauuaauuacugucuuugucauuuaaaauaguauuugauuuuuccuaucaauuuauucuguguauacaaaaucuuaaaauauuguaucuaaagaggucaggaugacuuaagaagagagcacgggugacacaugugcuuggggucagcacuccaucuccucugagauucagguuuugccaaggcacucuggacccagucaccccugggacacugaaguugaugggcagucaggaaggaacccucucugugacccaugagcaggucucucagcccuccuuaacaagugucugccauuuccuucaucauaugccuuggccggcaagcuuagugagcgugaugguuuagauaccagcgggacaguacuagcuagcuaguucugcuuucucuuuucaaaaaggaauuuggcagccugcugugacuguacuguagaggcaaccaaguaaauucaccacagugauugauccaucuguguagcuacaaguuggccaccgaagcccagucuccaggauuuucucgaauacuucuggcuugccaaaugccaaacuauugggauucccaugcccugagaugccagaugucuaacuucuaacagccacaaaguugauaguuuaucuccugcaaauagccagggccuuuagccacugucauccuuggaacgaggccugagggguggagggauagcuaugagccacacucaaaggcccuuugugaucaauuccacagaccucugggggugggguugcaaggaagauggccccggaaccgccugccucuaguggcuuuuguuuaggaagaaacuaacaaggaauguucuuugaaaugucggccguaauggguuuuggaaaucuuaacucauuuaagaaaacauuuuaggaaaaagcaaguauaguacaggggaaaacacacacaguccagagguggagaccagguggccuuccccucagucuccauggccccaaaggcuaagucaaagucagagcuagccaguaccccucaccugcagcaucacuccccgcucugccaccuugggaccaguaccuuuucucuauagugauguaaaccgagucgguuuuaagacaugcugcugugcugggcagccauugucugcuguucguaguuccugucucagggcaagugagaucaaagcacggggacaucuaccuaggaaguccuaguggucagcuucuccaagccacgacucuagaggccuaggaugagagggugguuugcacaugugcacuguguugucccugaagcaguauggcccugagaaggcaucauagcacggagaguaaacauguaaggagaacaugaccuauggcccagcugucuaugaaaggcuaacauauaaccccagggguuuguccaaaccuacaggagcuaauggcugggucugccugaagcuuccaaagaccuguggccuggucaucaaguauaaauccuggguuuugaggacuaaggaagaguggcuugucgugccuggcauggcaguagcugcugugucuguguggcacuguaagguccccacaaacccccacauauacacacaugaaacugacagaagccaggcugguaguggccagugcuaagucacauauuucccacacagugcucaagguguucccuggccuggggacuguaugauugugccugaguaacuuuaaacccugaggauccugggaaauacaagugcagugacccgagucugcucugcaccaagaggccaugugacagggaggccacuccagggaccaagguauuuuaguaguucuguuucaugacauuggggcuccucauuugucccuggagaaacucacuaaucagaagaggcaauacauagauguaucugagucuuuuggaguuuuuauuguuguagguggguuuuuuuguuuucuguuuuaacuuuuuugagggaggguuucucuguguagcccuggcuguucuggaacucgcucuauacaucaggcuggccuuacagaauccgccagccucugccucccaagugcugggauuaaaggcaugcaccauccccccauuggcugccuauugguuuuuaaagacaucugucuaggaaagccaugcuguacuccugguagcuggcagcacuaugcuucuuagccaucuccacagugggccuugugacagacuggcgugugacgguagcugccuggggugaggucagaguucaucugcccuuuccugugcuccuuagagaaugcccgcugaagcuguccucuaacagcugcaggaccgcaucccuguuaggaccucuaacagcagagggccaugggugggcuauuggcucaggcagcacuguaggcaccauccaaaccaaauauucccugugugaccagccccgagugaaguggaacuuaugugugaugccagggagacgaggcuaggaccuaccuggauccuucaucuuagcuguuagcagguaccuccuggccacggccagcaugucacugucugacuauggcugggagcaagucaugaggccagcuucagauaaggggcuguggcugucuuggccuucuggagaagggcaugcugauuccugagcagccacaacaauggaacaaaggacugauggcucugaacuuacuagagggaagccaaaggcuguggcggccugagugcaagguguuugauuguaaaggaguuucuggcugaguggcggcagcaagccaaggcucuugcaggagaacacagagggguuuugucuuucaggaccagaccugccugagcuggaagagggcugauaaucacugucugcccauugguuggaucaaggcagaccaucuucuuuuucaucucagaucaguccaaacccaggaaagguagggccuuuccauugccacccuccucccugcucugccugcccuugugagguagacaugcagaguaagagagagacauuagaguacacacaggucaucucaugcuuggugagugagcauggauacucacggggacugccuuagguauagcagacuacaggugccacagccuguccuggguuauaaauagcuguaccggggccauuugagaggcuaggagaagggcuaugcccuuggggcuuucuacagacccacuuccaucaggugucccuccucccagguucaccugcuaaacuuagaaagccuucaagaugcaggacagaagugucaucucugagccauucaugcuguccagcagggcguggucaugcuaccuuagugaugccacaguccuucaucugccuuccugguggacacaagcacacuauauacacuguucuauauaguguccagacaaugcucauuguauucuugguauuuugauaugcuggcuucauaaauucucacaguguucaagaaauuuggguccuuccagagaaaucuugucaaaccugcucuguggaauuugaggaauagacaugauuggaggcaggacagauuccagauaccuucacacacccgccaccuccccucacuggguuccuggggaccagggaccagaguuuucaccgagucagaggagggcacaggcaguauuggcaaccccuggugacaucauugcacauuguguuuucaugacaucgucccgagaagcuguaacucuguuccugucuccucacgugaaggaaguuaaggcucagaagaguuuaaaacaaaacagaacaaacaaacaacuguugcacauuugguuuugaucuccguguguagagaaccucaaggaugaccuugaacuucggcuccuccugccucugccuccugaguucucagauuacagacacacggcaucgcaccucagugcagacacugccagcugagcugcacuucagcugacuuaaauaacuuucuccagagcaaauagggaggaggagggacgggcacggcagauccagguguuuauccccauuuuguucccgcucaggaaauguccugagauggcugaguuagaaaccagagaucccaaguugaaaggaggccugggugacugugacaccagccuucauguggugcccaagggcagugucacucuggguauucugucggaacacagaacgcacuccacccugccuuugaccucugcugcaaaccaggugugggugcagauggcacucuuauuaggcacuggacacagagcugaagacagacucuucaugccagucuccuuguuuuaagaugcaaagaccgugaucaaaggaggcucaguuuacugugggccagugccacacacacauucugcauuauuucauaauagaacugucagcugggaacagacugaaauaaagccuacccauagacuuagaugaggagcccaggaacagggugacuuggcuccuguccagaccucgccaauagaaggaggaggauuucgauccaggauggucaacucugcacaccugcucuccacccacaccuaguccaggucuuucuucuaaggugcuauggcauaugcugugucaugugccuggcuccuccugcccccacuggccuauccauucuugaucugcccacuggucacccucauacacacagguucaacucaguacugguuuauuuuuuaaagugugaaauagguacaaaggaucuuuucaguaaaaaucucucccugucaacaaagacauugguaccccaugcauaguuuuaguuaacuuuuucagagauuuagcacagguggaaaacaacacugccuagauaaaggagaagcccagcuccuggaacugggccucuggagaggacucuuccggccugcuccccuacccugacgauuugccagagccuucacacaccugccaccuccccacacuggguuccuggaggcuagggaccagaguuuccacuaagucagaggagggcacaggcaguauuggcaaccccuggugacaucauugcacauuguguuuucaugacaucgucccgagaagcuguaacucuguuccaugugucugaagcaggggcccagcucuaccugagcaucuucaggcugugaacagguuagucauccugucccuaaggagcugcaggacuagucaagugacccucaugaaaaucccaguguaguaucuugguuacacuucccagggugugcucccaaggaccccauucuucuauuacggugucuugagagucucaugacaugugugcugagaguguaaggaagccuuauugaaaacuaggcagcaccuaacugaaggaaacuuccauccagugcccuaguccccgagaagcauuaacuuuggacuuuauagcacucucccacuagccuagcguuuaucaugugacauuuucagacaguuagcucugggcuuacacaggcaugagagcccacaggugagacaccuagccacuaagacagggcaggugcaaaaccucagaguauccaggacuguauucucuccccucagagaccagagcugacacccauaccuucuagcuucuggguucuaccuucuaccaccuuauuggagcaaugccaucccuugcucccaucaacccaacuccacuggauccagcagccaccccagaggauugccagaggauuauacaacuuucuugagacucacaugcccacauguacccccaggcugaggggcucagaggcgcaugggagcuggacuccccaaaggacuuaccugauggcuuaucaguggaagaugggagacugguaagggcaggcauggugggcaaggagggcggcagcaccuucagauucuggucacucuggaucucauugguggaaaucugguugaugaugcgguuguaggugggugguugguagacccgagguggagcugcuggggguggcuggggcauaggccuggcugcagguacgcguuggcagugcucuucgagcugagcaaugaccucugauugguugugugccagcauagccaggugcuggaacuugugcuccagguccuuguacuugcuagccagcugcagcaugucagcugucugguucaggauccuguucuccagcugggagagcuccagcgcauugucucgcuuucgaaugaucucauguagaaguugcauguacagcugcgugacucucgaguucauguugcggcucuccuugcgcagcagcuucaccucgcucacgaugccuccgucuaccucuaccagcugcugcagcgucucgaucugccgcuucugcuuaagcagcucauuguugagcagcuccagcuccugcuugugcacacgguucuccaggugcaccucaggcuccuuggaguugacacaaauggcaccugugacccgcugcuggggcacaaugaaaguguaggugcacuugucgggggacucaccugcccgcuuguaccuguugagguaaauguacucucucugugaaccauccucugugcccucaacgucagccucugggccuguagcagcuccgaccguggccagcaguccaagccaccaguaggucauacacaguggccucaugguccuugcagugugcugguuggucuuuaugaacugaaagccuaagaguggagagauaaggucagugacagccccaucugccaguggcuugugcaagguaggacguuccccaaauacacguugcggacgcuaugucccacucuccuggagucagagagaaugauuguuguugaaauauuaauagauaguggggcccugcagagguagagaggaaaagggaucugccauacccagagcccaagaauuggcucuguaagggcagaugcaggaucucucagccucccaucccuacaauguagcauugagaagacuucagcuaaaugaacgagcugccggacacagaauggcaugugcucacuuaguaguggacaguaucagaagacugugucucuguuuuuccugagcuacaaagccccaaacaggaauaaucugaccuugucuaaacccaaauucuugcgacagcaaguauauucagggcccugaucaucgcagagugauuaaguuaggcaugucucuggcuuguuuccuggacaauauaucccuuccccauauguuccucggacauaaaggugugccaggcaguaugcuuacucgauguuggggguauggcugcucucacagggcuuccaugucaccagaguucccaagaacuguaagaaggaacagucaugugucgugaaagguuaugacaaggcccugacccaauagagaggucaggagcaacuucccugagaaagugaccuuuguacugacucuugagggaugagcuagauaggccaagagggacauuaggaugcguggcguccuuccuccaggccccugaagggcaccagcagucuucccagucugguuuuccuauaccccugccauugucucucuggagcucacggccucucuccagcuacucuucuauuugucuuccucucucuuuggcagagcccuccagagacuugcccacucucacaguucucagaccccaucagucucugcccucugcccaguuugcaggggucugugugggaggucuucuuccucccugucccucccucucagccugcucuuccccaccccucaccccugccccacccccacugauuuuuuuuccccuguguuagcaaauagcaacuguucuagucacucaggacacagcccuugaaguaauucccagcuccuuagcucuguucugccucuaacuccugccucuaaugcaccacagaggugugguagccauagcuuagaagggcuccccagugccccugcuguccucagccacuccccauugucaccuauacucccugccuucacugugugccucgauuauugcagcugcccccuaaccugcaacccugucccugaccccugacagccagagauccuuuauaaaguccaguggagucuggauucgcucuucaaugcaagcccuccagcagcuucuuaaagcgaaaggcuaggacucuuggggcccucccuggcccagcuucuguucucucccauauuucaucucuggucccuucccugcuuagucacuucuugcagccacuugggaagcugcugucccuuaggcucccagguacuaagaacuccauucuuuauccgccucuccccuguuucuuuggugcuuacuuccuuucucuuucaugucuuugcucaaagaucaccuucucagugacaugcucucucccaucuccgaaacuaaccuaagauugugaccacuacuuuccucagaguccuugucaccagguuugugcugucccuacccccaaaugucagcgccuccggggagucaguuuuguucccuguaccauuuguaaugucuacugccugacccaaaauagagauacuuggucaauauguggugguggggggugggagaugcaugugugaaaagacagcagcagcugcagugcaguggagagagcuguggagacagaagcaacaagccaggagcccgugugggaccaaggugaucaaccugugcgauugaggucacgggucagauucacuguuaacauccauagcaugcauggauugggugucgccacaugccugacuggggcuucuucucuguguucuuauagugaccuugauggcagcugcucugcuccuuaacuuuuacaguguauguauaugugcauaugugcauauguaggagcacaagcgccagacacacuugcagaggucagaagacaacugcaggagucaguucucuccuaucaugucugucucaggcaucaagcucagaucgucaggcuuggugcaagaacucuuacccgcugacccaucucaccagaccuagauauucuuaaucccguaucacagagcaggggacugggacucagucuucaacucucaagaucacaaggcuaaaaggaugcacaacuggaauucagcccugugcugauggcccuuagcaguugaaagccaccagcagcgucacgugugcacuuaacauucuuuuguuuguuuguuuguuuguuuuguuuuuuugagacaggguuucucuguguagcccuggcuguccuggaacucacucuguagaccaggcuggccucgaacucagaaauccgccugccucugccucccaagugcugggauuaaaggcgugcgccaccacgcccggcuauacuuaacauucuuaucugcugaacguggcuguggcucaggagcccaaggaagcuucuucugggaaucccuggcugcaggcugugccguggaccagccaauguaacugcagaucggagccuguucuccacggggcucugcugggcuguuuucuacugaaguccagagcccauguuugggcuaacagucaaagaaggccuacugggccaggcagggaggguauuuaauggagagcucuguggagagguggggcuucaguggaaacaggaugguuugacaauguuugccugguuuccaaaguuuugguuccuugggagcugauggucacgcccccacuguagaagaguggggagaagcgggcuccaggcuaggguuggcccuccugccacaccuucugugggcagcucaccugccuacuuggugacaaacaccucugugcuguggccaagaaacugucagaaugccauggaggcaacuuggcaccaaagaguaaacuugauuucuaaacauucuugggcauccacaccuggaagguaugguguacuguuuaugguggcuucugccccuuucaacuguggguccucacugcucuugccuuuggacuugagauccugaagucugagcacuuccuuuguggaaugaggugguucaacccccauugcacauuggguaaagaaacaugaggauagacuguuaugauggccacaugauagcaagcccagcaaagcacuacugaggagcagagaugauggcuguggguaggacgccauugcccucuuggaggaaaggccacuaauggcccacuucauagagaaccuacguccagucacaaagcugcucaguucugaccaaguucucacccugggcagcugcccagugcuggcacacgguggguggcuggggacguggucacugaaccccuuuuccuggaagaacauagauugucauuggacuaaaaagcaaaccaaacuugacaugugaugcucacacacguucugaucccucugaggucagagucuaguauuuguguuguaugcgacuuaaaggugaggaugugaaagcccagaaagacacagcaguuaccaaguguccuggcaguaucugggcuuccaguuccauuugcaugggccugagcuuggugagguaauuuggagucuggugccuuacagaaaggaaugcaaggaacugaguccuccguggaggcugacauccucacucuaguaagucagcagcaguguuagugaccagggaagggagacgccuggcaugcaggcagacagggugugcugucuguggacaugacaugcagcagguaaaguucaagcuagaccaccaagggacuuuaccagggccgugguuggugcgucccucagccuccauagcaagcauuuguuuucucuaaggagucuaaccauccucugcuaguuuggcaguucugaaugggcaguaaugagucuguuuacuuuugcuuucuugauauuuauucagcuaauugcaucccaagagaaguaaccccccagcauuccagccgucuuaggcuggagacuagcucaacucuaggcaaagugccccuccuugcuuucuccccaugaccaacaaagaaaagcaaacccaacuguuuuccuuggcuuagaaauuaaaauaaaaacaccgaucggaaucgcuuuuccacauuguguggugaggaguuuccauugugccgggcuucccucucucuaacuguaaggcugcaguaaccacguggcaggacagccuuugcacauggggaggacucccugggcuugggucucacccagccuccuaugggcugucuuaguguccccauuuggccugugugauggggccacacacugcgugucugcaucccucuggccaucacagcacuguagccugggcauugggcuacuucaugggaugaagcaucauuuugguaauacagagcugacuccugcccaguggcagaagcugcuggccugggauaugcuucuggguucuuaucacaaacauugggaauggacgagaaagguucagauaauacaaauagcugcagccaguuaguucugggaagcaagcacuuugucuguaccauguuacugaauguucccagcagcccauugggaagggcccauggcuucaggacagccauguagccaggugcuggcggccuacaccugcauccuaaguaacagcagggcaguuacuccguuugacugcugaaaugcugaggaacuuugguggugagcucucacacucacggucuuugugggcuuauguauuucuaguauuccugcccuuuuccuuaaauagggucacaugugucucaggccagcucucaacucccugugaagcugaggaucagcccugccuccaguuccccagugcugggugugaggcuuguauuauuacccccauuuaugcagugcugaggauuaaugagaacuagccaagcacucugccugcugagccauguauauccucagcguauuauaucuaucuaguuaccacaaggugcacucaaggcuaaagguauguuguguguaugugggggguacuguugagacugaagaccaucacuuguuguugucauggaacuacgaaguagcagaaccaggcaggagguacacuagaaacaccaaaguaggucugcugugaaagcagugugacaggaaacuccaagacaagccuucugauccucuaggcagaaggaggcuaggggugucuuggggucugcagaauuggcucuugggggcuauucuggucaaugcagguuguauucuucuggaagaguacacuucuccaccccagcuagcacugcacugccagcugcgagcacaaacuugaggaggcaucccagccaugcuggagaccuaaaaaguaaccuuugccaaggccacaaggcccaugugcguuuggcuagcccuccccuccagcuucugugcuugagugagucugaagaaucagagcaugaauggagauggcaaguccaagaucaggacaccagagagcccagcaaaaacuuaagcggcggcaaaugguuauuacuguaaacgcugcaggaagacccagcaugccugcacagugguuucuaagccugccgcugaccaggauggggaaggagccugcugcagaguaagugucuaaacagagccaucaggugggggauguggcagcaggagugugagcacuggccgucuacuuuguugcacauguguaccccuacacucuguguuguuggccuucacaucucugugcauagauggcuccagguacugggugcucugugauuauuauuacuagcacuugggaaacacaguauugaugccugaccuaggaugcagaucacaccugaacugagcagcaaggaaagcccaggcuccaaggugucagaucgccuggaguaaacaucagaaccauauuugaugaucagugccagccccaugcccucacuccaaggucaccucuccaccacuaugaauaaagacuccuguuuguuuguuugucuaauggccaggaugcaguugcuucuuacuguugagcagacuugacuuucaagucaguacaagggugagucuuguuggacguuagaaagagcuucuucauccugugaguggagcgaccccagaaugggcaucgcagacaaacggugguagacucaccuuggguagcuuggagaaggaacuguguaucauuuguccuccaugaaucaccccaagccuggaggccagggugggaguaaccagucuccaacugccacccuucucaacccagcauccugugaaucaucccucaugagagaccaugagggcccccagggagcugcagccagcuccuccucacuucucagcuuagcaaucgucagaccuuauauaagucccucuccaugcagccuuccuuccaucacccgcuggcuuagccuuccccucuaccagucgggcuccauucuggggucggcccuguugcgagugacuugggcagaggcacagaccagagaagcagagagaguagguucacguccuccaacugugcuugcaggagugauggagaugggguggggcaagccugaagucccaggcucucgugcacaugccacgggugagccguuggcuuccagggaaggcugacuguguggaggcggacuguggucacaccgugagaucauaggggaugugguuaggcuggggagcugggugcccaugccagggggaugaggauucugcuguugcucuuucuugcugcauuauuagggaaccauuuugagauucccccaaaguccacacacggaacccucugugccaggagucacggaaugcagagcagaggcagggagugucuggagaagccauugagaggccagcuucugaguuggcugcugcauuuucuguggugccuagugugcucuggagcccuggauugggggccagggugggaggugucugaggcuggcuacacaccacugccccaggcagcuuccuggaaaaccuggacauugcccggagcgucucuccugagcccagcugaguagcugacacagaaggucgccucagccaacagagaugccuccuucacauucauccccauuucagagaugaacaaauggagccaagggaugaagacaagggccaggaccagggcugccagaugguaggggugggcuucaagcuagcuuucuuacccacacgcuccuaaguuucucccugcaucugggugggugugagacggagucucguguaguccaaguagaccggggacuggccaaggcugguaugcccaugagacuccugacccuccugcugagaugucaggcccugugugccagugcccauuuuaggggguguuaggcaauuaaacccaggucauuuggugugcuaggccaauacacuacgcuauaauucacuccauaugcacuuccaggacuaaauaacauucacauggcauuaagucagcauucuuacaugcaucuuaccuucacaugcuuucugccuggagagcccuuucccacaauucuaucugguauguaucugucuuccuuucuaaggugaccucuuaaggccaccucucugugcagaagucuccucucuacgccagcuugcaagaacaguucuguccauccagcacucagagcucagacuguacuggcuggcugccccagagugugcgcuucuuagagucgccucagcacgcccagcugcuagugcagcaccucggcaacuagacaccaaggacuacguuuguucuacuuauucuccuggcuacuaguaagagacaaagcaggaaaaaagagaugagggcucugugcuccaggggcccucagcagcaggcauuccuaacucagguggcaguacucaggacaacuaaggggccccaugacccaaccaggauggggacuagaagugauggaucuagggggaggggaagugccugagguuugucucauuacucauggacucauccacccugcaggucuccucugcuguccaggguggaugcuggagagucauucagcaguccaaccuuccacagcagagacuggaguaggauccaucccuggaaggcuugggccuucgggaaccugggagucuuugggagcugaagauaagagucccuucugggcauuucugugguggucuccaucugccugugugagaacugagugaccaaggccaagucucuagggcugcuggccucaagacaggcugguuucaccagggaguggaccugcacaauggcucaauugucagaggccuggcuccacacccagcaucucagcauuccugugaucagaaugugucucauggcaauguauacauggaaccggaugcuguaacacccccacccucccccaacucccugcuccuguuaggagcaggauacagcuuggccacagaaacuucccccaaauaaggauucugauguguacuaucuaccaccguaaacuccaagcugcccgagcuuaaguaaccucuucggcguuuucuguaaguuuacaggaaagauucacuucucuaucuaguucuucacagagauuucuacuguauggcuguagcagacugugagcugagcuggaggggcagcuuaaagcugggguuccuccuuugugggccaccgauggagaggccaugggagguacuguguuccggagccucaguuuccacuucuguaucagcucccagggccaucucuuaugacucgcgccaucugcuggguguuuguagaauuguuuacagucugccuaucucauccuagugcucuuagguucugcacagcuguucuauggugugcaccuaagaugagaaccuuccagauaaaguaggcugugauucagugagaggcagaggcugaauauaccugcccuucccagagacuggcugucugcuguguuuguuucagaugccugugcugccucaagggcuguuagguguggcccaggguaggugcugaacucccacacagcagccucacaggauuccccggccagugaugggaauaccugccagcacgccuauccugucagguggaugaaccccaggcucugcccuccacacgcagggugggaacaguguggaccgcgcagcuccacuccccacgcugcagaugugggucccugcagagaaggcagcagggacgccagggaagcacacuguucuuggagggauuaaggucagcaaaagcagacuugacagccagggagggccauagggcggcaucaggacagagaggucaggaugccguguggaguaguggaguacaauggaagggggagugggcuuuggaaacacaguacuagguucaaagccuauggaucacauagcuguuagcuugggcaaguuagcuuucuuuauuccuucaucugaaacaggaacccauuuucuaggguaggaguaaggauggaguaagauggagugccugcucaccaagcccagugggcaacuguugugggguucuugccugugagcccacagccaugcugggcaugagucgcuagacuccuacaugccguccaccuaucucuuuccgcuguguuccccuugcccagugguaaucuguaugucuuagccagauucacagaguuaggcagaaccuuugcagaggccagaaagccaccagguucacacugcaguaggaaaccuucagugucacccaccccagaagccugaguuggaagcauguacuucacagccacuuuccaaaugccaccaggaacucaggaaaccucugucccugggcucagauacgcugguguuguguggcaguaguuaccacggccaggcuugcuggagucuguucucugcuugucccucugcaacaggugcagccgguggcccucuugcgggaccaaggaagcuccauuuuccuaucccuguggcucugacagggaugccaguaggcagaucccaagggugaugcaggauagcauccugccugggagagugguguuagaaguuuuggucuaguuguauguuuucuuacaauauacuucuaggauguagaaaugcuacagguggcucaagcccaguccaagaugcaaaguaucuuuaauacauuuuaauacucuuuuauuauuuuauauuuaaauauaaauauaugaauaauauaugugauaaauaaaauauaaaauaaaguuauuuuaauacccuuuaauccucauguuguggugacugcccccccaaccauaaagcuauuucauugcuacuucuuaacuguaauuuugcuacuguuaugaauuguaaugcaaauaucugauauguaggauaucugaugugguugcaacccacagcuuaagaaccgcugcuuuagagaauguauccaggucagggcaagaguugggguacugguucuucccucugggcaugcugaugguugggcucuaauaacugguaaccagggcuuuagagacucugaacacaucucgugcgccaccccuggagagcagugagugaugugugacuugaagaaacccugaagucacaugccaggcuuccucaucugggagauggagguaguuagauguguguugugggguugcugcaggugucugcugggcuguugcugagcugggcucucagcccucuuuuucacagaucaggaaacugagguuuagaaaagcugugaucugccacuuaacagaguucagacaggagccagcucauaaucgcugccauacuaggccuguacuuggaagaacccauguggagagcacugagcuagcuuuggaacuuguguucucagucuuccucaaagggaucuuuuucugaguaacaacacuggccucugggaacucuccuaaucccacagcagaggcaauagcugacccgugacacggaugucacagggagaggggagggaucagcagagaauuucuguuuggaaauguuaucucaugcugaagcgcuugcuuucaagggacugacucuguauguggcgccugcuguguccccucacuaggcuguucagaaagcagguccuccacagucucucagccacauccugcuggcuggagaccugggauccaucuacuguauccuugggcgcagagggaaagucagggcagcacuuugccccaguccuaccgacagaaacuugugggugacauguucugucccgcacaggacgccucugcuccuggcacgcuggcagcucgugcugccuggcccagggcacuuucugaacugaggcccccacugccucagguccgcauuacaucugcuucugcuguagcauaacucuagcuggcugggugugcaggaguccggagcuugaacacaacuugcccaguccuacacugcccugcgacucucagccugcugcccuuucaaauccgcaccuacacacaugcacauacccggcuaccagccuguguccgacagccaaaccggcucaccccagaggcucuuugucugaaagaggugaguggagcucaccgaugaaguccucaacaucccagcccagugugcuugugccucuacaccacccugcccaaguauucacaguccucugccuggucagaugcuugauucagcucugagcaaaagcaagguuugaccccugugggguccagcugcacacggaagcuggaggagucaggguugcccgucucaagccccucuuccccuggcugcugcaguugagagcugaccccuuaccucuucucuccugcuuggcccuggagcagcgcuucacaugccucacggugccaucagcagcacagccuggccguggccuccaggagaggucccgagucucaggcuggacuggccgccgagcagcccugccucacuggccucagcuggcagcagucuaugcucucugaagcuccuagggaugaggcuggcucuggugucaccggggcugcucccaaccugcucucccucacagugugguccgcagcugccuuagugcaugcuucuugcagguccuggguccaacaacaccacucagggcuugggguccauccccaggccgacagcagcagccucaguugaacucccagguccuuuguggagccuuuacgugccgccagaggaaacugugagcacagccugacccugguuggcugcaggcacuucucuccgcccaccagugcaagaggaucccccaggccccagaaaagcucugggccuccccucagcuccagacaggggcgggccgccug

SEQ ID NO: 774 - RNA, 5164 nt, Mus musculus
gcacaucaucagaugcauuuauuugcacagacacucauaaaaacuuuacuagacaccaaauaauuacaggaaggggccaaccuccaauucggcugagccgcagcguuuugaaguggauuuaagauagagaucaaauaagagaggcacccgcccuggcucacacccacccccccuuccccagccguggacccucaggguggagaccaaugaacucccuggcuuuugugaaucuguguccgauucugugaguuagucuuaaguuccuaaugaggcuuuuauggcuccaaacacgguccuucacccucucuuuguucugguuccuguaacuggacuggggagccacucauucuuaaagacaggaugccuguugaaaccauccuuuggcaagaaaugcagagauucuuaggaaagugcuugguaaaaagcaaacauacaaaaaaaguacacacaucacagucucuaacggguuucuuuccaaagagcuuuuaaaaaaaaaucuugauucuauugccucucaaagcucucacugucgguguuagcugcccucagccucgguuuucaugacaaagugagaaggcugagcuguuugugcugggugcccaggcacuggccgugucucagguggccaguccacaguagccggcucggggacuccaccugucccagagggaaggaagagaccagacaggacugaauuugagacaagucuguuuucguucuggcucuagaggcggcagaggaacagaaagaggaagagagucuccuaugucuaaguagcagcucuccucccauacaauuauucaucaaauaguagaucuagagccccacagugagcuggccacaccacgagcacuuucaugugacccucucagagacucuguaagucucuuuuaugcccauugcacagacagggaccuugaaguacaaaggcgcagcaggucuuuuacccuggugucuccuaaccagacccugagacagacagggaugcuuccugacaccugcccuucuccuguuccuaaccauuguguagccaguaggagaccucaguucugggccaccaguccugggagggccuucucugaaccuuccuaagagcugccggcagccuuuggaucugagagagccugauuuccccacaaguggagcaaguccaugccugaugguccagaguaauggccagaguggggguuguuggagggcugagggaucuggcugcggauguucaucuucuggcucuaggcauccuaacacucaccagccaccagcaaacccugacaccccucucucaucagccucaaaagcccccaguggagaauaaguaccccagaaaccccucucuagucucgccucucuggagaacuuccaccagcacagggagacuucagacgcccuuccuuagguaguagaaaguggucguccaaugcuuugacucguguguggggugaagaccagcuagaaugcucagagggguaccuggaugcucgggaguuggauugcuagugaucgaccucugcugagucuugggcgcgcccuugcuccauuuccguggucuucggguucuucaucacugagggucugggauagacugaguuuccccgaggagcagcucccgacuuggcccacaguuuugggacagcuuugauucugcgcggcagagccucguagaucuugagaugccauuagccaggggcagcauggggugagccuagguguuccauggcuucgguucuugaggcagagcaggaaggccggugcgaugcuucugauagccuccuugcugaugaauccaaggcugugguccuccuccugcugggaucugacacugcagccggugguucuaaaccuggaggaaggguccucucucucccggacucuggucagaagcaccaaacgguuggguuuucgcugguauagcccuuccccucacaccgcucccccgcucucacaagaugggucgcuaccgagugagguugcaagguccuaaaggagaagagccagagaccaagucagggcucaggagcugcacgccucugggauaagaagagcccggaucucucccuguuuuguuucuugcgauuccagcagucgcuggcaacucucuuucucagguggaaacagucccgagcggauucugcagcagacgucggaggccgcaagcaucccgcguuggacggcgcggaagagauaggccaccugcguugugagucucagagccaggggugggcauccgcuuguacagaagagacgggcgaagccaggagcuugaggcccgcggagagaagugggucuaggccuaggccgguguucuccuguccagucguauuguucuuccuuagaggcaaaggaugggagaccaagaacccuaagaaugccucggagacacauggacgauuauguggggcaaugugaagaccgggucuagucaauucgggguugaaaaguaaggacaaagaaggccuacggguagaggagaacggacagaaggaaacaggcaucugugaacggagcaucguccucaaucggacuagagacaaucuuggugccacuguucacccagggaacucuggacucaguugccgacaguuucggcagccugacccgagugggccgggcugcgcagggagaggcccccaaaacucugagccuuggaaaacacaccagccaugcaucaaauggggggggggcuacaggugugcccucggugcugagaccuggcuucaagcacugcagaacgcgcagcaaacacagucaaagguccagacccggucuuagaugccagccagaggaucagggaaaccucugaagccgggccacaggggccaccauucagccaaagaaaaacggagaggaaugggguagaaauggacaggcacagggagcgugggggaaaugggagggugaagaugggggugaaacacugugcgauugcuuagaguccgagguucgucuuuaagguuugagacagagaagauucuuucgacucagccugaaggagauggcgaagcuccgggccuggaaccagggcuuucggugcccagcagugguugcagagacacacuauggccagcagagggcggagugcacccgguugggccgcugcuucugcgagcgguucggugccucccggcucugcacgccccagccuuuacccgcucggcuucuucccgcaguaacgcgccagggcccagauacccagagaaggcgguccagauccaggcccaggccucugcccaaccucagggcucaaggccuuagauuuuucacacuggguaaaaacaaggacgaagggugggugaagaaaacucuacauccacauacccaugcuccuggauacacaaaggcgccgagaaauacacagaacacaaagccacaaacacaaaaaccccugggcgacacagaacaauucaggagcuccggggcaaacagaaacacaaagguaacucagagacacacuuauagagaaaaaucuaccagauucgcuaaaggggccgaggcgcauacaaaggcguagacaucuucacuaucuacaccuucacgaggacacacacaaagacguguaaaaaacaugacauagaagcacgagagacguguaccgaaaacacacacacucauugccuggaaagacguaaggacacacaaacacaaaauguaugugcacaggaauacgggugcacacguucucaauagcuuccgcgaggcgggagcgcggacacacacagacacacuccgauacccaccgacacacacgcagguacugggguggggcggugaccgcuaauccuccacaaagccgggccccuccggggggcccccccagcacagggggccacuucugaccaagccucccucaggcuccaaaucugauccgcccucucgccucuagcggggucaggggacccgcccuccgagcccuccauccccucccggcuucgcgccgcugcuccacagccggaggggccagggccgcccagcagcagcucgcaggggcuguuaacuccugcccugggaccgcaccaucccuccugcuauuccaggacgaaacccgcgcgggagugguggggccgaagguacccuguuucccgaugcgacgucuucuaguuuucucgcggaugucuggccggaugcacccaggagucuccagcugcgugccgcuggccuugcguugcccgcugucgaggcccacuuugccaaggguggccagcgcucagucucuaacccuggccaggucccuuagccacaaugaaagggcaccgauuucagaggucacacagauuuccuuagaacgacuguacccaugccguuccaggccuccaccccuagaucuugaggacaccacuucuuaccugccccucauacuccaagccuugggaggcccagccuucgcccacugaccccggccgggaacaagauaucuuuccgagcccuguugacccucuuaacacucucuuggucucaacccgggccugaccguccucuuucacccaagaucucccauucuggcuaugagagcccccucaacucauucccccgcccuauuucugccaggccugggcuuuuugggacuacuuacucaaacuacagcccuuacacccccuccccaggucaggguucccuuuggcgaguccggggccagcgguucuugcuuacauuugauguuccccaucccucgacccuaggagcccucucagcacaccaggcuguccggugcaggccccgccucccgaggggacaccaacucagacccugcgaccuaccuuagacuacgaguccggguuugggccagccgcucccgccuggcgcuguccccuggagaagucgcugcguuccccgccguccucacagucuggccucgcuuggggccacuccucugagcgcuggagcuuaaaaaaaaaacaacaaaaauauuaauaauaaaaaaggcaagaaagaaaaaaaagaaagccugauuuccccaacucccaaaucaauuuuucaagagggguggggcacaggauuuguuucgauggcuaaccaaacuucugccaaugguggacaggauggucgccuggauucagggcgcggcacggggugcaggacgggggcuaagggagcccucccgcagggagggggggaggcgacggcacuauuugacguggagcagccggcucaucccggcgcagugaua

SEQ ID NO: 775 - RNA, 81524 nt, Mus musculus
uauucauugucuucaauauuuuaaagggcugucaagugggaaccaauucuccuugcuuccaggcagaauaacuaccugcaaagggaggaaagacaagggaagcagauuucagcucagcagaaggcagaacuuucuaacauuuagagcugugcaacagagaggagcaggcuguacuccugagagguagugagcugauacuggaacauccgaaacagaagugagacguggaggccauuccugcuugggugggagcugcaccgaugaccuuuaagguauguucuagcucuaagguuucugggacuguucacuucugcuaacuugacgcguccuuucauuuuuuuuuuuuuuuugaaaaaacaaaaccgaccuaagccuauuuaauguaacacaguuuacaguuuauuuaauguaauguuauuuuuaaauaacacaguuacaauaaaaaucgacaaaacgagaagugggaaauuauauuuauaaguuaaaaaugaagauaccguccaauuggcauagcuuuuaagugaaaggggaagagcgagagagagagagagagagagagagagagagagagagagagagagaggagagagagagagagagagagagagagagagagagagagaggcuggcuauuggaugauguuccgagcaagagaggagugucauuuuucuuccacccgucuucucuagcaccagguacacggagacgugagggcggaggaucggcguacagguccuggcaaggcgguucgcgaccgggagcggaagggcggccgugguccggaccaccgaucccaggggcccccgcggcgccgcgcacgcgcacugcugagggggcagcgccgccgcaggaggcagggaaaccgacuggcgaucuguggcggcggcugggcggcgguggcaguucgcagcgagggcgacggcuccgaggccgagaggcaguccagcgaggaccugggcgccguccuccgcaugaccucaccggugagugcgcguccccggccgguccgcaccgcgugccccgccgucuggccuagcaccgcagcccgcgccugacggccgccccgccccgggccccgggccugccccgugcccggcgucgcucgggugggaagccgcgcggccgggccccgcgagagggguggcggcgugcggguuccggcagccugccugaggcggcggggacacagggcgcaugggggggauggggugggagcgcgacggggcgggaaggggcgcaguagcgcgggucgccucugugggcguccggggcaggugggcagccgagcccgggaggccaggagcggaccgaauggcuugggagcgccgccagggacgcgccggacgcuccgggcuggggacgccgugcacccgcaaacgcgcgccgggcuuggcgucugugcacuugcugcugguggucuugaaguguccguucuguccaucucucuucuuucaauugucgacuuuuauugacggacagaauugucacgggugcugccuggauagaccucagaaacgagcgggauccaaggcauaauucuaaauaaagugaaauaaggugaggagucagauaagcgguaggaacgacgaggacucugguuuuuuuaacguuaagacucaauuaaauuaaacuuaauaaaaugaaaauuuugaguuugagcaaaaaggaugaggucugggaacuagagcuuccaacucgugguuccucggugcauugaauguagauagaaugucuuuagugagaaugaagguaaaauuacaccuuuauuuacaaaccaguaauugaaacuguugccuuuaguuauaaaaacaaguaccaaaccacaguaguauuagcaaucccugugaguuugucaccaauagaauuuacagauauuuuuguguuauguuuacaguuggagcauucucaaaauaucauguuuguugauggauuucuuugagucugugaguuucugcuauaucuuaucuuauguaauaagauguagcuauacauacaugucaguuuuacauuucauaauaugucaguauaauugguuuccuuuguacugauaggaguuuugcuuuuuuuuuuuggguggggggguugagacaggguuucucuguauagcccuggcuguccuggaacucacuuuguagacuaggcugcacucgaacucagaaucugccugccucugccucccgaaugcugggauuaaaggcgugcaccaccacaccgggcagaguuuugcuuuuaaaagcauuuugagaagggaaccuuaaacuuccccagacuauccauggcacagaaugauuaagaauuccugaaauaaagauaaacuuugaaggggacuuaacaguacccaaauuuugucauucaguaagaaaaaagagaggggaaaaaaagaaaaaagaaaagcagacagaaugagauacaugcaaaagauuuuuaaaauauuuuuuauuggauauuuucuuuauuuacauuucaaauguuauccccuuuccuagauucccuucugaaaauccccuaucuccuccccgcuucccugcaagagaauuuuauaaucaaggacucaauagcccuguucaccuaaaacuggguauguacaccagguuggcuucaaaugugcugugugguccuucuaccuuugucuuccaagugcuggggauauagguguaagccaccacuccugcccuuuaaaauauauauauauaugugaaugauaccaguguaguuuugaaagauagaccagaccguagauauuucauccaguguacuggggaaucagcucaacacuguaggaagaagaggaaaugaguguugugauuuuugugcugaggcaucacacacuuucaagccccugaagcuugugaaaagaaauuuuuguauuugcuaauuuuuuuuccucuuaccuucuuuuguauguguguuguauggguauauaaauguucauguguuuacaugugugugcauguguuucuggaagccagaguuucauguugaaugucuuccugucucucuaccguaguauuugagacaagaucuccuacuggcuugucagcaagcccggaguucccacugucuuugauucccaguccagggaucacagacacuggcuacaguaguggcuuuuuacauaggaguugggaaucugaacucagguccucccuccugcuugagugggaagcgauccaccaacugaaccauuuucccaguccuccgccgccuccuuuggaaccuauggcuuugcacaugcuguaaaauagcaggcaagcacacuaggaguugugcugccagugcuuuucuuaaaaaucauaaaggugauaaagcuuuuaaauaggaagagguccuuauuuauuuauuuuuuccuaagugaaaaguaucaggcuccacuauaauaugucuucaguuguuauuuuuucauauaugaaaaaaacccauacaauuuauacagagucaggaagcugguaaauuguuuacuuuaaauucucuuucaaguucuucagguucuggcacucucagggugguaccugcucagggccaugggcauucuggacagguguacuauuacugagcugucuuuucauacagcucuguaggguguuuuuuuuuuuuuuuaauuuaaaaaaaauuuuuuuuuuuuuuucauuuugagauagggucucacaaaguugccaaggguagucuggaacucgcugugucauccaaauagcucucaguggcaaaucuuugucccuuacuccuuuguuuucuuuaugccauguauccauaugcuguuauuuauauauuuauugaaaauuauaauuuuuucuuccuuacuugccaucuuuaugacaacagagacuuugucuucauuucugugcuagaaaaugcuagagcugcugcauaguagguguuccguaaaugguccauagauaaaggagugagugugucugucugucugucucuguuucucuuuagcuccucuggcuuucaacuugauauauagcagagaaugauuuuuuuuuuuucaagacaaggucucacuauauaacccugacuggccuguaacucacuauguagaccaaacugacuuugaacuuccugucuuuccucagccuucugaguugggauuauaagugugugccaccaugccuggcuucucuaggaaauuauuucacaaacacuguacaguacuucugugggcauuuguuuucuuauggcauguauuauuagccuuauuagcacaugaugccauauaggacuuggcuaugcucaccuucccaucaucauagaaugaaagugagaggucuguaagucaaguucuuuuuuuguucugcuuguuuuugaagucagggucucgcugugugauccaggcuuucuuggaacuaguuucagucucaccaauacuacuguuuuuucuuaauuucucucuuacuuucuaugcugagggauauaaacuuguuuaugucaaaaaagaagaaaaguaguucuagacaguauauugaugauagcuuuauuauuaaauuagggaaugcaaauugaaauaaauggugccacaucuuccauggagguagugugugaguguguguguaugugugugugagagagagagagagagagagagagacagacagacagacagacagacagagacagagucagggucucacaguaaagcccugguuugccuggagcuuccuaugcugaccagguuggcuuacaguauacagagauccacuugcuucugccucccuauugcugggauuaaaggcaugagccacuacacucagcugauuaaaagaaguuuuaaucugauaauaacuggugacuauguagcagaaaugauaauuuuagaaagaacauauagaguguagauugguacaggugccauuggagauuguauuauaguucuuccucuuguaauucuuauugacguugaaauauuuguaagagaauacagauaggagguggugacaacagugacgguaugugugaauuccucuccuuuuccuuccuuccuguuuguuuuuguuuuuuugagacaggguuucuuuguguagcccuggcuguccuggaacucaugccugccucugccuccugaguacugguaucaaaggccuguagcaucacugcccagcauuuucuuuuucuuuuuuuuucuuuuccuaaaggcuaaagcaggacugaugauguagcuugaugguagagcaguugcacuuagaaggcagagacuggaucuuuuuugaguucaaggccagucugaucuucauaaugaggucuaggcuagacagaacuauaaaguaagacucugucaaaaaaaaaaaaaaaaagaauagaacacagcaaaaaguaaaaaagacuuccuuguuuuguuagcuguuuuuauuuccuuguuuauguugcaguguuagggaucagacuccagccauagcacccagcagccagucacauuuacagcacaaagacaaaugaaucauuugguugucaaaugccauuuucuugcuuuuuuauuuuccuuaugauuuucaccaaggugcugggaguugaaccccaggccuucuuccgcggcccucagaguaccacucaaguuggauuugucccagaguucuuuucagucagauucagacgaaacaguuuuagcuggcauacuaaacugguuuuaaagucucauugugcgccauaagaaacacccagugaugucaguuuuacuaaugacauauuuuugauuaaggagucucacaagucuuuucuuguaaaggcauuauuuuuccuuuuuaauaaauaaucuauggaauaauaauauuuugcuuucucaaagucaucuuucgaugugugugugugggggggguaugcauauguauaagccagaaacugaugauggguaucugucuuccuuuauuguuuuccaucuuucuuccuuccuucccuucgcucucucucucucucuuuuucuuuccagagauggaguuucuuuuuuuuuuuuuaaagauuuauuuauuauuauauguaaguacacuguagcugucuucagacacaccagaagagggagucagaucuccuuacggaugguugugagccaccaugugguugcugggauuugaacucuagaccuucggaagagcagucgggugcucuuacccacugagccaucucaccagccccgagauggaguuucuuuguguaguucuugcugugucagaacucuauagaccaggcuggcuucaaacucagagauguacucacugggaucugaauccuccugaaugcugggauuaaagguguacaucaucacccagcuuccauuuuaugcuucaggauaaguuugcucauguaucccggagcucccugauuggcuagacaagccucugggacccuccugccucugcuuccccagucugggguuacaagcaugugucagcacagcagacuuuuuauguggauaaugggauggaauuuaggaccucaugcuuacaugacaagcguuuuaucugcugagaugucucccuaggccuucuguccuccuugcacuaccacccccacccccccuuuuuuuuuaaggcaggaucucacuuuguagcccagaugggccucggacaugcuauggcaguuugggagaccuuaucuuaauaguggguuuacaggcaggagccaacaucucucguuuacgguuucucaguauguguacucuaaaggguacuuggauuguguuuguguguccccuguuuguuuaaaaaggguagcauugugugacuuugaccuccugauccucuuguccauaccucucaaguucuggugucaucaugccuggccuagauucuagauuuaaggagugaacccuccucucuuggugccuucuugguuccugucccagugcugccauuucuuuguccacugagcaugcugagguacucucuaguggugcacacagcacuguauaaggaacuacggucugacaguaggauuuuggagaccguacagauauagucuuaacuuuuuguugguauagcuaacugcaaaauuuguuacuuuuuaaauauaaugaacugcaguuaaauaaauugcauaaaauacuaaauaaauauuuuuaaaacuacccuucauguuugcagaaaaguuuaaguggaaaagcagguacaucuugguacuaaggcauuuacuuuauucuuugaucuuuucuuuuuuugagacagucucauaauguaguccaagcuggucucaaacuugagauccugucucaguguugggauuacagguaagugucaugauuuccauuucuuucuagaauuauucuuucaagggaggauauauauuggggagaauuguuuucauguucuaagaaucucaaggguaaauuauaauuuuuuucuuuuuuaagcuugugcaaauagaauccaguuccucuggaagaauaguguuuuuuuacugcacaaauauuuuuuuuccuuaggcuagaaaaccuuuuuuuuuuuucuucugagacaggguuucucuguguaacucuggcuguccuggaacuugcucuguagacaagugugccucaaacucagagaucugccugccauagccucuugagugcuuggauuaaaggcaugugccacuacuacucagcuggaaaaguuuuuauuuaaguauuugugucauauaagcuauacaaacuaguguuuguauagauuuuuuugugaucuuaacuuccgaaguaauuguuuucauuuguaaaagaaucggaacuaguaauuucuuuauaaaauauacauuuuggaaauugauuaaauaauaauaacaguaguaguuauuacuauuacuaaauaauaacuauuauuauuauuacuuuauuauuauuuuuuuuugagacagggucuuacuauguaucccuugguuguucuggagcuugcucuguagcccaggcuggccuugaauuuagaagaaauccucccacaucugcauccugggugcuaggauuaaagaugagugccaccauccuuaugauuuuauaaaaacauuuccaaaaguccaguucuguuuuguuccuaggugagacccaguucuggacucuuuagugcagugcccagaggaaguguucaauaucaauugauaccucgauuucucauggcucuauguauaaaugaaugaguuaggaaagguuuauuuagaaaacauauuaacagggauagcaagauggcucagugggugguaaagguguuugucauguaagugugacaacuucaguuccauuccugggacauguaaaggugggagagaaucaacucuauaugguuguccuuuaacuuccauaugcacaccacuacacacaucacacuuaugcucacauaacaguacaguaaggaaaaaguaaaaucuaaaagcagacuuuaagcugggcgugguggcgcacaccuucaaucccagcacucaggaggcagaggcaggcaaauuucugaguucaagcccagccugaucuacagagugaguuccaggacagccagggcuacacagagaaacccugucuugaaaaaccaaaaauaaauaaauaaauaaauaaaagcagacuuugagucuuuauaacauaauaaauagugauaaugaaugauaaaaauuguuuugagacuuauguguguagguauucugucugcaugugugucuguguaacacaugcagacauuaccuguggaugccaggagaagaugucacaucuucuggaauuggaauuauaaauagucaugugugugguauggagugaacuugguucauuuggaagagaagucaguguucuuaacuguugagcugucuguuacauagcuauccuauaucuuuuugagugugaagaugaaucugauaucugcuaaguauuccuaccugaaaaaauacuuaauuuacaugaauuacauaauuuacagccaguuguggugguguauacuugugcuuuuuuguuaguuuuuugagacagguucucuccauagccuuagcugucuaaaaacucacucuguggaccaggcuuguccuaaacucacagcaaucagccugccucugccucccaagugcuggaaucccagguuugcacaaccaugucuagcaugugcaauauauacuuggaaucugagccauucagugcuggaugcaagaagaacagaguucaaggcuagccaugacuauugagugaguuuuagagcuauuugagacccugucucagaaauagacccaaaaucuccaucuaaaacagcaacagcaaaacauuguuguuuuguuuuguuuugugugugcaugugugcuuugguucaaauccaggacuucaugaaugcaagagacaucuaggccacaguuuugccuaggccuaugaauguguuuauacaccuuucuuaguaagcgauuuucuuaagacaaggcugucugcauacucuuguaacuauaaagcagacaggaugucugcucuuaucuaagcugucuauccagaaaggugcuugcuuggucuugcuucuauguaauucugauacacccacacagagccuagaagaaagcauguugucaaacauguucaguucuucguuuucuuauguugcuuacuaaugaauaauuuauuaauuauuuucuauaauucuugaaggauugaguagugguuuucaauuggaaaaggaaaaauauuaaaaaagggccaaggccuaauagcucuuuuuccuuuacuuaaugaucagagccagguaguacccucccaagcuauuauuuggauuaaauaucuuuuuaaaaaaccuuuguggugcuuuaguucaaacccaggcccuggacauauuaggcaagcacucuauuauugagcuacauuuccauuuuauuuuauuuuauuuauuuauuuguuuguuuguuuuuuuugcgacaggguuuccucuguauagcccuggcuguccuggaacucacuuuguagaccagguuggccuccaacucaaauauccuccugucucugccuccugagugcugggaucaaaggcgugcgccaccacgcccggauugcauucccauuuuaaaugcuuaugguuuuaaaauuuuagaaacuugugggguaguucagcgguuaagaacacuuaaugcagccgggcgugguggcucacgccuuuaaucccagcacucgggaggcagaggcaggcagauuucugaguucgaggccagccuggucuacggucuacaaagugaguuccaggacagccaggacuauacagagaaacccugucucgaaaaaccaaaaaaaaaaaaaaaaaaaaaaaaaaaaccacuuaaugcucuugcagagauccuggauucagaucccggcacccaugaggcagcucacagcugucuguaauucaauuccagagaaucugaugcugucuuuuuuuuuuuuuaaauaauacgaauuuuuuucuuucuuuauuuauuauauguaaguacacuguagcugucuucagacacaccagaagagggagucauaucucguuacggaugguugugagccaccaugugguugcugggauuugaacucaggaccuuccgaagagcagacggugcucuuaaccacugagccaucucgccagcccgaugcugucuuuugaccucuacgagcaccaggcacaaauguguuccuucuguuucagucuuugaagugcuggaauuauaggcaugagccacucacaccugaccaagagcuuccuguaccagagaagcuuaagaaagaaacaguuuuaugguuuuuuuucccccacaggaaguauuucaucucagaggguguacuauugcauaccuaugaucccaauguuuaggacggugagacaggagucucaugaagguuugaagcccuccugggcugcacagugagacccugucagaagaacagaaagaaggaagagaggaaaaaaggaaggaagggaaaauaaauuacuccaucuuuccuuccuucuuuggaacccaaagaagcuaaccuuuuuuuuuuuuuuuuuuuuuuuuuuuuauuuauuauauguaaguacauugcagcugucuucagacauuccagaagagggagucagaucucguuacgggugauugugagccaccaugugguugcugggauuugaacucuggaccuucggaagagcagucgggugcucuaacccacugagccaucucaccagcccucuuuuuuuuuuuuuuuuaaaauacagggucucacuauguagcucaggccagccuggaugugcuauguauaccaggugagccucaaaugaacagagauuugccugccucugccauuucugagugcugggauuaaagauguguaacacucccugguuguccuagaacuuguucuguagcucaggcuggccuggaaccuccagccucugccucccaagugcuuggauuaaagggugcauccccaugcuuggugagcuacguguuuuuaaaaacuuaaaaaauauuucuuaaaacuuuuaaauuauuuuauuuuucauuuuuuuuuguauacaaguguuuuguaugcuugcuuguuuauauaugcaccacauuugugccuggaguccuuggugccagaaaggguauugaauucccugaaguuggaguuauagacaguugugagcugcuaugugggugccaggaaccgaaccugaauccuugagcaacaagugcccucucccuuuuaauuaauuaauuaacuaauuaauuaauuaauuaaauguauacgaguacacuauggcugucuucacacacaucagaagagggcauuggaucccauuacagaugguugugagccaccaugugguugcugagaacugaacucaggaccucuggaagagcagccagugcucuuaaccgcugagccaucucuccagcccaagagauacuaacacuuaucaaauucuuuuuuuuuuuuaagacauuauauaaaguaguaauuaggaauuccauucuauaagggcauuuaauuuauuuuuaaagauucauuuuuucacuuuauauuuaugagucuugcauguguauacaucugugcaccacaguaaguaccaagugcucuaggagauagaggagggcaucugauuccuggaaacuggaguuagaggcaguuugagccacugugggggugcuggaaacugaggggcagugaguacuccuaccucuagauccaaugagauuucuuuucuuucuuuuuuuuuuuuuuuuugguuuuucgagacaggguuucucuguguagccccuggcuguccuggaacucacccuguagaccaggcuggccucgaacucagaaauccgccugccucuaccucccaagcacugggauuaaagguaugcgccaccacgcccggugagauuucuuuuuuaaaugaggacauuuuaaugguugguuuauauugaacagcuauuuuugggucaaggagaugacucaguaggaaaaguauuugcuaugaaagucuguugaccugaguucaguuccuagaaauggugugaaaguggaaggaaagaacugacuggagaaaguugccucugaccuccauguuccuucugugcccagcacgcucugucaccuggcacccacacaccgcaguaacugauguuuuaggccaggaguuuucuuuuggguagaaacacagacauugauaguaaugcugauugaaguguaacgagugcuuaugauuacugugauaucaccaucccagcuuggagccguaccucaucugugaugcccuagauuuaaucccuggcaguuaauacuguccaggcauuguagugcacccuuguaaucccagugcucaggagguggagaccgaagaaccucaaggucacccuugccuacacaggugaauuugaagccaguccuggcugcaugaacugccuuaaaaacaguaacaacaaagaugguaaaugugaucacuuguaccuuguagguacugcuuuucuuuucuuucuuuuaaaaaaagauuuauucauucuuauuuuauguguauggguguuuuugcuaucauguaugucugugcaacauguguugcugugucugaggaggccagaacguuuuagauucccugggccuggcguuauaguuuccauuuaggugcaaggaauugaaccuggguccuuuggaugagcagccauuggucuugccacugagccaucucuccaguuauucacuuguaaaacuguguaugcgugugcgugugcgcgugcaugcgugcguguguguguaagaagacuggcaaagggcaucauccugggauuggcauuaacuggcaguuguaagccgucuuauagagagcagcaagcaugacaagcaagccccaccacgcccggcuuuuugguaauaucuggguuaaacacuagcgauucuuuccuaaauuuuuacauaucacuuccuucuuagaauuugaggaaguugagauuauuuaguccugaaguccaacuaaaacuuacauugccaggcaguuggaagcuuuucaagaaggcuggguguugucugcacucugacuuauauaugagugcuuguuccaagagugagggaguuauuucuuacauuuaauuaauucauucaguuucaaacacguuuauauuauggucauacucaucucucacucagcuucuuccauccuccuuucccuauaagucccaauucuaguucuacuaagugaggcaacuguaaguaguaaucuuaaccauaauaagcucucauagcuaggagacuaaugauuggcuuaguagauagacagacacacacaaagaagaggggaggagaaagauugagauuguguguguguuacuagggaaaccaaauuuuuuuuuguuuuuuuguuuuuuuuuuuuuugguuugguuuuucgagacaggguuucucuguauagcccuggcuguccuggaacucacucuguagaccaggguagccuugaacucagaaaucuaccugccucugcucccaagugcugggauuaaaggcaugcacuaccaugccuggccuaugggaaaaccaaauuuuaaaacuaaauauaacuagauucucaucacaacuuuacauguuacuaauuugacuuugggaaauuaaaucguuuuuucuuuccucagccauguagcucuguguuguaaucaaaacuaguuauguaucaucaggugugguggugcacaccuuuaauuccagcacuugagaagcagaagcagugaacccuuccaucuuguugauuuuugagacaggguuuuucugugaagcucuggguauccuggaacuugcuuuguagaccaggcaggccuugaacucacagagauccaucuaccucagccucugccucugucuccucagugagcuucaagacucugucucaaaacaauaacaaaaauccccacaaaagaaagcaaaacaaacaaccccccccccaagacuuuagauggcucuguggguaaagggguuugccaccgaugcugagagccugaguucuauccuaggguagacagacagaacugacucccacagacuguugucagauuucugacuuccacaugcuuugugacauuuuccccagaacaaauaaaggaaaagugaauacuucucuucaggacuggaaguguugguggaguacaugcuuagcaugcauauggguauagguucagcuucuagugucaaacuaaaacaaagcaaaagucauacauaguauuucauggaugaaauuggaguauuuaggcacucaggugaugcagagugcaagcuugaaaugcuagcuacuaauauuuccuaacacccguguacuuauuaccucuagucaguugaaacuguucaaccacagucauucuacauugucucuaucucugucucucuccagguagacacauugucacuguagccuaguuuggucuaacuuacuguacagcucaggcuggcuuugaacuugcuacaacucuuuuauaucagcucccccaaaccccaaaugcugguauuauauguauaagccacuggcuauugcccuuucucucccuuucuuuuuuuuuaaucuuucuuauuuuauauguauggauguuuugcugcauguauguaugaauacccacauaugucuggugccuguggaggucagaaaagggaguuggauccccugaaacugaaauuaacaugguuguauaccaccuugugguggcuaggacuauaaacaaggucguaugccagaauaacuagggcucuuaacuguuguguuaccucuacagaccuagcuuuauauauguucauugauggggacugaacccagacaaacauuuuacuacuauggugcaucccuagucaagacccuaguuauuucaaauaggguuucuauagccuaggcuaguuucaaacuugggauucaucugcuucagccuccugaaugcuagaauuacugguuuguaccaacauguuuggcuuagcuauaacuucugguaccuuaagauaagguuugcugugggugauaguuaacauaaaagcuggcuuuucagggcugaguguauugcuuagguguaguguuugucacuugggagggaggucauggauucaaucucuuggucugcaagaucugaaaaaaacaaaaccaaacaaccaaccaaaaaaaaaaaaaaaacaaaaaaacaaaaaacaaaacaaaacaaaaaaaaccaaaacccugguguuucuuaaauaguucugcuuaggaaauauauuuaccuugcuccacauaugaaacuagugcaaauuuguauaaugaaauguuuuguauuuuguuuuucuaaucucagaaacuaaaagaaaaaaauauuauuguguguuacagaauguuaguguguucuagaacgucauaggcuaguuguugccuuuucuagggaguaguugacagagauuaugauacauuacagcauuaauacuuuucucaagauuauauuauuuuacugaacugaaugcuugaauguaaaaauauauuacuuaugugauuaaaaauucuugccagguaguggugguucacuucuuuaauaccagaccuugggggggcagaucucugaguuugaggccagucuggucuacagagugaguuccaggauagccaggauuauacggagaaaaacaaaaugucuugaaaaauaaaacaaaaacaaaccaaaguuuugccagguucacaccuguauccuagcauucaggaaacugaggcaggaggacugcaguaaguuggaggccaacuuggccuaaauaguaaaguucaaugucaggcuggaauguauagcaaaacucucucacaaaaacaagggaucucauuacagaugguugugagccaccaugugguugcugggauuugaacucaggaucuucagaggaacagucagugcuccuaaccgcugagccaccucuccaguccccuugaucucacuuuaaaugcuuugcaaguuuugagucuuuggagcuagugauggcucagcugacggaaugcuuccuagaaugcacacgaccccaggacaugguggucugugucuagggcaccagggagguggaugcaggaagaucagacaucucaaagccauccucagcuuuguagaaaguuugaggccauccucuuuugaaaaaacucucuucacugucuucaaaaaacucacaaacaaaaccaaauaagcguaggucccauauuagcaaacagucugucacaucuccuuaauaauaaccuugauuuuacucagguacaguggcacuuuaauuccagcacuggaaaauggugaacaaggucaaccugguggucuacauggcuaccuaguaaaccaccucaaaagaaaaacgaacaaaccauguacauaaccuugauauuuuccacuuucucaaauguuaaauuguccccccccccaaaaaaaaaagaguuucucuguguagcccugguuguccuggaaauuacucuguagaccaggcuggccucaaaaucagagaucuaccugccucugacucccaagugcagggguuaaagaugugugccaccaaaccuggcuaaaagauuuaauuuucauccauucugccauguaauggagauggaggcuaucuuaauuguaguagggaaguaauuaaagccuacacuggcuuuuacugacuuuauuaacaacauacuacauuucuacuuaugauuuacaguucucucaguuuucugugugggacaucaucuuaacuucaggucauaugacacuagaugucagaggucacagaucacauggcagaaggugucagaggccaacaugguuuugguuuguuuguuuuugugacagcguccuggcuggccuuggacuugcuuuguagaccaagccugcuucaaacucagaaguuggccugccucugccucuugagugcagggcuuaaaggugugcaccaccaugguuguaaguggccagucuucagugguagucaucagaccuacuccaguuuuaguuuccucuccacuuuauugacuacuaaaguguccucuauaguaaaugaauacauuggauuugguuuaauguucacucucaaaauguuaauaaagggauaguguuugggccaaggauguaguuuggugguagaaugccuggcaaguacaaauauaauuugugaaccugguacauuauaaguuacaaggaggauccugucaacaguaggauugcauugcaguccucuguuccucagagagaagagagcaugggaggaagacacagaaagaaccuacgauuaaccuagggaauaggcuauugauuugaacucuaaaugcugccuuacaguuuaaaauuaguagaugcauuauuauaaauuggggugcuuuuaauuagagauucuuauaaagugugaaauauuauucuaucccaaaauguuauuuugggguaauuuauauuuuuugagagucuuaagcccucacugcucucaaauuugcauuguauuugaccuugaacuuucgaucuucuagccuuuaccuccucagugcugggauuauaguugugugucauuguguccuguuaacuguugacacuuguacuagauguauucuccuuggaacgucuaguguaguuuucuaguguagcucaaaaauuauacuuuaucagguuugugcuuccucuccaugcauauccucugacgcauauggauacuguggcaugugucccuccaccaauauacaauaauaauaaacuuagaagagauaaacuuacuuauuagagguuggcagucucucuguaggggccaaauagacuguagaagacugguuauuauuucccccugccuucuuaauaugaaaccaguuguagacaacaugacuagauggcauagcuauguuucauaaaaucuuacuaaggggauguagagguggcucaguggguaagagcaugugcugcuccugcagaucuguguuugauccccagcacccauacugggugacuaagcugugacucuagcugcaggggauccucugcccuaaucuggucucugggcacugcacccaugcucauauacagaaaguuaaaaacaaaucuuuaacaguuuuagagucuggggcuggagaaauggcucagcagguaaaaaagugcugaccuugcaaaucuggcaaucugaguuugauguaagaugaaagagauggcuacagauuuguucucugacgcauauggauacuguggcaugugucccuccaccaauacacaauaauaauaaacuucuuuuugagauguguugcccuaauuaacagaccuggaaugcucuaugcagaccaggcuggccuugcauuugcuugcuucuaccuccugagugugggaucaaagguaugugccaccaugccaggcauaaauggauuuuaaaagucuuuaguaaguuaaauuaaaugggacauaaaaccacaaguuaugagccugggaaagggagugguagggugggaaggguuauucauaggggucgaggauaauagggccagggaacagugauuauuacauuaucuacguguaugaaauuaucaaagaacaaacuuaauuaaaaaaaaaaucucaaaaacaaacccaaaccaaccuuuaugagaagugaugcugaaacagcaugccuuauuucuagcuggccuaagugaugguuuguuuucagggcuuguuuguuuguuuuuuguuuuguuuguuuuuuguuuuucaagacaguguuucucuguguagcccuggaacuaauucuguagccuagacuggccccgaacucacauagauccaccugccucugccuuccgagugcugggauuaaagguguaugccaucaucaugacuucuuaagagguguuuuaaccauaugaguugaaaagcuuaaauuauuccucaguuugauuuuauauaaaaaugugguaagugcuguugaauuuaaguggucagagaguaguuuuugacccuuucaaaauggaauuaacuaauuuagaaaauacaugcaaacuuuagggaaaauauguauuugcuaugguuuauuauggcugaauccugauuauuacaauauuauuguuacuguuguuugagacagggucuuuuuuuuuuuuuuuuuuuuugguagcucuggcuggccugaagcucacuaguaguccaggcuggccuagaacuugcagugguccucuuaagacucuagugcuagcagcgcaggcacacaccaucaugcccagauggugccagugguuugauggcacuugugcucuucuucagagugauuuguggggaaguaaauacuagcaaagaugauuugaaaaugauuuguguuuucucugguaucuggaacuggugauaaaugggucuaucagaggcucucagauuuugaaggacuuuuauuuugcuggaaacccaggagguagauggcaaaagaugaaaauacaguguauuccuuuaauccuagcacucgggaggcgguggcaaguggaucucucuguguuugaggccagcuugucuuuuacaaagugaguuccaggacagccagggcuacucagagaaacccugucucgaaaaaccaaaaaagaaaaagaagaugaagcaaaagcaaagcacacggucaguuccaagacagugauauaauuaguucuucaguccagaggagagguuuaucacuaggcaauguauaagauugcaaagguucuuugggccaggcuauggaaauuaaagcauguagauaagaagcuaugaaaacacaggacaguagaaaugaggucuugguuuuuguaaaaguacucacacugcaaaucugagaucagccagucucuggauucuacagugagaagagagaaccaggucuugaauguugcucucuuccuugcacaagcgcaccaugcugugugcacacacacauaugcauaugcacuaguaaguaaacaaauaauguaauaguguaaaauaguauuggauaggugugcugagguaagacugauuuugaauuuuaagcuaagggccuuugaaauauguucuaagaaaucaaaaauaacaaauaugaacaucuuuaauucucucucuguguguguauguguguguguguguguguguguguguaucuguguguggugucauugaguguggugauuauuuuuaccuaccuagugaggcuacauuuagauauccugggcaauaggaaaccuuaucucagaaagggacugugugagggggaguaagaauacaaucaagaauucaaccaauugucauuaaccguaguuacugugaauauaaaguagaucucauuuauuccucauaacuguaagguuuccuaauuccuuuugucucugcuaucucagacucugcaaagcacuauucuguucugagaggucaaccuuuucugagucuacccaaaggugagcuuaugcuuaugagguauguacucacugauaaguggauauuagcccagaaguuuggaauacccaagguacaauucacagaccacaugaauugaagcucaagaagaaggaaaaccauaguguggauacuuugguccuucuuagaagggggaucaaaauucccaugggagaagauacagagacaaaguuuggagcagaaacugaaggaaaggccauccagugacugucuuaccugaggauccaucccauauacaguucccaaacucagacacuauuguggauaccaacaagugcaugcugacaggagccugauauagcugucucuugaaaggcucugccagugucuguauuuacagaaucuggaugcucacagccauccauuggacugagcacagggucccaaauggaggagcuagagaaaggacccaagaagcugaagggguuugcagccccauuggaggaacaacaauaugaaccaacuagugcccucagagcuuccaggaacuaaaccucuaaucaaagaguacacauggagggacuuguggcucuagcugcauauguagcagaggauggccuugugggacaucagugagaggagaggcucuuggucuugugaaggcucaaugccccaauguaaaggaaugccaggacagguuagugaaagugaguggguuagugagcagggagaggggagaugggauagggguguuuucagaggggaaaugaggaaaggugauaaaauuugaaauguaaauaaagaaaauauugaauuaaaaaauuaaaaaaauuuugaacauguuuuacguaaaaugcuuagaaaguuugucugguggccuaaauuuauuaaagugagcucuaaaaacaugucuuuaggguuaacaagauggcucagaggauaaagcugccugcugccaggccugguggcuugagcuggauaccuggaucccacagagagagggaaccaacucuguacucuuuuguauauauaguucuguccacgugucuguugauggggugcuuugguugaucccagauguuggcuguugugaauaaugcugcagagacaugagcguaggaggacugcuggagcauaugugguucuguuuuuacauuucagagagauguguuguuguccauagugaugauacagaauuacauucccaccaacaguauaggaaggcaugagucccucuacagucuuccaguuaaugugguguaggcagguguggaucucuguggaucucaggaggccagccucaucuacacauagaguuccaggacagccagggcuauggaaagaaaccuugaauaaaagaaaagucuaaauaaauguugguuugauauuaauauuuuauuucuaguuugaauuguuauuucuuuucagggaacauacguuuucuuucauuuuuuacuauuugauuuuuuuuuuuuuuuuuuuuuuuuugaguuaggguuaaccuucucucuaccgcaggcuggccucaagcucacacauccaccugccucugccuccugagcacuuccagcugcugccauacguuuucuaauauuuauacuuucuuuguuuucuuaugguaaaacauuuccuacuuauacuuaguuaugcugaaauuuuauuguauuuuaauuuuggaaaggaccucacuguauagcccuggcugacuuggaauuuauagagcucuaccugcauaccaggaguaaagccauguaccauuaugccugucauguccaaauuuuacuuaaucuguuucuuagcuucuggcuauuaacuuguuguaacuguugucuuagaagaacagaacaaagccgggugugguugcgcaugccuuuaauccccgcagaggaggggaaggcgaauuucuggguuugaggccagccuggucuacaaagugaguuccaggacagccagggcuacacagagaaacccugucucgaaaaacaaaaacaaaaacaacaaaaacaaaaacaaaagaugaaagaaggaagaagagaacaguucuuacuuuuuccuuaguugucauauuucguuuucggugcuagggauuaaagccaguggcucgugcauacuagguaggucguucucuuccacugagcuguauuacuuaguucacgauaguuuuaaaauuuuguuuuacaggguaagcuauggucagcuuuuuuauggcauucugaccacaaauauagaaguauaaaaaggaaagcuuuauaauaauugaaccugauuaaaaagauacuuagaaaguuugucuuguggaaaaguucucuaaaaaaaugcuuaugaaggucauggagauggcacagagggaggauauagcuaccugccacuagauaaccagaauuguaaguuaucguaugaccuccacauucauggcauggcaugugugcaugugcucuuacacacacacacacacacacacacccuauaaugaaacaaagaaauugacacuacugggugauuuaggaguucauuucuugguuagauuggauggaacauuauuuuaaguguuaaucuuguauuuaauuuuguuuaagauuauuacuagauguuacuuacuuuaguuuauguguaucaguguuuugccugcauguauauaugugugccucaugugugccuggugccauugguggucaggagagaacaucagauucccuagagcuagcugaauaaaaagacacaaaccaccacaugcauucugggagccaaauccagguacuacuacuaacugcugaguucucucuucagcuccguuaaguucuaaguuuuaaggguuuuuuguuuguuuguuuuugagagagucucucuauauaguucuggaugucuuagaacaugcuguguaaacuguuuauaauugcugcgguuaaagguauggaccaccgugucuagucccaaguugguuuuuuuuuuguuguuguuguuuuuuuuuuuuuuugagacaggguuuuucuguauagcccuggcuguccuggaacucacuuuguagaccaggcuggccucgaacucagaaauccaccugccucugccucacgagugcugggauuaaaggugugccucaccaugcccggcuaguccuaaauuuuaauuuugaagcuauaguugaagauuuuaacuucuaaacuguauaaauucauuuuuuguuuuuuuguuuuugguuuuuuuuguuuuuuguuuuuuuuuuuuuuuuuuugagacaggguuucucuguauagcccuggcuguccuggaacucacucuguagauccgccugccucugccucccaagugcuaggaguaaaggcgugcgccaccacgcccggcuucauuuuuauuuugcugugucgguggauuucugaguuugaggccagccuggucuacagagugaguuccaggacagccagggcuacacaaagaaacccugucucgaaaacccaaaaaaaaaaaaaaaaaaaaagaaagaaagaagaagaaaacauguuuauuugguagcuugaacaguauuuuaguuauaagauuaugggcucuuugagauuagaggaauccggcugaguuccagcaaaacucaagaauauauuuguuacuacaacuggcucucauaauauuuaauuguuuguggguuuuuaauuuuuauuucuaugaacccagggccucaugcaugcuaggcuugaccacugaaaucuaucuccagccucauaauacucaauuuaaaaauuuggugauauauauauauggguguguguauuguuuuuuaaggacucagauuuugaugugacuacccaucccuauuauuuuuuauucuuuaagaaagagucuuuacuguguauuuuagucuuugauuuuagaaaauaauuuaugugauaugaacuugaauuuugucauuuuuuuauucuuagugaucaacuuuuguaccuuuuccgaauucaaagauggugaagcuagauauucacacauuggcccaccaccucaagcaggaacgcuuauaugugagcucugagaaacagcucauucagaggcuaaaugccgauguacugaagacagcugaaaagcuguaucgaacagcguggauugcaaagcaacagaggauuaauuuggaucgucuuauuauaaccagguaaagacaaauuuuucaggucaugcauuaugugaauacuacuagcuaacuaaaugaaucucuuaagugcaugguuuugaaucaauauuaggugagucuuugcuuauaaaauguauggcguuacuuguuuaugaauuagcuuaaacugugauauggauaaguguaacuuaaggauuauuguuuuaugcuuugaauacauaacauuuuauuguucuagagacuaaauuuugugauguuuaugugcauuuccauguuuuggaauuauauaucuuuuuguuuguuuuucaagauaggguuucucuguguagcuuuuuuuuuaaagauuuauuuauuuauuuuauguauaugaguacaccauugcucucuucaggcauaccagagaaggcaucuaugguugcugggaauugcacucaggaccucuggaagagcagucagugcucuuaaccacugacccaucucuccagcucucuguguagccuugguugcccuggaacucacucuguagaccaggcuggccuccaacucauagagauccaccuaccuuugccucccaagcucugggcuaaaggcaugaaccaccacugucuaguggaauuggguaucuuuuaaaagaaaaaaagcuguuuuagauuuaaaauuuuuauuuuauguguauggguguuuugcccaccuguagaucuaugugcccuugaaugccugguguucaugccauuguuccaagaagcaguuuuuuaacuguaacaauuuaguauaauguuguuaaaaguagucagauuaaaaaagaauauauacuguaugauuguauuuauaaaaaucugaagaggcaggacugaccuuugaugaugucauucaggucacagcucuuugcugugaucucccgggagguauugccugguaggccgaauguacaaauguaaaucagacccagggcuuugugcuuaucagcaaguguucugccaacugagcuaccuccccagcuccuguuuugauuauuuuaguacuugaauauuugugaauguucuugugucaguaaauaagcaguuuuuaaucuguagcaaauuuuuaaauuuaauucauagaagauagcucuggaugcugaauauggaaaaguugacuucuuuuuuacuuucagguauggcggucuuuacucacuguucucagaguuuagcaauucaaggagaugucacuguuggcacaguaaugaacucaaauuuauuaauuucaauauagugccuauguuguauaauuguuguuaauauuauuuugccugugugcuaauauuuuccagugcugaagcuuccccugcugaguguugccagcaugccaagauuuuggaagauacacaguuuguugauggauauaagcaacugggauuucaggaaacagcuuauggagaauuccugagucgguuaagagaaaauccacgacuuauugccuccucuuugguugcuggagaaaaacucaaucaggagaacacacaaaguguuaucuacacuguuuuuaccuccuuguauggcaacuguauuaugcaagaagaugaaagcuaccuccuucagguuuuacgauacuugauugaauuugaacuuaaagaaagugacaaccccaggcgccuuuugaggagaggaacuugugccuucagcaucuuauuuaaacuuuuuucugaaggacuguuuucugccaaacuuuuccuuacggcuacuuugcaugagccaaucaugcagcuccucguagaggaugaagaccaccuggaaacagauccaaacaagcugauagagagauucucuccagcucagcaagaaaaacucuuuggagagaaaggcucagauagauuuaggcaaaagguucaagaaaugguagauuccaaugaggcuaaacuaguggcuuuggugaacaaauuuauugguuaucuuaaacagaauacauacugcuuuccacauaguuugagguggauugugucacagauguacaaaacucuuucuuguguagacagauuggagguuggggaagucagagcaauguguaccgaucuucugcuggcuugcuucauuuguccugcaguugucaauccagagcaguaugggauaauaucugaugcuccuauuaaugagguggcaagauuuaaccugaugcagguaugguuuugcuauuauuauuauuuuaagauuuacuauuauuugcuauuauuauuauuuuaagauugcuuuaaaugcaaucaaacaaaagugauaagcauuuaaagcacaaacaacaauaacaaugacaacaaaacguugguuggagguggagagauggcucucugguuaaaaguguuuguuacuauuguagaacugaguucaguucccaguaccuacgucagauagccacuacuuguaacuccaggggauucaacuucuagcuuccauguucagguauacacacuuaagggaaaaaaaaaaaucauuguuucuugucugcaugguggcucacaccuuuaaucccaacacuuggggcagaggcagcagaucccugugaguuggaggccagcauagucuauauagcaaguucuagggcagccagggcuacacagacccugucuaaaaaagcaacugaaaacuauaaagagaaugcuuuucccuguauuuguguuauacuugaagucauuuauugugugaguuagccuuugcagauacuuaaaauuuuuucuuggggcagagguaguuugggaauaaaaauguuauguaagcuugacaauuugaauuucauaucugggaccuaugauaaaggagagagccaacuuccaaaaauugucuucugaccuccacaugugcaccgugacacgcaugcacacacauacaguaauaauaaaguguaaaauauuuuuaagcacacaaaguacaauaccagaaacaaauaaacugugcuuucaguuuccucgugcugcugucaugugcuaagaaggaauuacagcaacgcuuucuacuuccucuaauucuuaaucugaaaauaacaaaagcugacagagacaagauacacauuuuauugggaacauuauuuuguuugcuagaucagaugaauaugaauauuuuugugaaaccagauucuuagacuggaauggaagugcuuucaaaaaccagugcuggugugugcacccacaucugcuuaucauugcuuuuguuugcagguuggccgccuuuugcagcagcuagcaaugacuggcacugaagaaggagauccccggaccaaaaauagccuuggaaaauuugacaaaguaggaaugaguguugugucaugagaaauacgguucguagacuauaagauguccaggagugcuaacccacaccuguaaucucaguugaggugggaggauugccuugaguccaagguuagccuagauaacagugaguccuccuuacaaacaaaggaaacauacugauuuggugcacaacuuuuacucugcauucacugugauucccagacccagccugguccacacagaaguuccaggccauccagggcuauuuagaaagauccucugucaagaacaaacagcaugaagugaaauaauauaaaaaaaauaauucuggcaaaguauuagugaacuuuaguguucuuuuuauuaaaucuugucuuuaggugauaugaaauuuaaauauuucagucauuaauuuuuuuuaaaaauuaguuaacaauauuguaucagcagcaguuaaauuuaggaagauuucucuaaugguuauaauuaaacugucuuauaaauauuaaaggguuauuauaaugagacucaagaccuauuauauuauuuuuuaaaaguuuguuuuuaacuuauuacuaauauaacagucagcaauaauuaaauaaguuaaaauuuuuuaugacuuuuuucaguuaguugaguaacauaaauauuucauuauauuuugaguaggcuacuaguuuaacuugguuuaaaacucaugucagacuggagagauuacucagaagguaagagugcuugguguucuuucagaggacaggaguuuaguucugagcaccaagcuuguguggcuuacaaucaccuguaauuucaguccuuuggggauccuguacucucaucuugccuuugcagucaccagcacauauucauauucauauauauacauacauauauaagaauucaucuuaaaagcaaaugaauaaaaaauacgaaaaccucaaauaccauucugagcauagcaguccauauuauaauccugaggagugggugcaggaacaucacucugcuuugaugccaacuuggacaccauugugaguauuaggccagccaaugccagagaguagaauuuuguuucaaaacaauaggguuuguuucaacaacaaaccccccaagaaauaagaaacagggcuagcugugacuuaguggguaaaggugcuugugauaccaaaccugaugacugaguuugguucucagaaccugcauggggaggagagagccaacgccuccaggcugucuucucaucuccacguguacauccucaugaacacucacucacccagcccacccuacacacaaagaaacacaugaaaacauugaaaggaaaaaccaaaaaauaaaaauuaaauuaaacuacaauacaaauguguguugucugucuccccaugcuugucacccaucacucccauuccucucccgagaguucugaaugauaacaucagucuuuucuggaggucugcauguaucagcacacuucugguaggucucucacuccacacccucccagccuuuccaguacuguagguuguagaauacaugcauauacuucggguuuuuuugagcuuauucugcaucacuguauaaagaucuacagcuuuuaaaguguaagguuuaaaauaguuuucaugaagcuauuuuuuuaugcuugucuaccuuggucaggaaauuuuccagucuuuugaggggagaauuucacuuugaucucuuccuguuucaacagggcugugucgcugcuuuccuugauguuguaauugggggccgugcaguggagacuccgccaauguccucuguuaaucuucuggaaggcuugagcagaacugugguguauauaaguuacagucagcuuauuacucugguaauggcaucauucuuuaacugaaguuuuuggauuucauucuuuuagccaugcguuggcaggucacagaugaauacguacuauaagaaauauguauuauuuuugaaaauuggauuuuacuagauaauaucuuuuccuuuuaccagguaaauuuuaugaagagugugaugucuggagaucaacugaaagaagauagaauggcucuugacaauuuguuggcaaaccugccccaggcuaagccagggaagagcagcagucuggacaugacucccuauagcacuccucagaugucuccagcaaccacuccagccaacaagaagaaucgauuaccuauagguaaggagaaccugccauacuggggcuuauuuauuuauuuauuuauuuauuuauuuauuauauguaaguacacuguagcugucuucagacacuccagaagagggcgucagaucucauuauggauggaugguugugagccaccaugugguugcugggauuugaacuccggaccuuuggaagagcagucgggugcucuuacccauugagccaucucaccuaaauacuaguucuucaaagacgaggauguaguccauagguagagaauuugccuaguauguaugaagcccuggguucagcucccagcacugcauagaccaaguguuauggcacaggacuguaauaccagcauccagaugguggaagugggugaucagaguuuaaggucagccuuggguaguuccuggccugcuuggguuguauuagacccugcuuuuaaaaagaaauaauuaaauuaggcuuuacucacugagucuuuguaaccuaucuaccugcaugugaagauugaucacuaauuaaaccuguuuuuacaaauguuucauuuaauccauacaaacauccaacaugguaugaucauuguuuuauacuuauauuagaugcuggggauacaaagaacauuaauauaagcccugauagucucagguuaguuacuccuaggcaguuucaaauguaaaguacucugccacugagucacaccucugcucaacuuuacacauuuuaaagaagaggauuucauuuuaacuacaguuaacugauuuuuuacaaacaguuucuaaaaauguuucuugaaaucaauguuuucccuuuaacauacuauggauuuauagcaacaagaauaugauaucaucaagucuuuagcuuucuuuacuauccuaaaaugucagauuuauaauucaaaauggggcuagguaguagaucccagcauucuacaggaguagaggcagaggcagucagaucucugaguucaaagacagccugguuuacagaucaaguuccaggacagccagggccacacagagaaaccuugccuugagagccaaccaacaagcaaauaaauaaaauaaaacaauacguuucuuuuuuuuuuuuuaaagauuuauuuauugauuauauguaaguacacuguagcugucuucagacacuccagaagagggagucagaucucauuacggaugguugugagccaccaugugguugcugggauuugaacucuggaccuucggaagagcagucggguacucuuacccacugagccaucucaccagcccaaacaauacguuucuuaaaaaaaaccuuguuuauuuauuauauguaaguacacuguaguuggagaugguugugagccaccauggguugcugggauuugaacucaggaccuuuggaagaacagucagugcucuguuaaccuugugauugcacugagccaucucaccagcccccaacaauacauuucuuaacuaggcauggugaugcaugccuuuaauuccagcacgcaggaggcagaguuaagcaauggaauguagugagacccuaucucaaaaacaaaaacaaaaaaccaaauuacuuuugauuaaaaaacgauguuuuauguuuagugauuuuuuuuuuuuuuuuuuuuuaauauuguagaccauagccgggcaugguggcgcaugccuuuaaucccagcacuugggaagcagaggcaggcggauuucugaguucgaggccagccuggucuacaaguuccaggacagccuacagagagaaacccugucucgaaaaaccaaaacaaacaaacaaacuaaaaccaauauuguagaccauaauuuguuauguuaguuuuuuggguuuuuuuuuuuuuuuuucuuuuuuucugucacuugaauguuauuagagauggguguaaugggaagaaauuucaaaugucugcccaguguuuuguauggucauguaaccuugugauugcacuuaauuuaauaauuuaaacaaguguuucaauguucagaggguugaucuucuuucuauuuaauauuuuugcaacccaggacaacaguuagcagccaucacugccugggauucgucagccaccaaucuuacugcucauauuccucuaguaaccccauuugguggguaguaggccauucuucuugucuuccauauugugcgcuagaaauauucacaggugugcucucugugcaugcugcuuuugcuuucuuucucuaaguugcuaauaacauuugaucacuugcauuuuuguaaauuauaacuuucaaguuugcuaagucacagagcugcuuaugagguugauuaugaguucacaguagaggaugggagggaagcguaaagaugugcugggccugucucaggcuugagugacguuagacuaaaagagauaaugaacauaucugcaguuuuguaaaugaagauguuuauaucuguuugucuucagcacgcagagaggucagcuugucucagcaugcaggucgcuucuguuacugcugauguuucuuuuuguccucacuuuugauuguauugagccagcagagagugucuacuucccagacaguuguacugaauuugauugcucugugagagaaaagugucacagaacacuaaaacacuuugucccaaaaaaauuguaaauuucauuauucaaaauuucauauaagauauauauaggaugcagcaugggauaacucagugguagagagguaaugugaguaggcccuggggcaguccccagcaccagaagaagggggauggauggauggauggguggauggauggaaagauagauggauguuagauauauagagaucauuuuuaaauguauauaauaaauuaguugaaaaaauaaauauuguaagccugggaagaugacucagaggguaaagaacuugaugccaaacuugccaguuugaguuugaucccuggggcucacaugguggaagaagaggacugacuccuacaaguugugcucuauguacacaggcgugcugugguguacacacaaugcuaaagagauagaaaaaggaaaaagagagccgggcgugguggcgcacgccuuuaaucccagcacuggggaggcagaggcaggcggauuucugaguuccaggacagccuggucuacagagugaguuccaggacagccaaggcugcacagagaaacccuacccugucucaaaaaaaaaaaaaaaaaaaaaaaaagaaaagaaaagaaaagggaaaaauauauguauucaugguaggagaaaagauaggugaguuuuuaaaaaacuguguguguauauguaugguugugccaguauguacagguggaggucagagaacaacucuuuggggucaguuuucuuuuucuaccaaguggguucugggaaacgaacucaggucaccaggccguggcagccuuuacugcugagccaucuuaucagucugagucuuguauagagagucuaguaaagcagaaaggaucucacuuuaacauaaagcaaugccccugugucucaggaaagaguugauaauauucagaagaaagaaaucugcuuucagaaacucccugguuuugccaguaguucucugaugacuuugcugggcaugaugguggaagccugccaccucagugaccagagggggaagcaggacagcgggagccaggcuucucuacuacacagugcaacccuaucuuacagaaauacgcaugcacgccauuguuuaccagguuuucacaugacacuuuuuacauuuauaaguuuguguauuagaaugggagacugcuggcaguuaaaacuuuuauaagaaaaauaaguuuaagugucuuauugaaaccuugagaaugagguagugcuuuuguugucccugaccuccuggcuggcuagagagaauguuuccuguaucacaguggugucagguggagccuuccuuucuaguagacguagagcaacauguguaggaguguuuugccugcaugugugucuguguaugcguggugccuggagagggcagaagacggugucagccucccugggacuggaguuauacaucuauaagcuaguaugugcuuguugagaguugaacucagguccucugcaagagcagcaagugcucuuaacugcugagccaacucaccagcccucuaauggucagauuugaagaagagucuguauugucaucaggagaaugacuagggagaccuagucuuuguuuugucuggauuuuuuuuuugcuguuuucaccauugucuuuuaugcauguacaaauguucagcacaaacagaaaacacauuuuuauauucagugugcuguuuuuuucauugugaguuuuucccuuauuuguuagcaacucggagcagaagccgaaguaauauguuaauggaccuacauauggaucaugaaggaucaucucaagaaaccauccaggagguacagccagaagaggugcuggucauuuccuuagggacaggcccucagcucacuccagggaugaugucagaaaaugagguaugcguuuaagaguacaugucuuuaauuuuuaguuuuuuaucuugagacaaggucucacuacauaggccuggcuguccuagaaauuacucuguagaccagacuggccuugaacucacagguaccaucuuccuucaucuccugagaguugagaguaaaggcaugugcuaccauaucugauuuguauugcugcauuuaacuugcaccuaucacuguaaagaauuuuaaguccagcaugauagcucauaccugugagcucagcaugugggagggaggcugagguaagaagaguguggcugcauagcuaguucuaggccaacauggucuacauaguaucacccuauuucuggaagaaaauaaaaagagauacuagcuaacuaucuagccagaaaccccuugcuucucaucaguauucauagcucagucugguugguagauauaacaaagguuaugucuuuuauuuugggggagucuuguuuguuugcuuaaucguguugcuuuguuuuauuuuguguuuugauacugagucucauguagccauggguugucuugaacucuggucuucugccucuaacuuccaaguccugggguuguagguauaugccacuguacuuaacauagagguuuauacuaaauaaaauaguacuagugguuuauaaguaacagaaauuuauuucugauuguuuugggagcucagaaguccaagaugaaggcauguuuggugucugguuagggucugauuccugguuuguagagucacccucuuacggugcucuggugguguggagaaggugugugggcugauguauggacacuagucccaucugugcucucacuuugugggcuagcauuugaccacauggaccuuugcaaggcucacacaugcgguuuauaccaauuuguuuuuuuuuucuuucccucccucucccuuuccuuccucuuugauagucucuuaggugucuaaagcuggacugaaauuugaucuauauuucuccaguauaugaccaugaucuuuugcuccuucugaguccaccugggugcuaagauacauuggggcuggcgauuaaacugagauuuccacaugcuuagcaaacacucuaccacugaguuguuuccaaucccacaaugcauuauuuuccauaagucuauucgauaaaccaucaagugcuaagucccuuugaacaguuauggaggugggucuucacuuuaauacuuaacauuauacugaaguuggugagcgugcccacaacaaaaggaauuguucuaguagcaauauugacauuguggcauagaaauugguaagacuucucuagccauuuguagaaauguuuuguuuauuuucaucuggugguagaguaguaguauuccuguuuagagucaaauuuuccuaauguauacuuucuauuguaugguuagaggaaaauggaagagauaaauaaaaauuaggaaagcaaacuuugauuaauuauauguacauugguguuuugccuguguguaugucugugugaggguguuggauccccuggcacuggagauacaagaaguuguaagauucuguguggguucugggaauugaaccuggguccucuggaagaggaauuaaugcuuuuaaccacuaaucaauuucuccagccccuaauuuuuuuuaaaagauuauuuuauguguaugaguguuuuaccuguauuucuaugugcaccucauuauugccuggugaccaggggguccauuggauccccugaaccuggaauuacagauuguuguaagccaucauguagggguuggaaaucaaauucaggucgucugaaagagcaacaagugcuuuuaacuaccaagcuuucucuagcccagauuguuuguuuguuuguuuguuuguuuuucaagaaugagaucagggaacuaugauggcagaaugguuaagcuaagagcauauaucgugccagugguggugccuuuaaucccagcacucgggaggcagagucagcuagauuucuguuauuucaagagcagcauggucuauagaucaaguucuaggacagucagagcuaaagaaagaaaaccugucucagggguggagggugggggcguguacacaugcuguuuuuauagaguauuguucugaucauccacaucagguggcucaucugcccauagcuccaggagaucuagugcccucaucuggacuuucuaggcaccuacacucacaccuguauacccugccaccaacauauauaucuaauuuuuuuuuaaacuucaaaggggaaaaagaagaugucguguaaagcuggacauagugguacauaccugugcaugcucaggggcaacuugaucugcaagguuucuaaggcagccuggacaaugagacugugccucaaaaauaaaguaaaagccagaaagggaaagagaugucaaaguuggagucaaaauugguuuuaagaauuuguuaagaguaugagguuagagcuaucaugaggaaacaucuugauucuuugauuguagagaaugauuugcagacguguguguguguguguguguguguguguguguguguguguaugauccacacauuuuugguauuggggauugauuuuaggucauccuggcuuagaggcaagugucuuucuuaucuguugacccaccuugcuggcuuagaaacaacuuauauucaaugacugauggguuauuuuuuuuaaagaaaguucauugcuagcuugaaaaaaagucacaguuuauaaauccaguuguuguaugugguggcuuacaucuguaacccuagcacucaggagauggaggcaaggaucaagaauucagggcuagccuggguugaacaaacaaaaggaaucugucagauucuuaguugaaaacuauaacucaagccgagagaacagacugggacggcuguacugacuuaagagaaacaccaguuuucugauggcugcaucuugucuccugucuccuuccugugugacgcuagcugcugcuggcccugaaaggagaauggaaagacauaguuugaguuaucuucaaacauagacuuuguucugagucuauuugaaagcuugauagaccuugcaaauguauuuuaguuaaaaauaacaagaacuuaaauuagcauuuuuguaguuuauuuuauucucaguagucuuucauuugaaauagguuagauuuuuauuuuaauuuuuuucagguucuaaacaugcagcuuucggauggaggacaaggagaugucccuguugaugaaaacaaacuccacgguaaaccugauaaaaccuugcgcuuuucccucugcagugauaaucuggaaggcauaucugaaggugaaggguuacuucauucagggagugugugauugaaguuguucuguguucuuuaaaggagccuuauaaauuauaguuaagccacccaugccucucacuaaggagaauaaugaaauuuccucuaaugagcuuuaacaugacuauaagauuguuuccugaauaaaauuaagauugcaaguggcuguugguccuauaaaaugaccaaacaugucaauguuaaaugaguaacagcaagugugguucucagucuuggugucggcacaagcuuauagcgcuccuuuagagggauauagugcauguguaacugcggagaguggaugcuggcauugcaggaugcuguguacacgucuuuacuguucuguguuccuuuauccacacacucacacaugccuuuaugaaucaggucacuguggaauaaaaaagucaggugaggguguaguugguagaguguuugccuggcaucccuagacuuaaucuucaguagugguggggggaaaaaaaaaggaaacucuuaaaccagauugugaaguuaagaguuugucauuccauauguuagggcaguucauuuuaugaaaaaaguucaaguuuacuaacauuuaaaaggagacauaaauauccucuuuaaccuuucagaaaaucgcugauauguucaaucuagaaaauguggaaaagaaauaagcuuaccuguaauuucacuguucucuuaaaaguuaauguuugauuauuuagagcaaaaucaaguuuaugauguuuguaacccuuuuauguuucauuaacauucccuuuguauuuuguguuuuuaaauaacaugcuuuuuuuuccuuucauuauuuugagacaagguguuauuauugucccuggcugaccuggaauucacuaaguagaccagacugaacuugcccuuaacagaguuucuccuaccucugguucccaagugcuaggauuaaagauguggucaccaugccuggcaauucaucaccugggcaacaggcagguucaucucuggguuggaggccagcuugucuacagagugaguuccaggcagccaagguuacacagagaagcacugucuugaaaaaaacaaaaccaacaagcaaaagaauuguuugguuugcuuguccuaccaauggcucgcagauggcauagcuuuuaaacuggccauuaaaccuuaaccuugacugcguucaucugguuggacauauggcccuuggcccuaaugauucggucauuugcagaacauuuccaaggaacguccagguccaugaaccugcuggcauuguucugcauguccaggcacuuccugcuuacucuuuacugcacacuagcacagaaaguacuucuuuuuuuuuuuuuuuuuuaaagauuuauuuauuuauuuauuauauguaaguacacuguagcugucuucagacacuccagaagagggcaucagaucuuguuauggaugguugugagccaccaugugguugcugggauuugaacuccggaccuuuggaagagcagucgggugcucuuacccacugagccaucucaccagcccaaaaguacuucuuuuuuaaguauuauaguagcucuucaacaagcaaccuuagguuauuuuucuuauuaguuuuuuaaagauaaauuucuagaggcagaccuguuggcucaaaggcauuuauauuuuuaaggaaauaaauaaaauauuaaaagcaucuuaaaucagguaugauggcacauaucuguaaucgcaggguucacaaugcuaagguagaagacuugaagaguguaagauuagucugggcuauauaguaaggccuuguuucaaaacagaacagaacaaaaccagaagagaaauaaauacuauuuucauggcaugaaauauuacauagugacuuaugaauuuuuuaagaagauugcugacaggauaaacauuucuccagguccuuccaaucgcuccaauucggugucuucucucgaccuggagggagagucuguaucugaacuuggggcaggaccuucugggaguaacggaguugaagcacugcagcuguuagagcacgagcaagguaacgugguggagaacacaucuguacagguagcaaagaacgugcgugauuucaggaaagguagucucuuugcuugcugugaguugauuaaugaucauuaaaguugcauuuauccauagcuccuuuaguuuuuaaaagguguuuaguugguaaguguauuauuugggcuuaaauuauacacagcaguaugaguuacuuuaaauucuguaauauuuauuaugugguacaaugauaacuacuaagggcucaauaacuuagguuagggaaagaacacuacaaaugguuaaaagccccaaguuauaugaucugaguuugauccuuggaacccaccuaguggaagaagagaggcaacuccuauauguuguccucugagcuccacacacacacacaccauggcaccaguguauguguauauacacgcacacaugcaaacagaaauacauaggagguaggaggaugacucagugaguaaauugccugccacaaaacaucagggcccaaguuuggauccccaacaauuagauaagaagcuggguuugugcacuuaggugacaggugggugauggguugggaggaauggaagcaugggaagaugaagaggcaaacacagguagaucccuggcucucugaccucuugccugcacacacaugagcacuguacauaaacucuuaacaaacagaagcuuguuguuagggagcacauucacagcuaagugugauucuuacacuuuaguguacgugaaaauuaccuagggagcucuaagaaaauguauuuuccaagcuguccuagaaauauacuacugaaaaggaaaagaguguuacuacuggaauguaugguuuguauaaauuauugccauauuggcuccauuuucaacuuaucgauuaauauuaaauuuauugcacauaacagagaaaccugaaauuaguauacagucaagaugaaaagaaucacaucuuugacagguguucugggugauuccgguguaggaguggacagccuucacaugugaaauacuaaguuaaguaaaucaaaggcuggaaguuggcucagucauuugugacaaaacuuuuccugcagagacacaauacuugccuauucauuccacuauggagcccaccauagaccaaaguccacggugaaccaugacuuuuuuuuuaaagauuuauuuauuuauuauauuuaaguacacuguagcugucuucagacacuccagaagagggagucagaucuuguuacggaugguugugagccaucaugugguugcugggauuugaacuccagaccuucggaagagcagucggguguucuuacccacugagccaucucaccagccugaaccaugacuuguauugggguuacuuauaggagcagaaaugauucaaagaccacugcauaaagccuacucuagcgugguugacaauucacaaaguugggagccuggagcacacugcacagccugcaggcugcuuaacagguuggagaauguccuuuccaagugacucgguguacaacucucccaggcaguucagcagguuugugcugcugccaggcagcugguuuggucucagauucuucuuugcagcuuggcuuuucuugguuccauucaucugagaugaacugcacuuuuacuguuuauacuggcauggagggaggggccuagugaaucugaucagucucaggaacuuccuaaagcaauuuucaguuaccuccugcuuagagauuuccugcaggauacaauguuuauaauauuaucaagauaauguacugcucuugcacaguacucugguucaauccuagcaccuuuaggaugguuuauaugggcucuagacaccaggcuugcaugugguacacauacauacauacaggcaaggcauuaauauagauaaaauaauaaaauaaauaaaucuaaaaagagggugaauugaagccugggcaugaugaugcauaccuuuaauccuagcacucaggaagcaggcaagcuagcuugguuuauguauagagacccuaucuuuaaaaaaaauuaaaaaaacaagcaagcaaucaaauugagagcuagaugugguaaccuaugccuguaauccuauuauugagagggugaaguaagaggaucauaaauuuaugcuauuuugaggccuugucuuauaaacaaaaacaccuacaccaaaacccaagucaaaguuuuacaaaauggaaauugacaagaaugacuuaugggucuagguagaagcucaguggguaagagugcuugcuaugcaagcaugagugcuuuagucugagucucuagcaucaugucaaagccaggcguagccaugcgugccuauacccucagcacugggccacagacagugcaggccuugaagcgugcuuagcugaaggugcugagcuuucaguucaguggaaaguggaaagcaguggcagggguaccucuggcugcugaauccaugugcacaucauauacacagagcaagcugaagaaaagugaucugggaaagaaggaaaacucuagaauuuacacuugagcuauugccaagugaaauaguuuacauauggguuuaccaccuaauuauuagcacaaugauuggaucugguaagcuaccccaaauaguuauuuuuacauuccugucuggguuaguuuuucucauuuagacugggcacaucugucuccuuucagcagugguaagguggagguugggagugugugggggagucucuacuaaucuuaacuggguuaauuagucaguggggagcaggcuggaacuacgugcuuauuaaugauaaaaugaauaaccugacaauuuuuucagguuaaccaagaaguuguagcugugccaccauuuguaaagugacuaaauuuguuuuugauagcuacaacacaagauaaucuugaugauaaacugaggaaguuugagauucgugacaugaugggacuaacagaugacagggacauauccgagacugugagugagaccuggagcacugauguccugggaagugacuucgacccgaacguugaugaagaucguuugcaagagauugcagguaacuggugcucaagggcuguaggacugaauagcuguuuaguuguuacaucuguucauucuucaugggaguggguggcucuagccugggaagcugguauccauauggaacaggacauuugaguacuuacccuaaauagucauguguuaccuucuguguuaaucuccuccacuuuccaccuucuuuaaaaaggagaaaaaccaaagcuagaugauggagauggcaaaggcacuaguugcuaagucucaugaccuaacuuugacagcuaggaucuacauagggaaggagagaacugcccuccauaaguugucaucugaccaccugugugccauggugugcacauauacaugcacacacuguuaaaaacaaaacaaaacccaaacagccaaauaaaagaaggccaaauuaaucucagcacuuggggggcagagacagggacucucugcgaguucgaggacagcuugaucuacagagugaguuccgggucagccaggacugcacagagaaacucuguuucaauaaaacaaaccaaaacaaacaaaacaaaacaaaaaacaaaaaagaaaagaaagaaagaaaagacagaugaaaguugggcagugguggcgcacaccuuuaaucccagcacuugggaggcagaggcagguggauuucugaguucgaggccagccuggucuacagagugaguuccaggacagccagggcuacacagagaaacccugucuuaaaccucccccucccccaaaaaaaagacagauaagucuuuuggguuaauuuccugucaagucucuuuggagcauagcauacggucuccauuuguagugagcuuauuaucuucuugaggcuaaaaucccgaagaaaacauagccuacuagaauacuaaagaucuuuaaaacgagagcuagagguguaagguguagcuauugguagagcacuaggugugcgugugcgaugcucuaagaaucccccucaagcaccacagaaccauagaagacgauggaaugaguucaucucugcaagccuuaacucagucgcagaggauagccaggcuuuccuuuguaaaaugucaguuuauugugcugugacauucagaaccuuuuuagaauauuguuuugugaguucugaaagauuucauacagccauauaauuaccaucuccauuuucuuuuuauggaaaauaucaaccaaagacaacagggaacucauuguaccuggcccuaagcuuuagcaacuagacacacauggccaguuuuguuuuuccauucuuccacugucccucuucaugccuagacauguuccagauauucuuuuuucuuuuaaaguuuuauuuguauuucauguguaugcguaucuguauaaauauauggguaccacauauguaccuuguaucugcagaagucaaaagagagcauuggaaccaaccccugaaauuauccuuauagacacugagucacugugagcacuguaacugagccuggguccucugcaagcgcaguaagcgcucuuaacugcugauucacucuguaggccuuuauuugcaguuuguuuaaucuguaaaagguaguuuuuacuuguaacuauucucaaaauuuuuucaugaccugaaauaguuauucuuuuauuagauugaaccaaguguaguauagaauucccaucuggaguauuuuuucuucauuuuuauuuuuuauguguaugaguguuugccaacauauguaucugugcaccacuugugugugguagcuucaaaggccagaauagaauguuggauccucuggcacggggguuagagcuacuugugaacugcuauguaacugcugggaguuagacccaaguccccugaaaaggaggcaguuuuuaacugcugagcugucucuuuucaucauuaucuguuaaacacagguauauaauaauauuccauuccuuucacuuguguuucaguagugcauagagauuucucaauuggcuuuguauuacucuuuccacgugccaaagcaguauuguucuuggccacaagcaguauuugcaguuggcugagugcuaugaaggagccauauagucucuugcaaauguauuuaaugcuuugaauuuguggcuauuaggcuggaagaaaacauguuuggcuaauauaacuuucuguggguauguucuccggauuuuuauagucccuguaggacuauaaauuuuauaaagguaaaaagauaucaaggacauagguaagauuugcugagaaaccuuggugaaaauaaauuggcaugaggaccuggagagaugauucggugguuaagaacacugucugcucuuccagagguccugaguuugauuuguagcagccacaugguggccuacaaccaugcauaacaugaucugaugcccucuucaggugugcagauguacauguagauagaguacucauacauaaaguaaauaaaucuuuuaaaaaaaaaccccaaauugacaggaaccuaaagauguguuuucccuguggagagauagaguuaagcaggaggaacuuaaugaaagggagguuguggggcuggagauuucuucccagauaggaguacuacacuuacugcucuugcagaggagaggauccaaguugaguuucuaggaucuacauggugacucacaguuggcuguaacucuaguuccaggguguuugaugccucuucugaucugcuccagcuccuacaugugcauggugcacauaacucaggcacauauauacauauagacuaaauauuuaaaacaaaauaaugaaagaaaaggagguugugccaguguccccaacugggaacuuuguguuuuuaguuucgugcuuaaaugaaaugauugcuaccucagccacuuucccguguuaagagucucucuccccucuuugcuuucuuucuaacacuuugcucucacugguuacaggugcagcagcagagaacguguuagguaguuugcugugccuuccagguucagggucaguucuccuugacccuugcacuggcucuaccauaucagagaccacaagugaagcuuggaguguagagguauugccaagugacucagguugguaugcugucauuguuuacuuuuuccuucuguagaacuuuaauguguaaggugucuuaauuuuuauguuacguguauuuugccaaaugauauacauuuauauguuuuucuguuuuguuuuuugagacagagucuggcccuggcugacuuugaacuuaaaauccuccuuccucaauuucuaaguacuagauucucagacauuuaccucagcaccugaugacucaguauagauaaggccaauaucagacagucauacuguuaaaaauuucaaauaaaaauuagaacacuuccuuuuuuuaaauuaauuuauuuuauuuugucuugauauuuugaguacacuguagcugucaucagacacaccagaagaaggcaucagauaucauuacagaugguugugagccaccaugugguugcugggaauugaacucaggaccucuggaagagcagucagugcucuuaaccgcugagccaucucuccagcccacuagaacacuuucuaucuaucaaggaaaaaauguacuguuggucaguacugauuaacauagcaagugcugucugggugaugggggugcaggccuuuagucccagcacucuggaggaaaaggcaggcagauuucugaguucgaggccagucuggucuacagaguuccuggacagccagugcuacacagagaacccuguuucaaaaagggauggagggagggaggaaggaaggaaggaaauaaauaaugauaacaacaacauagcaaguguuucugagucugugaaguaauuguuugaaagugaguuuuguguguaugauaggucaguaucuuucaccauaucaucccaggaugagaguagcagcccagcucagacuacacauuugaauuucuagucaacauucuuucauuuaucccuggauggccaggccagugagauagcuuagugaauaaaggugcuuacagccaggccugaugacuugaguucaaccuucaggagagaacuacacacauauggccguaauaaauguaaauuuuucccugggaauaacuucuccauuuuaagagauaucugaaaguuuguuugauugcuuauuauaauaaucuuuuugacauaaaaauuguuuuucuuuuaauuguauguucacguggguaugugcacucguaaugcagguacccaugaacucccgaagagguuauugaaucuccuggggcuggagucuggcauuacaggcaguugugagccaccuaaugugggugcugggaacugaaccccguccucugaggaccaacagacacucauuacuguugagcuaucucuccuccacuaauuuguuauuuuuauuuucuguuuugaguguuuguguucauguauaucauauaugugcauaucaugugagugccugcagaggccagaagagaacaucagauccccugggacuggaguuacagucauuugugagcugcaauguggguccuuugaacugaacuuggucuucuauaagagcaccaaguacucuuaaccacugagccaucucuccagucucuuaaaagagaauuaauuuuauggcacauacauguauuauuauauagugagauccccaucucaaaaaguuaguagauggggcuggugagauggcucagugguuaagagcgccgacugcucuucugaaggucccgaguucaaaucccagcaaccacaugguggcucacaaccauccguaacgaaaucugaugcccucuucuggagugucuucagacagcuacaguguacuuauguauaauaauaaauaaaucuuaaaaaaaauguagguaaaguauuaaguaaagaaaugauuuuccugucuuccuuuuuggagcuaguuugagacaggaucucgucauguagcucaggcuauucauggaacugccaguguauuuuaggcuggacucaaacucacagagauccaccugccucugcuuauugaguguugagauugcccugcugucaugcccauuuuaagugcuuuugagaacauugagauuuagagaguugauacaguguuguauauuauucugugcuccuauugauuaguuuacguguuaaccaagaaaucgcuuuuuuuuuucuuuaaaguauucuagaaauaguugacaucuguacauaacaaacuaguguguauaucaggaggaaaucauaaccuuaucuucuuuaaacuaugaucuaacuagcuuugcuaaguagcuuaggcuuauaaaucucuuuauuccccaaucgcuuguaugucuaagucacaaaagcuguuuucuguucagaggcuccagacuuaaagcaggaagagcgccuccaagagcuggagagcuguucuggacugggcagcacaucugaugauacggaugucagggaggucaguucccgccccagcacaccaggccucaguguuguguccgguaugucugucuuguuuuaagggcuaggaauuugaaggcauccccuucuuucuguuuauaaaguguuaccaaagagauaacuggguuuuguuggcuguuuuaugguaugguacuaucuguugaacccagaacuugggacauguuagucauguguucaucacugagcuguaucuccacccccaagagauauguuauuuaaguucucaguaguccccagggaaaaaaauuaauuuuaugccuucauaaucuuugagaacuuaauauguggcuuuuacagccuguuaaaauaauggacgugcugcuccucuuucagcucuugauauuuuugauagcuuuugcuacgauauuuagguauagcguguaauucugaugauauuguauaaagcaagauaaguguguuugaauaacagugguaacuugccagcacucagcaacucacauguguagguggauaguuugaaaaggaauuucuccaaacuucauaaaauuuuguguaacuacuuuggucuucuugcagcuuauuuauuuacuuauguauuuuugcuguauuuuuuaaagguauaagugcuacaucggaggauauucccaauaagaucgaagaccugagaucugagugcagcucugauuuugggggcaaagauucuguaacuaguccagauauggaugacauagcccaugguaaguuguaggagugagaauggcuuuuuaagguaauuauagaaugucagaacucagauagaggccagggaauaucuaugaguuugagacuugccuggucuacauagugaguucuaggucagccaagucuacauagugaguccugauccaaaaaaccaaaaacgaaagaaaaaggagaaaaaaaaauccuaaaacaaccaaaacaaagcccuaaaaaucaaaguggggcauaacuugucaauguguucuuggggacuuagaugaucauauucuaaauuuggaucaguuagaacuacuucuagagggggcuggagagaugguucagcgguuaagagcacugacuguucuaaugaagguccugaguucaaauccuagcaaccacauggugguuuacaaccaucugaaaugacaucugaugcccucuacuggugugucugaggauagcuacaguguacuuacauauaaauaauaauaaaucuuuaaaaaaaaaaaaaaggccaggcaguggugcugcaagccuuuaaucccagcacuugggaggcagaggcagaggcagaggcaggcggauuucugaguucaaggccagccuggucuacagagugaguuccaggacagccaagaucuacacagagaaacccugucucaaaaaaaaggcggggaaaaaaaagaacuacuucuagaaaucuguuauaaggaaauccgugaguggagaaaguuuuagucucuguauacuuaccuauuuuaauauuucuaguuguguuaagacaugcuuaguuaggguuaucuuuuggggagggggaguucuguagucuaaaauaguacauuuagaaauuagagucaauuucauggcauuauauauucauuucacucauagauuuuuuuuuuaaaucaagacauuugcugaaagcaauauuagacuuucaaauucuauaguucuccaccucuucuuuagauaguauuucuuguuuuuaugcugggagaaguaagucuuagaaaagcugagcucacuuuaaauaugugugaguucucauggaggcugucuucacacuaaccauaauaauauuuguccauuagguaauaagcagguagaugcugcucccucuaaguggagugaaaaaucccuacaugcagauuaaaaugcagggcaaucagaauuugauacuuauuggugucauuuauugcugguaugcuucucaaguucuaauugauuaagagauaaaagcugugggcgagucucagcuccuucuucacuauguggaacgcugucugcauguggcugaucucauggugugccuucuuguuguaggcgcucaucagcugaccucuccucccucucagucagagucucugcuugccauguuugauccacuguccucacaugaagguaagcuggugguauaaacuuuuggacucugucauaaacagaagcaagagauguagaccuuuguugauuaguucuucccagcaaagcuucuuuucuguguuacaggggccucugcugugguaaggccaaagguucacuaugcccgacccucgcauccaccuccggauccuccaauccuggaaggugcagugggaggaaaugaggccagguugccaaacuuuggcucucacguuuuaacugcagcugaaauggaggcguucaagcagagacacucauacccugagagauugguucgcagcagaagcucugauauagugucuucugugcggcggcccaugagugaccccagcuggaaccgacguccagggaaugaagaacuuccuccagcugcagccacuggugcuacuucuuugguggcugcaccucacucgucaucuucguccccgaguaaggacucuucuagaggagagguaugggacacagccauguagaauuugcauguuauggucgggucaguguuccuaugaugucugaaaugaaaauggacucugaauucaagauuaagggugacucugguugugauuaaagaugaucugucaagccgggagauauggugcacacuuuugaucccagcacucgggaggcagagaaaagugauuugucugugaauucgagacuagccuugucuauagagcaaguuccaggacagccagggcuauacagagaaaccaugucuuaaaaaaagaaaauaaacaaaacagaaaaaucuguuuaauaauccauaaugcuguuagaacuugguuuuguaagaaucuugccuuugacagcacuuagaucuuuucucugugcaguucugugucuaaucacacuuagaacacuuuugaggugguucaaugaggugucucacuggugauuugaaagucauacaguugggaagacaaacacuucuuccucauuugaaaguaaguuuccaaccuaguucuugucucccuuuugugaguuaguaaguuuccugcaaaugccgcauuauucugugugcagccccauucaucagcacuuuggcguacuccaucaugucuccccagucgccagcauuacguucuucucaguuagcuuuugcuguuguccuugguuuuggagacaagaucucuuuauguagccuaagcugacugggagcucauuauguagacaaggcuggucuugaacuugugauaauccaugugucugccuucugagugcugauuucacacugaagagcccuucugccuaguccaugguuuauagcaggauacagcaguacacgugcugccugucggccuuguugcuccaucgcucugcugcucguucaguuuugccuuggccaauuuucuugagaucacuuauauuuuuguuuaguuuuuguuuugguuuuugagacaggguuucucuguguagccuuggcuguccuggaauucacucuguagacuaggcuggccuugaacucagagaccugccugccucugccucccaagugcugagauuaaagguaugcaccacugccucugccuuacuuggcuauuuuuuauuuuuuuauucuucucucauacauuacauucugaguauaguuucccauuccuccuccccugagauuauuuuuauuuucuguguauaauguauuuacacguuugcccaaauguuugucuguguaccauguacaaauagcacccgcagaagccagaaaaggacauugggucuccugggacgaaguuggugagccaccauguggguucuaggaaucagaccuguguccuuuggaugagcagccaugcugagcugcuuuaauaucucugucucgggcuggagguagcuguuucucagagggucucaaggcccuuccaucaaaacuuaauuuucagaaacugagaugagucagaacucauugcugcucucagagccucucagugaacagagagagagagagagagagagagagagagagagagagagagagagagagagagagagauguguguguguguguguguguguguguguagguguguguacacaguuacccuguauucauuucugucuuccuuggcauagagagaccaaugaguggacacuggggauuuaguuucaguuuagaaauaacauuuuauuuuguuucccccacuuucuugugcuuuaacuccucgauggugaaagccugcuuucguuguucuucauguguauuccuaaggaguucgccuguaaacuuuguguccucauaagcuuuccugccacauaaguccuaaucuaucugcucagagaaauuaccuauuaauaauuauuaguaguaauuuccucuuuuccauucacaugaaacauuuuaagaaacauuuccucuuuuuuuuuuuuuccccccugaaacaggguuucucuguguagcccuggcuguccuggaacucacucuguagaccaggcuagccucaaacucagaaauccgccugccucuguuucccaagugcugggauuaaaggugugggccaccacugcccagugaaacauuuccuuuuaaguagaaauagauacaguuaauuacaaagaagaaagcacucugagaauaagagucgauuggugggcaaagagaaaaggcuccugcucuaacagccaagaauguauagucucaguuguauaaauggaaaaaaaaggaaauucugagauuuucugaggucacaguauaggcuagucaugauuaucaguucugcccuuccaugugaacagaguuaaugguaauuguauaauuggugagcagagagagagagaguaggcaagucuaggcuugaugguuagcuaugucacauguaagcuauguaccuuggggaaggucaccucauuuagcuucauguucuucauuuauguaaaggacuuaugaccaggcaugguaacgcucgccuuuaaucucagcacuuaggaggcagaggcagguagaucucugugaguuugaagccagccuggucuauagagugaguucuaggacagccagggccacacacagaaauccuguuuucauuuuuaagaaaggacuuauuagcugagcaugguagcuugugccuauaacuccaguaguugagaggcucagauaguuggugagaaagagguuagucuggucuaaauagugcauuugaggccagucugagcuaccgauugagacccugucucaaaacaaaaaccuaacaacccuuaauaacaggagccauuuuaucagguagcugagaggauuauucucagacucaguucugacacaccaaauuacuauuacugcagcacacugucuucaccccuauuaaaauucacugcacugcauuuacuuaggguuuucaauuuuuuuuucuuuugcuuuugugcugaggauugaacccagagccuguaccugcuaagcacuugcucucccagugagaucuacuccagucccuuccuucacaguguucugugaugcccuccaugcacucuguuaggccuuugguuugcuagcacuauagagaggagagaguaucuacccucaaaugacccaggcuguccugaaggguauuucccuauuccagagggugccuggaaggcaauagcaguagcuucuugggcuguggcucagugguagggugcccugggcuccauccccagcauucuccuuuucccugcuagcacccagaagaucaguguuguuuuaucacaaauaggacugacuuauagacuuacuaaaauccuuuucauagcaauuuauccuggugcucaacuccaaauaacacauccaacucucucuccagacugaggaacgcaaggacagugacgaugagaggucagacaggagcaggccuugguggaggaagcgcuuuguuucagcuaugccuaaagguaauuucacaaaacuucagagugcugucuguaagaacaaagccuccagucucuuuggagaguaguguggccacggcucugugaugcugcggggcugucucuagcuguguggaaguguagaacugcugucauugagaugaaugcucuggcagagcuuuaaaaggcccuguucuuugugggaaguggcugugguguccuagauggagaucaugccggucacugucauuaaacguggaggacucucagcaugcugcucuuaacuuaauguugaauugccauuuugacauuccuggagcaaaucuaagcuuuucaugucuaugugcauugaaagcgugagugcccuacagauguagauagugucaauuguggaaaggagauguauacauuuauuuuucuugaaugccuuacauccuuugaguugacaaaauuucucuuccuggaaaaagauauuguccaaaaguugggguccucuuucauaggccuuuccucaggcuguggcgcuuaggagcugaggagaccugcaucuacccgugcucuggcccacuuaauggagaggagugcaggacgcaggaacucuguucuuuuggcaaagcuaagaggcauugguuuugacuuacuuucaguggauccucauuaauuaaaucauucuuucuaugucaaaugacuccaccguagauucugaaagcuucuuuaagaaccuuugaugcuauuuuaagaaugauuaucaguugacgcuugggauuucuuagcuuuuaaaguuucaaccuccuugcacuuagaaauguuggcacgccagcuaacuuccgaggaguguaguauguuauaugucacaguacugacuuuauuuaauuuccagcuccuauaccauuuagaaagaaagaaaaacaagaaaaagacaaagaugaucuggguccugacagauucucaacacucacagguuuguagacccaugggcuuccuggcuccuucauucccagagcacauauuucauaacacuuuuucuugggugccauaagcguugccuuuuuagaagaguauguuuguguguguaugguugggaguauguucuucauggcucugugguuucccccuagaggccacagugggucucgguguguucuuccuacagcccacuaccaccaucaccauccucauuaccauaaccuguuucugacaaagccugccugacagcucagcacccagggaccaugccaccugacugcuggaguguguggggccgccuccaguucucugcgugcccugucucuggaucacugguuggacaguuuucucaaacacugaucguaggacacuaaauuuauuuucaucuguaguuugcucuagcuuauucaggaucacaaugaaaugcuauuuuaucuaaucauuuuauuuuuuuaaugacuaaaguauuuguucaacaguauuacaaaugccaaccauugugguaaaaguuaaagacuuuuuuuuacagcuugaaccauuauaguugcugucugauccauggcagagcuuuaggggucuuccuuauucaacaccugcauuucugcagcuucuuggguaccuuaaaagcauccgugagcuagcaugaaugaucauaguugaaucugauagcgugcauugauucuuagaugcuguagaucaucuagaggggaguucaccucucaguucuuuuuuuccuuaucuuaauuuuaaaguguguuaucuucccauccuacuaaguuacaaucagcuauggucucaaaagugaccaguacaguaccaauucugaugcguguucuaaugucuauuugugcguguuagguguuccuccauauuucagcuucuauagcucuuccuuauuagauacaguaacuuucacaguaauaaaggguaugaacagaaagagacagguugaacaggccacaguucccugcugagagcagcccagccuguccuauucaguuagcaaauaucuguugaccaucucaugccagacaucaucauagauacuguggauauuaaauuagauuacauaugaccuggguuuguugggaccuugcaguguuuugggaagaguuggaaagauacugucuuuugggcaaugucuuuguguauuuuccuguguucuucauuccugcuguuagaaguauauacaugucacagaggaugcagccaccuucuuucaaucccagcacucaggaggcagaggcaggaguucaaggccagcuuggucuacauagugaguuccaggccagccuuggugagaccccgucuuaaaaaagaacagaggagaguacuguagucucuauaaguagaauuacacuggguggaguagcuuuguauguaaauuguuuaaugacuuugaagaaauuguaaguaguuuuggucaauuuuguuuguuuguuuguuuguuuguuuuuuucucaugcugagauuggaagcuaaauaaaguuccugucuaucuguuccccaccccauaaaauaguucauuuucuuuggguuugauugaagaagcuuagcuuucuuauuggagaaauuaugcccaauccuaacuaaugaucacuuguaaguuaccauaaaaucaguuugaaauguuuuuauauauauuccuaauuagccuggccauaaucuugccacucuagccacugguuugguuuuuguuuuucuuuuuuuuacaaucucuccuaaucuuucucagaguuuguauaaugguggcuuuucugucacugaaucggagauauauauauauauauauauauauuauauauaaauacaaacauuauauauauauauaaaauguuuguauuuaccguuaccacacuucauacacuuuccaguuucuacuggauacaguuagcuuuugaauaauuuucauuggcuguaaaguaaucugauucuacuacauugcagcauaacucuucuuuuccuauugaaauauuuaaguuauuuccuguuguuuuuuucugaaaguaccuuugugcccauagguggugguggugguuguuguugcugcugcugcuguugcuguuguuguguuaacagugcuggggauugagcccaggcuuauacaggccagucaggcacucuccacuaacuguaaccccagcucugcaccacagcuuuuacuuucauuauuuuucuaggauaacguuuuuuugagaaguauuuuauuaaaguaaaagguaauaagcaacuuuguaguuuaauugacugagguuagccaguuuacauuugucccucucacaguccuuguggacucugaauagauaaccagcggggcuggagagacgcucagcaguugcagcacuuguugcccuuacagagaaccuggguucaguucucagcacccucauguugguucauagcgaccuguaacuucagguccaaaggcucuucugaccuccucaagcaccaggaacacacucgguacauuugcauccaugaaacacucaaaauauacuaaacaaacaaacaaacaagaauauuuuaaaagcuacaauccaaaauauuacaccuuaaaaggauucugcagugguugcauuuauauuuuugaaaaagcccaccauugauuaugaaucucuuuucaugacuauacuguucuaguagacauuuaaauguauuuggaagucagaugugcucacaccuauaaucccaacucacaagucugaggcaagagguuugcuacaaguucaaggccaguguaggccacagagagaccugucccaaaaaagaaaaauaugcaaaacacaacuuugugacuccucuauauaacuugagguauuuuauagaaccaugaacagcaguacuuguuuuguggagaggacaggccugugagugugcugcccagucccugugcccuuugccugcucugcuggggugugcugaggccagugcuucuuugugcagugguuugcugauaaguguccacauaagaugccuacaacaaguucacugacaagugguacaaaugcagugcuaucagcugcuguugucauacacacucacacacacccacacacauacauacagagagguuuugaugcuauuuuagaaauguuuacaaauagaauucuaccagaagauacacugcuggguuaccaauuggccuaguacaaucucaggaguuugaguuuccauauggaaccuuauuuuguauugaagauccauagcagucuauuaauggcuacuguuugagacuguaggcuaauuuguguguauggugcugggcaucaaacucagggucuuguaaaugcuaaacaagucuuuaccgcugagcuguaucccuagcuugauguuuugagauagagucuugcuauugcucaggcuggccuugaauucauaauucucuuauuucagcuucccaagugcuggaauuauaaucauguuccacaauagcaagcuagcuuaacaguuuugauaacugauuugguccugucagugaaaccaucugcucugugcauccuagaccccuagaaugccagggaccauuguaugaauaaaaauacuguguccuggcaccgcacugucacggagagaaguggugugauagagcaggacguucugcagccuucaaaugugauggaaagaaggauuugcaaagaaaggauagagaaagccauuuaucaaaacuaaaaaaggguuuugguguaauuugaauaauuauuuuucuccuuaagcauggaggugucugauuaaguuguguguauuaaaaaaaaaucagcaggcuuagauaggagacccacaaacugaaagcuaagccuuggcuacuuaaugaauuaaaggucagccuagguuauauagcaaaacucuucuauuugucccccacuccuacaaaagaaaccauugguagaaguuguguuaccaugaauugauaguuacugugucuuaagcaaguacuuuagaauucuuucugcacugaacuuugacacagucaugcagaauuccaauaguguugagguggagugccucucucuggcuuccugcuuugggaagcucuuagaccuagcagugggguucaguaggcagcugcauggugccucauaacacugagauaugcgcccuucuuuagucugaccuccuaaccugccuuugggaugcugcugcugcugguguuauacuaacagcagaguagggauaaacccaaggaacuaauugucuuucucuuuuccccugcagaugagcccagcccuaggcucagugcucaagcucagguugcugaagauauucuggacaaguaccggaaugccauuaaacggaccagccccagugaaggagcaauggcaaaugaugagagugcaggugauaaucacaauagaucugaaccaugauaguuuaucuuagagaugagguaacucaaacucacauagccuuuagaauaggcuguccagaggagccacaguauuugaaaaugauagcuuuuguaagcaugucagguuaguguaucccucucuacagcuucccacuaagugugggcacccgagauguucagaugguuuagggucaccuaaugaggcuggggugacagcccagagcaccuugguuuauguuuuagugagagggaacccuccccccagcccccuacccacccaccccaccccauccccccuuuucuucccccccuguuuagaaaagugagauuugauguaguuauggacuuuuagcauagcuguggcggccaacucaggcuaagguacuguaccuuguugcuuguuaugucuuuucuacagcgcuuacgcucucucucucucucucucucucucucucucucucucucucucucucucucucucucucgggauacugacuaucugucauaaaaauacagaguccucaagauauauuaaggaaaagcaaaagcauguaaaagcaugagcaguuuguucaaucugucccuuccugugcacugagcaggaacuugagcugcucugaggagggcgugcgccugaggcugaagagggacugagggcaccgaugcuucccuuucuuagggcuaaggugcagacaacucuacucuggagggcaggcuuucccugaaaucagaauccuccugccugucucccaagugccaacucucagugcagugaaggguauuaaacucuauauuuagacuugccaguuaccaauauuuugucauaauuuccuauacgaacaguauuuaugaacauuuuauuccuuuugacuuaaaggcguuauuuuucuuuuucuuucuuuucuucucuucucuucucuucucuucucuucucucucucucucucucucucucucucucucucucuuucuuucuuucuuccuuucuuucuuugagacagagucucauauaacccaggcuuguaucaaacuaaccuuaacaguuauuuacuuuuuuuguuguuguuguuuuuuaagauuaauuuuacuuuauguguaugugucuuuugucuacaugugaagucuguucaggacaugugugcgguaaccaugaaggucagaaaaggauguuagaucucuggaacugaaguuacauacaguugcuaggcaccauauguguacucugaacccauccuggguccucuggaagagaagccaaugcucuuaacaucugggccaugccuccauccccagccuugaacucuugucuucacuuucacuaccugccuucacuucaacuguuagggacacaucaccacaccuauuugauuuggugcugggaauagaauccaaggauucucucaugcuaggcaagcccugacuuuuucucaugcuacugacugaggcucaggccccuugacuuuauauauguauauauuaacuggcuaauuaaaaacauaacagaugugggaaccacagaccuggccucgauguguuuugaacuaggcccuggcugugucuuagguggggagggcuuuguugaggagacucaggagacaugaaugagugucuaucccagcacuuggcaggaguccaugucucuaaagugaagcuauuguuaaaaugcuuuuugaggcucucaguucugugguucagugauucugaacuuuauuaaguaaauaugaacuuuauuaaguuauuccaaauuggauacuguggcaagaaguacaguuuuuucugcucuaguaucugauaucuugauauauggcccuggccauugauaaucucguuauaugucugagauuuguuuucuuuuuccaagaacuguuauuacaagacaaacugacuuuugauuaaauuucucugaugccugcuaguacccgaaauuuccacauuaacuaggcuguccucuucuuggggacugguuuuguuuagaggucaugggugauggugaaagugcccacgacucuccucgugaggaagcacugcagaacaucucagccgacgaccucccggacuccgccagccaggcagcccacccucaggacucugcuuucucuuacagguuugcaacguugcagguuguacuguuuaguuuugguuugauuugguuugguuuggguuugguuuugguuuugguuuuggagacaggguuucucuguguagcccuggcuguccuagaacucacucuguagaccaggcuggccucgaacucagaaaucugccugccucugccucccaagugcugggauuaaaggcgugcgccaccacgcccggcuaaaguauuuuuucuuaauuaagauacaauuacguuguuuuugccacucccuuuccuccuuccaaccuuucacaguuggcuuugaauguucugaucacuguugcaaucauuugaugucaaccgcuuguuaaguguaaagaagggcugggugauggcccaguccuugaaacgcuucaauccucagugccugcccgaaaaagccaagcgugauggugugcacuuguaauccccacacugagaaggcaguaggucccucccuuagucuagcucuaagccagugagagagccuaucucaaaaaaccaagguugauggcaucuccuaaggaaugucauugagguuguccugagguuucuacacacaugcacaccuguacacacacacacacacacacacacacacacacacacacacacacacacacgcaaaagagaagaauagauacuauuuacuaagaaaacucagguuggaccaggugagguagcacacaccuuuaguaacuaggugaaucucugaguuugagggcagccuggucuacagagugugugucagaccaguaggacuauacagugaaauaguccuuuuuuuuuuuuuuuuuuaaagacuccaauuguggauaucagauaucaaaaacauuaauucaggaauuaaaaaaaaaaaauugugccuccaggagcacacaaguaguuuaaauaguuacagugccauugucugugcagaaucaucagccugugugcugcacagcggggacccagggagucaggaaaaguucuacaucagcucaccaaguacugcagcuccguuugucgugucguccucuccuuuccccacagucucuugcuuccucagacaaggagaaccucuuaaaacacccucacccagcuuauggguacuaguuuccucucuccacgucuccaguuuuuaaaaauguuuuuuuaaaauauuuauuucuuuuuccuuuaugugcauugauguuuugccugcauguaugucugugugaggauguugauucucuggaacuggaguuacagacagucgugagcugccacguggguauugggaacugaaccuggguccucuggaagagcagccggugcucuuaacuacugagccaucucuccagcccccauuucuccauuuuuuacuuuguauuguauuguaggcuauggaagggcucuaccaccaaaugguagcugggucaccaguugaaagucauagaaucuaaucucagcacaaaacuuccaagcaguagaacacagcaaguaguuuguuugguuuuuuguuuguuguuugguuuggucaagggacgggcuugucuaaagcaggaccaacauuugcagagagacugguaggaagcauucagguuggguaaucagcaucuguguuguggcagacccucugccuacucgcagcacuucagggugcucuaggagaucagaaggcuguuguggcucaucauggucaccuaugagcuugcccagagcauucuaacccucuuuuuuuuaaagauuuauuuauuuauuauauguaaguacacuguagcugucuucagaaaccgcagaagagggagucagaucucauuacagaugguugugagccaccaugugguugcugggauuugaacucuggaccuacggaagagcagucgggugcucuuaccugcugaaccaucucaccagucccauucuaacccucuuaaccaguaacuacaggcugugcuuugccuugaggugccaguccuuugaaacugaucuuuucuuaaagaaucauuugaaacauucagguucagagcuaacauguuguuaacuuacacauauauaucuguaaaguguggcuguaucuggcugaggaugugcuagaaguccugggucccagcuccagccagcacaaaaggcucuuauuauuucuaugcaaguaaauucaugugcccuguacuuauucuucagagauguaaaaaagaagcugaggcucgcacuuugcucugcagacucuguggccuucccagugcuaacucauucaacaaggaauggauugccagaccacacagacccagaaggcaagucauuccuuacucuccaguguacacagcuugcacagcagaggcugccacccuucaccuguccaaugcacagaaauuccugugguccaauuuuuauauguuuuucuaagucaucuaaggauacuuugauuucuuuuuaaaauaaauuguauauguauuugugucucugccauuuguguuugguugcccacagagacuagaaaggggugguagagacccuagagcuggaauucagacaguugugagcucccuggcaugggugcugguaugagcucagguccucuggaaaagcagcucaugcucuuaauuaagcucugagcccucucuccaguucccgggacguuauuucuggcuguuuauuuuauaacuagagcggcaguacugcuugguucuaaugguuuguggugcagaagaauugacuucccaauuacggagagguuaugaauccuaacagaauucuuguuuuuuuguuuguuuuuagacaaugaaauuguaugcuucuuaaaaguucaaauagcugaagcaauuaauuuacaagauaagagcuuaauggcucaacuucaagaaacaaugcguugugugugccgcuuugacaauaggacuuguaggaaguugcuggcauccauugcugaagacuacagguacuauucccgaccugccugguuuguaagcugacuguagaacaacaauguuuuguuuguuuguuuugguuggguuuuauugagguaaugaaucuaguuauaaagcacauggugguguuuucuuggauagagauuuuuaaaaacacaguuuagaauuguuaacugacaguucuuguuaguuaagaaguguaguuuacuucaacuuuucaucaagggagauaaagaauggguugggaaauggcucaaugaguaaaacacaagcaugaggacccaaguuugcuuguccagcaccaggcaaaagcgggcaugguggggugugucugugacucugugacuccauccgggagaagcagaugcagaggauacugggggcuugcugaugagccaaaaccgcuggcuccaaguuccaugagagagccugucgaaaaagaaaaagggagacggggcugcuggggagaggucacuggguaacacaugucauggaagcuggacagucucagguagaacccuagaauucaccaaacgaaggagagagcugaguuugcaaaaauuguucugugaccucuacauguauauuguggcagcacaacuacacacacauacaauaauaauacuuuuuuuugcuuuuucaagacaggguuucucuauguaauagagcccuggcuguccuugaacuuucucuguagaccuggcuggccucaaacucagagauucaccugccucugccuccggacuucugggauuaaauguguguacuagcacccagcaaauaaauaaauauuuuaaaagcaguuuucuuuuacugugaggccaggagaucuagguuccgacuuuguuguuguuguuguuguuguuguuguuguuguuguuguuguuuuacauguguuaagaaagacuauagaaggccagagaagcaggaagcagaggugaucuuagggguugcugcuguguuuugccccaagcccuugccaguaagagggaaauaugaguguuguucuuaggcagagugcaggcucccagccuuaagggaucuugucacacgaacacuauaagcaaguauguggugugguuauuggaugaucuaauguauacaguuuguguuuugucuguuaaguguggagcccuacaagcauggagagcaugcuucuguaauaaaagcaaugagccugcagaggccuuggagacagugagugaguuaggccuugaugaugaugugccacagaaacaagggcagcuuuccugagcugccagcggggagcguucccaagaugcuuaucuacagccucucgugccaacuaguaaaaccaaagucugugaaggaguuguuuaaaaaauuaagacucuuaguugcucaagaaaguaugcacugcuacacaucugaucaucugauuucaguagcacuuuguuuucuuucagaaaaagagcuccguauauugcuuaucuuacccgcugccgacaaggacugcagaccacacaggcucacuuggaaaggcucuugcaaagaguuuugcgggacaaagagguggccaaucgguacuucaccacugucugugugcgguuacugcuugagagcaaagaaaagaaaaucagggaguucauucaagguaacgaaaugcauucggacagacgucgccucagccaugggacgugcggaggaugguuuuguuuugcacaguuagggauaugcuagcaugucuuacagcaguuccuuaaauuacccugccagccucccucgcucccuuccuuccuuuaagauuuuggggcuggugagauagaugguuuaacaguuaugacgacuucucuuccugaagaccagaguucaagucccagucccuauagcaauggcaccagggaauuugcucucuuuuagccugugcagggaccagaugcacccaugcacagauaaaauaaucacaacagcaauaauaaaauagaagauuuuuaguauuguguguaugaauacaguguaggguauaagccagaagaggggucauaucuccuaguacucagguuacaagccucccaacauggguacugggaaccagauuccuuccuuuugaaggguagcaagcugcuucuaacugcauagccaucuuuaucccuccuuuuaaaaauauuuuuuauucuuucuuuaaaguuuuucgggucuagggccuaucacaucugugauaggguucucuagaggaauauguguauauacauacauaaauauauauauauauauauauauauauauauauauauauauauauauauauauauacauacauauacauaaaauauguauguaggacuuacugaaauggcuugcaggcuugugguccagguaguccaacaauggcagccaucugcagugcuaggcaccucaucuggucuucaguagacuccagaauccugaagaaguugguucuaaagccagggcaggaauagacuuaacaguaagaccagggcaagcaggcaaguaaugaaaacuugcuucuucuaugucuuuuauacgggcugucagcagaagauggggccuagauuaacaguggaucuuccuaccucaaaagauccagauuaaaagugagccuuuccacuucaaaugauuuaauuaauuuuaaaaaauccucacagguaugcuuggguuuaguuaguucuuauuguggucaaacugacagccaagaguugccaacacaggaucugacuugggucuuuauuuggcagcagucauccuuaccuacuuagccaucucccaggccuaaguuuuugugcucuuggaaugacuuugggauugguucucugaaaagacagagggaagcuuugaugaacacagucuauccagauucuugacuaaaaaccuaaaugggcuggaaagauggcucagcauuuugcaagaauacaugaugucuugcaaaggacauggguuugauucucaguacccaucuagcagcucacuguuguucauaacuccaguuccaggggauccaacacccucuuuuguccucagcagcuaugcaugugguacacugauauacauguaaaugaaacgcauacauaggggaaaaaaauaaaucuuuuuaaaaaguaaauaauaaagaauuuaucaaaagaaagaaagaggggcuggagagauggcucagcgguuaagagcgccgacugcucuucugaagaucgugaguucaaaucccagcaaccacaugauggcucacaaccaucuguaaugagaucugaugccccucuucuggggugucugaagacagcuacaguguacucacauauaauaaauaaaucuuuuuuaagaaagaaagaaagaaagaaagaaagaaagaaagaaagaaagaaagaaagaaagaaagaaagaaagaaagagggagagaaaaaaagaaacccaaaugguuccccaagcuaugaugaaggcacucuauccacagaugggcuccuggaaacagagccauuagcauuaacuacuccacauggggucagugugcagugucagcccugccacuugaagggaccuaccucaucaaggacccauagacuuuaaaguggcgggcugcugugggugccacacucuccgaagggaagaccagaucauuauccucuguggaugucagcuuugauuggucugcuccaugaugaucuucuaugaacaaggugucuaacucagaauggguagggaaagccauucugugucugcugcucugcuacugggaguaacaauucaaaagaugacuucuauguccuugccaaccuggugcucagaaugggaguguggcaacagaucuugaugacccugccuucaggaucugcuuuuugcuuagguacauauuauacacugcauggagugcuaauuugguauagcuagaugcugauaaugcaggccacucacaaagugggaagcuggaauaauggagagcuccagcagcaacuucacuauucugauuuuuggaauuuuggggggugcagagacaaggucucauuauauaucccugucuggccuuaaaaucacagagauccuccuggccuugccuccugaauacugagguuuaaguuguaugcuauuaagcccugcuuuuaauaaucuuugacaucccauaccuauaaucuaucacuugggaggcugagggaggaagauugugaauuuaugucagccuuggcuacagagagacucugucucaauggaaaaaacaaaaucauaaacauggugguauaauucuguaaugcaagcugcucagggggcugaggaaggaagaucacaaguugaaagcuuuccugggccguugagugaguuuaagaccagggaggauuaggaaugcaaggucaccuugcaccauaugaugagacacucgcccuuccaucgcaauauuaaaaguaaaagcaagccaaucaguaguggcccacaccuuaaucuuagcacucaggaggcagaggcaggugggucucugugaguucaaggccagcuuggacuacaaugaauggaaguuccagaauagccagagcuacacagagaaacccugacugggauguguguggggucaaaagcagagugaggucauaagcuacuggcuguauucugguaugugaaacccuggauucaauacccagugcuuuagaaagaaaaauuacaaguauuaaggacugauaugaagugucugaauuguauuaguuuuaucugagauugaguaucuauauauuaaaaauggaacagaagcugcagagauggcucagcagguaagaacacuugcuggucuuucagaggacuuggaaucaauucccagcacucacauggcagcugacauccaucucuaacucuaguuccagggaaucggacaacuucuggucuccucaggcgucagacauacacucagacaaaacccccauaugcauuucaaagagaguuggagauguuaaaauuuuguaucuacuuuuuauuuuuaauuuuuauuauuuuuaacucaaagucucauauaggccaggguagcuucaaacucacuauguagucauggcuagccauaaacuauauggaucuuccucccucuuauucccaaauguugguguuaaagguauguguugcaaugccaagcauugauuuuugugguuuuuugagacaguuucaguguaucccagcuugugacccuccuaccccugccuuccaaaugaugagaauauaggcauuuacaccaugacuuaaguuguacucacauagcugggcagugguggugcacgccuuuaauccaagcacuugggaggcagaagcagacggauuucugaguucaaggccagccuggucuacagagugaguuccagaacagccagggcuacacagagaaacccugucuccagccucccauccccccacccccaaaaagguuguauucacaugguuuuuaaaaacuguguauauuuuauauuuaaauauucgcauauuucuuaauuuucccuuuugauauucuggcuuuaagauuauaguguuaguauuauuuguuaaucagaaugauuucuguagaccccacuccuccaccccuuuuucaugagagucaugcucuaaggcuaccccgacauaguggagacuuaaauugcguaguacugaaccugcauauugaauggauaacugagcugcaagggaggugacugaguaggccauguauacaguauggcuguccugaccaaaggaauaacucaucuguggugaauagaaugagguuucuagacuucuucaugccgaacaauuuucaguucaaacaguaggaacagccugggaagcuggcucagugagucaaggccugccaccaagccugaugaccugaguuugauugcugggagaaagccaacucauacgaguguccccugaccuacaaaugcauacuauggaggugcacacccccugacagggaaauaaauguaacaauaacaagagagaugagaauaaaauguacaaauguguauuucuagaacuuuuccauuuaauauuuuuagauaagaauaauggaaacagaaaacaaaagugcagauaggagguugacuguaauuccccuuuaggguuacuucuaugguguauuuuaaaggauacuguuuuucuuggagacuuucagaaacuuacugcugcugaugauaaaacggcucagguggaggauuuucuacaguuccuguauggugugauggcucaggaugucauauggcagaaugccagugaggagcagcugcaggaugcccagcuggccaucgagcggagugugaugaaucggaucuucaagcuugcuuucuacccuaaccaggauggggacauacuucgugaccagugaguacugugcuuaaugucugugcgggacuacaaagauauuuuagcuguaccuuuguuugguagaguaaagaaaaugcaucuguuaccauucacauucacggucagaguggaugcagcuugagggacaacacgguaggaagagacaagucugaauucagagagccuugcugagcaucucugccugccgugugccugccucacguggucuucugugucuucugugggaugaguuguuugaucuugacccaggcaucccuuucuuaggaacccauuuccuuucuagcuuaaauugcucagguuuacacaguuguuucauaguugucauuugccauauguuugagucaugauuucuucuuuucuuuaaagguuuauuuucucuucuauguauuauuguuuggucugcaugugcaccacgugcaugccaucagaggucagagagggcagcagauccucuggaacuggaguuucaggugguugugagcugcccuguagauggugagaaccaaaccaaguucccuucaaggguagccaguacuuguagcugaguacccuaagccauuuccagacccugagucauaguuuguuaacccaauggcccugaaauuuggagccuaguaguuauuugaucuaugagccuauucugugguagguguuuagcagcacucaugauccaaccaguuauggcaacugacucuagauauugcuagacugucccucauuuaugccucucccgcuguuagggcuuuugcauauuugacaagcacucuucucugugggcuggggaaugugcauauggucagcaacaugugucuucuuaggugucucgugaacccagggcccuauaauucaguuaccuacugugucuaccauugcagcgcugggcggauaggcaugcaccgaggcuaaguauccaaccaggcccucauucucacuuugcaaguacuuucccaguuaggccaucugcccaagccucccuggguuuuuguuuguuuguuuguuuguuuguuuguuuguuuuugagaaauccauccuguugggacgaggugggguagaaaaguaggguguagagacuuuggcuuuuguguuuuucuucuguuuucuauucuguauucuccaugauccugauucuacccccaaacauaccgaccauguugucaccauguuuucuagcaaaugacaaugacuuuggugccuagggauccucaggaauccaugugguagaaucucaaggaaggccauuaguagucuuugcuuuuuacagguuuuuuguguacaucgauacacaugcuguggguaggacccaggguuuuauguaugcucuaucacugagcuauacccaggcuacagauacugugaggaguugcacacaugucugagagaauauaccuuccugugaaaugaaguuggcauuuggguuguuccagccuccccucuaaguguucuuggucucagacugcuugcugacucuggucuauuuccucuccaggcaccugcuuacaaaucaggcaugggguacagaguugggggcugaagcuauauguaugacagaguuuaucccuccuacugcuucauccauuucugcagguuuuacaggguguagagagcagacuugucucuaaaaaggaucaggaggcugaguuuaaccccugcuacugaggcagcuccuuaacuuuuaaaauccuaauuccggucaacaaagggcgggcugggcugguagucaagucuugucuccaucugagagcuauggccaucgcuuucuggccugugacgaucccgcucgucacuucccucccuugccucacucccuuucuuucacugcacagguguccaggcucagggccucuccuccaucugggcuugcuggugaccuccacauucccacagccuucuggcucacgcaguaguuuuucuuucuuuuuuuguuuuaaagauuuauuuuuauuuaugcguauauuucuguguaauugugugcauguguguaagaggcagcucaaguuagaggccgugugagcugccuagccugggugcugagagcagaaccucacagcuaagcagcccugcagcauuucuaagugaaucuguaagagauggauggucuuguuguguaguccaugcuagugccagcccugacaucccgaucccucucccuuaaccucugcuggaacuacagacgccuacugccaugcuuggacuugagcauggccuccuuuguucuuguuuucuacaucguuuaggcuagcccuaccuuaccaugcugagcgagcuaagauaagcccuccuaaaugaacuauaccugugacuaagagagucauaauguaguaguagaaauaguaauaauaauguaaccauaauguaauguauaucuagaagagagucuaaaaugcuuuguuuugauaaaauacaguugugacuauuuguauacuuuccuuucagaaaugugcauuuacauaugaauuuugggugguuuucaggguucugcaugaacauauccagagauuaucuaaaguagugacugcaaaccacagagcucugcagaucccugagguaauacggcuuguguguagcggguggugguguacuuggaaaguuaacauuucagcaaggccccgggugccccaagacagaagcaccguuucccgaggugcucgucccucucauugucacuguccccagggaacuucugggguguaacuuccucuguguagaaaaggaccucaguggagaaguggggagagcccauaguaggguaccccuuaaaguaucucuguucccaagcacagcuucugccccagcucugcccuccugggcagugugcugucccugagcagcuucaggcugggcuuugcaaaggugucccuuucugaugccgacaagaacuguuccagagggaaggcucagucugcauggccucaggacaagugcuugcuuggguggggccagcuuuuuggaguuccuguucuuuaaagauuccuuauggugaaacauugaguacugcaggguuuuacaguuucuuugguaugggugucuuagucaggguuucuauuccugcacaaacaccacgaccaagaagcaguuuggggaggaaaggguuuauuuggcuuacacuuccaugcugcuguucaugaccaaagaagucaggacuggaacucaagcaggucaggaagcaggagcugaugcagaggccauggagagauguucuuugcuggcuugcuuccccuggcuugcucagccugcucucuuauagaacccaagacuaccagcccagagauggcaccacccacaaggggcugaaauuucccccuugaucacuaauuaagaaaaugccuuacaguuggaucucauggaggcauuuccucaacugaagcuccuuucucugugauaacuccagcugugucaaguugacacaaaacuagccaguacaauugaccccuugucaacuugacacacaaacacaucacuaguaagccucaacccuuacauucuuauucauccccaagaucuaaauaacuuuaaaagucccacagucuuuacauauucuuaaaauuacaauuucuuuaaaauauccaucucuuuuaaaauccaaagucuuuuuacaauuaaaagucucuuuaacugugggcuccacuaaaacaguuucuuccuucaagagggaaaauaucagggcacagucacaaucaaagcaaaaauaaaucuucaaccguccaaugucugggauccaacucaggaucuucugggcuccuccaagggcuugggucacuucugcagccauguccuuuguagcacaugugucguccucuaggcuccagaucccuguacuccacugcugcugcucuugguggucaucucaugguacuggcaucuccaaaacacugcaugaccccuucaguccugggccuucaauugcaacugaagcugcaccuucaccaauggccuuccauggccucucacagugccgagccucagcugcuuugcgugaccccuucaugccuucaaaaccaguaccaccugggugacccuuacauauuaccaagucccacuguagcaggaguacaaccuuggcuaucucugguacacagccucuuucugcuuucagaaaacacuucccagaagaugucaccucaaugaugcuggucucuucuuaaucaccacuaauuucuuagcuccagcuaaccagcaucaauagucccaguaaugcaaaguuuuugcuuuaguaguucugguaucuuguuaaccacagcugauuccucagccccagcuaaccagaacuacaaaaucuucacaaucaaaacagcaauggcccugaaaagagucuuuaauuuucccucugaaauuucacaaaccagaccuccaucuugugcacuguugucaacauuaucuuccaagcuccuacacaacaucugacagagcucuuaacaacgaauagaucuucaagcccaaaguuccaaaguccuuccacaguccuccccaaaacauggucagcuugucacaggaauaccccacucugcugguaccaauuugucuuagucaggguuucuauuccugcacaaacaucaugaccaagaagcaguuuggggaggaaaggguuuauuuggcuuacacuuccauacugcuguucaucaccagggaagucaggacuggaacucaagcagggcagggagcaggagcugaugcagaggccauggagggauguucuuuacuggcuugcuuccccuggcuugcucagccugcacucuuauagaacccaagacuaccagcccagagauggcaccacccacaaggggcugaaauuucccccuugaucacuaauuaagaaaaugccuuacaguuggaucucauggaggcauuuccucaacugaagcuccuuucucugugauaacuccagcugugucaaguugacacaaaacuagccaguacaauggguuuuuuguugcuugguauuugcuugcuuguuuguuuguuuaagacagccccuuaccccuuauacacaaggucucucuuauucuauagcccucacuauccugaaacucccuauguagaccaagcuggccuugaauucauagagauccuucugccucuaccucaagaguagagagagauucuuucaaguccucgcugaccucaagcuugcuauguugcugaggcuggccuuaagccccugacccuccugccuugaucccccaaagugcugugaucccaagcuuucaccaccguccugggcuuugacuuuguuuuuguagaagcacugcaacagggauccuagugaugucaacauuaccuucuugcugcugcuugucugugcuucugaaaucagcuaaauggaaaaucucaucccagcuuuguaagaaacucacagggagguugugagcuccaggcucugugguauauauacaccucugcccaauggcuaggcuguuguguuuugaaauaggguuuaucuugggaggcugggaaaaaaugucccuugucagcuugcugugacagguaccguggcugcuaugcagauugcuguuggauucaugaucucuauguugucuaccaucuugcuuagguuuaucuccgugaggcaccauggccaucugcacagucagaaaucaggacaauaagugcuuacaaaacgccccgcgacaaagugcagugcauccugaggaugugcuccaccaucaugaaccucuugagccuggccaacgaggacucuguccccggggcagaugacuuuguuccuguguugguguuuguguuaauaaaggugagucuuuuaguauugucuaauaguuuauguggccucuugagcaggguggcauagagcuucacaagguaauagauuugaauccugggauccuuucuaaaacuugaagaugcuuaauuccaaaacagucucgggauuguuguccagagcccuggccuggcagcuccaacagaucauggaagaacagaugcuaagauggcccuggcagagcacagcaccgaguaaugggcucuuucuuauuucccaucugucuaggcaaacccacccugccugcuguccacugugcaguacaucagcagcuucuaugccagcugucugucuggagaggaguccuacugguggaugcaguucacagcagccguggaguuuauuaaaaccaucgaugacagaaagugaccaagaccaggcccaccaagacagcagacuguagccaggaaacagaucucuaggaacauguagcagcuucuuugaaagcugaacauuguuuugucuaaugcucuacagcuuccagacguuuccacauggcucuuccuaagcagauuaacaagcuacacgcagguccucguuccuuucggccuuucugaguugcauauuuuauuuccugaccccaaguagagaguaguacugcaaaagggaccauguuuuucagguguuuuaaauuuuuaaaaaccagaacagaaaucuuuuaggaaacgucuagaucuugguucaugaauucccuguucguccuucucauuuuuagaaagaacagugugccccuuccaaguugcugugugagcguucggucgugaggcaccugcacggagggucucaggagaugcgcaauacgggcucccuagauacacucuccuaaggaagagcuaagaaggaaauguaaaucuaauauauauuuauauuugauguacuaugggcaucuucagacucuaauaaacaacaaggacaguugcugagaguaggcugugacauucccucuugugaaaugguuuccuugacaaaauuuaagcugagcuuaaaagcaaaagcagaaauauuuauuagucuggaguagaguuuaucgcucugcauguguggaguuugauggggaagucaugaaggcguguaccaccauggacauguguugagccugcgcauuggggcagacuccaccauguggacaagcaguacguggcauggcaggugugcucaugcguccuuccuuugcaccugcgcacugaguggaagccaggaagggcuccuuaccgagccucagcuaucaucugucucugaugaugguucacauugaaugcacagaccaggaauucagugaaugucauuuuuuaaaacuaauuuguaucgucugcucuacugauccaggucuuacuaguguuaaacuauuuugaucagccacacuauucuuauggaaaaaaaucuauuuuggcagguuccugugccuuuauugcccucuucugaaaaaaaaaaaaaaaaaagugucucuguaguuugguuugcguuguacaucaguaauuaaucaggaaugggcuuuggugccugagaagcuggccaaggaggcacaccaaagcuucaagcacaagucuuguacauacgccaucaccgagggguuucaccuuguauguuuccuaaaccugucuagcuuuuuugacaaaugcugcaaucccauacuuccgagucccuugugguggcagcaauacaggcaucuucuaagggacccgugacaaccagccaugagcagguggauaacgaccgucugcucccucucuaagaacucggccacaccgugccaaaagaagcugaguuuucuucaugcuuccacgucucccuucccuuucaaaucccaaaauaggaauuuacauaggaaugugagaugugguaccugccuuuuagggagagaucaaaacuaaacuaguaucacaaauauccguucagauguugggucaagaaaucuguguacuuaaugggcugucguuguccaccuugccuugggguuggaagucacaucccuugcugaguacauugcaagccaaacucugacaggguucugcaacuagaagggagucuaacaucuacuucagcacugauucaauaaauguuaagucaacagaaaauuuugaauaguuggaauucauuguuaugagacuuaacuuguaaaucaacgaucucucucucucucucucucucucucucucucucucuguaaugguagcuaaauauauuccauguuaucacuguggaaauaaauaugaagauguggacguugcugcagggcucuuuucuguggaaugaaggucauggaugugagguguagggcuacaguguccaagcaaguggugaggugcagccuggcauugggacaccucuggacgugggguagaugccagcacuguccaggagcaaacuccagcauccaccauugcuuugcauuuaggcauucuuuucccccauauuuauuuuauuuuauuuuaauuuauuuuuuguguauugguauuuugccuauauaccugucugugcagcuaucuaugcaguggccauggaguccagaagagggcauuagauccccuggaacuggaaaacagaaggcugcaaacugucaugugguuaccaggacuccaaucuggguccccuggaauagccagaguucugaaccgacgugcugaacugucacuccagccccacaauggaauucuugugggguugaugucucagcuuaucaaguaucuacuuccuggcaguggcagcaugcaauggggagugacuugacuuguuuguuuuucuggaaaggucuucagauguuucccacuguccuacaugaagguacugcugugugcaagucaccuggggaaauguucagacaccuaaaauuauauagaauuuacaaaauuaaugaauauuaaauggggaggcaguggcucagcucaugaaaguucuauagaauuaaagaaaagaaaaagccauauguuuuuucaguuaauguccuguuucuggauguaauagguuguagaccauguuuccauguauacuuuuuuuaaaaaauuaauuuuauuuucucagugcauugguguuuugccugccuauaugucugugugagggcgucagauccuagggcuggaguuacagacaggugugggcugccaugugggugcugggaauugaacccaggcccuuuggaaggacagcuagugcucuuaacugcugagccaucauuacagccccuaaacuuucuuaaacuagggaacguuuuuuauuugucuguuuuuccuccuccucaccuuaggucaccauaauuaaucaccucuucuguuugcucccuugugaaaauaugccucucagagcucucuggaauagaaggauugcuguugaaagggccuugggcuuucagagcacugaaagcagccaggauaaauggcuccucuuccugugugucuugaacguaguuauuggaacuggauuuuauagaugcacguuccugaagugugugagcaaagucccagaucccgaggcaacagcagggcuguggccugagccaggugccaugucucacugcugacagugggggcuugucugcaguaaguaagcuucauauucauggccuuccucuuggugacuggguauggagagagaagggaggcacaggccagguggaggugaugaaaacagaagucccagcagugugguaucagugggauagccucuucccucugcugcuccugcgguuuccuuaagaaaagucugcaguugccaggcagugguggcgcaugccuuuaaucccagcucgggaggcagaggcagguggauuucugaguuugagggcagccuggucuacagaaacccugucucgaaaacccaaaaaaaaaaaaaaaaaaaaaaaaaaaaaggaaaagucugcaaucaucucaguucuuugaagucuagcaauugauucuguguuugcuaugacugcucugugugugugugugugugugugugugugugaagaaccauuucuuugaagcuagcacauuuucacagugcuagacuguuggaacucugaaugccaaguaccugagagcuaugucucaugccugugagcccagcccauggagccuggagagcagggacugucagccuggaguguggaauaagagccuaucucaagucaauacaaauaaaagugcuugagagcuuugccaaguggguguugguggacccuaggagcagguggcugggaguaacuuuuuacuggggagaacacuuggauaagugaagacacugucugcuguggugggggcggagcuccgcagaggcagguucaggugaggaagguucccaugugagcucugggccagguggcagggccccuugugaccuccuuucugcugagaugacaccugcuguccguuguacccucaaucaaagcuuugugcuggcuuuccuccagcgagccucgccuuauauaagcccggauggugagccugucucccggucccauuacucuggugucagucugugaacccgguuaacagggacaguguucuucgcugcugcguuucuguacucuguauccagaagcacugcugaaaacgugcuucacuuccugaauguuaccaaucuucuccaugaguuuauacuuaggaagucacuauagauacuuguccauauggaagaugacaaauuugaggccagccuggacuauauaacaagacugucucaacaaaacuuuauuuggugcuagaa

SEQ ID NO: 776 - RNA, 2567 nt, Mus musculus
uauauacccuccccacagccccgucguggaggccuccgauuggugaagucgcuacucguuggaggccgcugauugguccaugccaccaagcuggcugcugccgauucgaagcggccuccuccgcaacucacgucauugcuacgccccccgggcugacucauuggcuacuggucauucuuaacggccaccaaugagaggcagcauccgcccugagcgcugguccuauugguucagcagcugccuguccuucgggugaccucucaccccgagaccguuuccgccgguaaccguucagguccuccccucacgccaggcccccggggacuggaguggggucugcgugucaguucccucggggucuccuuuucugucucucacucugaagaaguacgcggccuuucuccuccucgauuccccgcguccugagcugcccggccucagcugugaucgcccuccccagccuccacacguucucggaugucccagaguccaggcccuguuacucgcccggccugcacgucucgagcuggggccugaucuggauucugccucgcugagaauccuggugcuucucagcuaaccguguuucuccuucaccccaaggcuagccguaugugucuuuccaggccuuucgaaucuucccuuugccgggguuaagucccaggauuggccuggccaauuguaaccuauucccuuucuccgccgcggagauucaguacuauggucaaacgagcacuuuccaccaugagauguaucuuuucuucucucucucucucucucucucucucucucucucucucguagcgccuuauuguucgcuaaccuguucuagcauagcauuuccauuuaugacacugguuauuauuuauaaguccuuccucuuucccucuuccuucuugacaccacccuauucgacucuuggaauagggcugauaaugcuaaagacguuuagcagacaaaaaagucuugcugaugcuuuacucuuuuauaauaguauguugggggacaaacaaaacaaguuacuacuugagcuuauuauguacuucauuguuuuguuuuauguauuuugagaggcauuguacacaggcccaagcuggucuauaacuacugauccuccuauguguuuuccaugugucauuuauucauauucaagucuugguacauuuuucccauuuuccagaagagaccauugagaccaagagcgauuaaauagcuagaauggucgauugauaagugcugagaauauaguuaauaacccgguugauuuuacuccauaauuuauacuauugauucccaccaccaccacccuuuuuuguuguuuaaagacaaauuucaugcacccccagucuucaaacuguguagcaaaugacuuugaacuucuguuucuucuaucuauaccucccaagugcugagaacuucaggcauaggcauguacuaccaugggacuugcaucuaugcaugcuacacaacugacaucugucuccaggccuggagcucaacauguccaccaggcuggccuugaacucucagguccaccaucucugcaccccaaguccuuauagacaugcuuaugaaggcuacuugggccauuuauuacaggcaggaaaugacuccaguauuccuauuaaauguauucugagcuucauaaguacacugugcaaauacuacuaaaacaucacacgcacagucacuaaaauguugagccuaugaaucaguguucaggaauuuuuuuccuuucucauuccucaaagauuagugacucagucaacuccauccuugcuauagaaguugcaucacacagcucuuucagucaggcuuguaauacugucauaacauugaucuuccuuuggguugcaucagacuaguauuaagauagaaucacuaagcccaaucuacuggugcacaccuuuagucucagcacguaggaggcagaagcaggggaucucucugaguuagaggccagccugguuaguacaaagacagccaaggcuacauguugagacccuaccucaaaggggggaaaaauggaaaucacuacuugaccacauuacaacuucaugucauuucaagcuugucuguauauauauuacagcagucaguuuacacuaaaaucaaauuucaguuucauccugucucucuuuuuuuuuaaaaaagauuuauuuauuuauuuuauguaaguacacuguaggcugucuucagacaccccagaagagggcaucagaucucauuacagaugguugugagccaccaugugguugcugggauuugaacucaggaccuuuggaagagcaaucagugcucauaacuacuaaaccaucucuccagcccucauucugucucuugauuaauggaggaaaugcuuacaacuaauuuuucuaacauuuagaaacuugaugccuaagcccaaccuagugucacaggccuguagccccaguauucaagagucugaggcaagaggaucacaaauucuauguguaacugaacuacagagugaauucaaggucagccugggaaauuuagugaaaaccuuguucaaaaguaaaauacagcucuauucucaaucucua

SEQ ID NO: 777 - RNA, 25467 nt, Mus musculus
cagaguuccgggaggcccugacuaaguuuggcgcguagucccggagacccggaggcguagagcgguuggccuggacgcgcuuccgggacuggggaagaggacgggcuccuaagcuccgccccauggguggagccacguccaggacaugcgggggcugcggcagguaauaggugcugggcuggaggucucuuaaggcaguaggcuugaacugggugggagggguaguacccauggucuccggccggucaguuuuggggaaagcuggcagccauuucucccugaccccgacuucuuucgcgcggagauguggccggcagaggggacgcaaaggagguggcuaggagaguccccgccacgccggccccucuaagcucugggcugacccuguggucauuagccuagcccgcuugugggccucaucggcccaacucuccuuuaauucccuuucuucauucguuuguccuucacuucuacacucugcagguccauugguaaguuaucggaaugaaucagaaggccggacaugcuaacauuuuggaaucuaguuucgauacuuuucuguuacuuuuauuuugagacaagucucacuguguagcucaagcuggccucugcugccucaagccucucuagugccauguagugcaccaccaugccuggccgauuacagacuuuuaaauagauaguuacauucagggauguaaggguguaguucaauugguagacugccugccuaucgagaacuuagcccuggguuugaucuccagaaggcauaaaaagguauggugguguuugccuguaauuccagcuuuugggagguggcagcaagagaagcagaaguucagggucauccuuggcuacauaaugagugggggcuagccuaagguacauaagaccgugucucuaaaugaguaaugaguuuaaaagaaaagauaauuacguucagaaugacuccuguaauauggugguuaaauggauacagucauauauauuguggucuaaacccaaguccugauuaagccuuccugccgaggguguaugugauguauauugcuaaucccugaggcaggagcaguaacuugagagacuggaaagggguaaucucuuuaaauaaccuuugaaauuuucugggacuugaacccagagcuuugcccaugcuaaacagacacucuaccacagagccaugccaacuccuugaaacuggcuuuaaauauccacuagcagugugaaaauuuacaggaaggaaagauaggggcggcaguaauuaccacagaaugcuuguuaauuuuauuaaauucccacugggugaggcagugcaaguuaugaaagucagaggagcaacagaaagcccaguauugcaggcaaggccccaaaaagccacagagugagauccuguccgaaaauaacagcaaaaagauagagaccagaaaacuugguuucuauggcaugcuagggccaaggugaggcaggguuagcccuagauguccuagaacucacuauguagacuaggcaggcauagaaaucacagagaccacaugcccccaccucugccucaccggugcugggauuaaaggugugcaccacuaugccuggcucucaaaaaaaaaaaguuuaaauccaauuuuuaaguuagccuauaaaacaacaugucucauuaugccguuuucauauguucugauuugcacccgcugcauggcugccuuccuugacacccugugaguucuuuauuuuggaggugguucuuucggguuuuguuuguuguuuuuguuuuugcuuuucaagacacgguuuuccuggauaguccuggcuguccuggaacucacucuguagaccaggcuggccucaaacuucagagauccuccugccucugccuccugggugcugguacuaaaagugugugccacuaccaccuggcuaaccuguuuuaucuuaauaaagaucuuaaggccucugacaguuugauguauguucaucccuuaugagccuuacagacagaaggaaaacauuagcugagaaacuucaaaagcuauguugugucaacagcuggaauguaacucaagauagacacuuaccuagcaugcauaaagcccuggauuaucacugggggccgggggguggggggggggcagcuggauauagugguuacaguacugaggagaauuaggcaggagaguugcccagaguuggaagucagccugggcuacuuguuucugaacaagaaagaauuaucucagaagugugguaacguugauucagauuugucaggccuuugaacuucguacauucaaccucagagauuugggguguuuguuuuguuuuguuguuuuucuuccugguuucaaccuggggccuuucucauccugggcaaaugcucuaccacugagcuccuccacaauccaauaagaaagguuugagaggggugugguuggguuuguugucuugugggaagaugucugaacacucccuuccucucuucugcacagggcaucaugaagcagcugcccaucuuggagccuggagacaagcccaggaaagccacauggucuguaaggaaggauucagaugcauauaagaacuugaguuuuuguuucauguaguuugcuaacacaucugauuaucacugcaaagagguagucaugaaacugugguaaugagacugaaacugucugggaagaucuucagaggaaagauagaggggaaauaauuaucaaagagcagcuguuaauuuuauuaaaaucuguuuaccaggaagaauaaagcacuggccaucuggcauccucagcuccaucccucagguccuccucuaagcugagacuuuagggaauuuggauuauuuggcuuuuguuaaacccuucauucagcaacucauagcgacuaacagugaugagacuguaaaagcuccgaagcccuaaggcaaauggucccuauguauugaagcuagaggcagagcaagugauggagugugaccugcacugaggggaucccagaaggguggacaaggucccacugacuccaacugagccuccaugcccacuucccacaauuaccuugcuccagagccaucacacgugcucuggagacaugcuccgggguaaaacccaauagagaacuggcaauguagcuugguuauagagcucugcuuaguaugaauaguuccaucccucucccugaacaauacgacaaagcaggaaccuuaaacgaggcccugcauauccuguauguaccuguccauccaacuucagaugucuuuauuuauuuauuuugcuguuugauuuguuguugagacagauucucauguagcccagguuggcuccgaauuuugagcaauccucguuuccuagccucccaagugcugggaucacaggcauggccaccaagauuagcuuuguuuuguuuugagacggacuaucaaguauucagguggauugcugagaauccaaggcuagccuggaugauggaguaagaugcucuccagaaaacaauaaagacagaaagaacuuuuauguuaaaacuuuucuuugacugugaaaacaaagaagggguauucaugaacacaaauccacaugcaggacagauccggacaagaaugagagauccuguaaucacugauagggauggagauggguguccauagaaaccaccaggacagaugaaucagaaaagcaaaaaggcagagggaaagggauuccuaggauacugacaguucugagggggcuggugggagacacgucagagaggaaaggaaacagcugucagagggaaguacacacccggaggaagaggugcggagaaucuagguucuggaaaaggugaaggaaagugggacguucaggagcaccaacaucagagaggucaagcaagacaggagcuggagucaggauauauccauguucacugugugcccuggcccacaccuauagccccacacuugggagauaggggcaggacuaucagggauuuaaggucauccugggcuaccuggaaaucuaaggccacccuagacuguaagagacacugucagaaacuaauuuuuuguuucuuuccaaucagaaaguuuggaauacuuccccccccccccccccacuaaccaucaaaauaaauguagcggugaauguucuggcccuguacuguagucugaauccuagacguaaguuccuagauuugauggaggauccaagccugggaagucuuuuaguggauuuuuuacaauuaugaggcuuaauccguguauucuggagggagacaucguuggcuguuggccagggugucccugugaauucgauagugcccuaucuauccccgcacccucccaggcucugucugagucaucacaccccccuuugaaggugagaacuauaguaacccuggcuuuagaguagagaaaacugagguucgaauaggugaggugacuacccuaaugccucccaucuagaaagcacugaagcccacacuugaacacaggcacuugcucacauaugauaguaauuauauccuaaagcgugaguaugugugccaggccuuucauccuuugugaggaauggaagaacauucucgcacggccuccugagcaugccuucccuuuggcagguacacuuugacuugcccuggagacaggcccugcccucgaguuggccacagcugcucauauuuccccccaguuggugaugccgagagcgggaagaucuucauugucgggggagcaaauccaaaccaaaguuucucagauguacacaccauggacuuggguaagaucagugcuguagagcauuccuaagaacaccagcccuacuggguaucgugguacaguucuugugaauucuugcaugauagccccugggaguuugaagcuagccuggucuauauaacaaguuccaggccaggaaaacauagacccugaacaacaacaacaauaguaaugacucugaaccauaauaacaauaagaacaacaacagcaauaaaaugucuuaguuuggguuuuauagcugugaccaaggcaacucuucuaaaggaugacauuuaauuggggcuggcuuacagcuucaguguuucaguccauuaucaaggcaggaagcacagcagcauccaggcaggcauggcacuagaggagcugagaauucuacaucuucauccaagggaagucaggagcagacuuguccucaggcagcuaggaggagggucucaaagccuagccccacagugacacaccuccuccaccaaggccacaccuccuccaccaaggccacaccuccucuaccaaggccacaccuccuaauaaugccacucccugggccaagcauauuuaaacuaccacaaauaauaauaccgacucagaccagacaacagaguuuuccucuuaaagagaagaauauauuugucccuccgaucucagcugaccuuuagcauccuuguuuggagaagagucugugucuuaggguucccauugcugugaaaagacacaauuaccauggaaacucuuauaaaggcaaccauuucauuggggcuggcuuaccauuucagagguuuagucuguuaucaucaugacaggaagcauggcagcauccaaguagacaugaugcuggaggagcugagaguuccacaucuugauccaaaggcagccaggaggggacuccuuccacauugaguggagcuugagcacuagacacccucaaagcccaccuauacagcgacacacuuccuccgaguccacacugccuaguaguaccacuucccaugggccaagcguauucaaaccaccacagucuguauugagcccuggcaaucccgaaauugguuauguauuaacaguuaggaggcaucauuucuccugcccucauucuaaugaauguccuggcuuugacugucucccacuguguuugucccuuuccguucccaccacaggucccaccacugcugucuuuucacuagcccuggaaucauucucccucuggucugcuugccuccaugucagcucacugcacagugcaugucccauacccaugcagaaaguguugcucuuugguuuggacaagggugguuuuuuuuguuuugaagcagucucauggggcuggggcuggacuugaacucacugugaggcugacagcaugaccuugaacuucugauucucuugccuuuaccuuucaaguauguaucugagccccuucaccuggucuauaugauggugcugaccagacccugccuuugugugugugaggccagugcuccaccagcugaacugcauccaugucccccaagccaucgcucaugcuguucccuuugcaugaggagguccucuccuuccuugucaucucucuguggucccugacucagugccccuucugucuggaagcuagcacuccagcucuagacugguuuggauaccauauuccuccauauccauagagucauauacucucccauuuccuccuuccaagaucuuagugcaucugauuauuuccuguaugucccacaagagcuuaagagccuuggagaaagagugagacuguuuuacucauaauuguauccccagccacugcuagagcauauauccagggcaggcacuuuauguuuagaugaaugaaugaaugaaugaaugaaugaaugaaugaacaaaggagcaaagcuaugaauaaacuauuaugaugaugugcuauaugcugcuguacaaaaggcagaaguugaaaauuggugaccacgugaaaguguggccauauaacauuucuguuauacuauauguauguaaauauacuuauaaauauauaggaauguuuauauguuaauaaauuauauauauguauauauauguauauauauauauauguauauauauaaguuuuugagacaggguguuucucuauagcccuggauguccuggaacuugauauguagaucagaguggacuuaaacucauagagaugcacuugccucugccucccaguauuaggagcugggauuaaagaugcaugcagggcuggugagauggcucaguggguaagagcacccaauugcucuuccgaaggucaggaguucaaaucccagcaaucacaugguggcucacaaucauccguaaugagaucugacucccucuucuggagugucugagaacagcuacaguguacuuacauauaaauaaaucuuaaaaaaaaaaaaaaaaagaugcaugccaacauccccuguccagguauuauuaauuucuucauuacaucuauuauuuuguacaugugcauaguacacauggagauuagaggacaaagcuggcaauuuuuaaaagauuugguuuuaggguuuuuuguuuguuuuugucuuuauuuuuguuuuuugagccaaaguuucucucuauagccucagcuguccuggaacuugcucugagaaccaggcuggccuuggacucagagauccaccugccucuacuuuuuuuuuuuuuaaauuuauuuauugauuauauguaaguacacuguagcugucuucagacacuccagaagagggcaucagauuuaauuagggaugguugugagccaccaugugguugcugggauuugaacucuggaccuucggaagagcaaucgggugcucuuacccacugagccaucucaccagccccugccucuacuucuagacugcugguguuaaaggugugcaucaccaccuggcaagauuuguuuuacucuuuuuauuuauuuauuaaauuagagaugauuggucuaaagaauuaguauaagaaauaucuuuuauguguauuaguguugaucuccaugucugcaugugcacuggggagggaguugaauccuuuggaacuggaguuauagagagcugugugccaccauggugccaggaccugagccuggguauuguagugcugagcugucacuccagcccauuauuguuuaaugucuguggaguaugugcaugugagugcccgggguuguggaggggcagaagcauuccauccccuagaucuggaguuccauacaugcugggaauuucugcaagguucgaaagugcccuuaacagagccccucuccugcccugguuauguccauuuuuauaugcacacuuggucuguaaauaauucaaguuugaaacaacagaaaugaggcuggagagaugguucaguggguaaagguuucugcucccaacgcuaaucucaguuuguuuccuaagacccacuugguggaaaggaagaaacuaacucucaaaguuguucucuaaccuccacacaggagcugugacacaaauguacacacaaauacacacaaacacacagaaacacgcacacacagaauaaauagaauguaauuagaacauuuuuaauugccguaguugggcuucucaugauaauuuucagagcaucaauacucuugcauagguacaucacaaucauuuagaccuggggugucaccucucgcugaggcucccagccacaguuaccacagacucuuguuuauacuguccagauacuugaaacucuacucccagcaugaggcaaaaaaagaugccuugacucuuuuagauaccaaggagcuucccuuccagcucaguuaugucacgucugucugucaguccauccuagccuccaguucucuauguagcccagacuggcuucauacucacaguccuucugccuccacuuuccauguuuugggauccuggacuugugccaccaugccagcagcuaucaagugccauagugaccuuagcaaggccaucugaaccccaguagccuauuaaauagagguacuaaccagcuucauuuacaguuuugauuagcuaacagugugaugccuguaagguccuacauucgugacuugcuaacuaaaaggaugagcuaguuuuggcauuguuacucuauuugcccagagauuuguuaaggaggggguggggggaggaagggagggagggagauuucauagaauccaggaguguucugcagaaucuaaaaacaaaaagucguagcccacacugaugagaguggaaacuagauccaaguggcccgugucagccaagucccauuaguuacaaguagaaaguuagugucagacauaugucacuggacucugaacggggaagaagagacaguuuccaugaaagagguacauggaccagguagacagccugcaggcgugcacuagagaccacaucagaguuugauccugcucccuuugugguugguugcuuaugauuuugccucuuuccacugcccugguaauccaaccagaauuaccagcugacagcccuaaucuaaggaucgcauaaauguuuucuaggaacacaccagugggacacggccaccagggagggccucuugccucgguacgagcaugccagcuuccuucccuccugcucuccucacagcaucuggguguuuggaggugcagaccagucaggaaaucgaaacugucugcaagucaugaguccuggugaguagacacagguuacuuucuuuuuaucgcugugauggguugaaugcgcuugguucaggaaguggcaguaugaggaggcguggccuuguuagaguagguagggccuuguuggaggaaguaugucacuguggguaugggcuuuaagacccucuuccuagcugccugguagcagccuucagauaaagauguagagcucucagcuccaccuguaccaugucucccuagaugcuaccaugcuccuucuuugaugauaauggacugaaccucugaaccuguaagccagccuuaauuaaauauuguccuucuaagaggcauagugucuguucacagcaauaaaacccuaacuaagacaaucgcacacuaugaaugcaguuacguuacaguacauugaauugcuguugcccuaacuaaccuauuuuacuuugcugaccucuuagaaauaggaauuuauggauuuuuuuauuuguguggcugugugugcaugagagagagaucguaugcagucugugguguccacguggaagccagaggaugacuguggaaaucaguucucccuuuuuaccaugugggguccagggaucaaacucuccaggguagcucugguuucauaaccugcucucuggcgauggaauuauaggaguguuucaugucugacgggacugaauugucuuucgugucgaguaugaaauuucuuuguaguguuugaaaaguaucuacuuggggcuggugagauggcucaguggguaagagcacccgacugcucuuccgaagguccaaaguucaaaucccagcaaccacaugguggcucacaaccacccguaaugagaucugaugcccucuucuggagugucugaagacagcuacaguguacuuacauauaauaaauaaauaaaucuuuaaaaaaaaaaaaaaaaaaagaaaaguaucuacuuagacggccauugaagugguuugaguguuuguaacccaccaugcccuuccucuguggaaugcaaaugcuuuuaaaaaacauauuauuuuauuuuauuuuauguauaugaauacuuugccugcauguaugucugugucccagguguaucaguguccaaggaugucagaagagggaaucagauccccccagaacuggaggugcuaggaaccaaaggcuguagaagagcaguguucucauucucucucucucucucucucucucucucucucucucucucucucucucucucucucccccccccaucccuagcugucauagauuagagcucacucuguagacuaggcuggccucgaacucacagaaacccaccugccucuaccucccucugugcugggauuaaaagcauauaccaccacuacucucuuuucuuuuguuuguugucugucugucuguuuuugagucugagucucacuauguagcccugacuggcuggccuagaauucuuuauguagaucaguguggucucaaacucucagugauccuccugccucugcuccugagggcugaaauccaaagugaaaggcaagcaucgccacuguggugauguaagugcuuugaggucuuguucuuuguucauagaguccagagcacagucagguaugaaguagacagugccuugaccuccucgccuaugcuggagccauuugucuggaaccauccuagaguaugaucaucacgcuggggcugguaguacaggccugauaccccuguuacuugggaggcugagggggagggaccacaacuucaaggucauucugggcuagcaugugaugauugacagcuggaaucaggccagaagagugcuugccuggggggcaggagucucuuaguuugguucccagaacuuggggcagaaauaguucacgagucugugcuuugccguacacuauccgugagcuugagccaagccccucaauuccuuccuuucucuuuucugccacaugggauaucaguccuucccuugugaccuuguuaaagauuucuuuucuuuuuuuaauauuauuuauuuaauguauauaaguacacugucuucauacacaccagaagaaggcaucagaucccauuacagaugguugugagccaccaugugguugcugggaauugaacucaguaccucuggaagagccaucucucuagccccuguuaaggauuucgauuaggagcuaacacucgcucucugguauugacccagacagaauuugggaaguggaaaucaguucaggaaguccaucuuuaagaagguggcauggagggugugggaauguugggagaccugggaaaggguuccuggaauguugggagaccuggggaaggguuccucacucuaccgcccagggcuagccuggaaccaagauuucccugucuuggcuuccuaaaugcugaguucaccagggugugcugggacccuguccuuucgguucugggggaugacauuuauuuaaaaacagaacuaaacagaaaucuacaguggugcaugccuauaaucccaauauucugaaggcagaggcaggcagaucucuaugaguuugaggccagccuggccaggcggggcuauguaaugaaacucugucucaauaccauacaacagaaacagacugguggaaccugggaaagccgcugucggggaagcugauugucugcacuguucauuugucuuguuucacugacagagucucacuagagagucaaggcucucagucucccugucucauucuacacuuacaaguuugagccaccagacccuguuugacuuuccguuccugggcuccaagcccugcccgauaucugcagcucuagagacauuuccuuuugcuuugauguagugcaaggcccauucugcacuuguguuccuguuuggcucccacaugcauugcaugagccuuggguagcauuuuguguguugaaugaagagucuuuacaaaaggcacaguauuucuagauaggaaauaauagucgauuuggugggacucugacagaucuggcuucaaaccucaccucuucucuccagaaggccuguuaaaaugucugaccuuccacacaucucucaggggugagugggaaccauggagggacagagcuuaaguuuuauuuuaaaaagaaagaaacuucuuuacgcccgucauguggugagcuuuugauuucaagacagacugguagaacauacacagaccaugguguuauuauaacuguucaaaccugggcuggagaacugcucugacagaggacccagguuugauuuccagugcccacauagaggcucacagcuggcauaacuccauuccagggaccuaccacgcucuucuggccucugugaacaacaggcauacacaugguggcacauacauagaugcaggcaagacacucacauaagauaaaauaaauuuguuuuuaaauguguuuaaaagcuggagagauggcucagcaguuacaaguacuagcugcucuuccagaggaccuggguucaauucucagcaccuacauagcagaucauagcugucuuuaacucuaguuccaggggaucugauacccucacagagacacacaugcaggcagaacaccaaugcacauacaaaaucaaaaugaauuuuuaaaauguauuuaaaguccaacagccauuugcuagccgacuguuaaggaaguaacagucuagcucggcuucagcuccaaugugagaagggagagacuggcauuuauuucucauuucucauucaguugguuaucaguaguaccucuaaaagugcagugagguugcugcuaucuuucuuauuuuauuuuauuuuauuuuauuuuauuuuagugguuuauauauauaaguucuuuauuuguaccugcacagcagaaaagagcaucaaaucccauuacaggugguuguaagacuccaucuauaaugugguugcugagaauugaacccagaaucucuggaagaggagccagugcucuuaacuacugagccaucucuccagccucaucuacucucuuucaauggccacauuuucuaggaaguuuggcccguuuggacucuagcauccagugggaguggauguuagcaggcguuggacuccugcaagcacagagccgucagcacaguggauccgcacucagacacgcuccugaccucacuccuaacucaaccuguggcuucuuaacuuugggaauuucaccugucugaacaaccucuaauaucaucuugguuuuuuuuuuuuuuuaaugguuuuaaagcauuuauuguagaaaggcagaaagaaggagaagaguagagaaguagaggccggccaugaccauguggagagaggggagaaggaaauguggagagagagggggacaagggagcaagaguaagagccagggaauaagagcucuaauaucauccugugcuugcucggcacuggagaguaugagaucccugccuaaugcugugcugugcucugcugugcuguguugugcuaagcugugugugcugagcugugcugcgcugugcucugcucugcucuacugcacugugugugcugugcucugcuguguacugcacuguguugugcugagcugcgcucugugugcugcaccgugugcugugcugugcugucuuauacuguuuuguguuccucagagacucagguacaaaggagacccugucaagguccaggucugcagaaguggaucaguaggagacugcaagccuagcaggcccgggguacagauccccagcaccucagaaaacaaagaguaaggacagagccuuaagccuaggucuuuuaaaugcuuauuuucucucuggacuagaagacaggacguggagcacaccagaagugacuggcuccccuccauccccaagaacauuccacacaucguccgcagcuaucggaaaccaacuauacgucuuugggggaggagagagaggugcccagccuguggaggacgugaaguugcauguauuugacgcaaguaugggcuggggacauagggaucuuggggcugcuuuccuggccagggccaccucagcuucacuuaucucucaaacaggagacagggacuugagaaaagauuuuacacuaaguagaguccuugucuagcaugcaccaaacccuguacacauuuagucccuagcaccacacagaccaagcgcaauggcagaugagugucuauaaucccagcagucgagagacuaggccuagccuacgagacaugaaaccugccucaaaaaaagagucaagcuugguguauuggcacaugucuuuaaucccagcccuaugcgguggaagcaggcggaucucuucgaauuugaggucagccuggucuucauaguucuaggcuagccacagcuauauaaugagacccugucucaaaagacaaugacaaaaagguggugacucucgguuggguguggcucaaagguaaagcauguacucagugugugcagugcagugcaguguaugcagugcccuggguucgauuuccuguaccucucaaaagcaaacaacaacaaaagaaaaaaaaaagaagagcucugaagguuucucacagaagaagcaugcgcacuuauuuuaacuuugagguaguucuuauucgaagcuuuucucaauccaaagcaagagauggcuuccuacuagccagacuguaagccagcaugcgggguuauuggcuuugcagcuuacagcccugcgaguauccaaguagagguuacguagugggauugaggucuccugcugguaagcuggggagaaggacucugaggugacuuccuucuuggagcgcccugcccugggaggugcuugcagagacagguuaccuaguguuaaugccuuuaccuuuguagacacucugacauggucucaaccggagacacauggaaguccuccgucuccucggcauggccaugugaugguggcagcgggcacaaaacucuucauccacggaggauuggcaggggacaaguucuuugaugaucuccauugcauugauauagguaagccuguaagagggccaggggccuuauauauucagaacucuuuacgaugugcuuugaaagaauuccacuuuccucuuauguguugguaacuugacuggcuguuagaagcuuuccuagaugucaugaagcuuggccugaauauugaagaauaaaguagcucagccacgaagcucauuggcuggacuuuccagggcaccuagguuggauucccaacacccacaugacagcaccagcacuuccagauucuguugcccucuucugcccucuacaggcagcaugugguggugcauaaacucugggcaggcaaaauacugcacacuaaauaaguacagcacuuguguagguagguagcguagguaaguaaguaaguaaguagacaggcagguaggcaggcagauagacagacagacagacuaacugacuugaagaagaagagaggaggagggaagaguaucaucaacaacuggggcugaagaaaugggucaacacuuaaaagcucuuccugcucuugcagaguauucaaguucaguccccagcacccacacuaagcucagagaagcuucagggaacccagaagcucuggucacagcugacacaagaacauacacacacgcauagacacacauacauucacauagguaaaauaagacauuucuagagauuaaaaucuaugguguggauggucuuccugcauguauguguaccacaaguauguaguaccugaggaggccaggagagggcccuggauucucuggaaccagaguugcaggaaguugugagcugccauaugagugcugggaacuggaccuagaacuucuagaggagcugagcgccaucucuguagacccaaacacaucuuuuuaaaauugcuuuucucagacagagucauacuggccuagagcuugcuguguagaccaagcuguucuugaacucacagagaucagugccucagccucuugagugcuggaacuaagggugugcgccaccacauccaacucuauuuuuaaaugcagucguuccccaagacucaguauguguucaggcacugauccuuuccaccaucaguuccuacacguuguguucccagcuagaaaccugugaggccuugguucuuacuccaugucuggucuagauaacaaaguuggaugaccggaacugcauguuugcagggcuucauggccaaaagcccaggaaaaagaaagccagaaagaaccugaagauuaucucucccucagaagggcugggcucucggcugagccuuucugacuguuagcuccauugagggcgggacuucgucuuuccuuuaucuguacauuuccagcacgaaugccgucagccagagagugaguaagugcuuaucugcucaagagcggguggauggauacaugagccaagccuaguuugcuccagacuacagagaagagggaugagaggccggaggcacaagaacaccuaugcagaguauucgaguucucacuagguccucagaggcagcucgcuagcugggauuucuucauuggcugcaggguuuucccucccucccucccucccuuccuucauuuauuuccaaggcaguguaucucuuuguaccuuggcuguccuggaacuugcuuuuuguauaccaaauugguuuugaauucauagugauccaccugccucugccuccuagugcugggauuaacaggcccagcuuuuuuuuuguuuugcauuuaagacagugucuagcugagcaguggcggcgcacacuuuuaaucccaacacuugggaggcagaagcagauggaucucugaguucgaggccagccugguguacggagugaguuccaggacagccaggaauacacagaggaacccugacuagaaaaaaacaaaaaacaaaaaaacaaaaacaaaaaaagacagugucuagcuguguagcccaaccucacaaucaguccuccuucagacuaucgaguucagggacuagagacguguuuucucaugcaauuucaaauaggauaggauuuguucuuguuuuuuuuuuuuuuuuaagauuuauuuauguauaugaguacacuguagcuguacagaugguugugagccuucaugugguuguugggaauugaauuuaggaccucugcucgcuccagucagcccuacuuucucagucccugacucgcuccagcccaaagauuuauuuauuauaagcaaguacacuguagcugucuucagaagcaccagaagagggcaucagaucucauuacaggugguuaugagccaccaugugguugcugggauuugaacucaggacguucagaagagcagucagugcucuuacccgcugagccaucuccccagcccguucuugaugucuucuauguagcccuggcuguccuggaauucacuauguaaaccaaacaggccugaaacucacagagauccaucugccucugugacugagugcugugauuaaagguguacaccaucacgcuuggcugauaauuguuuaagacuccauuuuucugugcugaagaauaccuccuagcuauugcuuuauuccuucucaaauagucuucuaaucuaaaguccagaguuauguauuaccucauuuaagugcuccuuugaacagaugcaaaaauaguguugggagcaucaggcagaucucuguaaguucaaggccaacuuggucuacagaacaaguucuaggacagccagggcuacacagagaaaccacgucuugaaaaaccaaaaaacuaaaauaagacaguguugaggaugagcacugaaucaacaaguugcauuguagaggacacaggccuggcagccuuaggaugcccagcucagccccuuaccagcuacuccagcaaggcccauccuucaaucauccugugugcucauccauaagagaaggcuguagacacaugugauagcaauucagagggcugagcaagacucugcaagugucuaacuugcacucacacaguugcuguuggagaaacuggagagaugggucggcaccuucccaaggaccuggguuugacuccuaguacccacguggcagcucacagccauuguaauuuuaguccaguggaaugaaguaccuccuucuggccuccauaggcaccaugcaugaauguggcgcacagacaaacacauaugcauaaaauaaaagugaaucugcauaaaauaaaagugaaucuaucuuuucuuucuaucuuccuuucguuuucuuuucuuuuucuuuuuuuuuuuuuuuuuuuugguuguuguuuuguuuuguuuuacaagaaaggguuucucugugcagcacuuaggaggcagaggcaggcggauuucugaguucgaggccagccuggucuacaaagugaguuccaggacagccagggcuacacagagaaacccugucucgaagcucccccccccccaaaaaaaaaaaguuuucacauuucucaguaugcuccaaagagcauuagaaucccacaagaugcuuuuugaaacuauaggucccuugcugcagauuagagaauaauucaagccacccucccuuaaaaccaguucugcauauugaaccucucuccguuaccucuuaagagauuccugugacccagguaugguguugagcagcuuuaauccccaaguucagcuuaagaccagccugcuuuacuaaggguauuccagaucagaacuacaucaucguaucucaacacacacacacacacacacucccugaggaugacugucaucaaucacuuugcaaacugcagcagauaauuugaauuccuauuuuagcucaugugcaaaacucucucuugugacaggugacaugagcuggcagaagcuuggucccaccggggcuguuccagucggcugugcugcccaugccgccguugcugugggacaccauguauauauguuuggagguaugacagccacuggagcacugaacaugauguacaaguaucacacaggugagugagggagucacuccugcucacuuuucuuucuuuuaaaaaaacacugugcccucuccuuuccuuucaaaaaaaaaaaaauuuuuuuuuugagacaggguuucucuguguagcccuggcuguccuggaacucacucuguagaccaggcuggccucaaagaaauccgccugucucugccucccaagugcuggaauuaaaggcaugugccaccacugccccguguuuuuuuuuuguuguuguuguuguuguuuaaauuuuuuuauuuaagauuuauuuauauguaugugaauacacugucacugucugcgagcauaucagaagagggcaucagaucccauuacagaugguugugagccaccauguaguagcugggaauugaacucagguccucuggaagaacagucaguacuuuuaaccacugagccaucucuccagcccuaacuccuggucuuuaaaacaaacaucuuuugguaagugaugcaggcauuuucuaguuuggugccuucaugucuaaaucgaaaggaggggguugggaaaguggcugagcugguaacagugcaugcugugcaaacguggggacuagaguuagaaucccagcauccguauaaaagcuaggcauggucaugugcgccuauaaccccagcacuguggagcagacaggccgauugccagggcgcauuggcuggccagcccaccugaaauugcagcuucuggcucagugagagauccuuccucaaaggaaaauaggacagauauggacagaggaagacauuugugguccuacucuacucuaccaaaacacacacacacacacacaguguacguacguauuuaaaaaaacaaaaacaacaaaaacacaaaaucccacagaaaaacagggucugacaaaggcaggcauccuccugccugugaguccugagugcugggauuacaggcauacacugucagacccaaccuguuuuucccuuuauuuccucuuuguggcuuaagugauguagaacaucacugaauaccuguggaacuaugucuuaacaggagccuuuguuuugucccccuuacucagaaaagcagcacuggacuguacuucaguuugacacuucccuacccgcuggacgacuggaccacuccaugugugucaucccauggccagugaugucuaccucugagaauaaagacucagauucugucauucuaacccuccaagaugagaaaggggacgcugcugagaaagcagagacccagaguggaggaccacacgaggagaguccaacuacuguguugcucugcuuuguguucggugggaugaacacagaaggggagguuuaugacgacugucucguaacuguaguggacuaauaaagcccacauuuguauuacuugugacuuuuuacaaaagugaaaacucugccgagcuacacugccaaauacuuuuugcacaauauauucucucaucccagugcgguggugcacaccaggcauaguagcacacaccuuuaaucccagcacuugggaggcagaggccagccuggucuacguggugaguuccaggacagccagagcuacauagugaaacccugucuugaaaaaccagacauaaaaagcauauccaucuugcacuuaaucaacauuuuuaacuggauagccuagugcaaauaauuccauuauaaaguuuuaccagcaauaaaaucuguagauacccaagcuagguauuggaguagacaauuacgaguuagacacucuuuaauauguauuagcgaaucacuagaaaaaaguacaggcaggaggcuagaaagauagcaguuacaagagcagugugggagauccuuauuugguucauaaucacaaugacuggguguucacagaauauguaccuccccuaaaccuuguucaggugugggcauauuacccaucuggaaaaaaaaaaaguaaaaaaagaaaaagaaaagcugggugugguggugcaugccuauguaguaggacccugcugguaaugggggacaaaggaugaggacuggcucuuguuauuaaccaucccuggacccagcaugaaguuguacaaaucaauuuuaacauuucacuuggccccaaauacuuguguuugauagaaaaaucugacagcauaggcuggccucaaauuuaucauccuccugccucggugucccagugugcuaggauuacagacauguacuauaucaugcuccucucuccccuuuuaggaaguaugaaugggaguaagacagaugauguagaaagaaucucaagguguaacugugaacuugcuauaauccugccucagucagccuccugagugaagaaauaaguagcaugagcuaccaagcccaagcuggguucaaaguguaucagguaguguacaaaaaugaaucucaagagugagacggggacuggagagauggcagugcucuuccagagguccugaauucaauucccaucaaccacaugguggcucacaaccaucuguaauggaauccaauacccacaguggacucaaauaaauaaaaucuuuaaaaaaaaaaaaaaagugagacggggugggggugaggcuggcaaaguggcccaguggguaagagcaccagcgcucuuccgaaggucuugaguucaauucccauaccacauuagcccuggacaaaaaucuucacugaucaagacuuacucucaaaaauaaacaagucaauuuuaaaaaguaugcuuccauuauuugguucuaacagaagaugguuuuuauacaucuuuaugaucagcaaaucauucuuaaccuugaguccuugaccauauuuggccuuagacaucuaaaucugaguaguaaguagagcacucuacugaccaacugagccaagucaaguguccagucuacaagaucaugauaaaccccagggauuuuugccuacagcuggggaagacaggccucagaagaucuuaaagccaccaagcuggcuucuugaucuugggaaaaugauaaccacaguauaaacauauugccuuaucuccuuccaaauguacuauuaauaaagaguugcaauguagucacacacaagaaaagucuucauugaucauauagauuaccuagaucauuacucuccugauguugccagucuaaacaauccucucaaccaauccuuugaccaucaacugacguuuguaauaucaggguugccauauacccuaucccuauaccaguaagacauuuuagaaaaagggguucugaccaauuaggcuucagagcauguuuugguucauguagcucucaugaacuacauaacugaaucuaguauuuaauuaauccugccuccagccugagucacuacauccaguauguggugcugaguaucaaauaaauccagggcuucauacaugcuggauaaguaaauccucaagcuguuaaauaacuuucaaccaaacgucuucaaauauaaauuacaaaccaaauacuacccagugauauggacucuuuaaguauaucacaggccuguggguacacacaaaauauaaaauacaaguauauuuaaauuuuuuuccaguccagaggauuaacaacacuagggcuucacacuagugcuaggcaacgcucaccacugagcaugcaccagccucagaucccuagauugggcuuggacuaaacacagccuggaacaugaucaauuuauuaagagauuccaggcaguaccacagcacuacuuguaacaaaagucagaaagggccauggugguauacacuuuaaucccaguaccugggaucgagagacagguggaucugaguucaaggccagccuggucuacaguguugaguucgaggacagacaaagcuaaagaccuuaucuugaaaaaacuaaaagcccagaaagcaauuuuacaaaggggaaguaugauuucaaccauguucaaaagaauuggacuuaggcauccugaaauaacccucgccuaggggaguaaacagcaaacaucucuacauuguuauaaagcuaaauaaaucuccaagaagugguaccaccccacagcaucacaagccccacuucccugcccaccgaagaaagacacaccugagaauccagucuuaaauuuuaguuaucuaaaauaaaagauggauauaauuacaaacuuuucacaaaaauuagaccaguguaaauaacaaacauuuauuggugucacuuaugguagaaaaaaguuccuacaccacaugugcaugacccaauuguuaaauagaccauauccaaggugaacacacacccugacccaccuuuuucucaauuuuuaaaauagccaauuccuccucucccugaccccaagacaugugagcaacugcuaaugaaaagcaguaaacagccacuugggcuauagcauuuucaacuccacucugaggugaagauuccaauuacauucgagacuuaaguucucucaauuuucucccaacgaaaguuccugaguccaguauuuacaauauuacagcucuagcagaucagugcaccuacaacucaucuuuuucugauguauccucuucaccaguugggggagggccuccacuuccauagaguuugcugauaauuggcugaacaauuucuucuaguuccuucuuuuuggcuuuaaagucuucaauguccgcauccugguggcuuuccagccauucaaucuuuuccucuacagcuuuuuccaugguuucuuuaucuucagaagaaaguuuaccucccagcuuuucuuuaucuccaaucugguucuugagagaauaagcauagcuuuccaauucauuccuggugucaaugcgcucuuugagcuuuuugucuuccucagcaaacuucucagcaucauuaaccauccuuucaauuucuucaggugucaggcgguuuuggucauugguaauugugauuuuguuuuuguuuccuguaccuuugucuucagcugucacucggagaauaccauuaacaucuaucucaaaagugacuucaaucuggggaacuccacggggagcaggaggaauuccagucagaucaaauguacccagaagaugauugucuuuuguuaggggucguucaccuagaguaagaacacagaaaaaacuauugacaaagccagggcacugggaucccuacauuaacucacugggugcuacugcucuuaauuucaacucuucaaagcauuguaagccccucugaccuuguauuacaaaagcuaguuaacaugaaaaaaauucaacacugguucaacuaagaaccucuucauuugaguuacaaaacauacuucuuucccugggaggauaauaguuuaacuuauuuaauaauauuguuuaauaauauugugaaacccagaucacauccuuucaaaacauacaauauuugugaacguuuaauuaccuucauagaccuugauuguuacaguuggcugauuaucggaagccguggagaagaucugagacuucuugguggguaccacaguguuccuuggaaucaguuuugucaugacuccucccacaguuucaauaccaaguguaaggggacaaacaucaagcaguaccagaucaccugcaaaggaaaauuaaucagguuugguuuucuuuagaguccugagagcacuaccaagcaaucucccaaugaaugaacucuugccaucuuccccacugucaucugccuaggcuaaccacacacacuuuaggaaaaaugaauuaacaguugcuaccgaucuuaacuaagccugaccuaagucuucucaucacuguaccuuucuucccuguuacucuuaacccuacaguuuccuaaagcaacaguccucccaucgagcuacuuaaacagauaaagacacagugauaacaaccuaccuguauccugaucaccagagaggacaccagccuggacagcggcaccauaggcuacagccucaucgggguuuaugccacgggauggcuccuugccauugaagaacucuuucaccaguugcugaaucuuuggaauucgaguagauccaccaaccagaacaauuucaucaauaucagauuucuucagaucagagucuuccaacacuuucuggacaggcuucaugguagagcggaacagguccuagcaaaaaagaaaagcaaggcaugguuacuauggugcugaccacccagaccuuauuuaguuaucccaaauucuacagucuaagcgg

SEQ ID NO: 778 - RNA, 1105 nt, Mus musculus
uaggugacgcucugccgacuucggacucaccagugguguuucauucucuuuaacgucauacuguuucacgcauugcuuuuuggagcugacuuuguagaagaauauuucuuacauucuuugccucauguagauaugaaaauucucgacauuaaggacaaggcaagaaaauugaaccuggaaccuuuaagagguaaucccuccaaguauuauauccuaaaccagccggaggucuguaaugggaaaaccaucuuucugcucucucuuaucuucaguagcccagggaauggaacaagacgggaccucaucaggaaagccugggguagugugaccacuguccaaggcuacccaauucucacgcuguuugcucugggaaugccagcauugguaacuacucaagaagagauagaugcggagucucagaagaauaaugauaucauugaagggaucuucuuggacaguucugaaaaccaaacacugaagaucaucucaaugacccagugggcuguggccuucugccccagugcccuguucauacucaaagcugacgagauguuuaucaaucuaccaggcuugguagacuaucuucucaaucugaaaggucaccuggaagguaucuauuuaggaagaguuauucaucaggauauaccuaacagagacccccauagucaagaauuugucucucuuagugaguaccccgaaaaauacuacccagacuacugcaguggugaggccuuuauacugucccaagauguggcucggaugguguacgugguuuugaaugaagcaccuguuauggugcccgccgauguauuuguagggaucugugcuaaguccgugggccuuauaccuauccacaguucaagguuuucuggggaaagacacaucacauauaacagaugcugcuacaaguucauuuuuacaucugcagaaguuacagaugcugaaacuucccuggcauggaaagaagugagugaugggaaggaguguucccuguuugagacuuauuacgggcucauuuccugcaagcuucugacauaccuugacagcuucaagcauuuucacacggggagcgcaaaagacaaugcuguguauuuugggaauuagu

SEQ ID NO: 779 - RNA, 23842 nt, Mus musculus
cuacauucgcuuuuucggacacuucagagaugagauagcagccugcugaaaacaggcguaacuguaauaggcaaagaccuaauaaacagggcuuaggagacugcaccgcaagcacucuccccucacagaguacaaccccauuuauccccucgcggcaggcgugagagggugcugcuaacccauuaacacuggauggccuccuggaccuggacgggaaggacucccaagacucucaacuguucucccacaaaccugcccacacuucaaaccccgaaaacagcgaagagaaauaccuuuccuucaguucuucucccucuguccccagguaaaagccucagggcgggcaaggaggacgguauaaucaacccgggcacucaccaggaggcauguaaggacgagccugagggagcccgguggagggcaccgugauuccggucuguccauggugguguuggggauuggggauuuagcccuaggcaguaaccgugaacuacagccucagguagggugcgggccggggaggcgggcacugaagccuaagcugcagccuccuuccccugcacacaccuuuuuccaggacacuauccagcuugccccucccagcggggcuggccagcagcgggucagcaggcagggaaagaaagcuggcuucuguuuguuuguuuuuuucccccacuaguuaacaccucuuccgagcuuacuuuucagagcuacuguucuuacaaaaacuaaugcuacuuuuccuuccuauucauguaaacaaaccacauagguagacaaagacaaagccuuucuuaggaaacaaaaccuucugaaaccccagcgcacaaagccugaacacacagauaaaauccuucuguaaacaggccaaagccacccacaaaaaccagcaagugaaucgcacacacucaucgaacugccucccuggccuuaaagccuacaguucuagugugccagaggcagaagcagaggcagguggaucucugugaauuugaagccagccuggucugcgaagcaaguuccagguaacaacacagagaaaaccaccccucaacacacacacagacacacacagacagacagacacacacacacacagaaagagagagagagugagagagagagagagagagagagagagagagagagagagaccuguacuugugcccagugaauucauuucucucuucccaaaccaguugcucugggaagccuuucuuagaauucagcccaauaucaucuuuuaacacacaucauacacacuuagaagcauuccaaugggggggggggcugccacaaacuggaaaagcaauaagccagcagcugaguauuguccuucaggaaugcagaauccuccguugcuagaguugcuaacuuuuuggaaacuauuuuauucugugcuuggagaaauggcucaguacuuaagaacaauuguuggucuucagaggacacagguucaguucccggaauccacaugucagcucacagccauccauaacuguucuaggggauccaacgccuccacaggcaccagacagacauucaggcaaacacacacauaaaaguacaaacaucuaaauauauauacucuuuggauucuauauauucuuaguucuuuggauuuuuguuuguuuguuuguuuguuuuucgagacaggguuucucuguguaacccuggcuguccuggaacucacucuguagaccaggcuggccucaaacucagaaauccgccugccucugccucccaaugcugggauuaaaggcgugcgccaccaccucccggcuucuuuggauuuuuuuuaaaaagagaguuguccauuuauuuauuuaguguaucugugagguucuggcaaugugccauguugcacauauaggggucaaagacacuuugcauaagucuguucucucuuguuagccauguaguuuuuguccaaggaacugaacuuggcagcaaguguacuugccugcuaagcuauacugcauuggcucaaagauuuccaaauuuuuaauuuagcucuuuaaugugacauauccuaacuugacaaugauuacaacuccagacauagggaaagagacacagcauaaacugguuauggcacuauuuuguaucuagauuauucugguguguguguguguguuuuaguucaacaaaauagacaaccuauugagccaauagagaugaguuugagccagagagauggcucauuagguaaaagugcuugccaccacaccugaagaauuaaguucaaucccagaacccaaaugauggaaagagagcaaguugcccucugaccuccacacauauuguggcauguguaugucucuaugugccagcacuuaagacuaugugccacgguguggcauucagaagacaacguguacgagucagcucucuccuuauaccauaaagaauggaacucaggucuucagcuugccagcaagugccuuuaucugcugagccaucucaagccaggauccagggcaauugcaaccagugagggcugaggccuagcauaggcaacauucgcuuugcuuagagucaucuucagucugugguugcagggauuggucuucuugucuauggauauagacucuuggcucacuuuucccaauauuauuuuuaaccaaaucaauucuccauucuuuuuaaaucucaucagcucuagggaaacguguguggccacucacaacauacuccuaaguuucucgcaagcuuuaagaaugacuggcuaugugucaucuuuuuuuuuuuuuaaacuucuuuuacaacuacuaaaaguaguauaaggcugcuguguuacuuaagugaguuuucuuuuucaacgcagggagcaaaguggucaaaugucuucuugauauaauuccugaaugucuggaaaauauuaugauccaagggcuacagaaaacaagccccugggaguuuggagggcuggggaggagucugaaugccugggacuucuguucauaaucacccacaccuuuaauucaagaguuuucucugccaauuagcuucuaggcuucaaggguacgauaaucgugaaguaacgaaaagagaagacaacgguuagugacaguucuccguguguaugacauaaaauggggaaacggguaguuuaaccuuuuccaaaagagugggauuagggucuuuguaaagucgcagaguuuuauuguugucaccugagucccugacaugcacgcgcgaacacacauacagaugggcaucccauccuuagucuccucuaagcuuccuggauuuuugucucuuuccguaaaagaacaggaagccaugcguuccaaaacagacucaucuccuuggcacaggggaccaaaugaggucuacaacucugaccagacauuccaacggcuugaaauaguugguugucaacuagcuuuuaaugguucuucuccaacaaccccguguuucgcagauggcagcgauuuuuaagcuucucucccucucucucuccucucucucuuucacgaaauauauauagcuuguccuugaccacugauuuccaucagacacuucugugugcauuuggucucggagucugaggccagccccuccauggccugcuccuucucuccgcacuaaaugcuaugucuguccuucggugauuacgucacgcgcagacucuggaagaugccgaaaacuuccugcacaucggccccaaacuucucuuaaucaggccuuccauuggcugacagacgucaaaccggcgccccacguccaaguuuucggggaccaugugccucaucuugauggccaccuggccucggacucggguucagucaucccgguuccgucacggaggccucugcggagagcgugcacaaagccucuugauccccugggcggucucagucucuuagucucccggcacgcgcaagacuccgggccccaaagaaaggggcggggaccgcguugagaaaggaucucgcgagacuugacagaucugcugggaggcuucgcuccguaagaucucgcgagauucagagaggcgcucugggaaccuaguaggugggcgggcagacgggagccagggagauggcggcgcaggcugugucgcuccugcgggagguggcgcggcuggaggcgccgcuggaggagcuucgugcgcugcagucaguggugcaggcugugccgcugcacgagcuucgcgagcaggcggcggagcuacgccuccgcccgcuguucuccuugcuuaaccagaacaaucggugagagaagcaccgggcuugggcggguagggauggcugcaggggucuuucggagaaaaguccagguuguccaauugcaagauguccacaacuguguguugcccgggucuugacgguucuccucuccggaaggaaucuucugcugauauuguggcgggguccacggcacgccuuuuaauuucaguauccagugaaugcuuguccaguggaauuaaaauguacggaauaacagauuugugagacagcaaaacuuuaaacuagaaacaaccauauuaauaaaucauuaaggacauaaauuauugcugcguaacguugcgcggccgaucuguguauguaugaaaguguugaauguaaaaaaaaaaaaaaaggaaaauuguaaagcuuauguguaaauuaauccacuauauaccccuuacaagcgagaguaaacugcauaacccaggauuauauguagaaguuauuaaugugcaacuggaauuaaaauguuaggauagcaacuuuugaugaauaugcaucuauagcauuaaauuagaaaugucuuguauuuguuaacuugaucauuuaaugugcuuuuuguauuugaauuuuaauuugaaaagauagugagcuccagucagucagcacugaaugcuuucagugcgcuuucuuaccucccuucugcuacaucucuuacuccugcuacgucugcuaaguugguuuuaacagucaguauuuuagugguuauuuuccuuuucugacuagcccucacccugcaaccagaacuaaugucucaggucaguuggcuuagcuugucuguggaaaucaugauuguauaguuugguauuugggcccuuccugguagcuuuccagucugcuuuuccaggcuacucuccuucauuuacuccacugagcgcaucuguuccacuaccguguuaccaucacuaacguuccuagagcaugacuuggcacuuucugaacuccucucacaccaguucuacugacuguggacccagcccaugugccaccuccccaaaaaagucuuucuccagcugcaaguggcucuucgucagacaccauaaugacauuaucauuuuucuguuuauaauucuggauaccuuucccuuguuauaauucugugugugucuuugugguuaggaaacacauuuguuccucucugcaucugcccugaaguacaguucaggaaauacaugguaaauacaagaugaggccuacagccuuuaaagaagguacuggguccaguuuuguuaguuuguuuugaaauaggaucuugcuguauagagcuugucuuaaacucaguauguagcucaggcucucucccagggcuucucccuagccggcuuuucauauugaaaaugaaaagacucugaaaaaucauagugcagguuggcaacaggaaccaaaguugggaaguuugggaauauaguaaauggagaagacaguuugcugcgugcuggggugguauucuaggaagcuuuuugguuguuuuuuguuuuuuuugagacaggguuucucuguauagcccuggcuguccuggaacucacuuuguagaccaggcuggccucaaacucagaaauccgccugccucugccucccaagugcugggauuaaaggcaugugccaccacgcccggcuucuaggaggcaguuugaaugggcacuuagagcuggauauguacuauauauggcaguugcaauauguuggagugauucuccucugauaguauugcagucuccacacuacacuacuguuacuaauuuguugucuagaccacauaagaaauucugcugauucagguucuggguuuguugcuguaaaucuguaaucuugacaccuugcgugagggaaauuuaacaccuaagaucacugauacucaccauagaaguccaacaaggaugacugacuuaccaccuuuagcuugcuuggcagcuaaggcucacauaggaccugagacaguuuauacacaauacacuuuaaaccaucacugcuuuuaaaaauuauuuuaagagagagagagcaagcaugugugugcucgcuggagugcauguguggggacaacuucagggaaucuauucucaucuuccaauuuguugaggcaggacaucugggggucuuuuuguuguuuauuuucccccuucucccccccaacccccaucaccacccaucagacuccuggccaguggcugucaacuguccuaaugcuacaacucuuagauacaguucuuuguguuguggugaccaccaaccauaaaauuauuucuucauaacuguaauuuugcuacuggugugaauuguaguauaaauaucuguguucuggugguccaccccacaaagaggcugugacccacagguugagaaccucagcuccaagcuagcuggccuguaagcauccugcaauucuacugucaggugcauaguacuauaaugcaguguuucccuuggguucugcaagucgucgggcuggcuuugugagccuucucacugagccauccagucucucuagggaaucugggaauugcaacucagcuccucacguacauggcaggugcuuuacccacugagcaucuccccagcucaagugugcucauuuguaagguuuuugauuuguauucuuaucgcagucuuggaaaguuaggccaguuuaauucuauccuggcaucagacauaaauuagcccauuuauuuauauugccuauuaagaggcaaguaaauuguucgggaacaagauccauaccuacagcaaguagucaucaaguucggagugguuuaccucucugauagcuuucaggcguuuucccuuuucuccccuuugcugaugcucugauuugcuccuucaucaccuuccacauccauuggcugcuuucuacuggaacaaccucucuaucaugcugcagagcggccucuccucuuucuucuucaugucuucuuuuguucugucaacuuggcguuagggguuggcccaggacuuuguacaugcuguguauguauguuccaccccugagucucaucucagcccccaagagauggcuguaagccaacuguccuugugucuauccccaagagauggcuguaagcuagcuguccuugugucuguucucugcuuaaagccacugcaucacugggcauugcuucucuggaaaagccaaggauggcauaagaaccucuuaguuuuguuucuuaccacucaucuuacccucugccaucucuacccuccccaguccagagcacaggcaugacaugcuccguaaggcuucuuugcaguauuagugcaguaucugauuugucuguguguucuugugugcugcgacuuccucugcuugaaacaccuuucuaagccauucauuccugggucuuccugaacacuuaguuccgaguuacugcuccuggaagccuuacccauaucuugcaaacuuacuuuuaaucugcuacagcuucuaucccuagcuuauggcauacaucuauacuuugucuaucuuauugugugcaugucuucuauuagagugaccuuucugaagcuagacaauauguccuaucugucucuguagccccaacacaggcauugcaaagaguuuagugcagagauacacuaaaugucuaauaagugacgagaaucugcuucuuugaagaaaguguucaggagaaaucgucacuuuagguguuagguuguugucuccagccugacgugauaugacugagaccugugcugucuccuuuagggaacagacugcuuugugugucuccauucuggagaggcugcuccaagcuguggagccgauucacuuggccaggaaccucaggcuugaccugcagaggggacugacucacccugaugacucuguaaaaacccucacucugucgcagguauggaaucauagugguaaaugcagaaacgucuaagucacucacugaagcccuuggauguggcaggugugcugccacugcugugcgagcucacgagaucaaccuguaaggagcucccaggcuguagaaacugacuuuuagggguuuagaaguuacucugcuauaucacguuguauuggagaagcuugaaccaaguguaaacuucacaaagccaacacauuauaguagcggcuuucauccugacagccagauaucauagcguuugugugguacgcugcuggggucauguauguuaggcacugcaguugguuacccagcagucugcagcuuucccuucucuucucuaaucugugcauuccguuugcggugggugggagggugguauuuauucauuccccauauauaugccagaaacuauagcauuguagcagauacuuugccucauccauuuaaucuucuuacugcccuagaauuaaaaaugguauucuuauuuuucuaaaaaaaaaaaaaaaaaaaaaaaaaaaaauucaaagacgguaauuuauccaagauuuguacaacuaaaaaucgacaugcugguuugacucaccugucuccacucuuuacccacuguuuauuguuccuucccacuuaaaagcaugacuauacccuguguguguuuggcuuuagugaaguuguaguaauuugugugauagcuguaauaaguacuuguaauaaucacacacuaaaaaauacaaauauccuuuguuuguguguucuauuugggaagagugucucucugccuuuuuuucccccagauuggaagaauuguugaaaauucagaagcuguuacugagauucucaauaaugcugagcuguugaaacagauuguuuauugcauuggcggagagaauuuaucuguugcuaaagcggugaguucacuagagccucagccaacugugcagacauugguguccuaaagucaggagagaagcuuacugcaugguuuguaggguuaagguggaaaugaaucugcagccuugucagaaacagcagugagcuucuaagucaccugucugugucaucugucacacuuguguuugguugcuuuguuuuuaccgguuauaaauaaauaacaguagcaaaaaugggacuaccuauuggauuaggguauuuuauguacuaauuuugacaucgggcucaggaagcagauacaacucuucuguacuuucugacagauacuuucuuucuguguaaggcuauuaaaucccugucgagaauaucacuaacccaggcuggccuggaagcucuguuugaaaguaaccugcuggaugauuugaagaauguaaugaaaacaaacgacguuguucgauacagggucuaugagguaagugugagaacacacuuccuaauccuccaagcaguggcgugcauuuauagaggaagccaggguggcucacacaugcacauucagugagucuuuugaguccuguaugcuacgacauggugcuuacaguacaggguguguucaugaccucgugugagacggucucaaagguacuuccagugugguguauguauuacaccugaccagacaccuuugacucaagacugaaaagaaugucaguauucuuagugggaaggugguuccuccuuccuccaguuuucuguugaacacuucuaaaagccucacgcacgcugucauuaguucauguguuuacacuugguguguggauaugugcaugucgaacccagaugucagucucauuccucaggucugccuuguucuuuaaggccuggaauccacugauuacacuaaccugccugucuggugagcaccagagaccuacccagcacugggauuaccacugcaugcuacuacaccuggcguuuuuaacaugaguccccaugcgugcacguaugcacuuuaaugaccaauuaucuuagccccagagcaacugaguaauacaauaauguuauauguuguuaaucucgcugcugaagacugaagaaguauugacccuguccacacacauaaauaaguagcauaucuaaaaaugaagccacguguaaucuaaucccccucacauuuaacucacucccuuccugaggacucucugacuuugcaugcucugcuuucccuugucucuuucuguuucuugguuccgugcuccuuacuagacuuuuguuuguugacgcccgagagagugaaaugaaucccaucaugugcggaggcacaugguacucaggcagaccucauucuugagaugucaguucccgccuacgugguaagacuaugaauugugggcuucucccuccaccugucuucugagcuagaccuucagccuucacggaacugccugcccgagcuggauuccugcucccucccuuccauucccucugugauggauggguccuagaccuuggucuauaucuuuacaaaggcuucucccugucacguuuccaauccugccagcuuuacugaagccgugugucuccuugguggcauagcugccgcuacccuaggccaaccucccagugucacuuuguacuguauuugcauccagaugagucucacuucauuuuucucauccuugguuucuuuuaaaugcaaucaguaguauuuccccaaauuuguauuuuaauugauucauuaaauugcaugcauuggucauguacagcaugauguuuguagcauauauaagaaugaucuuugggccaguggaaugguguggugaguaaaggcacuugcugucaagccugauaacucggguagagagagagauccaacucccacagguugucuuugagcccuucucccucacacacauacuccccuccacaaaauacauaauucaaugaagauguaaaaacccaaaaucccugauucugccacuucuguuaaauauuuuaguauccuucaucuuucauuaagcuuucaggacaugucaaaugaacaugugacagacagguacauagauacaauuuuauuuuguggugcuuauuacaggccuuguacccaucagggaaguucugcuacucucugugugcgagcgugugcaugugugcaccacuuugaaugaaucauuuuuauguuuguugcuaaugccagucucaugcccugauuaaugcuuucuuuguggaagguacauauauaccuagauguagauggaauauuuuucuacaaaaguaauuuguuuuauggucaaugaaguuuuccuagaaacaaaucauggauuguuaagaauucagucucauacauaguacaaauauaguucugcauuuaguuaaaaaugaaagcuaacagguuggaccuguuuugaccuuuuuuuuuuuuuuucucucagcuaauuauagauauuucuucugugucaucagaaucuuuaaacuacuguaccacaaguggacuggugacucaacuccuaaaagagcugacgggugaggacguguuagucagguaaguagaguugggagacuucuucaagugaaaugcccuuuuuuuagggccacaaagcaagugugggucuuaguguagucuucugugcugguggauccuauacagcugugaucucagggcugguguuacuuucaagaagcauuuuaggaaauggcuuuuuuaucaugauaauacauuuagcuuugcaaaguccugcaagaugucuuaguuauuuuucaaaugacuauauccucugucucaaaguuugcucuuugauuaauauguuacaauauguaauuuaaacagucaugaaucacuuugauauaggccauuuuagaugacuuagcaucuuaccaaguugcauuaucaaauagcucuaugauaugauagaagaaauaccguguuuuaaaaagaaugaagauuugcugggcagugguggugcacgccuuuaaucccagcacuugggaggcagaggcaggcagaucucugaguuugagaccagccuggucuacaaagggaguuccaggacagccaaggcuacacagaaaagcugucucgaaaaaacaaaaaaagaaugaagacaugagcuucauagcucuuagaccucuacccguuuggccuuggacaaaugacuauagcauuucuguacccaguuucuuuuucuuuuuuuuuuuuuuuaaagauuuauuuauuuauuauauguaaguacacuguagcugucuucagacacuccagaagagggugucagaucucauuacagaugguugugagccaccaugugguugcugggaauugaacucaggaccuuuggaagagcagucagugcucuuaaccacugagccaucucuccagcccccaguuucuuuuccuuuugcugcaguauuagggauugaacucaggacuuacacaucaggcaaucacucuaccacugagcuauaucccuaugccguuuacuuucuuauuuugagauagggucucaccuagaugcccaggcuggcuuugagcgcacauguaauccaggcaagccuugaacuuaugauccuccuguaucagccucugggacuaugucugacauccaugacugagaacaauaauaauucuauaaagacuauaugaggauuaaacaaauuagccauacaaaccaauauaauggcucacaaggguccuugcugaguguuagcugugucucuuagagcuccuguuguuccuacucccagguccucuuaauauugcccaguguuugcucuacucaucuacacucucugccuuugcuguuaugauagcaugguaaucgccaucuuuguauauagauauuuccgguauuuaaugacuuuaugguugucuuucuuuuguaguaugacuggauuuguuaaauccauauauauacauugguuacuggguccuuuuuuuuuuuuuuuuuuaauuuuuuuugagacaguguugcccuggcuguccucgaacucacagagcucuaccugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucgagugcuaggauuaaaggucugugcuaccaccacagugucacuuuguacuuauuugcauuuucauauuuuaaucgaaugaacaaggacauagauaaaucugaagaggucaggugccagguuuaaccucagcuaaacuguguuaguuacuuaucgugacugcaugccagaagggacugaagaauuacuauuaugcggugguuacuauaugagaaaguguugcugcuuuuacagacauaggugggguaaaugcaagauguugagccuucuuuagaauagcucaguggaagauuagauaaaacguugguaauucuaaaaacaguuacuggugcacggggacucaugcagcuuugguuuugugucuguuugguauuucaaaauaaaacaaauuauuuuuuuaaaaaaaccucuuaagaaacaaguauguuacagaaauaguauugggucuccaguuagaaggucaggccucagaucugagcuccaccuuaauaagcuuggaaaaugauagugcucuuguauccucaucugaagaaggagccagacuaugggccuuucagauuugaugagaauaauuaaauauaauagaccccaugugaaaucaguuuuaaaaugcucuucauuuuuguccuuuuugacuuuagagccaccuguauagaaauggugacaucacuagcuuauacccaucacggacgacaauaccuugcucaagaaggagucauugaccagauauccaauauaauuguuggcgcagauucagacccuuucucuggcuucuaucugccaggugagagcagcucuuccaaugucugaguuacacuggcuccugaaaggcagggcuuucucuccuucaugcuuccuucacaagaugccgcagccacagucgguacagugagaggacccugcaucacaccugagugaugccaugaauccaaguuaauacauugugguacagcagauuacuaaaaugaaggauggaaaacauaccagcagauaccaaacaugcauguggcagcauccuuuuagcaugacagcccagucggcuguaaaagaaguguguuauaacacagcacaggccgugugugagggccccacagcugauggugggcucagguguggguugucgaaagccucuccugugaucaggagcagggcccucuccccacuucucugcaguacaguuuaacaaauccuggaacacacugguaagagaaaaguaaaagguauguaaacccaaagaagauuugaaauuguucuauuuauagguauaaauguggggugauaucacauggagaauacuucagacuccaccaagaaacugucagagcuaagaacugaauucagugaaguugcugaucaacagcagcauacaaaguugguagccuuccacacuaaugaugaacugcccaaaagagagcucaaggcagcaaucccauugugauagcaucugaaauacaggaauacucagugauaaaucacugucuuacucccagaaggacacacagacuaauaggacagaacagaggacucuggauaaauccuuauuuuuacaauccaugcccaaaacauacauguggaaaguacauuauuuucaauaaaugaugcugaaagauaaaacuggauauuuaggugaagaaugaaauuagaccuuugucuccuguccuagaacucagcacaguguaauuaaggacaggaauguaaaacgugaagcggaagagaauguaguggggaaagcuuuggacuugggucuggaccaagguauuuuuggauaugcuacucaaagcacaggcaacagaaguacaacaaagguacuugcaccaaacugaaaggcgucuauccgcccagugaaacgaucccgagugaggaagcaaccuggaguuagaggaacauuuguaacuguaucuaggaaagaguccauguccagaacauaagggcacaagcaaauuguagcaaaaaaccagcccagguaaaaaucagcaaaggaccuggaucagcuuuacucaaaagaaguccuguagcugccagguaggcucuuggaaagaugcauaaaccacugaggacagucaguccaaaccuguuaaaauuacugaggugaugcugugaagcagagaaccuguguauugaugggaauguaaguuagugcaaucgugggaaacugaaggucuuuuaagauagacucuggcggaucccauuuggguauguagccaaaggaaacaaaaccaaucugcugaaaagcugucuguacugccaugucacuugcagcacuugauccggggucaaccugaacauguaccaguggcuacauagauaauagacuguauagcacaaugggagguuacucagcuuuaaaaauaaagaaacccuguuauuugcacacugguuaaaucugaaggacaagggugaaugaaaccaguaccaugugaucucacugacauguguaauccaaaguugaacccaggaauagguugaugauuagaggauauuagggcuugcugugacggugggagugcaggcauccaaacugccagaaauaaggacagggucaugacuguuacacugugugcucucuuaaguggugcuuagaagagacuuaaguguuuucaccacaaacaacauaguacguauauuaauuugcuuaauuuguccaguauacaauacaaauauauuuccagacaugauguacauaacagcuguguacagaauuuuuugguuuuuguuuuuuuguuaguuugaaaaguuaauaaaaacaaaagacacuaagagucccuuaaugagguggaaucuguuguacugggacaacugcacuguggacugauguuaugaaaacaugggcacucuacagcauuagaugguuuucuuuaaaaauucagugagagccaggugugguggugcaugcuuuuaaucccagcacuugggaggcaggagcagucaaauaucugcauucaaggccagccuggucuacagugauucugggacagccagaaguacacagagaaaccaucucucaaaaaaucaacaguugagugagaaauaaaucagaauaccaauauaccaguaugcugccgugcaccgaguccagaucugugcauucugugcggugagaugaggaggauucaccccgcccauuucacuccaggucggguugauuagucuuccucacacacucgaguagcugaggguaaugccccuugagguggucugcugaaguuuacagugauugcaccuggugcaaucacucccugucauugguauccauuggugugccuauguucucucucuuccucccuccuucccugucucucucuccuccguuuccuucucucccuaccuggcuauagaccaagcugaccuguaacacacagauaguucucugccucuccccucaagcuccguugacaccuuggggaauuucguucuuggaaccacacagaugggucuuugaaucuccuuagcuguccgcugcaggcagcacagugcuuaucugucuccuccugcugccuacaguuacugauaauuccuguggaaacauggagcccccaacuuguguuucuuauccuucuccuaacgucuauuuuuguaaaucuuuuaggauuugugaaguuuuuuggaaaccuggccgucauggauaguccucagcagaucugugagcgcuacccuguuuuucuggagaagguguuugaaauggcggauagucaagaccccaccaugauuggugucgcugucgacacaguuggaauccugggauccaguguugaaggaaaacaaguuuuacagaagacagguuggugugacuugacuuggcuuuuguaagacauauuuugggccaggauuucauguucagguucaucugcuggugggauaacuguucuagaaacuacuuuugcaggcgacagucuucuuaucccuaacaugaacuugccucccagagucuugugauuaguacugaaagcuguggcuuuugcuccuuacuauauguaggcuuucauccaacaagaaccaugugguuugcugcuaacauuuuccuuaauuuuauggcauugcucauguuguguucgaguuucuacacugacggaagcuguaugaauuucauuuacauaacuucucuggucacguuccucauuuaucaaaauagcacagcagcagcuucuucaggguuuugaguauuucagaagcacagagagagucagaaggaacacuuugugucgagacccuuccgagccugugcagguuggaaccuuugacugcacuccuccguaauguuuuaccgugcugagcguccauugcuuuucacuucguacccaugaggguagccgcuaccuuuauuuucuucuaagcauaacaaguguucagauguuagaaaacaguauggaaguuccacagaaaaauuaaaacagagcuagcguaugagccagcaacucuggaauacaauauggcaagcaaagguucaagcagugucuauauacuccuguguagagcaguaucuaucugcucaaagcaauuuaaaccccauaauguacgugguggaugaaugaguuacaugugugugaaagugugaggcugugacagaagcugcagcacagaggcggucuaaagacauuuugcuaaaacaagagggccaggcauggagaacagguacugcacgauucacagacaagcuuauguuaagcacauagggaggucaaguucauagcaacagaaagccgagaucaggcaccagggagagagaagggagggugggguuugcuuguugggaccucgucucagguugggcuguugagaaggaugguggugguggagcacagcaguaugaacgagaugggcagcacugguuggguuuaaugugucaccuuauccuucacaggaacccgcuuugaacguguccucaugagaguaggauaucaagcaaagaaugcuuccacggagcugaagauuaggugcuuggaugcaguuuccucucuccuguauuuaucgguaaguacacggggaaguuaaugaagggcagcgggcugucuguguuugggaggacgaaucggcauggcacuaguaguuucugaguuccaggccagccagggcuccagagagaaacccuggcucaagaccuaacaaaacaaagcagggcagugguuauuccaccacuugggaggcagaggcagguacucuugaguucaaugccagccuggucuacagagugaguuccaggagagugagagcuaccuucacuauguuacugggacaugaaaacuuuguaaggguauuuuucaauuuauucaagaguugcauacacguaugcauacauuugauuguguccacuccuuuccaguguccccucccuguuccuccaauguccucuccaaccucaugacuaucugcuuucuuucuuauuauguaauuagugcugcccauaugcacaggguuugaggucauggccacacaugcaagacucccccuuccucccuggcugcugucaacuccucuagcucuuccuuggcugcauugggguuuugguuggcuuaaguuugugcagggaaccacagcagcuagccaucucaagcacuccucucaucuucagcucuuaaauucuuucugcccucucgucuucagaguucccugagccuugagaagcaggggauugauacagaugugucacuauaggcaauauuaaagucacuuauucccagucacugcccauugcaaaaagaagcaucucugaccaaggcugaaagccucacaaaucuaaauauaaacaugagcagcuagcaaaacaacaauaggaggugccccucuaagaccuuugacuuccacagccaugggucauuuuaugguauggugugguguggugugguguggugugguguguggugugguguggugugguguggugugguguggugugguauggguauggguauggguauggguguuuagcgcuugugugcagugccuguagaggccaggagagggcucagaccccuagaacuggaguugcagcuuuacgguaccaagccugaaugcuguccuauggagcaggccucaguccagucaggugcuugguucuccucauaacagucaucgcaagugggcacagcguucagguccagcacugggcaagaacacugaugucuuugcuccccugcauccugcagagagcaguuuaugguacugcggaagcuaggcagcuuagaagaaguuuuccaggguuaucauuuaguuaugauggacagcuaagagcaacaggcauaaccugcuuuaauaggggaggugcucucugggaccucccaacuguagggagucgcugggguuuucaguuacuagcccauuuccucugggaacagcauuguccacucaugcagggaucagagucccuugggggugggggcugcuucuuuagucuuaguuagcuuacccauaaccccuucucacucccgaaaucuaucaucgugagugagagaaggggguuacaggagaugugcauauguauaggcacacgugccauagugcacauguggagaucggaggacaacuugauggagucaguucucuccuacucuauaugacaccugaggacugaacucgggcugucaggcucacacagccagggcuuuacccgcugagccaucagcagcucgguuacucauaucuuuugguuugucugcuuguguuuuuuauuuucgagacaggguuucucuguguagcccuggcuguccuggaacucacuuuguagaccaggcuggccucgaacucagaaauccaccucccucugccucccaagugcugggauuaaaggcgugugccaucaccguccauaucuuaaguguaacauagaaugacagaguaauagaacuggaggaguccuagugaguaguucaucccguccaacaaagaugggagcuuucuggccuggauugagagauggguucucuccaaggggcucacagaaugccauuuauccaaggcuuccugacucaggcacgggcuuuucucuggcugugguaaccuugccaugggcauuuccuuucugugcugcagccugagcagcagacugaugacuuccugggaaugacagaauccugguuuuccuccaugucucgagacucccuggagcuuuuccgugguaucaguaaccagcccuucccggagcuacacugugcugccuugaaaguuuucacaguagguaccuuuucuccucagauccuucugugacugccagcucaacacggagcacuagagugagcuagccucugugcacgcaguaguuucuacccugcugcuucaggagccauugagagagacucgugccaacggguugucaguaagggguguucacuacugucugagguuuaaaccagcugcuauugcaucacagguugacccagcuccucaaguucugcucagcuuuagccuugacuccuacacucccuuuuggcacuccgugcucuggauaugccgggcugcugguuucucaccucugaccuuugcuguggcaacugaccucagcacugcuaacuuugcuuaugaaccucuuaauuauucaagaaguggcuccagugcaggaacuacuaagucugguacaguggcgauaaaugauccugguucucauacacaaguuuccccugaugugagacggugggcccuuucucaaacuucccaucuauggagggagccacaccauaaauacagugguuauaaaauuauagcuaaggggcuggagagauggcucaccgguuaagagcacuggcugcucuuccuaagguccugaguucaauucccagcaaccacaugguaguucacaaaucuuuuuucuuucuuucuuuuuuuuguuuuguuuuuuuguuuuguuuuguuuuucgggguuuuuuuugguuuuucaagacaggguuucucuguauaguccuggcugucuuggaccucacuuuauagaccaggcuggccucaaacucagaaauccgccugccucugccucccgagugcugggauuaaaggcaugcgccaccacgcccggcccuuuuuuuuuuuuuuguauguaugugaauacaccauaaggaugcugggauuugaacucaugaccuccagaacagcagucggugcuucuaacagcugagccauuucagcagcccacaguuuucaaccuguggguugcaaccccacuggcaaaucugucuccuaaaacauuuacauuaugauucguaacaguagcaaaauuacaauuaugaagugucaacaaaaauaauuuuaugguuggagggucacuacaacaugauggauuguauuaaagggccacuguggcugucucagacaccagaggagggcaucagauuccauuacagaugguugugagccacccugugguugcugggaguugaacucagaacucaguuaggagcagucagugccaagccaucucuccagccccauacgaaacuuuuaguuaguuagagaauuuuaaaaaauguuucucaggaaucuguuuacuuggacaaagggagaugcauuuaagguuugugcuaucacauuuaucucuuaaguauuauguugucugcucaugaacuuaacuauaaguuguauucucuuucugccuucacuuucaggcuauugcagaccagcccugggcucagagacuuauguuuaacaguccagguuuuguagaguuugugauggaccggucuguggaacaugacaaagcuucaaaggaugccaaauaugaacugguaaaagcacuugccaauuccaagacaguugcagagaucuuugggaacucaaauuauuugaggcucagagcguaccuaagugaagguccauacuaugugaaaccuguugccacaacagcaguagaaggggcugacugaucccuuuccaccuaaaacagcagaauuucccaaggcacacgauuccauccgugcuccacaccacaggacgucugucuucccaggcacagccucaccaucagcaguguugucccuacuuaaugcuguguagacucggcucuuguaaaagcaguaggagccugagagugcucguguuuccccgaguccucuggcugccaaagucucugcugcaaggucgagguuuguuuucucaaaguuuccaugggcacacucaugacauuuuuaaaaaauaaaaugaagccaaaaugauucuggauucucucaaccacauuuucuuuuuccuuaccugauuuuugccucaaaaucuuggguaucuuggguagucucuaaaaaauaagucauuuagaaucaucgaauuauauuauuuguauauaaggaauaauaguuugaauaauauuucuuacuuuuccuuugaaaauaaaauaaauccaaacuuguuuggcguugguauuccggcugugugucacuguuaccauguuguggugacagggaaggaaguguaaugcccuaaccagaaaguuuccuuuguuaccauuuuauccauuggugggucaucaucacugagggcugggcugauucuucagaccuauuaagucuagucuugauguagucagacucucuggcuccugauguccaaagucagaagagaagggacagcguguaccaacuaacaugccaugucacuguuuuaccaauguuuauaucuaaacagcaaagcucucgacacacaaaaaagacuuggggggaggggguguugcuccagccugucaguggcacuagaaccaggacguguuucuuuuaggcugugcugagguagcuaagucaucccuuccuguaaccugacuuucgaaugacuggaguccugguccagcugcguuuccuuuuccacacugaucauuucuauaugaccaguaucacaaauuagccuauaccugacuuauuuuaauggcauucaugauguuagguuuuuuucccuuaacuuugguugcaguaagauuauauauauauacauacacacacacacacacacacacacacacacacacacacacacacacacacacauauauauacacacacacacauguaauucacgugguaaaauaaaauauagcuauuguaagugugcuuuucaguagcauuauauauguguuauacagugauuauugcugucccucuccaaaacucuaucuuugaaaacuaaaguuuuaugucuauuaaaugguaauuccucccacugcugccagccaccaucccaagucacacuguugacuuaauuauguaauuccaagauucaaaggaguccccucucuccaguguaugguguguauacucauucugcuuuguuguuucuuuaaaaaaaaaagauuuauguaaauauaugaguacacuguaguuguaaaccuuca

SEQ ID NO: 780 - RNA, 1419 nt, Mus musculus
cggagucuugcgcgugccgggagacuaagagacugagaccgcccaggggaucaagaggcuuugugcacgcucuccgcagaggccuccgugacggaaccgggaugacugaacccgaguccgaggccagguggccaucaagaugaggcacaugguccccgaaaacuuggacguggggcgccgguuugacgucugucagccaauggaaggccugauuaagagaaguuuggggccgaugugcaggaaguuuucggcaucuuccagagucugcgcgugacguaaucaccgaaggacagacauagcauuuagugcggagagaaggagcaggccauggaggggcuggccucagacuccgagaccaaaugcacacagaagugucugauggaaaucaguggucaaggacaagcuauauauauuucgugaaagagagagaggagagagagagggagagaagcuuaaaaaucgcugccaucugcgaaacacgggguuguuggagaagaaccauuaaaagcuaguugacaaccaacuauuucaagccguuggaaugucuggucagaguuguagaccucauuugguccccugugccaaggagaugagucuguuuuggaacgcauggcuuccuguucuuuuacggaaagagacaaaaauccaggaagcuuagaggagacuaaggaugggaugcccaucuguauguguguucgcgcgugcaugucagggacucaggugacaacaauaaaacucugcgacuuuacaaagacccuaaucccacucuuuuggaaaagguuaaacuacccguuuccccauuuuaugucauacacacggagaacugucacuaaccguugucuucucuuuucguuacuucacgauuaucguacccuugaagccuagaagcuaauuggcagagaaaacucuugaauuaaaggugugggugauuaugaacagaagucccaggcauucagacuccuccccagcccuccaaacucccaggggcuuguuuucuguagcccuuggaucauaauauuuuccagacauucaggaauuauaucaagaagacauuugaccacuuugcucccugcguugaaaaagaaaacucacuuaaguaacacagcagccuuauacuacuuuuaguaguuguaaaagaaguuuaaaaaaaaaaaaagaugacacauagccagucauucuuaaagcuugcgagaaacuuaggaguauguugugaguggccacacacguuucccuagagcugaugagauuuaaaaagaauggagaauugauuugguuaaaaauaauauugggaaaagugagccaagagucuauauccauagacaagaagaccaaucccugcaaccacagacugaagaugacucuaagcaaagcgaauguugccuaugcuaggccucagcccucacugguugcaauugcccu

SEQ ID NO: 781 - RNA, 23050 nt, Mus musculus
cagcugggggcgggacugcaccagagcuugagccccuucguugcuaacggcucucaguaaagcuccggcuuugggaacugacgaguuuuugagcgacucugacuccagcacuaugucugacaaacggcaguccagccauguccagucucagcggaucccugaguccuucagaggugagucucucgucccccgcacagccucuucaagccccccucugggucccgagacccaccgccugcagugagaacccccgcagaccgccggcgugccuccacugcacugugugcgcuucgcagagccgucgucuucuucauuccuggguucucgggcugauacaugaugauuugggggugcuggggugcagccugcauggcagucaagagggcgcacucgcgcggcaggggcguguauccauugcucggcacccuagcaggcaagaacuggcuuauccuuuggguccuagaugccaggugccuaucaccagcgcuucuuuaucucgggcggugcacgcagaccaggacagacccuggcagccaggagugguagaggcgccucuucugcagcuucagccuccucugcucauucuuguuucuuuucugccccagcgccugggaggggaagcaagcagucccaacaaguagccuucagcaaucccuacgugauccacaguccucugaaccagggaagaacucccacccucuuccugccguccccagcuucgggaaacuaaucaauuuccuaguaaagggcuaggcuucaaccuaugacacaguaggcgguauaggcagaagaaaggaggucucccuggcuuuccuuccaguuccauugucugucccauacuguguccacuuuugucuuagagaucucuccuuccagguaaauagcucaccacucuucuggagccuuccuaguuuugaaggcaagaacuguuagcaggcccucaggcuaucuucuauaaaaaaauuagagcccuugagcgaacuaccuccuugagccuuuaaauuguauaacuccuuggggucaggagaugcccaguaagagaaaauaaaccucgcaggaguccugcuauccuccugggagcuuuacuaaucuaaaggaauuauuucuaaagauggaauuucagggagaaugacacgguggaagagauuuaggaggcugagugggcuuuuccaucauccugcggagacagcugucauccauucggauuauuugcaaagccaaccuggccucccaucuaacgcccaucccccugcccagaagcaucuuuaacucuuucucaggcgaaucuugaggaucucagauggcuccagaguguuguaauaggaaaccuacaggauuccauccucgggauuaugcagaaaagccuguguguguaucauucuccauacuuuaacccuucccccaacugggagcauagcaaaauuaaagagagccauagcaaaacugacccuuaauaggcuaagcacuacccuaaguguuuuauaaugugaucuuauugaguccucacaacugauacuuagugacuuagucacaaaggcuuaaaauucaaauguaauucuaaaaugugaacaggagaaaagugccaagucugccucuucagugcuggucucuggcuuuagaucaaaguguggguguguuggcggucuccuucaccuguacucagaccaccgaagugggguuggauuuggagccccacccuaggaccccccugugggaaguggauuuggagcccugcccuaggaaugaacucaaucucuauuccuaaagaucauuauauuuuucuugcucacagaccaauuugaguuuugguucuagaccccuuuucuugguucuacacuuggcuguuuuagacagaaaucuugaguuagugaaaaugauugggcuuuuucucaaguauuauacaauugaaauuuugcuuggcuuugucacuuuuuuauuuaaaaagcuuugcuuuuacuguguguguguguguguguguguguguguguguguguguguccaucuuguggagagaucagaagacaacuuuugagcuuuuuccuuccaacaagugugauccagggaucaacuucaggccauccaugcuacagcaagcaccuuugugggcugggguagcucaccugcccaccuuuuaaucuuuguuuucucacugguaagccucagagauuuaacacuaggaagaaaucuauuacuauaacauacuaaacagaacuuuuuaaaugugcgucauuuugccaaacaucuaauugcaauccugggacaaggaaaugucuuuauucucugucuuucaguaaagaaacugagucagagugauaaaauuucagacagccuaaaaaauugagaaccagguuuccaacccaggcucugacuucccgagggauguucccaguccugcagcgauccauaaaggagguaccacaauagagggucugguccagccucaggacuucacugaggguaagagggaguaaacaaagggagccuaaaggaucagugugacucaggaccucccagagaaagccacuccagaggacugcuucugauggaagcaugcaauuacacagugccaacucugccucuuugugucuuuguggagaaguggucccccguagauaaacauggccaaagcuaggaccaaccaaggaaguuaagcuagagcaguggacaauagugcagguggauggcagaggaaaguguuguuguaaagaagagccuugucaacaagauagaucccuggggaggaucccuuggaaagaagcagaaccaugggacugauauguuuauuucaguugcuacaguugaucagaauggugggacuuuaacuucuucaauaauugaccugauuaaaccaccaguggugauaaaugaacucaaacggaagacuaagacugcagaagcuauuguuuauacaguuugugaugaaauagauuucagugucacugaauagcauaugcuuuacacuguaaaagacagagugaauaacuaucuggccugcuuuuaaaaauguaaaauguugauaaagugauucagaggugacuaaacuagguaaugaguuuuaaagagggcacaggcaggcaauuuccuguaaacuguuaugagcacauagcaguaucugccuagaauccugcauauacuugugucuugacuauuguguaauguaacugucaguuggacccaucuguuacccuuuccuuuuuugccucauuguaagaacucagggugagccaggugguuguggccuaugucuuuaaccucagcauuugggaggcagaggcagguggaucucugugaguucaaggcuagccuggucuacagagugaguuccagaauagccagagcuacacagagagcagcucaguaugaggcauauagcagaugaauaaauguuugcugaaagaaaagggaaaugggaguaaaucaucuuguuaaacguugauaguuuauuguuuuuugauuuuuaggauguggcaauucuuuuccuuauguauucuuaagucugcuuauucagguguguauuaacaauaaaggaacuauaauuggcaaggaaagauaguguaccuuaugaaacccgagagaaguuagagaaucuagaggauacaagugugccucaguucucuguaacacacuugcaccuccuuuuucuuuucugucucugccuacacucugggacuaccaaagaaaccuggaccucaagcuuguguuugauauuuuaguagauggaaccuuggagauauaaccaagaaaaugccuucaauuaugagacaauaaaaaggaugcccacugagggaagguagcaugguccagggaagugaguggcauuagaauggaaagccuggguugugggcucaguaccaucacucacuaccugggucacuuaggcaaguucccggacuuccagagucagucaauuguaggcauaaccuuacugcccuaucucccaauaagaucuguguaggagguacagagggcuuugugcucacagauaagcaccagggaaccaggaauguuaaacacauaggguuggcucugcagagagggggauguuuucugcccagaacgcugagagaagaaauaggucaaagcuuggugaacuuuguccuaucuuuauggccaaggccacgccagguccucccacagaccgccaucaugagcuuauuuuucucagucaauugacugaccccaucuuuauggaagaugucacguguacuucacagagaguuuccauguagcauggcuuaagcuuuacugugcacacaggauugaguucacuagcaucagaaaauuuuuuucagcaaauugugcugugguugaauaugccuaaaauaaacuacuuggggucagacucucaaaguuugagccaacacugacuacugaguuguguuaaccaaacugucuucuuaucucucacacaucaacacucugcuggcccugggaucucagagacccccacagauauaugugaaucuucuuuugaaauguugagguuuuuuuaugauauuacuucauagagaaaagaaagaaugaaaagauuaaagaugacuagacuugcagggauauacccacuucccauucaguucacguucaggagaaagugggaaagacgagagugacggauucccugacagaguucacaacucuuuacugccccacgugugaucuguucucccccccugagauggaauccccaaacacauuguuagccuugauauuuucuccauggcaugcaggucccagaagacaguuuacccaauaaaaccacuuauuccuuaugugguggugugaauaggcucaguguuugaaggcuugacccauagggaguggcaguuaggaacuguggccuuguuggaggaaucugucacucgggguggggggauuugaggucucagaagcucaggacagucuuuuucugcuuccuuuggaucaagauguagaacucuagcaaccaugucugccuggauaccaucaccaugaggauaauagacuaaacuucugaacuguaaucuugccccaauuaaauauuuuccuuuauaggaguugcuguggucauggugccucuucacagcaguaguacccuaacuaagacaccuuauaagcuauuuauuaauugccuuauaguuguauugguaauaguggucacugcuugacuacccuuauaugucaagcaagcauuuuauguauuuuuuuucauuuggucuucauaacacugugcacuaaguacuguucuuucuuccauuuuacugaugagaaaaugaagugcuaggauuggaauuuggccccaaauugucaugcuccuacauauaucuuagcaguucgucugagggaagaauuaggaaucuaaugauaaaguguccucugccagagcaagcagugcuccuaacugcugagcucucucuccagccucugucaauaguuuuuacauuaaaaaaaaaaaaaaaacacccucaguccagcguuuauauuuuuauacggucuuuuuuaagggucaauguuuuguuacaaaugaaaaucagaugucaguuuauguaaguaaguuuuauuagaacacagccacaauccuugucccuguguguugcccauggcugcuguaugcugccauaguagacuugaguauuugcucaggcucuguggucugcaaaaccuguuuucucuuugccucucucaagaaaacacuugcuaaauucuagaagucuggugugggaugcuggugaaagggaggaggaagaggaggaaauaguuguaucuugaauauaaauacuuuuggaaguaaaaauuugccaagaugagaaaaugaagugcuaggauuggccaaauuuuucaccagccuguuuccccuuuaaaaaguguucuuagacccagauagcaugcauuuuuaagauaaaauucccaacuauuuuaucugucuuuaccuagauaauacuguucaugacaguuuacaacaagauguucaccuacauucuguguaaggaaaagggaaggauugccucuuaaauacugcaaugcaaacggguuagcccaucccuuucccuuugugcaauggggcaugugacucugagucccuuauuuuagauauaagucauguuucugggcuuccccagcagaggaaauccaauacauuuuggauuaauuaaaucucaauggugaaugggauuuacucaugcuuuuuauugugcuccaauucaucuuagaauaaaacagcugacacaggacauagagugucauacaccacucugaacagucuaggagcucccaagugaggcacuucugcugucccuguagccagacgacaaaagugacuauacaaugugaacuuuuacauucuaugauuugguuugguuuuauguuaauuuccuugaggugaggucaauuugaauaauaauaaauuuaaauguguagauaugugugcauuuucaguccuuuugagauaaauuauuuauuauuauuauuauuauuauuaguaguaguaguaguaguaguaguauugguuuuccaagauaaaguuucucuaucauaacccuggcuguccugguacucacucuguagaccaaaaacuggucucaaacucggagaucugucugccucugcuucccaaaugcugggauuaaagguauguaccacucugcccaguuuauauguuuuuauaugcacagucuuuugccuacaggaauuucuguacaugccuugucuguagaggccagaagagggcauuggauccucugggauuggaguuaacagaggguugugagcugcugcauagcugcugggaaucaaacucagguccuguggaggaacagccagugcucuuaauggcugagccagcucuccaacccuauaaauccuaguuuugauugguuaaaaguuuauuuuuaauccaguuuucagaaaagaguuucauaguggaagaagaaaaugcaucaaaaccugucaaagcaagguuuacacccaaguacuguggggucccugaucuucucuagucuucccgcugucgggcauugaaagguauuuaagccaaauaucucaggaauauugauugccccuugcuugugugccauuucccucauaugcuaauagaaggaaacacccuaaguuaguaacugagacacucugaggaagcugcuucccacuuucaaugccauguaccuaucugggcuuugaagaaucuugauguaaugguggggccugagccccgaaaauaucuuggucgagcuuccuggccugucuacaugggggaaucuuugacaauguacuuuccacaaaucuuugaauguuaaguggagaauuaacucauuuuuaaggggauuuuuguuuuucaaaaagagcaaguacuauuucccauuuucaacauggaaauucggauagaauauucuuuucacugcguacaguagauggucucagcgacuucucauuugugguuacugagcucuagcuaucucaguuccagaagaccaauccaaugcucauuguccuuuuacagugaagaagcuaaguucccaucagucgugggugguggugguggugguuguuguuguuguuuugguuuugcagaacacgugcugagcauugggaguauggaaaugaacaagagggacuguauuuguaauccauggaaaagcacuuuccaaggauguucaagccccuggacuggguucccaguaccauaaacuaaaaaacaugauuaagaaccgucccugcuuuggagguuuuguggugcacugugaucaggagcucagcaauuugcccacggugggagggacuuacagugauguuuuugagaucaccaaauguuaccagauaaacaucuuguggccugucugcucaucuuuggaauccaguucacauaaaaucuagaccuaugugacucagaacugugagcuuuucugcuaaaaauaggaaguccaccuggggugaaaggcuuccucaguuaggauauaagauuuuuauccucaaaauugccugcccacccuugggcauagucuuuagggccaggguuuuguccuuccuggcaugaccuggugaaagucauguuguuucuguuacuuuauucauaaaaugcaauuagaauuacuuagccuagucagguauggugggcauuccucuaaucccagcacacagaagaguuccaggcuagccugagcuacauagcaagaguuuauuuaaagacaaauaaaaaauuaagacuucacuggaugguucuaaaauuuagugauacacaucacauuuuaaaaguauuuaaaaaacacaacgccugccugguaggagaccucccauauugucccaugggaaggcacguugcuucuguccccucauuuauaaagugcaauuacaacugcucuauuaucauccauguaauacuugcuagaacuucccuacaagcagugccucacaguggcccugucccaggugcucugccagugacugugucugugcccuaagaauugugacuuagaucugccaagauaaacuuaaaguugucuaaacaguccccugacacagaucagaacguuacaaacauaaccagucuccuggcuguguuuucucgguccccuccuguguuucagaggcucgcucuaguugccaaagccuuuauccacccccacccccccgcccagcccccagcccuggcucuguguugccgaguugcuuuaccccuuccuccugagcauugacucaccacaccagguacaccucuccccuccugucacuucuaaaacuacaacagcaccugaagugauggcaaaagcccagggucagcuggccucucucaguccccaucuguuccaccacagaaacaaggaagaugcuggacucagaaaauagaaaacucugcacaaaaggccaagguggauugccaggcucgaggguaaaaggcaacugccgaauacuaacugugcaaaccagagaagaaaucgaggggaugccuggcuguugugaaaggagauuuaaacuguggauggaggauuacggguggaucagucagaacaguagcagacuaaagaaagugaaaagaaacaaacaggaaaaaaauaguacuagaaaggaaugcuaguuuguccuuuaccauggcuuagcuuugacugacauauuggugguuauuaaucuaaccaaaauuacgaugcaguuuuauaagucauguuggaggaagagauaaggaagaacaacuucucugguaucagggaaagucgugugguacugcucagaacugaaaacgcagggcgagcccagguugaggagaggagguuaguuagacccgggacgcagccagaagaucaguuugguuuugaggaaacagauauggggagaagugagcagagcagacacuguaccuuuuuguguuaacuucuagaacugcuugauucuacacgugggcaggcauaccauagcauacaugccacagugccaaugugacagcacacacguggagcuccgaggacaagcuucagggaucgguucuuuucuucuaccuuguggauuccaggggucaaauucaaguuucuccauuuuggcagcaagcacuuuuaucugcugagccaucuuucuuucuggcccugaguuucacuuuuuaaacuucgguaguguaacaacuuugauuucuuuuuuuuuuuaggucaaaaacaggaaaagcccaaguucaugaguacagaggcuaauaaagaacaauagcuagaagggggaaauaugcuacucauuuuauuuauuugaauuuuaaaauauaguguaaacuaggaaagagauugaaagaauguguugaaacauuuauugucucuggguuuaaaguaacguuacucuccuuuuuauacuuugcuacacuuuugcagcagucauguauguauuacaucuauaaucagacaaaaagcacuguuuauaugcagaagaggaaggaagcccuaggacugugacauccaucaucacauuguucuugcuauugcaagaagccagaaacagccaggucacuaaucaggaaaugggugaugguucauaagcccugggcacaaguaauuuguauaacaacaguguaaugggauuauguguguggaucaggguugucaucuggagucaugcugugcccucagcuagaauacccauuucuuucugucucugccuucuugguggcauuucccuuucuguuaggaagcugacagcagcugucagcuccccaucccacugucgcucaccuccauccuggucacucucccuccuuccucucuguuuaccuccuggugucaugacugccuucgguccucacuauacuugaucucauuagaggcugaguagucucuauuuuuguuaucucacaucaugaggcaaaauaagcaagugguaucugagaagcauuugcuggguaacgcaauaggugacgugagauaagaccagguacacguauuucagggcugagugagacugagacaaggacacucaggugaagccagcaguccaccaagcacagcucauucgugagcggcugggaugaagugacaacgugcccuuaacaaacugauuuuguuuuugacagaaaauuccaagacagaacugggagcuuguggauggauuuugguggcugccucguucuuuuucguaauuauaaccuucccaauaucaauauggauuugcauaaagguaaagagcauuucuuucccuucugaagcaaggucagcucccaccuccagaagccaugugauccauggggcaggugaauggauaccaaauuggccugugcuguuucuuucaucucuuguggauagauucugcugaugaguuauagcaaaaucuuaaaacccagccccugucugcucagcccuuccucacgagugaagugaugauugcuaugcaacaguuuugugucagcugugagaugcuccaucgaggaugguggagggcgggccugggcggggcugggcggggcugggugggguggcaggcucccuccuagauggcaguccuuccuuuggaugauggcaggacugagggagcagcccguguccacacacagcccguguccacgcacugcggagccuggcacagagcaaaggcuccccagugcaguugucuuucccacaauuacuaauacuuagucaaauaacugccacuugcauauugcuaggcuaacgaaugugcugccugcauuuucggauaaguuguauuguaacuaauggaaucagaagaagcacuguaagcuuuucugagcgaauaaaacaugaguagucggcaggaugcuaacagccaaggaugggcuggaguggguuucucugcgcucugcgcuccaguguuaugaggccaggguaucuguucuguguuuugggucagaagcuccuagauagagcaggcuagucuuggacucacuuuguagcucagcuuggcucggacucacuguccuccugcuucugccuauagagcccugagauucgagcauaugucccccacucccaggggucuaucgccuuauuauaguaaauaaagaucuauguguauauaagacaugagccucgugcuuggaaacagugaacaccagguacaguguuuauagauacugucaggaaauagagcaaacaacaggaggcauugagccuggucagagcagagacaugcuuaggaagcuaugcauguaaauuguguuccuugugaugaauuuucauucacauuuuuuauuccagauuguaaaagaguaugagagagucaucaucuuuagacugggucgcauuuugcaaggaggcgccaaaggaccaggucaguacucgacugcagucuggaagccaaaguguugggguuuuguauuuuuuaaacccaucuguaugugugugugugugugugugugugugugugugugugugugugugugcacgcgcgcgcacaugagugcuggugcccacagaggccagagguuugggaucucucuguagcuggaguuacagaauuuggagccaccuaauguacgugcugggaauggagcucuaguucucuggaagagagcaccaggaguucuuagcaucggagccuuucucuggucuaugagaugagcugucuuacugaugugccaaugggcccucugcuuggagcagaaguugucuaacaaggacaggggcucuggccagccugggggcugcccacccuuuccacuccuaucuauuuagagcgcuuagguuaucaguggccuugaccaacaauggccauagccuugggaggcugagcaggaaaaucuuuuuuuuuuuuuuuuuaacuuaagcagucuuuaaugaaagccgugcaugagaaaaucuuaaccaaggaaagggcugcagucagucaaaugcugggccuacgggcacaugccaccaugcccagugaggcucugggaaugcaagggagagcagaacacuguccccuuaucaaaggccaccaauaaagaaacagauagcugugcccugcauuuaguguuaggacccaguagccacagaauccugaaaaagaagccaggagaccuggagaagagcaacugaccugaagugggagcucagucaaagcuuuccuauuguagucuuauuauuuuaacauuacaugucuauguguggguguggguggguaugugcacaugagugcaggugccuucagaauccagaagagagucagaguccuuggagcuggagggaguugccuguaugggugcugggcacuaaacauggguuauuuagaagagcaguaagugcucaacuacugagcuaucucagcuccucugcuucucucucuccuucucucucucucucuccucucuuucucucucucucucccucucucucucucucucucucucacacacacacacuguuguuuauuuucuuuuugagaccguaucucacaggcuaaccugaaucucacuguguacccuaagcuagccucaaaccucagcgguccucccguuucagccuuccaaguacuguaaauaccuauaugcccagcuguggcuggccugccugcguucugaggcauggagaagugccagccacacagagggauuccugacagaaguaacaucugcagagcaguguagcggagagaauacaaugagugcugcaggaacuguguccagucagaaugcaggaccccaggacagggagagugacgagaggcaaggcgaauccugagagacugcaagggcuugagguucaggacagugggucauagggagaaacucuaguaagucuuuagagaagggugaucaagaaagcaagcuguguuaugaaaagugucugggcuauuccguaggacugaucaaggacgagcugagccuaaucgcacucucugauccuguauguuccagguuuguuuuuuauccugccgugcacugacagccucaucaagguggacaugaggaccaucuccuuugacauuccuccgcaggaggugagcaguucucacuauggcuaccugacacuggguggccagagcuugccgcccugacugccuucucuuugcccagcccugccucuugagcaggucucuaaaaucugugucaguguccucaacugugaaucgcagguuguaaggaugaggccgugggguguggugaggagugagugagagauugagcgugugaagugcuuagcacugugugagagcuugucacaguuguuagagacacggugugaugccgaggacaugaacuuaacauuacuguuguaacuaucauucugaccacaacucuauggguuucagacagaaaagaaaaacguaguuuaacauccuuucuaagggccuucauuuuuauuugagauaaauugguuagaagcaaagaauuagaaagugcucaucuggcauuuuaggaaccucugugaucguuugauucuuuucagacuucuucacagacagcuccuaguugacuuuacagccaguuccuagaaggaagcccagcucuugggaugcugugucuggugcuuucccccagcucagggcugacuacaccaggcauaauaaccauugcugacaggaagccagcaggcugcugaggggcuggcugugggagaacuggaagagcaguguucccuggcacaguccgggaacucagcaugguguuggagccuggcuuucucuuaucauaagucauaagugcagguuggccacucccuuacacuggcacugacccaagcacuggguaaggcaggcuucuccguucacaugaacucaaugaagcagacguacuucccacccacaccuuaaagaagcccgagugcauccuggauccucugaaugcuuccaugucauuuaggaagauggguuccccguagccccuuugaggggcugggaauuguggcuuuuuuuuuguguguguguguaaacacugugggcaucuggcauguggcugcgagcuuuugccuuccacugcucuuucccugcaagcuaccaaccuggagugauuggaacuuggcaagcagcucuuucccagccccugggaucuuacugcagagggagguuaaacacucuacccacaauaaccagugcucagagaagcugcagcauugagcgggcagcagcuguggcagccacacuggcaggaaucugugaauagcguucauuuccccacugcauuacaagaagcugucuaacaagauagcaaugaccuguacauuuguuaacaaaugccgcuguucccuugagucggagagguuuuagauuucgaaacuaaggagagcgcugcuuugggcgccuggcagaacuaaggccucagagaggcucugcugcuguuacuucucauugacaaggcuagggaugcuuucaaauacauccugcaggacuccucccuugaucagcaggacuacaguuaggaagcagugcugccagucucuuacagauaaaggucacauggcuacagcccgcuacagcccagggucagggcuccacgccugcaauccuguccuagggccucauuauaguucugagucucaccucguggcccuccaccaugucagccacacugccagugcucgagagacagaagagccgccccuaagaaacucaccguggaaaggagaagcagagguguccaucgugcauccccaucaguguaucacggcacaggggcacagugggugugcagggaguggccuuccugagagcaagaaucaggaaguccacagagaacaaauuugaauggagggaauaaaugagccagagcaaugucagcuuuuagguggcaccacagcuuuugucgagggguugaaugaaucuguggacuuggauaacuaggagagccuuauuaaaucucuaaagggguacagauaaccuucugaugcuuuaccaaaggguaucagccauugccuaggggucauggaaugacaaugacgaagcucuggcaaguguaugauugccuuccucuucccguagguccucacuaaggacucggugacaaucaguguggaugguguggucuacuaccguguucagaacgcaacccuggcuguggccaauaucaccaaugcagauucagcaacccgucuuuuggcacaaacuacccucaggaaugcgcugggcaccaagaaccugucucaaauccucucugacagagaagagauugcacaccacaugcaggugaggagugcccacugcugguuagcugaucagagccagagaacugaagcugaggccaugacccuucacccagauggggaugguugcccuuuuuccuuuucagguuuucuagacuuuacuaaauauuuucagacaaaacccaugggaucaugguacucagaugcaugcuguuuuuaaauuccuuuugguguuccccgcccugaacccauauuauucuccucauagauuguaauggcucaagggcuacucugcaagacaguauaagcauugcuaaagcucuggccuccaaacaaaucccaugaguccccauguaauuaccuugcuuuccagucuugccugugauguagauguuaauagcuuauucaaugaaguuaucauacuguaaaugcaaacuccuauucacagaggucucuucaugguuaaacucugccgauuguuuaguuuugaauaggugaucacccuacaccacagagugcccugucacuugcucugcagccaaggugggccuugcauuucuaucugagcauuacuaccauccccuugauaauguauguguggugccaucccaaccuccugagauggaguaccauucauuccugcccuuguaaaggaggaaugugagacaggcuugcacacacccguuaacuugaguaggcagacugcugugagcuuagccugaggcugaccacucuguguguaauaauggcucgcuggaccauagccucagcugcuccugaccaaggcagaacaucuggaacagcugcuguggagacuacaaauaagcaguuccuuuauguccucucagaagcuugccaaccuacgcgagcacaguagucacggaaucagaucuguuccucgcuugcucuguagccccugcuucagcguuccucugacgauggugcucugccaacucaccagucuuuauccaccucauccacaccacuuucuggugaaugggcccacucuuggcuucugaacaggcgacggugacucacuugccgucucuucucuuugcagaguacgcuggacgaugccacggaugacugggggaucaagguggagcggguggagauuaaggacgugaagcugccagugcagcuccagagagccauggcugcagaggcagaagccgcccgggaggcuagggccaagguaaugcuuucuguuugcguacguucugcuauuauuucaguuuaguuuucuuaaauuccacacucucucugaaagaguaaaauagccauggauguuuaggaaagccuugcccaucaccuaauauuccguuuccucagaggucaccauuuuaaacaggugcgugugugcgugugaugcguguguguguguguggggggggggguugaugaaugugcauuuuugagacacggccuuucugaaccaucuggugagacugucuggucagcaaggccccaggagccacuugccucccuccuccacacugagguuacagaugugugcuauguuaccauguuuuugcuuuugcaugaaggcuggggaauccaaagucugguacucaagaugguacagaaaacaccuuauccagggagccaccucccuggccuguacuugcgcuuuaauugacuagguuguugcauuauuagcacggguggaaccgcagugcacacacuuguaucuuagccuuuccacaugggucucaugggaacauuggucuauugaagcuguaucacugucucaagacugugagcuguaggcuuuauucccccgacucauuaguaagggcagguugacuuucagagcgcgugacagugcaucagcuugcucugcccauccguccucgauuucucuagccuuuucccuccucuuucccaccaggaggcucuucccuccugcugcaucuccuuccuccuguucauucccccaucuuucuucucucuccauguuuccuuucuucucaucucuaccuuuguccuaagccuccccgagugaauggcccuucugguagugcugaggaaauauuuauuaagcaaaccucaaaaaaacguuuccuguaagaugacaacaugucagaauaugaagauaucccaucaaacccaaggccuggaagcacaggcagaccucgucggagcugcacggggcuuugucucgcugcaggcagcccgugguggagggcuuugucucgcugcaggcagcccgugguggagggcuucucauucccaaggucacaguuuuccuuggggagcaucaguaaggacagagauuuccuguuagacgagugauucccugguacaaggaagaggccacacagccccacccugugaaaagcuagaccgguuuucauaggaggcuuugccugccuuugacagaccuccuaagccaauuugucaucaucaaaagucauaauggucagugacuggcggaccacagaacccucuccacuucauuggauacccauuuaagccacagacuggcuauuauaauuucuuagccagccaguucuaaauagaggaguacccuguugacagguugccuccggaaguuucuaucagccagaauuuccaugucuuccaaguacacuaauggugacauugcaggaaucucaaguguuuucuugcaaaucccucccuuucaggaacuaaaauauaugcaguguuauuaaauguuccccguuaccacccaauuauuugaaaaguaggaauugccuuuaccuuauuaugugacauuaacuagaagcccguuauuagaucauauggaauaauaaugucucauacagaguaugagaauuaagggacccgggaaucuucaccuucuauucccacgucggugauaaacuacagagcuguuuuccacugaguguaggcuugacauccagaccccuuugcggggcuccagauaacaacccucugcugcucggagauagcccuaaacaugaaacuuguuugccauccugcucagugaaaacugaagccugaaagagcugagugauuuccucaaggucccacggcugauuagagaugugaucgcuccguugcccccuucccuucccuucccgauuccucuggagccucccaccacggaccuuccaucacggucucaacaguugcuuucuucacuucacgacaaggagcaaagcuaaagaggccaguuagagugcuguccuuggaugaggcuguaagguuacaugagccuggcccauagcuguuugucuccaagguuaggcuucacacagugugaccugcuucagaaaaauacacuaguaaaugaaguaacucugaauucgcugugagcucgcauucaaguucucauggaaaauagaaguuggccgccucuucaguaagcaaguuacagagaagagagaguagugaggugacccauauacauggacuucagaguaaaagcccucaacuuaauuagccagagggaaacucaaauucaagccccaggcugaugccacaccagauacccaucaagauggcugaaaacgcaccaugaacuggagcccuguguucugcuguggggaugcccauugguacugccacuuuggaagacagucuagcaaaguguaccaaagcuggaugauggcagaaccuguggccauagcuccaugcucagcauggaccucacagauacacacucacauuuaccagcgguaugcccgggcagcaccucccccacccuggaagcauucugguccucauccugagcugaauagauaagggcauagcuauucauaggacagaauaguaugcagagaaaaugagcacagaacugcucgcaaacauaaucugagcucagaaagcugcucaaaaguauccaacaggaaggcacagaugagggcaggccucuagccacauuaccagcucucauuuuaaaguguguagaugaacucguggguucaggcuccagcagugaaacagaaugacgugugucagucgacacggaaucgcugcacauuuggccagagacccacccagcuacaaggagcuugcuuugcuugaagaugcucuccacaugcaagugucccagggcucugccgagaaaaaagccuguggcaucuugucaccucuuuggugguuugcucgcaguagcuuuuggaugaacuaaaugugugcccaucagaguggguccuuccuggaaggaaaugaauuaucugugguccauguccagacaauggugugccuaauuggauguaagagauggcacggaggagagugaggcugccacacacagcaggaguguacucaugcauucaccagugcuugccucagagcacuguuaccuaccugguucaguauaaugccugguacccucuguccuauuuaauaacacuacacaaggaaccaggauuuggacuuaggacucagauccugucuccuccccuuccuuauccaucauucucauuagaggcaggugggaucucugugagucugaaacuaaauuggucuacauagugaguacugcaccagccagagcuacauagugagacccugucucaaaaacaaaacccauauuauguguauacacacacacacacacacacacacacacaaaaucuguaucaguucuuggcuucuccuuucuauuccucuauaaguuuccacuuaaucaaucagaacuugauuccccuguuuuguuugccaucugccucaugaugauaccauggaaugcugucccauuucaagaguguaguguguuagcuacuuuucuguugcugugcugaauggccaaggcaacuuacucaggauuaguuuaucagccuacagugaugcuuuuaggacacgcuaaaaggaaagcguucucuaaauagaaggggauucuacggguguuucagaauuucuccuuaagucauguuuacuagacaugcuccugagugcagugugugcggcagucacucacgugucagugguugcucgguacuccuuaccggaaagagaaggcgugcaguacuauuaguuuuuauucugauagagcuaagagacuuugaauaacagguaagauggaacuuugguuggcugccaugcaccuccuagcaugcacacagucaguaugcugagacucacacgucauccucaucaaacaccaucucugaguuuucauuucaauaaagucuccuuucucugcuuucaaaggacuggaaauccaccugacuugcaaagggcuucuguccacacauuuaagucaguugcucgccccuuugcagugcuuuggccugcgccuuugucuggcacccuguucagauaguuuuagcccugccugggagacaaggcagcaguagaagagaaagccuagagccagacacauccugacacaauucaguuucaggaagaagagccccugggaucugagugucuagggauugaugggcuccuggcaagucccguaugcugucuuacucgaagaccacuauguggcaccaugcuauuugccagcugaucucuucuucccccugugcaggugauugcagcugaaggggaaaugaaugcguccagagcucugaaagaagcguccaugguuaucaccgagucuccugccgcccuucagcuucgauaccuucaaacccugaccacuaucgcugcagagaaaaacuccaccauugucuucccucugcccgucgacauguugcagggcaucauggguucuaaucacugagcuguccaggucuauggagagcugugcugaauccuucccaggguaaaguggggacaaaguuagccuuuaacucacagggagauuagccagaaacuugacugucccccucccucuucuuuccuguauguucacuagaggggcuuuuagaauggauagaaaucauaaaggcagaugagggacucacucuggagccaggaguguagcucaguagcagaggacuugcuuagcaugccuggacuuaauccucagcaccaaaacagagacauguuggcuuguaaauaacgagagaaugagauggcuggcuuaugcacaguucucuuacucuuuaaguuugcgucuuuuuucuuaaguaguugaggccaacuucugacuuccuuuaacucauucugaaccaugaaugagcaggcaagucagggcaagggacacagccuagacaugccaccugagcccagguagauguuccaugacacugaagaauugugccacccacuucucuggccaccugugcauucauucccuugagaggauauuuuggauuguuuuguuuuguuuuguuuugagacaggguuucucugaguggccuuggcuguccuggccuugcucucagagauccccuugccucuacccccgccccacccgagugccaccaccaccaccucgccuuaaggaaggguauuuccccaaaguucauccacccagucuaagcccagagcuuguuugggagggauccucuccuuccuccugcuugauccuguaggagccaacagagaggcccacgcugacccuuccgaggccgaaggucacuccugccauaguccuuuugaaaauaguaggugcacuuuuaaaaaaaccuucuugggccuccccucccugacuugaugaccccucuguguguggccuuuaaagcagcuaauuccugucacagaagugcucuuucucacuugugccuauucucauggaucagguuuuuacaucaucuugauuuuuaaaaauaacuuggaguucuaucaauaaauuuuuauguccauuugauuagcuuaaguacugaaguaccuuuaaauuuuuuaaagaaagcaucauacuuugcucuguacauacuauuaacuguuguauacugugguauguuuuaauuacuaacccuaccuaaguagcauaaggaaucccuaacacaagagcuugugauugaccugugcagacgccccugcugagcccuccgugcacagggagaaugcuuauguuugauucauuuugugggguuuucuuucucauauaaaaccaguagaggaucacaguuccuuauugugacauccuucccuuggccuggaaagcuuggugguggcuuuugcaacagcuugaggggggggggggauucuugacucagcuggaggagccuggaagaaugguucccugucacaguaguacuguugacaccugcccugagcuguucacugccaggcccacguggagcccaugacagacacucugucccuaagccuugagcccagcaggguuuucuagagguguauagagcacuuccaccuggacucaaguugcauuuacauuuugaguuuaaaaagauguuuuuuuuuaaucuguuuauagaaguagcucaccuuccacugaggaccaggaaacccuguguccugguaaaacaccuuggagacaggaaacaaugccccugguuuucuaaauuuccuguccagacaccaacuggccuuugcuucugugccuugugaauuaguaauccaguaggcuaaaacucagucacagggaggggaggagaagagcaagccuagaggaaggggugcuggugggaggguuuccacgcauuccccccuucagcuguguacaauaaagugcgugcccugugacccgacuc

SEQ ID NO: 782 - RNA, 1242 nt, Mus musculus
cuggccuguuugcuacuagggcagguuggugauucuccagggcagccauggcagaaccacagccggcguccaguggccucacugaugagaccgcuuucagcugcugcuccgauccagaccccagcaccaaggauuuucuacugcagcaaacgaugcuaagaauuaaggauccuaagaagucccuggauuuuuauacgaggguucuuggacugacccuccugcagaagcuugacuucccugcuaugaaguucucgcucuacuucuuagcuuacgaggauaagaacgauauccccaaggacaaguccgagaagacagcauggacguuuuccagaaaagccacccuugagcucacgcacaacuggggcacugaagaugacgagacucagaguuaccacaacggcaacucggacccucguggauuuggucacauugggauugccguuccugaugucuacagugccuguaagagauuugaagaacuaggugucaaguuugugaagaagccugaugacgggaaaaugaaaggacuggcguucauucaagacccugacggcuacuggauugagauucugaauccuaacaaaauagcaacgauuauuuaguuucgggagaaugugccuuugagguaugggggacagcgggaacaaaacggcguggaaaagaaacagcgugauucaagaugcugcggcgaccagaagcguuggggacugaugggucucucugcuccaguucaaauccuccugaaacccuuuucauuguccugauucaguggguuuuuaaaaaucuccccucuguuuugccaaccuaauuuucaaguagcaauuuaucuuaugaccuugacaaaguugugugacuuuacauuuaagauaauaauuagaacagcucccuuuagagaucacaguugcuacugccugucucuuaaagacugcucaagucuguuucugauucaucauuuagaauuuuguuucaaauguuucuuuuuggggucuguuaccuucugggguuucaguuccucagaaauaacuuuccauaaugggaaguacagagcagugaacagaaaugagauuuuuuuguguguacuucaaacagcauaguguuuaucuuacaaaagagaagguacuccugagagcaauucggaaucaugcugacaaggacacagauagaaauacuaauuuucuuuuuuucuuuuuucuuuuuuuuuguauguauaaaguacuuucagaauucaaaaaaaaaaaggau

SEQ ID NO: 783 - RNA, 316 nt, Mus musculus
acguuuuguuauauguuuuuauuguaauaaaaaguguugcccucuacaagucuaggaaucugaagggcuucuccaucucaugggagagaccugaaaaccgacaaagguggccuccagccucagucugaggcucacagaaaaggagucgaugaauguaguaggacuggggaaacuaagucucguguuugaggaagaugccgcucuucccaaguccuucccuuuccaagcucgggagcgagacaggagcgcaaccucuuuuacccucagccccacuauaaaucauuccuagccagucccugagugcucagaaacucug

SEQ ID NO: 784 - RNA, 23494 nt, Mus musculus
cugcagggaccucuccaaguuugucgggaccuucuucagaggcaguggugcuggcagccagggaggccaggacugcgcucaggccgggggcggggagcuggggcugggcccggggcggcggggccggagccucgguucuccagcucucccagcagccucugcccccaggacgcccgaggccccacucugcgccucucuucgcacugcgcgcccaccgagcccucccgcucccgggcccauguacuggaagcaugagagcgccgccccggcgcugcccgagggcugccgguugccggcggagggcggccccaccaccgaccaggugagcaagcaggcgagugggugagcgucggggauccuggggccagcgggagccgggauucaaccgggccgggucggguggcgggcggcagcaggaaggaggggugcugagugagcccgggagagugugucugcaagugugugagcgugcgagcgggcaggcggggguggggggucgcggaaagcgggaacacauuaugcaaauguuggaggaauuucucaaaaagcgauuuagcaaagacauaggcgaaucaagaggaggcgaggccaguauuguccgucugaauagacgcugauagcgccgaugcgccagagguugugccggcgcaacgcugaggaucucgaugaggggccggucccgggagcuccaagagucuggaggguucucuuuccuccuccaagaggccucucuuuucucuuuuuggccucauuucacucgccgaucucgcccucuuuggcuuggggcuucccuugaacuggcccuccaaaggcguuugaaucggugucaauauccccgcuucaauuucccggcgcgcgucgagcgggcggaugcuccuagcgcucuggguuuuauuuucucaaccaccaccaccacuaccaccaccaccacccccaucuccuuuuuauuuucuuucuuucucucuuuucuccuuuuugcauuuuguaccgagaguaggagaagggagggggcggagggagaaaaaaauucgauuuuuaauuacuaccauuaaaaaaucaaauuugcaauucuuugggcggccugauggaucucacugauugacaguuggaauugacacucuggcuaccucuuaucuugggcauucacgacaauuucuaauugcagguaguuugugugugugcgcguguuuuuuuucccccucagaggcuuggauugcaaaggaacuaagcgauuacuucaagagccacggguuaagugcagggagagggggagagagagggaaaaaaacccaauccaaauucaaauugcuucauuagagagacaccgcuuuuguggggaagggcuuuaaaugcccacuacaaaguuaggacucauuguucagcgccgguuuauauaacaggcgaggggaggcgcugggcucugacagcuccgagccaguucagcagccgccgucgccugcauucccucccccucccccaggugauggcccagccaggguccggcugcaaagcgaccacccgcugucucgaagggaccgcuccgccugccauggugaguccuuucgguccugcuuucggccccgaguccccccaacagcacaggccagggcuucuggcucagccuuccggcuaccaaccucuaccccugcgcuggaaaacugccgauaggagccgccucucguugagccuugguuuuucuggccuggaaugugagcuuuggcugcuuccugcacccaggaugcgcuguguuaaaaguugggggccgucccuucuucuccaauagguccuuucauucuuguacuccagccuagggcgcgacaucccuggcacauuucggugucagucggugcgcgaggaaaccagauucaacucugaguacucggcuaagcgcuucgcuguuccucucucccauuucaggcucagucagacgcagaggccuuggcaggcgcucuggacaaggacgaagguagagccuccccauguacgcccagcacaccgucugucugcucgccgcccucugcugccucuuccgugccgucugccggcaagaauaucugcuccaguugcggucuggagauccuggaccgguaucugcucaaggugagucaggguaggugugccugcuugcccacgggugugguuugcagccccaagagcuguagggaagcaaugaccuugccagguccauuuuccucggccucccaauccaaccgcuaaccgaucgcgcagcuuugggcaaguguucccaaacaggaggucuccuuuugccccgguuccaacaagagaaugcaaggcuguaucucaauuuccuugagccucucuguauuauagaagaaaaguagggaagccauacgccccuucugagcuucagugucucucugucucugcaaaugaggcuggggaggcugggggcgggcgugaaagaggcccgcgccaagccgacccccaccucugcccccuccccaggucaacaaccucaucuggcacgugcggugccucgagugcuccgugugucgcacaucgcugaggcagcagaauagcugcuacaucaagaacaaggagaucuacugcaagauggacuacuucagguaggcagcggccaucccgccagcaagcgcuggagcaugaacgccuugcacacgcgugccuaggccacuuguguggccugugcucuccaauuccugagcccugcuguucagagugcacaacgcggcucagcgcacuggcccggcccuccuacucagcacgucuuacacagaagggagcgccagucucagccugaguucuggcgggggaucugccucggguuccuccgaucugacaggcgcuggccacgggucugguuccaucucuggucuuuucuggccccgagcaccaguguguucuguugagcucugauguccgaggcucuggcccggaucauucggaucccgguaaccaucccguuccaucucuaguaagcucagcucugguuccaacuugagcuccaguugugccguacguagccuguccugggagggauccugaacuaggcucgggacucuccuucuagcuucgcucugcuuucaauuuugggcucagaucugcuccagccccaagugccaacgccacaucugacuccagcccuagcucagauccuagugcuuaguccuaagcaccaacaucgaucaaugccuucgccucgacucuugcgguggucgcuguuuaaaucuggagucacgccuugaccccaggcucccguuccuuccacugcugggacaccguuucugcccaggcuucagcucugccuaggucuagguucuaacuuugggccuccaggacuggcucucggagagucguguugcauuucacucacugggcuguauauacucugcgccgcggugcauaaauuguaaauccuguucaccguagcucacaagcuaucuucccugguuucaugguucugccugucccuagccgcucaauaucuugcaggagccuagcuucuagccacgcagcagacgccugcugacccggucauggggucuaggucaaggcagugccuaggggccucugugaaugaucugccagaccuaggcaggaagccgagagucugcaggagaaugguguagaauugguucuucagagaaagaagcaaugccuucuucuaaaugcuuucuccggaaguggagaaaguuacccugugguauacauuucuacacacacacacacacacacacacacacacacacacacacacacacacacacuucuuggagagaaguugugacucagucuuccggagaagaccucagccccagaaaacuuuugagucagggaauguguguguggugauccucacucaugcucuuugaagcuccagggcccuagaaagaacucugugaaccuaggaagaagugaguuagaaccuaggaaaccaggagaagcaugguuaggaggcaagcucuucaugucauggggauaggguacucugccugccgauccuaggacucugugaucaaagagcaugugugucuauaugguuuggaaucugcaguggcaaggauguguuacggagcaggaacaaggcacauggacaguggcuauguucuuuuauagaaaaaaaaaaaaaaccaugucuuucuauuucuguugugaguguugagaguauaggucuuacaugugaaugcugaaagugugugugugugugugugugugugugugugugugugugugugugugguuugcaaguugcucggaacagggaacacauacuugggcgggcaaguugggauaaaaagaugcuaacgucauucuccaccucugagguggugaaggguguggugcgaagauguaucuuuucgcugacaacuguuguauauguacacagacaaacagagguuauugcuugugugauguguaaccaggaguaugaagucuccuccuacugucuccucugauguuucauuggcuucguuuaggcaggaaauggauauuacaggcauuuucuagacaccuucuacucuaggccuaacuucgauuagagauugggagacacuguugagggggauccuuuuggauguggcagcugucaaggaccucaagauaguguccuuccuccaaaggauaaagcuaggcagauucgucccuuggcuuuucuaaugacaaaagcccaggcagccuuauccuguguccaaauuccuuuccauuuaucuccaggaugguugagacuccuugaaugauauaugcuuuaugagaccuugaaggacuagucaaaucuaggcucuagauucuaucauuuauagccuccacuaacuccucaguccacugcacuggugugguggaugccauguguagccaaccugggaagaggcaggagcuagaacucuguggggcuaauuaugagcuugggcaaaucccagcaucucugcccuggauauguuuuuuuuccaagauggucucucugaacugucaaggaggccaccaagagugggcaguccccacaaaggcucauaaccggcagugaauaugaaugcuucgguuaucgcuauuaugaucacugacagggugggcaccugugagggcauuuccacaggcagcuuggaaagcugaacccaccugucuagcucggucaucucuggggaaagguucugaccgauaaaccuuuuccaaugacagaucucaauaaauaaauaaacaaacaaacaaacaaacaaaaacaggcacuaaguuaagaaagaaagucaagugacuaaaagcucacuuuguccaagaugaagguagaauuuugaauuuugugaauuuuucugauccuuucucucccggccaggucuccauacuguaggcauaagucaucucuggcugacucaccaguaacaaaaauaauaaaaccaaagaaagggaaagagaaagccugcagagagcacaucaggcgagaaggacuauuguuugucugccugagcagcaacacugacucuucccagagagacugaauaacggugugugggaggcagaguucccgcucaagaacuauggcuuagggaaggccagcuaugcugcuccagaccucuguuuccugaaacagaggucaagggucggaugggguguggacugaaguauucugccaaagggaggcaagaucuuccaaucggguugagguuggugaggaagagaguggucagggcuccuaggaaggggcucucggacucccaagagcuaaccucugaccuuguccccacagaaggguuuuaucccagcuucuaucucccccucccccuucccuaacuuuaucuuguagauuuuuuuuuuuccuuucagucuccacuaguaagggguuggugguucagaaguuagagguuaggaagaaacuccaaguucaacagggagagaaguugcaaagcaugggguggggggaggugggggagaauugauuagucuggugcugcuccuguaugauuugcacuugguccccccauuucuggacauuuugccucuguuuuuccaauuuguucuccaaacggggaacucaccagccauugugaguucaacuugauucuaucuaccccuacucuugacaagucauggcagaacauaauaucacagggaaguaggauucauuuuuggagcauucguuucuccacugccaucagcaaacacaccccagggcaguuuuuuaaggccccuucaucuaccuaccuauagcuguugcccuguggccuucuggugugcccucuagacccccuuggccuccuacagcguugugcccauuauguagaagagaagaccugugugcaaggaaacaaaaaucccagggucauccagagauugagagcacagagugaggcuaccaaacccuuucccugcuguaucuuauaucuuauuuaauccugugauccacccaguaugauacugccagcacccucuuguuagaggaugggaaacugacacccugagggauaaggucacucagcuaaugaguggugaugcucagauaguccccacggccaccugacucuacaaguccauaugcuucuucuacagucaagcggugccugccacuuuguuguuguuguuguugauuugcagugguaaggcauaaagagugacaaagaccccucucugcuguuaucuuauccaguuuucccgauucacauagaaagugcccacuguaugcuuugaugugugacucuccauguguggcuccaggggcacuagcaccuaaagagaaaucagcagcuacuuuccuaagaccaaaggcccugguccucauuccuuuucucuuuggccaugggaguggggaacaaagaguucuagggguggggguggggggcuuuagaguuccaggacuagcugaaguucuuguucccugcucaagacacugggcagagggggugggcuagggggugggugcaagcccuucaggcuucucuggccuuccaccuugagaccaagcucuggcucuggacuuaagccccuuuccuuacagcuaggaucccaugggaggcuggagccuggaaguuagccccccuauguggagaggcccagcagcaaccagcuguuggggggacagauguuggggggauggagaggagaacugugaaagaaggagcucggccaggaccuccaggcaggcuugggcugcuguuuaaccuuuuaauugcugguucugcaccccuuuucuuuuuaaaguguguguguguuuuuuguuuuuguuucuuuuguuuuuuucuuuuuggacaggaaagagggagggacugggaagagcuuugauuccaguuuuccuuguuugccucaagaaaucuauaccucucugucuaguuugucucaaacccaaaauaagugaacuucuaguuccuuuuggucuuaaauguaggagaccccacccugaacuucguuuccccuuguagaaaggagcaauuuaguaggcggcagcgcuggggcggcagggcggggguauuccaaagggcucauuuuuagaggcucuuucacccaacaaacaauuaggagcaucuucagugagccugaccuggucaacgguggaguuccgccuacgaaacuggguguccggauuccugcucuuuaguguggggagaaggcuuguugguaucccuuuaacuguugcuaggauucacggugucugucgggcaccuuuccauucucaaagccauaggcccaauugcuuucugccuguggugugcugggaccccgguggggacaccgcacuaaauucagauuucacaguaugagugagggggccgguagaaucgucccccaaucccuuuggcaauucuuacacaucucuuucuugaaguuucguugucuccuccugugaugcugauuuucguugcuuccggaauggauggagcggcuggaguuucgcagccugucuggauaggaguuugucgcuuugucagaccuggauaguagcuuccuuucgcuuuuucucugugaacuauccccugucccgaggacacuuuguauguccagacacaauacauacaaacacagguaaugacaccgucaugccacguuuucuccagggaucuaacuagaugguuucauugacugggucaauuaccggcgcuucagcugagcaguugagacaauucagagggugagauaguugcuggcagcacuugcuuaggagcuagccuguguaggcaccaaagucggacaugcaggaaggaagaccagggauucccacagagauugggaucaggaaucccacggagucaaguauggaguauuuucagugcagaggaccacagcuggaagccaaaggcugcugcucagaaggucagcccuucccuucuccuugauccccuaguugaacuuuuuagaaucucugccaagagugggucaauacugucccucacugggaugccagguucucaucuucuccauuccaaccacuccuaagcaggcucuagguucuucagcaccucgaagggaccucagaucccaccacaugcucuauauugucuggaauaagucguuuguuguuuuugaaccucugacuccaggugugaaaaaugaguuuccgggucuguaccucaccagucuuagcaaagaugaugggggugcaauaaggguagccuuaacuaacaggaagccaaggcucugggaagggcugcuuguucagugcccugaaaguaccaaacuacaaacaacagagaaccagccucccagaggcagccagagagugguuccacuggggcuaccaccaacaaagcugcaugugcaugggggcaggggguuggcaaaguagucccaccucuauuuucugaaggacuggacucucccacaugaagucacagaaagaaucuauuuguguugggagguguuugacuaggcaaagggcugaagcucagggugagcaaaccuagaggucuggugaggauuccuggaccagaggagagugaccucucggaguuugugugagagcuugagcugauugaugugcugcauuucaacacacacacacacacacacacacacacacacucacucucucucucucucacacacacacauacacacucacacacacacacacacucauacacacacaaacacacacacauacacucucucucucucacacacacacacacucauacacacacaaacacacacacacacacacauacacacacauauaaacacacucacgcacacaaacacacacauacacacacguauccauccaacagccaauuacuugaauuugcuaaaacaggcaacaccaugguguaacugaagugaauuuugcugagcuguuuagucacggaacacggguaguguaaaugugcuuuccaguggaaaggugcuggcccuggggacagaaacacaaauccuuucuguauacuuaccccaucucuaagcaugcuaaggaugaggcaagucaaagauccagacacugaaagagcagcaugagauggugggaagacauguccagggaagaaauggccuccagaggccugagguggggaaaugcuggagguggagagaggaacaacugacugaaaaugagcuuccacuguggcuuaguagccuauaccaagucuagaguauaggguaggagaagauuaggaaagcgaugggucugagaaugauguggccuguugacuuuuguaaacccaaagcaccuuggacuaaacccuaugaacaguguggugccaccaaagacuauaaugagcucagggaacagaauucugugugcauggugauuuuuuuuuuuuuuuucugcuaacugcagucugggugaugcauugacaaaccaauccuggaaaguaagaggcaagggcagcugggacggugagaggagccugaugggaaccaggccaagcagggcagcagaggcgaugaagaggauguggugcauccagagacucacuucauuagcuggaggcacugcuggauagggucugaagguucugguaucugaguuggcgggcugggugagugguggcucugcuuccugaacagugugugcaagaggaaacaggguuaagggcuaggacagucacaggugagucagccucacaagagcaaccuuccccuagugcagagggccugacuugcacacaagguaaacuaggcucugcugcuuccuagagggacucccagucugaugauccaggcuguggcugccuacagccccuuacagaaaggagggagagaaguggaagagauagagagaccagcagaauggaaaaauaggcauaagaaacaggggacauuugauuuaagcucuuccuccucccccuccuccccuuccuccuccucuuccaguuaguauuaggaugucuugggugcuagaguucaggacugcuuagguucuugauugaccaauaggcacgaaauaaauaguagcagucaucacuguggucauccucacagcucuccaaucaaggaaaaugggaagucagagcaauucaaugaucugucuguguggggucacaaagcuaaugaguguguguagguguauucuaagaaaagcugagacuacagcuucaucuuuggagucaggccugcuggggcgggugggggggggggacuguccuugauguaguuagugaauguaugauguggugaauguaugauguagugaaacucauucugggucccgaacucccagauuuccuucucugcaaaacgagaauugagauaaacucugugaagcauuagaaucuugcaaggcaggugaugcucaaaacuuucccugcuaggaguacuguuguguuuuccuaacaccugugguauauucuaaugaacaaauguucaacuacaaugaaaaauuaugcagauauuaagugguuguuguagaguauuugaaaaacucagcaaaagcaagaaggaaauaaaaaucucgcucccagucaucuucuuggugggacuuggaugcacaggaguaauggauucaaguguaagguaaugugggggagugggugccaggcgaacccuggacgauagagcaggauaaagacgagcccggucuaaacauuauuuuccuuguucccuuugucccgcagccgauuuggaaccaagugcgcccggugcggcagacaaaucuaugccagugacugggugcggcgcgcacgcggcaaugccuaccaccuggcauguuucgccugcuuuuccugcaagcgccagcuauccaccggugaggaauucggccucguugaggagaaggugcuuugccgcauccauuacgacaccaugaucgagaaccucaagagggccgccgagaacgguacccaauccgcccaacccagcaccuaaucccaguccuuucccagguucccuagcacccaaguucgugguccgcacaauuguacuggcugagcggucccuggaacaccuggaggcagcaucgggguggggcuacacguggaacaugcgcucuggcuccaucauuugcaugggcuacuaagucacuaccuaaccuuguaacaaucucacauggcucccagcggccuacaagcuccgcuaacccccaccccauucugccugccagcugccugagcaguccaagagauaagauguagcccacauucuucccacuuccuuaugggccacacaaagccagaggcuaagggugggucaucuuagaucugagguucugaacauaaaaauuuuaaagggaccagucccccgagucuuggagacgcggcuuuaccauacaaugucagcaaaugaggauuucuuuuucucauugggccucccucuucccguccuacaucugcucaugauaccuagauguuggacuagaauguuccuugaaucuccucuggcucuggcacgauuuucucaagacauuuauccuagggucuuggugaaauucuucaaugcugugcgcagugggggugagaggggcggagugguguagaagaggaggugagggaauccgaauccuaaaagggacuggagcugugggcagaggcagcaacccuucccaugguucugcugucaggaucuauggauacugcuaacuucccuggaaugugguuggauguauaaagccuuacaagcccuuuuuaggagcuuugugcuauaucccuauuaguagcuagaaaagcggcagagguuauuugcaguacguaccuugucaaagcuuacaucuaguaggucuguucggaagcucaguaucuuaccuaucauaauacagaacacuacacacagcaugcuauauccccuuggcuucaggaggcuccggggaugugguugccucugaguuucauuuuuccaucuagaaaacuaggcacacuaacuguuauccugccugcuuuucuaggaauauuaaugucacacagcuucucccuaccucaauuucuaggcaucagugggagggcuaguaaggagccaaaaacguguuaguggguauguccucaccaaggucaucauuuucuccugcuaggaucaguagcuaaguagggagcaacugaacuuggugcacgcugaaguugccuguguugcuuggcaagucagcagaagaggagggcucaggagucagagcuuccucuccaccuugguuaaucaguaaaccacagccuccuuucacuccuggaccacccagggccaacauuagccauggccuugccaaagacagccuauucagggaaacuugaacgccuggggcuucaggucacugaccgucaucagcauuagcuauugcuuuucuuuuaaacaaaaacaacacacacacacacacacacacacacacacacacacacacacguucauuauagaaaaaugaggaggcaugguuaaagaaaaaguugaaauuauucugcaugucauuaucucccuguuuacauuucuauuuuucccuuuguacauguaguuuuccccccuuucugcauaguuuuccccccuaauuaaaacauuacagcaaauuguaagcaguaguuaucccugagugguggagucacuggugacuuucucccucuuugugcuugucagaaucgucaggcuuuugguaagaacaguguauuauuuuugcauucaggaaaaacgaacugcuaaaaugggaauauauuugcuggauuacaaucauaggaaccaaaguauuauaaaauggacaggcaacacuuaagauauaucccagucaauaaaauauacuuuggagaagguaaaaugcaauuguuuuaaauacgucaaacguugcugagguggcacaccuuuagucccagcccucuggaagcagagucagguggaucuacgagucaaaggccaaucuuaucuacauacagaaagaguuccaggacagccggggcuacacagaaaaacacuguccccaaaaaaauaaaaaaggggggggggaaguuauagcuucagcaacccaugcuguuguugcugcugcagcuucuuuuccuccucccccuuccucucccuucucuuccuccuccucccucuccccucgcagcccuccucucucuuuuuaaaucuccacggugauuuccccccagcucagcuaagacagagguuagggucagcucgguuccaguucagaggcagagcauuugggguucccagucaggagcuuuccucucuccgcuccuuaguuuccucucuuuaaaaaaaaaugggugauaguauagaaaggaagcucugggcucggggaccagggcccugggauccccgcucccagccacucgcuccugacccuuccagggacaagcucccccccaccccguccuuuccaggcugccacuagaagagauggggacgcguggucagccgcuucugucgccccccagggaacggucucacgcuggagggggcagugcccucggaacaggacagucagcccaagccagccaagcgcgcgcggacguccuucaccgcagagcaauugcagguaccccgggcaagccccgaagcgugugggcggggcuucggagugggcgugguuguucgggacuugugacuccgccccuugugcggggacccgcgugaggccgcuccaaggaugaagcugccuggggcguggccucggacccugagccucugauugggcggaggucucagggcccuucugcgccccacagguuaugcaggcgcaguucgcgcaggacaacaacccggacgcgcagacgcugcagaagcuagcggacaugacgggccucagucgcagggucauccagguggggcuccggggucucggccuucaggucuagggugaaccuuagggaagcgcugaagcucguagugguacggauggucgcgcgugcacguggccgccccucuccaguguggccuaaggaccccagucggcacggguugacccuuuuccuugauuacugagagugcagaggcugucguuccaggugugguuucaaaacugccgagcgcgucauaaaaagcauacaccgcagcacccagugccgcccucuggggcacccccgacccgccucccuucugcccuguccgacgacauccacuacucuccguucagcagcccagagagggcgcgcauggucaccuugcacggcuacauugagaguaagugaugcggauucuggggucgccagacagcggggaaggggacgcugaggccugcuccugggcuccauaugaggggcgggggaccccagggggguagccugguggauaaaguugugaagcgggucaguuugucuccuuucuccagugaaucggggcccuugguagagggaaccaauaguaaaacuuaaagcagccagugagcaugugcgugggaugaggggucugcguucugaugggcaagacaguuuaggacagaacccagguguacguaugguuuucauugcaaugauuccuauaggaagagugcugggugggaguguccggagaugcuggggucugaggacugccucugagcaagcugaacucugaaggauggggaagauuuacugauguacguagccuggggggaacugaaaagugggcaaacccugacucagaaggcauccucguaugggugcguuuggggagcagaggccacgguggcaugaccacuuagggcugugagaccuuuggacaagccacagaauguccucgauccuauccguuuccucaucugugaacuagaauagugauaaugccucucaaagaauguuaagaauugauugacaugggcauccagacucugaguacuuccuguguucuuagcgcugagauacaagagucaauaaaugggucagauuugcauuguuccugggacucauucacauuccaauggagagacaaauuccucuguuucagucugucugucuaucucucuucuuuccuccuucccuuccuccuuccugaaacccacaucaugauagcaagugcugugccgcccaccaagcuauggccucaguagagacaguaagcauuagaggggugggugugugguggugaaaugaccuugaagcuggaaccuggaugagugaagaguuggcuuagauuucugagacaagaggagucagugagccagcuacugagcuuaguucaaaaucucuuucccuuuggggucauuuccucaaagcuggguaugaccaaaagugugggguggggaacauacacacucauacucucucaaacagucaucuuaggguccaacuaaaaggggauccaauuguuacuuaaggggauccaauugcuuugugcuagaggugaugccgucugagucucuagacauuacauagacuaggaaacuaaaggguccacuguaaguuccagggacucuaaugauuacauuugggcugugguguaacuggcagggaucaaaucccacccuugccacuucgaagcuuggugacaucgagugaauuucuugaaccaccaucccguuuccucuucuguaaaaacaaggacaaugagaguagucaccucagugcaguauugugaacaucaccgagauaacuggcuuaaaggucccauuuaguacauacaagccuucaaaggauuagcugcuuugggaugugcuguggguucaguuggcagagcagggagcaggguccugucuacugcgucaggcugccagcuggaacuggcuuucuaggcaguuccauuucugaaccuucagcucaucaggagggacgcuuuuccccuuuuguuucuaaacaaugacuuaauguucagccugaauagaaccuauuaaauacuuacugaaagugccaaagacuggggacucucugguuaccaggggucuuggcagccagcuaauacuugguaugugguugguuaugggucuaggugacuucuguugagaguaggaucaggacucuguuuauguacucuguugaucuagccuagaucucucuuugcuagagcaggagcucugcuuuccuuccgucuucccugggagucagaacgcaccucuguugugugacuuagaggacaagccagcaguuuacuuuacagugaacuaaaagcaagguguuuuggguuuucugaaauauuaaagcuguaaacugcauauaggguuuagaaacagacaccagggguagggcugaaggagggugcccuuccacucuuugcagucaaugagauucagugcuuagaaucugauuucaaauaauuaaaaaaauaaaacaccaccuuuggagccagacucaaaaaaaaaaaaagugcagaguuauuugaguaauuugaagcuguucagagauuucuugaacacccagggaguuaagaauccucaauuagauacaauugccuugcccugcagaagagagaacagugucucagaaaggcacagugacuugucccaacucaucacuugcaaguaucugucuaggcucuuucugugagcaaguaagacagagucuagagaagagacaggcaaaugaguccuuagcuggagugguaaggaggcugagaugcaagggauuuggaucggaaccaacgauggccuuuccucaccaggcuuuuguuguugcuguuuuuguuuguauauuuguuugagacaagguuucucuguguagcccuggcugucccagaacuugcucuauagaccaggcuggcuuccaacucaaaaacccuucugccucuuugaccagaguacugggauuaaagacacgugccaccacugcucagauuuccucaacagcuuuagauguuggaauaggguacagaaauucauucaacaaauauuuauagaguauuucgcagggacuuggagagaugguucagugauuaagagcccugggugcucuuuaagaggacagggguucaauacccaaaauccacuuggcagcucaaaacugucuauaacuccaguucuaggggauccaguguccucuucuucccucugugagcacaagccauguaaguggugcacagaggaaaauugcagacauacaugcagggauacaugcgggcauacguguggacauauaugcagacauacaugcaggccaagcauccauauucauaagauaacauuuaaauuaaaaaagagugcuuuguauauuccaugccucauccuaaguacuagaaaaccagaacgguuuggggaagaaaaaaaucauacuguuauagagccugcauucuaauugaugaagagacagauuuaaauaagcaaugaaguuauauguaagucaggugauuagagcuaaucaagaaaacacaaaaugcaggaggagaacagggacuguuuguugggcugcaguuaugagcagggcagugacacauaagaacaggauguccuaggaggcagcugguaagcugucuugaugaugcucuguagaucagaacgugaggaugagggucugaaugggcgggcacauccuuguuugcaggagaggguucauacauauaggaguguggacuuagcagugagcugugagcaccugauaaacccuucaaguguguagcacuguagccagcucaggugagaccuucgauagggccacccaggcagcuagcagcagaaauagaacuccaaguuagugaucagagcacgaaacagguggggauccuguguggagccugggggaugggcuccaaggcauccucucguccacaggucagguacagugcgggcaggugcacugccgacugccuuacaccgcgcccccuguccaccucaaagcugauuuggacggcccgcucuccagccggggugagaagguaaauggagccuggcuacgucuggugggucagagccuuccugcugggaacggguuucuggcagcauucccuaccacugagugguuaccaugccacauuguggcagaucacucaggcccccaguguggccccaaggcagucaucagagcagcuacuuguguguuucaugugccugacuucucugaaguccucuuuguagcccuguccucccugucacuuggcagugaggccuucuuauuuacauaugcuuugagguucuggggaggguuuguaucccacaccauucuacuuaccuguuucaugggcuuuucuucauuuguuacugucuggaacuauuggcaguaacuaucuagggccaguaggucccagggcaaacagguuucauguaacugagggucaaauggcaggaccuucucuguggaugugaaucugugguugcuccaggcaucaauacugaauauccuaaaggauacauaagugucacccagucuguggcuuuguuuaauccuguccauaugagaguugaaaguagccgagucugcuuuagguauacccaggaguggguaugagccuuaucacuucaguucugaaauaccacaaaguuaguccucaaugccauuacucccaaacaagucuuuauuucagauguggagaaacggagccugggugaggggacagugaugggaaaugaagccaugaggaugcuaggggggauaugugugugggagguggacuuuaccaggaagcagggacguggugaugguccccagagaagcugagcaggggggaaacucaggagaagcagaaaacucugaggugcuacugcucuuagcagcucuccacuccagcagaucucagucgugaugcacuucagaaucccagaggcaguuugggaagacacagauccccacgccaggggagaugaggagcaacagaggccagccugaguagcacuggcucuugucauucugaaggguuccccagggaagagaacacuccuucagggcagguucucugccauugcuuucugaaaccugcugugugcagagcuugcuagguagugggcaccaugggguaagggcuggaggauggagguccagauagcccagugggacaguaugauaauacugcaugagaaucuggugggcgggcgucagguggacacucucugagcuucuaauccauagugagaucugcugauugcugagcuccuucucaguuugagguuggcacuuuacacacacugggugacacuucccagccuccuuugguguggacgugaccuuuucauuauaaagacggggaaacaaacucaagagagguggugcuguucgucugggagugucaaguacugggaucugaagucugcaugguuuggucauugcugguuuuguuuuuguguggcacuuugccguuuacacaguacucucucugaccucaucuuucuuggccucccuuaggggccuuauaaugcuaugucaagcccauagaaacugaggcucacccaggccacagugaacguggcagaccugacuggcauccuagcaccacugacuugaagcuggggguguuuguccuuugagacccaacacugguacggaggagggagaguacauaaccucuaucuuccuucaagggcugugugguuuagaccagguuugggguaguuacacuauagagugauggaguagauagaaucagggggauucagaagaggguguggcaagcucaaggggagagacaggaaagagaaggauguccaugucgaaagaacagcugauacaaaugcauggaggagccagagauugaaggaucucugauguucaguguggcugaaguccagggagguagggagaacuggcagcggccgugucacaaaaggccuguccuguggagugaaggguuugagucaggggagccuugaaagugcauaggguugggcucagaggagagccuuuauuucucaggugccuaacugagcugugauugugucugguucagccugaaagaugcgccaggcugggucauggcagcuugggcucuagguucuuggccucuggguuugcuuguuaagccagaagcucuguugcugggcuauguccccagcuuuguugccaggagcucuaugcccuucccucaugacccacugcccucuucuguuggcccugguugccagucccuaaguaccucugccagccacaucugaucacaucugcaugugagugaggucuguugugucagaaguguggggcagaacauacagcagaggaagguauuagcuuucucccauguccuucugggaaaccuguggggagauucagaguccccacggggcucaucuagacuagagcaggccucgauaguccugauagcuggagcaggguggagcuuccugucuccaugacaacauuauuugaccccacagaccuguuuuguuuccagaaauacauuucuuucugguuauaucccuggaucuuacagcuuuagcauguaaaagaagggucuuagaaguccggcuaggcuggccgccaucaggugggaagaauguagcacccagaagaggagagucauuuuuuaacaagagcucaaagccaggugcccuucaggcccaaagggaagcuauauccaggguugggugaagaaugcuggagucaggccacccagacucccagaucugucaccuccuccccuaagaucuucgaguacaaauagcuucuugcaacuucaguuucugccuuugcuaaaugggguuauaauaguuucugcccuccuacaauguugaaaugagaagcaauguguaugaagaguccaacacacaugccuggugcacagaagguacucaguagcuuuugcuuaucaaugucuucucaguggcucucuguauauggaggccauggaugccugaaccccccuccuauauacacauauacccaugauaaagcacaauucauaauugggcaagucagggauuaauaaaauggcaaacaacaaaucagcacaguugcaaugugcuguaguaacagcgccacccauguucacgggguccagagcgaagcacauggugggucucugcugcugcucuugcuaugagagaucacuauuuacacaugaggaaacaggcuuggggaagggaagugagcugcccaagguuucacagcauaaacugagaacugggaugcgagcccaggucuaagcucugagcccaucauucuucuccaggucugacggucccccagggcugcugcauguagaaggcaccaguuuagacaucuccguugcccuuuucuugcaggucauccuuuuucaguacuaacgcugccggcgcuugcacaucuguccaugggcaccacacagcugccccucagccgcugagauccagcauccagcuguggccagggauccaccaccucuguguacacccucacccgcugcuguccugcccucugccaguggccccaucaacccaggccuggucuuucccucuccugcugagaaccagaacccaccaggagcagcagagucccucucugggaaggcaggcucccugaaauguggcaucagcaugaaaacaagcagccugucuuuccucauuaacugggagucccacuuaccuacugucagcugaucacagcagcaauggcuaauucaguccgagucaacaacagccuccuacuucacagguucucuucucccccacauuggccuuuauuuacuacuuccuuggaaccaucuccaaauuccaaauagccaacaacccccaacauuauauacucugcugcuuuugucuggaaaacucuacaguguuugugggauauccccaaaggaaagcuguguucuaauuuuaucauuuccaucugucugguuaugucaaguuaacucagaaaaagaagagacacugaccaacccugagaggcccaacagggcagagauggaggccugcccagaugaagaggcagaggaugggcagggaugggugccaaagaccccccccccaauuggcuuggaggagaaggacuggguacgcuggacuuggagaggugacgagaguuucauggagagaaaagaggaaacuuggggggggcggaguuucccccacccaauuaccuagcaggagucguggaaaggauggcgucugaucugcacgaugacaccacugaauguuuaggugggcuagcauuagcgacccuuguuggccacuuuucaguccugagaugagggccugagccagucuucucuaggggugggaugagacuacucacgaggaccaaggaacagagcccagagaaacagcagccagaauauuaguucugauucauccccgagggaagagagguacccauggcuucagugagcacaugccaagcccaggaugccagcuggcaccucugcaaucuccccaccaaauacacagagccagcucuacccacuccuaagagcagaggccaacucuaaagaaaggucucagguuacacaggcccccccacuuauguuuucaggggaugccauuuaucccaagcuuauccuguaauucuagaaugacuugguguccugaugcacuucucaccagaggcugccuagcagcauguguuagccaaagucuuccuccuuguuuugagaagacuccaggacaggacaggcaaauucaugguauguaugcaguugcugcuccugcuucaccuguggcagacaucgcuaaucgaucacagcacucuaucucucagagucuggauaagaauucccaugcuuguugggacgagaccaacugugcuguugcuaugggaccuggaggaggguuaggcaugggugacaccccagaagggaacuuucaucuuuucccuuccaaaaauugucaacugacugaggacaaagagaaagcaccucccagaaagcugugagcgugguuugguucagaacuccagcacccugugccaggcacugacucaagcaagaggaaccuggccugaucccugacuuuggggaacccagaucuuuccuuugauuuuugcuccuaaugaucaaaaccccaauugcaaccauguggcaaguggccagcugagcccagguuacuugguacccacucugccuugagccuuccuucccccagggccuauuucuuguguggaucacguggcaguagcauguugcagucagacgucuccacuacccuguugagaacagccugggaauguacaggucaucgaggcuauuuauuuaaacacacacacacacacacacacacacacacacacacacacacacacgggggaacacacacaaauggaaaaaaauuguaagcacuuuuuuuguaaaaccaaugucuguuuuguuacauaccuuucauguugugcuuuguaaaugucuuauuuguguaauaaauaaaguuaaugcgaguagaagugccggcacuuaaacccag

SEQ ID NO: 785 - RNA, 21849 nt, Mus musculus
cagaggugacaacuggagggaggaguggggguggagccgugagaugggugggaggggaccugccagugcuggggcagugcuggaguugcacccgaggagccagccguuggcauugcacauccauccacucccagagucaugagucgugaguccgaccccaguggugcccccacgcgucccggaauucgguggccugcaggcggagccuugaacgcuaggcucaacucucucuuccuucugcaggaaggagucucucgcucugguuuccccugcugcugcuccugcugcugccgccgacacccucgguccugcucgcagauccuggggugcccucaccagguaggugcccccgccggaugcccgugaaaauuccaaguccugcgccgugggcuugguccaucucccuuccaggcggacucccugauuccccuuucugcucgcggugccggggaauaggguguugagguuauggaauggggucccuggagaauggcuagggccuaccugggaucucucuggcacacagcccacugagaucccgagucggcaggggaagcagagacagguucuuuaacuucucaccugauaugugguccgacuuuccaagcagccucuguacccccccccccccccccccccagaacucggcgguuuccugugggggcuccuuggggaggaagcggcagacgccaaggggaaggcgggcuggacacugaguuccuuuucuuuggccucuaacuuuuggggagucuaucuuaacgcucaaccuaucuccccaacgguagauacagggaugggggugggggacaccagcuauccugggaauggggaagugggcacauagugaccaggaaauugagguucaguaggugcgauaacagccccaagucacauaaugcauagugggcucaggguuugaauucaggaucagccuaauccagucacucucaauaccugcagugguucaaagaagccaguucugcaauucugucccgcuucucucccucagggcagaaccagguucuaggaaagaaaaauaauuuacuccccgccccccccauacuuccccugcccuccaccuuuccuuccucucuuuacaauuuggaugcccaucuguaaaauggggccaagaaagguuggcagugggggaaagggauacuacaggaccuuggaacucagaggacagaguggccugagaaucacagcaggcuuccuggaggaugggguuugagugagaaaaagagcuggggacaccugugcuagaaaggugacagucuggguuuuuggaaaggaagccauuugugauccagcacugcaguuuaccaagauuagcugugcgugccuuuucuuuggugcucacagcagccuugugggaggcagaugcguuaaguccauuuuguagaucagaacuuugagaggcucaggaaguggggccacuuguuggagaccccacagugagcugaugguagagccaaggcugacauguuggccaugcugacuuucaguuucagcaugaguccagcucucaccugacccuccacccuuugaggauccgguguucaugcaccugucuuccuugcugggauucuuuuagggaaaggguagaguucagcuuggagggcaaagcugugccagggaauccacaaauguucaaguucaucccuuccagacccuggguuuggcuugguguccucccuuuagccugggaguaggcaugacuuggugacccaagcugcgccugacuagagccacgguguccccuuugccuauagucauauugcaagugcuguaguggaauuuuucuguuuugcauuccaagggcuuuuucuauuugagccuuuggcuggggccuggugacacagaggucacagucugauguggagugauguaggugcccagagugacgcuggaguccacagucugaugguggagauaggcgccagcauguuguuaaguaggagagugagggcuguggcgaagggugagagagaaguauaaagaugucaaagagggaguauugacccuguguugguuaggggcugcaggcugcuuuaaaggaugauggcuuuugucucucauugggugggggggauggcauccuauuugagcucaaggcugugugcuggggauuuauaguguucaaaugcuugccuuccaguguguguguguguguguguguguguguguguguguguguguguguguguguauguauguaacagguagcucuggcuguccuggaacucacuauguagaauaggcuagucuuuuuuuuuaauuauuauuauauauuuucuuuauauacauuucaaaugcuaucccaaaaguucccuauacccucccuccgcccugcuccccuacccacccacuccugcuucuuggcccuggcauuccccuguauuggggcauauaaaguuugcaauaccaaggggccucucuucccagugauggccgacuaggccaucuucugcuacauaugcagcuagagacacgcgcucuggggguacugguuaguucauauugcuguuccaccuauaggguugcagaccccuugggugcuuucucuaguuucuccauugggggcccuguguucuaucuuacagaugacugugagcauccacuucuguauuugcuaggcacuggcauagccuccuacgagacaccuauaacagggucccuucagcaaaaucuugcuggcauugugcaauagugucuggguuugguggcugacuaugggauggaucccgggugggguagucucuggauaguccauccuuucaucuuagcuccaaacuuugucucuguaacuccuuacauggguauuuuguucccuauucuagaacaggcuagucuugaacucacagagcuccacaugccucugucucccuagugcugggauuaaauaagugugcaccagcaugcccggcccauuuaugugcccagggagagggcauggccuggugaguagagcugugaggcuaggcugacuccugcacguggggugagacuugaacacaggccaaagccucccugugucuuucucggcuucuccuaucuucagccccagcuagguaggucuguguaccuggagggccuuacuuuccugcuagagguggcuacuugggccugccauggaggugucuacccuggaucugccuacaggcauggugucagggaggacccaagucuggcuacucgggcuugcuuuccucuuggacgccaggccccuggagcuucuguaaauauuauucuuaggagauuuggaugcagccucuucugccugauguuguccacacauccuggagaacucaguguucccuagcuguaaccuguucuaugcccugcuuggcugugaguccagauccccccaaccuuugggcuggaggacaucuuaccccaaucuauggauggguuuuagagucgggacaucuuggucagggguuaucugggggaauguggguuggcugccuugaccuucaggucuguguuuugcagcaccaugguggcaguccaucguccugcuucaugaguggcuggcgcucagugggaauggucgcaggguucugggcugaggguaggagaaugauggaaaaaauuuagaggcccagcuuggcuuucccuagaguacagacaggguggggagucccuuugagauacccgcucucccuacuuauggacuagacaggaaaacaaggcccuaaguguggaaggcacuuauuuaugaauauggccagagacagcaucacuucccaguucaucuuuccucuacucuucuuccuugguagcugacuugugcuugaacgugggucacuggaauuaaauuagacuguaugccuguaccuccuagugcucuccucagauggcuccuuaguuccaucaagaaagacagguggucucuguagagaagaccucucuguaguuagccagagagcuggguagucucaguagagagaucuccccugcugcuuagaggcgugggugggcauggggaucaugcagaggugaagccagaguuccuguugaaugcuggaggucggcuucuggcaggaggcugaggcacaguuucucacauucaccuuguuuacaguucaccuugaagaaacagcagcaucuuuagccuuuggaucaucaugacuguuguauccuuccccuaaagccagccccagacaucccaagaugagucagacagggugagggaaggagguuuacauuuugguucugcagccuggaagcuguggggcuugcguguaagccucuugccuucccugagccuagacuuccuccuugugcaaugggaggcucacgugcgugucuuccugcuaggugcuggaugcucagucagugacagccccauuccccagccugggggccacagucagcaugaccacuggcacccggucuccucuccacacacuuucauaucccgaggagcuccugugguuguugucccugcccaaaaggacuuuuccuguccuggggcagcugguguuuauggaaagaaaguugggaggagggagggcaagcuggccacaguuugguugggagggagggagggcccucuuuuggauugagguggggcaugacauccugaugacaucaggaggccucacagcuugccucagggggcugcugggaggaugaaagcuucucucuggccagcaggggauggcuagucucaucacgcuauuuuguuaguuccacacacauuuguuaagcuucggucacuagugguucccugaaagcagaugggccaagcccaggcugugagcccagcccaauggggagaugaaugucugggaagguguggccuucucucaggguggagaacagagagcaagacuuggagagccuugggcaaagggcagagggcagaacaggauuccuuggggggaggcuggaagaugugugaaggagaaauauaggcuagguaaggguggggugagggaggguugcuguagccccuuugagauucagaacccuugagacuucugcugacgucgaaguaggaaacuggggccaagaagagccccuuccuuccgucucugccuuuugaguaguaggaguguaucuuugguaagugagagcccuuaggcuggaguggaagguggggguggcuaggcucacagcaggugagcugaacuugaucaaugaucagagagaaggguuccagaccugccaggcugaaaguggauccagguaucuuugaucuuucugggacugugaugagcugggggcaaauuuggggacggggaccucugggguccuggcaagucucaucccugggucuuguugccagaucugccugugcagcuuggaaaggccguuuuuguccagccuucuucccccuggccucucucuucuauacuucugccagagaucacaaaaaugccauugugggguuguucaaagucaccagggcuuaaacaaaacuauuugcaugcauggcccauaugcuuucugcugguauguguguggcgauggugguucugggggcaucuggaggccccuggagguggaagggagggugcuguacugcugaagugagccucugaggugaguacacaggccuuccaauguuggccuccaugacuggccaguucaugccaggcuacuccgacuucuugccacccucuugacccuaaucaucacucacacaaugucaaagcucccuaugguguuggcucuaugcccagaaagagccuuguucacagaaaggauuuugacguuucuguguaagccaaagcaagguaccuccugcccggagccaggagucugccagguuuugcucugcuuuuggcaaagccucuaucucucccugagccccaguuuuccugacugagcaguacgcaaaggcagggcuagaccuggaugaauugugugacuguuuaacuugguugcugaagaguaccugaggccacagagauauagaaagagaguggcaguaagaaggaugggacuuagacacagggaggggcuuuucuuguuggggguucuaugagguaggaguagggaggaagggggugguggaugcaagaguucacguaccgcugucucagauuuuccagccaggcuucuugugauuucucuguguuugacuucuucaagaucuuaggguauagaccgcagcuccacuuaggucaagccucugcuuuucagggcagcugagaucccccuccuggucucuuguauuuuauccuugguucugcaaagccucuuuccuggaauugauugcugaguuuggggaggagggguggagaggaagugaagacauggacaguuggccugauaugaccauuuccuggugaccuuuucuggccuuauuuuccucaucugcaaagugggcauaaugaagccugauguccccucccuucugcagaaauggaaggcuaggcagauccuguguuucuaauaucugggugcucacaaccuaggugcucaucugguagaaaccuucccauacccuggccuccucucugaagcccacaaacauggcguuugugguguuugccacuaggcucugccaaggcaggaaguggggcccauaacacauugucuuaucagcuguuuccuagcuucagcuccaccagcuuggcucuggacucuuucucugacuauuuucaugguagcagggagggauugagaacuuucccuugggccccuagcauggauugggcuggagguccagggcagagggugggguuuccgucuaugguguauggguggggcagggcaggucaggaggcuacuugaggguaucucuaauacuuguuucucacccacagucaaucccuguuguuacuauccgugccagaaccagggugucuguguccgcuuuggccucgacaacuaccagugugauuguacucgcacgggcuacucaggccccaacuguaccauccgugagcaagacuccaguccccaacucuccugcucccugagaucaucucuauacccccacaccugccuucucugaccauggcuucuuuucccuccuugucuggcuuugauccauguucccacgugagcucuuuacuuaguccccucccacccugugguaguucuucaugcucggugucccuugucuuauucuggguccuggcucuuucauguguuaucacuccuaaggguacuuccuauagacuccuguuuggucccuauccucucaccguggguugcucaggucuuuccagaagggauggacucagugacucccacuuucccugcagcugagaucuggaccuggcuucggaauucucugcggcccagccccucguucacccauuuccugcugacacauggauacuggcucugggaauuugugaaugccaccuucauccgagaaguacucaugcgccugguacucacagguggguguggggcuggccccucuaaucuggagaaccuggcauuugauaaaagcaguggguggagaaacuaagauuuccagauaaaucaagggcuggcaugggaggaggcagggaagugggguguaacugaugugggaacagccugucauuauuuuuguucugcagugcgguccaaccuuauccccagcccuccgaccuacaacucagcgcaugacuacaucagcugggaguccuucuccaaugugagcuacuauacucgcauucugcccucuguacccaaagacugccccacacccauggggaccaaagguaaggaaggggcuguggcaaggaacuagcuuggguuuuccucuucaggcagagcaggcaggaaagucauuucugacccauuuuuuagauggguaaagcaaugcaagacagcaugucuaggaucaaggaaaggcagaaaaggcaacuaagcgucaugccuauggugacaaagaaagccagaggcagaggcugacuaugguuaucaugguaccccagggugucugucugcuucguccugaugaaggggguuauguugggugguuaacuugaagcugaaauggaagaaggaaggaguaggguuccuguucugggugcuaacucagcuugaugcuuuauuacuagaguuuccaggcucuaccaagccugggaacaaagagugucucucuuuuuuuuuuucuuuaguuacccaagacccauuuggucucuugggcuuccuuuuuacucugucucgaacuauuuagagaccuuugugguuacccaguucagaaccaaccauauuugccauagauagggacuggcugcucaauccagcggugcuguuguuauacuugcugccacauggugacgcuguuggacacaagucccauacagccuuguagucuugcacacccugaagcuuaggugugugcugaugucccugcuugggucucugggaugcuacauugaugguuuucauucacaugguuagcugcuauuccccaaauauggccagugccacugaaauaucugauuccuuccaacacugcaggaaucaauccuucccaaggaugguucuaaaguauaagguagauauugcucucucuguuuucuucuggcaugauaccucucugaggaguccaguugaccauguuaauccacaucuauugacccugagucuucaacucagggcuucacaugugguguagugaaggaacgucuuuaccaggagggaggaaaguccuguugucucuuuuugugagggcaguaggcaacagcuccuccaacauggacauaaucaaggaagacauuuuacuuuguaaugucuuggcagacuccugcuucaugaugacucguccuuaccccagggaagaaagacugacauuguuuaaaauaggcaaauuauagccaauuuuguagcugaaguuuuuuaccaggacacagccacagcugugcugcugcccauggcugugcuugugguauaagaacaagaaagcacagaucugagaaagaucacacacccuguugggcuuaccuccuuucacaccacuccucagguccacuguuuuauggaggaggacagugagguuuauagaugagagggcuugucucugcucacacaguuaacaaauagcauugccaguuguaagcacagguuacuuugcuccaggguaauggggucuaucauauuuaauuuuaaaaauagauuuauuuuuauuuuauguguaugaauguuucgccugcauuuccugcacuauguguggauauggggccuacagaggccagaagagggcauuagauucccuggaccuggaguuagggauaguuacaagcugccaugaagaugcugggaaccaaacuggguccucuggaaaagcugccagugcuuuuaaugacugauucaucuucccagacuccaacucuauguuuuguuguuguuaucuuauuaugggaaagcugaaaaugcacacaaaaguugagaggaagggauggagaaucauguucugguuucagcacgacccacauuuacccagccuuacuucaucuagcccugcccccacccuuugaucucauuaugaaacccuagguaguuuggaacuucauguagaccaggcuggucuugaacucacaguggucugccugccuugccuccugagugcugggauuaaauccauguuccacaacacuacacugcuccacuuuucauuuuuuaauggaguuuuaaaaauuuuauauuaauaaauuauuaauguguuuauguguaugggugugcaugugucauucuguguguguguguguguguguguauguguguguguaggccagaagacaauuuuguggaguugguuuuuuuuccuaucaccauuauguggguuugggggcuugagcucagauggucaggucucuaugccaggagcuuuuaucugcugaaccaucucacuggcuccuucuuaugauuuugagauauagucucuuuguguaacccaggcaggcuuuuaacuagagauguccuugccuuggucuccucauugcugggauuacaggugcacaccuauaggagauuuaaaaaugaguucagaaugcaaggcauuuccuuggcaaauacuucaagcucuuucuuuugguagagcaggcuacagauuaccuguggggagggaggauuggcucugaggaggagucuucggccuuccugcuugggcuaguuugccugaggacuucugggagcccagugauccucagggcauguagguacaagcaagagcuaggcaucuucugcccuuuccuaccuccccaaccagggaagaaacaguuaccagauguucagcuucuggcccaacagcugcugcugagaagggaguucauuccugccccccagggcaccaacauccuguuugccuucuuugcacaacacuucacccaccaguucuucaagaccucuggaaagauggguccuggcuuuaccaaggccuuaggccacggggugaguaugugggacagggagggagucucaggugccacaugcaggcuaucaucagaauccaugugaucugaauggaccguucucugaccucagguagaccuuggccacauuuauggagauaaucuggaacgacaguaucaccugcggcucuucaaggaugggaaacuuaaguaccagguagugcuggcauggggaggggacagugugaagggucucccuuguucucucuuauaaagauggcuggguaggcaaauugaagaacuaccagagugaaggaaaccaggaggacagagaguaaaggcugggaggaguuaacagggcaaaagcaaauaaagaacgggguagauuucuguggccuccuggggauauuuucauuuccuuagcuguuucacucccuggaaugggcaccaugauggaacuuguacacaugacugagucaguauccaucuuagccaugggcccaaccaucaagaaaccauaaucuaucaggggucaaauacaggauuaccaggguacaggcaaaccacaguccaacaaaucaugaaccugacugucuggauaugggugaaccacaguuuauacauacaugacugucaggguacaggcuguagcaagauuucuuguguaaaccagagcuguccaacaguagugugagccucauauguaauucaaauuuccuaguggcuucaguaacaaaaguaaaaaacagaugagauggauuuuaauagcauacucuacuugggcugguaagauggcucagcugguaaaggcacuugccaccaagccugacagccaguguuugaucccugggagagaucugauuccugcaaguuauccucugaccuccacagcuuugcuuugauaccaggaugcucuugccucugcacacagacauaaauaaauguaauacaaauuaaaaagguucucauuggagauggcucucucuagauuucauaaacuuuguaauugaauaaguagauucacaaacccaguagcugaaacaucagcuuuaaaaauguaaaacuauagggcuggagaauugagucagcgguugagagcaccugcugaucucgcagagaaccuggccuugguucccggcauccacauagaggcucucaaccucuggaacuccagcucuaaaugaucugaugcccucuucuggccucuguggccauacucacacuggaggcauacauacauacauacauacauacauacauacauacauacauacacacacauacauacauacauacauacauaguauacauacaaaaaaaucuaaaaaaggagaaucuaaaacaaaaucaaguaaaaucuaaacuaaaugaaaugaaguucuacagucuagucauauuuggagauuuggagccacagguggcuaguggcuuucacacuguauucuggaaaccugaaagaucuuaaggaaaauucauuggggcaucuucagaacggagaacggcacuugcauauggcuuggcaguguguguauuugugauacucuugugauaacugccaccaaccagucgguaccauuagagagucuggaggcugagacugcuccccuaugaaguuaagguugcaagggaauugaggaagccaagaacgggccauggucaucuucuugcucccuagggcauuuagcugugagaagauuuggaggcaagaagauccagggauuccuaagagacgucugagugagaggaagggagcuacugugggugauuccagacaccucuuuaggggcauguuguauggaggucucccucuccuccuccccacuccgucucucagggguauacugauugcuguguacccaagugguaagggcaagaguuggcuuagggcaggcacuuagggagcagcaggcagaugggccagggcugagguaguaaagucggaacacaggagccggcuguggagagcuccaagacggaucuuggaggagggccagagucagguugccaggcggccucaucccacaggugcuggacggagagguguacccaccuuccguggaacaggcguccguguugaugcgcuacccaccaggugucccgccugaaaggcagauggcugugggccaggagguguuuggguugcuuccggggcugaugcucuucuccacgaucuggcuucgugaacauaaccgcgugugcgaccugcugaaggaggagcaucccacgugggaugaugagcagcucuuccagaccacucgccucauccuuauaggugagcacaugccccgagaggcaggaaagcaggguuaggacccugguguuacugaaccuggggagucacagccugagcccgagccaggguuuggcuacccauacucaggcccaggucuccaggcuguggcuucaguuccuacacgcgcugacuugcuaugagccuagaaggaaggaaggcucugaguacauuugauuggucaccucaaaccccaguuuguuucucccuugugcuguacccaguuuggccuuaaaguccucagcacaccagcaucaaaccucagcuuacccuacccucaggaacccccaauuucucucucucugucuaucagccuuuguagaauuugguagauucuaggugacucagggacaagauauuuuugugucuccuacgggggugaguccauaaccuaaaaugucagaugguuuccugccuggacccugcaccucuguccagaccaggcucuccuugucugagucacuaccucuggguacaagugggcauggcugguuccaauuauagaggcuaauucaccggcuucuagaagaguuggucacuggggauaagaguagccagaggaaggacaggcugauucuucggaagucuguauagcccagaccuuuaccagagaggccaggccuguggguaaagcagcccagcaggcugcaaugugaagacacuguuaaucagacuuaggacuucagccgacccauguugacacggcugagguugccaguccuaugucaacagcacaaaugccucuguuguccccuucucacaugaccggauacaugaucauauggaaaucgcauagcgauuaauagugccuacaguuuacagucgaggaaagugagcuuuaguaggacaaauaacucaagcucaauugacucaagcucagaugccuacauaccgagaagcuaggauuggagcccaguucugcuaaccgcaaguccuguggcuccaggucaguuuacuaaaaagccaguuuaucuguuggcugauugguccagauaacagcuuccucuaacgauccagcuggccaguuuuuauauuguucuggaauguucaaacguaaguaaucuuucuuggcuguuugcuuuguguauagcugcugccuaagggauuaaagggaacccccugcccaugagauucugacauauauaucagcacaccagaaauguauuacacuuaaacaaaugcuuagggcugggcucccuagcuguguggggcuuucuuuggcugcugcagcagcagcagcugucagaugggcucucugaagcccucgucccucacugagagcuucagagaaaugacauuccucacuaauacaauguugugcuuuuguaucuuucagaguuucucagcuuaaaauuuuuuuuugagacuaagucuuuucauuuagaccauucuggcaucaaugcugaaacccucuugccucagcaccucuuaugccccccaguucuggguuuacaggcuuggcuucuccagacccuugucauggucuguaggagggaggcuacaucaggguugggaaaaugauucuuuuuuuaucuuuuaauuuauuuuagauauuuugguauuuuggccuucauguauaucugugugucaugugccuggcugguguccuuggaggucagaagaaggcaccagauccauuugaacuggaguuacagaugguugugagccaccaugugggugcugggaauugaaccugggucccugggaagagcaaccugugcucuuaaccucuuagccgucucucucucucuagcucauggaaaccaguucuugaaugacucuuuuccugggucuaaggccugccuauggagcagcaguacccuugucugggucucucagucaagucggagacaguucuguuuucacauccccuuacaaggacacaaagcagaagugaccaaggggaguaaaugaacuccagcaucagcaaggagaggagagcaagcacuuuucacgagauguucauuucccaugcauugagcucugcugaccuuguuucuuaucuuccccuuguaggagaaaccaucaaaauugucauugaggaguaugugcagcacuugaguggcuauuuccugcagcucaaguuugacccggagcugcuguuccgagcccaguuccaauaucgaaaccgcaucgccauggaauuuaaccaucucuaucacuggcauccacucaugcccaacuccuuccaagugggcucacaagaguacagcuacgagcaguuuuuauuuaacacuucuaugcugguggacuaugggguugaggcacugguggaugccuucucucgccagagggcuggccggguaagcuugagagaaacagaggcaucaggggugggcucugggauacaacagacuugguucaaacuccccaguuucuucaucuguggaaugaacacucuguuacuucuacaggugguuguaaacaucccugugugaauucucuaauuuaggugacagugccagguuuuauuaguuacuuucauguuacaaggacagaaaccacucaaaggaggaaggguuuggcuuauaguuucaggggcauuacaaucugucacagugaggaggccauggcagaguggcccaaucuguuguggcagcaggagcucaaggcagagguuguucacauuacagcagagcaggagacaacaaguugggaaccaggggcugagcuguaacccucaaaggcugcuuucuagugguccacuuacuucagcuuggccucaucuucuaaagguuccagcaucuccaguagugccaccauuugaggagcuaaaauagaaacuuauggaauacauuucagguucaaaccauagcacaggcaucacaccagaugcccaggauauauauggugaugacgauggaugugguucguggacccugucccuuugacauucaucacacagaagagaaacaguccugugacagcuagcaucauuugaggacuuguuguguauaagggaacaugaaaagugcuuucuaauguccucagaauucuaaggacauguugaggaccauagcauagaaagccaugguguccugucaauucuaugagccaggguugaguuagggugaugguaaagaugggcaggcguuucccauggagagcagugagguugguuuuaggggaugauccuguuguauauggagaagauggcaugccugagggucagagggcauaaccccugaaggacaggaggaccuuauuaggaugugcuaauauauaagaaaguaccugcaugaaaugccuuuuugaauuccacauuuucuaucagcugaauugucauuccccaaauuaguauacucugauccuaacccugaagaccucagaauaacauuuggagauaucuuuaaagagacacuuaagacuaacuagaaaacugggauggguccuaauccaauaugaucaguucccuuguaagacaaggagauuaagacagucucacccaggaagaaaaccacauguagguacagggagaaaguggccaucuauaggccaaagagcucugcuucagagggaggcaagcaccagacccucuaguuuguucagugugaaggaaggaauauguuucuguuugucaaggcacacaaauacauuuucuugggauuccuagccaacccccugugaaguccuuccuucucuacauuuagaagcaccccuuucuucaccccaacucucuggaccccucuuucucaucuucagcccucuguuucucugucaucuuugucucucaucccuguuagaaagcugugguaccuaguggauuuagauuuccuccugguaauuugacugcaauuagcauuaguuuguugucagguuucuguccucugcucucuguggcaacauggguguguucgagaagugauaguagccuuuguguaggguuaggugacuguggagugugugaaagguuggguuuugaaauugccagaagauagcagguguugacucucaggauaguaaaacggagcagagauggacaaagcaggguuuucucuaaugucacugcggauggcuacugucugggguguugccaugggaccacacugugauacugcuuuguuccucaucuccuuuauuuuaccacaaccauaucagguggaugcucucacuuucccuauuuuugcauaugaggaaacacaaacuuagacuguucuuguguuuguguacugggguuuuccgacaaaaugccucagagcagguggcugaagguaacagagacguacauauucucucaugguuaggcggcagcagggucaugcuaacacucccuggggcucuaaugggagaucuguuccaugucuuccccacggugauccuacaguuucugguauuucuuggauuguagaagggucgcucaacugucugccuccaucaccuuaucacauagugucuucucuaugucucuaggaucauuuaaaagggaccacugggcugggcacagagacacacuccuguaaucccagcacucaggagguggaaggaggaagauuaggaauucaaugucauucuaguuccaugaugaguuccaggccagccugaguuaucugagacccugucucaaaaaucaaacauaaacaagcaaggcaucacuucuuggauuaggaucuuuccuaaugaagcaugacuuuauuuugccuacacccaugaagacuauauuguucucuuauccauagggaauacauucuaaggcacacccuccccccccuggcacggauguuugaaaugguagaguacuaaaccauauuuauuccuauacaaacaaacugcggugaaguuuaacuuauaaauuagguugaauuaacuugaaucaacuuauaaauuaguaagagacauaguaauaauuguaaaacaauuuucuguaauaaaguauguaaugaggucuuucucagugguauacauuacucaccccucuugagaugauguggguugacauugugucuacacaagcacaugggaugugaugaaugacauagguauaagauauuuaguuuauugcauaaggguuaccuggguguaacucucagcuaucaggaccguugacuugauaacuaacagaugcucugugauugacagcccagggagcuuaugcagugcagauauccuggacagagggaugauucacauccugggcaggauugagagaguccucauuagauuucaucacacuacucagaauagcaugcaauuuaaaacuugggaauuguuuguuucuggaauuuuccauugaauauuaucagaucguaauugccugugggugauagaaagugugcaaagcuaagccaccaauaaguugagacuauuuucagcuaaggucacgauugugggugcugcaggucagacuuuuuagugcaucuuugaggggcacaaguccagccacacagcuuggaauggguagagcuggggcuggacccacucucugcaugcuguuccaagcuugcuuugcucugagccauaugauuucaauucaguuaugcuuuucuuuccugcucaauuauacaugauuauuucaggagaaauagaacuuccuuaaaacugaugcuccuuaguuuuuaugacuuuuuaugggcuccucugugugugugugugugugugugugugugugugugugugagagagagagagagagagagaggucagaugugugugucacucuucuggagcugcucaccuuguuucuuacuuggccuguagcuuaccuagugagcuagguaggcuguccaacaggccccggggaucuggagucuucauuuucauggggacuuuauuuuucuuucuuucaauaaagaugacacuaccuguuggugugacuccaaggaacucaaguuacuggaaagugaagugcugcacacuucaguguugaggaagcagacacauugugggccucuaagugagaacggcaggguagggcuagagccagacugcagcaucacgaucacugggcuacaccagauucuguccugguucagaaagaaccggagccuuggaguucuucucugagaccuuccgcaggacaguaaaagaguuugaccugauucugagacugacagcaugcuaaucucuuacagauugguggagguaggaacuuugacuaucauguucugcauguggcuguggaugucaucaaggagucccgagagaugcgccuacagcccuucaaugaauaccgaaagagguuuggcuugaagccuuacaccucuuuccaggagcucacagguagguugcugcauccugggcauagucucugcccuugaggcauguccagaaaguacagaucacaagcaaagagacugggaugaugcggguggccagcauuguggcugagcauugucagggaagacagugaaugugacaguggccuacugauugagagacaccacuuuccaggugggugugagggauaaauaaaaaauuuccagguauaaaauagagggagggggcacuucagguauggcaaagggaaagcaaaaggauagagguaagaaaaguagaugcuugucugggagaugcuagguaacaaagggagauugacagugcacuagcaucucagaugcugaaggguuggguuguauccugucuagugguuccuaaguacugacaaagaugauaggaguaucugguugguugggggaguugugguucagugguugagaauuugcccagcauacaagaggucauuggcuuaacccccuugauaaaacaagacaaaauaaaauaaaaauaaaaacaaaaaccacacacacauuuauauauacacauacauucauuuacauacucacacagaaacauacaugccuacguacucacacauacacuguuucacauacaaacacacacacacauacucauaccuauagauauacugguauacacaaacacacacacacaaugcauacuuacacacacacacacacacacacacacacacacacacacacacacgucccaaauacuucuggagaucgugacaagaaucuguauacaggggacuggauaaauggcucagcaguuaagaguauagauugcucuugcagaggaccugaguucaaguuccagugccagcaccuaucuugggaagcucacagcugccuuuaauuccacuuaaggggauccaauguucuugucugccacaggcacaugacucacguguacauggccacacagagauguauauaauuaaaaauaaaauaggucuuaaaagaucucuacucucucuucucccccaccccccuucccccaaauuuccccagacguuggacaguggaguuagaguccucuugucuccacuggugugacagacccuguacccauaggaggauggguuugaggaaauaaauggagagagcccaugucugucucuuuugucucauguguccaucaucuguggacaugcaacugucagaguggaacagagucugggaucaguagaugagcucccacgguccuggaacaaucaucuugaugauucucaugaaaaaggguuccaaggagcaaagaguacgcuggcucugaagaccugugugaacuugaacacacacacacacacacacacacacacacacacacacacacacacgaggacucuaggguaauagggccugggcacagguaaggccuugagaucuuacuugaggggaucaagacaggcugcuuucuucauuuuaugauggucuaagaauuaaguccagagaauggggugaguuacucgaggucacaagccauuuggggacagaccuagacuucuguccuuuucugugacuacauaguccagguugaagggccuauuuguucuuucuuuccugacuauucucugaugacugcagguuaaauuuuacgauguuuccucuaguugcucaaauuguucuucuguagucucugucacccccagagaaaaacuagauccaggagcuuccauccccaggcugaucuuaagaaaaucaugagugacugcguccucuugcuccacaggagagaaggagauggcugcugaguuggaggagcuguacggugacaucgaugcuuuagaguucuacccgggguugcugcuggagaagugccagcccaacuccaucuuuggagaaaguaugauagagaugggggcucccuuuucccucaagggccuccuagggaaucccaucuguuccccagaguacuggaaacccagcacguucgguggugacgugggcuucaaccuugucaacacagccucacugaagaaacuggucugccucaacaccaagaccugccccuauguuuccuuccgugugccagauuacccuggagaugacgggucugucuuagugagacgcuccacugagcucugagggagcuggaaagcagccucuggagggaggaguuuuguuccugaugaagacaguccuugauguggguuuucguggcuuggcauugugagagcugaugcucacauuugaaacuuugggucuuacccuugccuagaauauugugauuuugccacuuucggauguugaauucuuuguuaacuaagaaaguuagaagugguuuugucugccuccucagaacuuggcucuuuguuggcaacucagaaagucagauuucugguugauuuggaauauaggcuuaaaacuuuauauuauaggguagggugugguugcacacaccuuaaucccagcacuuggaaggcagaggcaguuggaucucugggaguuugaggccaguuuggccuauauagugaguucuaggccagccauggaugcauagugagacucuuucucaaaacaaacaaacaaacaaacaaacaaacaacuuuuagaauguagaauuccguaaaaaaaaaaaaucccuugaaaguuaaugggguccucaauuuucuuccuagaauuuggaggccucuucagaauguugacuaucugacaggugacucagaagguccuguuccuggucaaugaucuauaacaugggccaaaacauucccaacuugaaugucuagaauguggaauugguucauuuuccuguucagugaaauggacacagaacaaaagaacccaguguccagcaagaauugccuugcccaaaccuacgucuacgccaaaggucaaggcaguaagguguucuugggagccacacuuagacucuuuccaaagauguggagggaacagauggacucaucuaugaucuugguuggaaaccaccacaguucuauccccauccagaucuuugcuuguggcagcuguuucucaugaagcuaauaaaauucuuucuccaaag

SEQ ID NO: 786 - RNA, 1293 nt, Mus musculus
acuuuuuaaauuaauggcuuuauuacuaggaauaacaguccuaggaaugcaaacagcauaaauggccaucagcagaugauugcauacaugcacauuaaauauuuacacagccaaacagauacccaugaggaaaaagaagccaggcauacacaaaaagaacauaaccauguggcaauauucaaaugaaguuaauaaguagucaaaacuaacuacaaugauaggaaucagaauagcaguuagcuuugggguguuccugaccacauaggaacacaaaaaugaccuugaaaaggcugaaaacaugcuacaucuugauauccuugguucuuacauguauaaaaaacucaucaagguguguauguaggcuuauguuauacuacaauggccugggguuggaaguggggaccugacauggaugucaacaaggacauacuaccaagaugccuccaaauccaaaauaccaagaccugugucccauccccaaaucccaugaagaagaaaaccaacuccugaaaguuaucucuugaccuccacaugaacaccuuuggcaugcacauggcugcagucauucacacaugcacacacacacacuagugagguuuaauacauugauuuauuuuguguacauguguauauugugugugagagguaugugugugcugagguuaaaggacaaauucaggggacagucugcacuuccaccuuguuuuugaggcagggucucuuuguuagccacugcuacacauuaucucaugcuggccagaccuugagguucaugguuggacauccaggagugcugggauuacagacauauaccacucugucuggcuuuuuauauggacucugaacaacugaacucggagcaucaggcuuucaugacagacauuuuacccacuaaaccaucccgaguuuaagcuguuccuacuaucauuuacaccagcuguuuuaucucuuucucuaggaagagugugguuaagugggaagacaagcaagucuaauacauugauaccuuccacaaacacgguuaguugaugaacuacaagcacuucacugucuucaggguugugcucacaguucuccugagcugucacugguacccucuaauggccucuguaguguucuacggcuggaaauagagacaaaaagcuggguacauuuccagccauuuggcuacuuuuucaucaugggcaacuucccacaugaugaaucgcuccucuccaagacccaagucaggaacgaaauucacuucuucacccucucuuagagcuguauacagucauauaagccagucuccag

SEQ ID NO: 787 - RNA, 941 nt, Mus musculus
aucacugugaccaaagucucccgcugaggauauuucucagcgcuccuuucauaucccgauuucucaaacuauaaauaaagggauucagcauggguaugaccauaguguacaucauagccacaauggcauccuugucacuaguguuauuagaugaggggacaaaauauaguccaaugauggcuccauaguacaaggaaaccacacagaggugagagccacauguggacaaggcuuugcagauucccuugauggagggaauuuucauaauggugacaccaauguggccauaagagaccagaaugcauaugaauggcaggguaaugaccauauuaccuaaaacaaggaugacaagcucauugaugguagugucugagcuggacagcuucagcaagguagacaggucacagaaguagugggggaugguauuguuucuaaaguaagauaguuguaccaagagaagagugugcacaagggaguuggcaguagauaaaguccaggauacuacuauuagaagaacacagagguucucacucauaauuugugaauagugcagaggguggcagauggccacauaccugucauaggccauggaggucagaagaaagcucucaagaucagcaaaaaaugaaaagaaauacaccugggaaacacacccagcauaugagauggauugacugugugucagcauauuuaugaccauuuuuggagaugcgacugaugagaaagagaugucugugaaggccaagugacugaggaagaaguacauggggguguggaggugagaguccagccugaugaguaggaugaugagcagguuccccagcacaguugucagguacauggccaggaacagggcagaguacaggccuugguccucugcucgaauggggagucccaagaggaugaauucagacacaguacucucauuaucucuccucauu

SEQ ID NO: 788 - RNA, 944 nt, Mus musculus
auuaccacuguggacacagucuccuguugaggauauuucucaaugcuccuuuuauaucccgauuccucagacuauagauaaagggauucaccaugggugugaccagacuauauaucacagccacaaugacauccuugucauugguguuauuagaugagggaacuagguaaagcccaauaauagcuccauaguacagacaaacaacagagaggugagaaccacacguggacaaggcuuugcagauucccuugauggacggaguucucagaauggugacuccaauucggccauaagagaccaggaugcauaugaauggcaggguaaugacuaguguaccuaaaggaaggaugaccaucucauugaugguggugucugagcucgacaggcucaauaaggcagaggguucacagaaguaguggggaaugguauuauuucuaaaaugagauaggcgagccaagagaagggugugcacaagggcauuggcagaggauaaaacccaggacauuacuacuaaaaggacacagagguucugacucaugauggugguauagugcagaggguggcagauggccacauaccugucauaggccauggaggucagaagaaaacugucaagaucaguaaaaguugaaaaaaaguauaccugagaaacacaaccagcauaugagauggacugacugugugucagcauauucaugagcaucuuuggagcugugacugaugagaaagagacguccgugaaggccaaguggcugaggaagaaauacauggggguguggaggugagaguccagccugaugagcaggaugaugagcagguuccccagcacaguugucagguacauggccaggaacagagcagaauacaggccuugauccucuggcugaauggggagccccaggaggaugaacucagacacagugcucucauuaucucuccucaug

SEQ ID NO: 789 - RNA, 1056 nt, Mus musculus
agccauguggagauucccugacagagaacaaaagauggaugggagaagaggagaaagaaguagagaugcuaagacagaagaccaugcccaucauugugagcacagucuccuacugaggacauuucuaagugcuccuuucauaucccgauuccucaaacuauaaauaaagggauucagcaugggggugaccacaguguacaucaaagccacaaugacauccuugucauuaguguuauuagaugaggggacaaaauacagugcaauuauggcuccauaguacaaggaaaccacacagaggugagagccacauguggacaaggcuuugcagauucccuugauggagggaguucucagaauugugacaccuauacggacauaagagaccagaaugcauaugaauggugggauagugaccauaguaccuaaaguaaggauaagcaacucauugaugguggugucugagcuggagaguuucagcauggcagagaggucacaaaaguagugcggaacgguauuguuucuaaagugagauaguuuagccaagagaagggugugcacaagggcauugccugaagauaaggcccaagacacaacuacuagaaaaagacagaggcucugacucaugaugguaguauagugcagaggauggcagauggcuacauaccugucauaggccauggaugucagaagaaaguuuucaagaucagcaaaaacuauguaaaaauacaucugugaaacacacccagcauaugagauagauuggcuaugugucagcauauucaugagcaucuuuggggcugugacugaugagaaagagauguccgugaaggccaaguggcuaaggaagaaguacauggggguguggaggugagaguccagccugauaaguaggaugaugagcagguuccccagcauaguugucagguacauggccaggaacaaggcagaauacaggccuugguccucugcucgaauggggagccccaggaggaugaacucagacacaguacucucauuaucucucuucauggucuuccucuucuucugugagugaaa

SEQ ID NO: 790 - RNA, 692 nt, Mus musculus
augcccaucauugugagcacagucuccuacugaggacauuucuaagugcuccuuucauaucccgauuccucaaacuauaaauaaagggauucagcaugggggugaccacaguguacaucaaagccacaaugacauccuugucauuaguguuauuagaugaggggacaaaauacagugcaauuauggcuccauaguacaaggaaaccacacagaggugagagccacauguggacaaggcuuugcagauucccuugauggagggaguucucagaauugugacaccuauacggacauaagagaccagaaugcauaugaauggugggauagugaccauaguaccuaaaguaaggauaagcaacucauugaugguggugucugagcuggagaguuucagcauggcagagaggucacaaaaguagugcggaacgguauuguuucuaaagugagauaguuuagccaagagaagggugugcacaagggcauugccugaagauaaggcccaagacacaacuacuagaaaaagacagaggcucugacucaugaugguaguauagugcagaggauggcagauggcuacauaccugucauaggccauggaugucagaagaaaguuuucaagaucagcaaaaacuauguaaaaauacaucugugaaacacacccagcauaugagauagauuggcuaugugucagc

SEQ ID NO: 791 - RNA, 932 nt, Mus musculus
aucauuguguucugcugaggauauuucucagugcuccuuucauauccugauuccuuaggcuauaaauaaagggauucagcauaggugugacaacuguguacauaacagccacaauggcauuuuuuucacugguguuauuagaugaggggacacaauacaguccaaugauggauccauaguacaaggauaccacacagaggugagagccacauguggacagggcuuugcggauucccuugauggagggaguuuucagaauggugacaccaauguagccauaagagacaagaaugcauaugaauggcaggguaaugacugcauuaccuaaaacaaggaugauaagaucauugaugguggugucugagcuggacagcuucagcaaaguagagaggucacagaaauaguaggggaugguguuguuucuaaagugagauaggcgagccaagagaaggguuugcacaagggcauuggcugaagauaagacccagaacauuccuacuagaagaacacagaggcucaaauucaugaugaugguauaaugcagaggaugacagaaggccacauaccugucauaugccauggaggucagaagaaagcuaucaaugcuuccaaaaacuaugaaaaaauacaccugggaaacacacccaucauaugaaauggacugacugugugucagcauauucaccagcaucuuuggaacugugacugaugagaaagagaugucuguuaaggccaagugacugagaaagaaguacauggggguguggaggugaggguccagccugaugagcaggaugaugagcagguuccccagcacaguugucagguacauggucagaaucagggaagaguaaauaacuugguucucuggucgaauggggagccccaggaggaugaacucagacacggugcucuuauuauccauccucauu

SEQ ID NO: 792 - RNA, 659 nt, Mus musculus
auuucuuuucuuuuuuuuuccaaugcuuuuuuuuauuaacaguuaagauccaggguuaguuuuuguagccucugcuggcccuucggccucuggcgcgcucaaacuuccggcccuuggaacggacauaggguuugguauggcugugugggguuccuggggccuugccaaaaugucgguacaccucucggcccuuccgaggaccagacaggagcacagugccccggcccuugggagacuccagggccagcuggucaaaggugaggaucuuacccccagccuugaggaugcgacucccggcccggcugcucacccgcagugcacacaccuucagcuugggaacuuccagaauccgcacaucaucugugaccguccccacaacaacugcagucuuguucucgcggccaggaagcuucaucuuucggaucaugcgggacagggacagagguggccgguugguucggcucaugaacaaccucuucagcacaaccugauugaagguggaguugguccgucuggccagaaaccuguacaacuugacaagcagccgcagguagauguccuggcucuugggcuccuugcgccgaaccuuucgguccuuguuguggcgaaugucaacacccaugauggcgccuucugcucggccagguccggaaagaccc

SEQ ID NO: 793 - RNA, 944 nt, Mus musculus
aucacuuagaaaacucugucuucuuacucaagaguuuuuuuaaagccccuuucaugucuuuauuucucaggcuguaaaugaaaggguucaacaugggagugacuacuguguacauuacugaagcaacuauguuguuguugauuuuacuguuggauggaggcagaaaauagagaccaauaauugacccauaauagagagccaccacugagagaugggacccgcaaguggacaaggcuuuacagauacccuugguugugggaaccuggaggauggugaacccaauacggccauaagagaugaggaugcauagaaacggaagcauaauggcggccaaaccugcugugaagauuaccaguugguugagugaugugucagaacaggacaacuuaagcagggcacccaggucacagaagaagugugggacaguguggucagcacagaaggaaagcuggucuaggaggagacugugcaaaagagcacaagcagaagcuaugacccaggacacagcuacuagcauggcacaacggcucugacucaugauagugauguaauggagaggaugacagauggccauguaccugucauaggccauugaagugauaaggaaacuguccaagucagcaaaaaauaugaagaaguaugucugugaaacacacuccucauagguaauggguaugggcugguucugaacuuuuguuaacaucuucgggacagugacagaugaaaaggaaaugucugugaaggccaaauggcugagaaagaaguacaugggaguguggagaugagaguccagccugaugagcaagaugaugagcagguuccccagcacuguaauaagguacauggccaggaacagagaaaagaagaugccucccugcucuggucugaugggaaaccccaggagaaggaacucagacacacugcuaugguucuugagucucaua

SEQ ID NO: 794 - RNA, 944 nt, Mus musculus
uaugagacucaagaaccauagcagugugucugaguuccuucuccugggguuucccaucagaccagagcagggaggcaucuucuuuucucuguuccuggccauguaccuuauuacagugcuggggaaccugcucaucaucuugcucaucaggcuggacucucaucuccacacucccauguacuucuuucucagccauuuggccuucacagacauuuccuuuucaucugucacugucccgaagauguuaacaaaaguucagaaccagcccauacccauuaccuaugaggaguguguuucacagacauacuucuucauauuuuuugcugacuuggacaguuuccuuaucacuucaauggccuaugacagguacauggccaucugucauccucuccauuacaucacuaucaugagucagagccguugugccaugcuaguagcuguguccugggucauagcuucugcuugugcucuuuugcacagucuccuccuagaccagcuuuccuucugugcugaccacacugucccacacuucuucugugaccugggugcccugcuuaaguuguccuguucugacacaucacucaaccaacugguaaucuucacagcagguuuggccgccauuaugcuuccguuucuaugcauccucaucucuuauggccguauuggguucaccauccuccagguucccacaaccaaggguaucuguaaagccuuguccacuugcgggucccaucucucagugguggcucucuauuaugggucaauuauuggucucuauuuucugccuccauccaacaguaaaaucaacaacaacauaguugcuucaguaauguacacaguagucacucccauguugaacccuuucauuuacagccugagaaauaaagacaugaaaggggcuuuaaaaaaacucuugaguaagaagacagaguuuucuaagugau

SEQ ID NO: 795 - RNA, 879 nt, Mus musculus
uauaaauuaucaugaugcaaugacucuuuuuuuuucuuucaaaagaaagccacacaaaugucaacacggagguguagaugggaaugaaagaaaguacaagaagaaaaggauaugaacucauuuucuccaugaugacaugguaaaugaucagucuucaagaaaaaaagcugccaaacuguuguuugucccuaauuaagauaaaaaauguaauagcaaaguguucauuuuauguuaaacaaagcaaaacuauguucuaaaguaggaucauauaauacagaucacucauauuaguaagaauaagaagcaguaaucuuguucuugugagccaguuucauggauucaucuugguacucucgcuacuuuacagccucaucaucauguccaucagauccugaguucaauacguuccacucaggaaaccuggagagaaggaagaugagagagugagacagacagacagacugcaggacaggcagauggauagacaagcagccaaaaccauauagauugcacuggaagaucucaagucaauaaguaaacaaacaugaaaauggauaaauagaaucccuggaaacacacuuaagaauaucugaucucagcgccaaucccuuacacuauuaaugauacucuguuguguugcagacaggagacuagcauaauuguccuuugagaaggucuaccuagcagcugacugaaacagauacagauucccauagccaaacuuuggacaaaggucaggacuucuuauggaagaguuggugucuuagucaggguuucuauuccugcacaagcaucaugaccaagaagcaaguuggggaggaaaggguuuacucggcuuacacuuccauacugcuguucaucaccaaaggaagucaggac

SEQ ID NO: 796 - RNA, 987 nt, Mus musculus
cuuuagugagcuuccuguggccagucacgagugcuccgccccgggcagcagaaucgaugccaagugcgcuggaaggcuuccuugacuuccuuguuucgaagacuguagaugaguggguugagagcugggaugacgagaguauagaacacagaugccaucuuguccguguccagggcauagcuggagcugggacgcagguacaugaaaauaagggucccauauaggauggacacagcugugaggugagagccacagguggaagcugcccuccgacggcccucagcugacugcaugcggaucacagcaacagcgaugaauccauaagacacagcaauagccaacacugugguugucuggauaaagccacagacagcaaaaagaaggaguucauugagacuggugucguugcaggagauggcaagcaguggaggaauaucgcagaagaagcuguugacuuccagggagccacagaagcucaggcgaaaggugaaaguuguauguacaaaggcacucacugcuccacccaggccugaugccccaaggagcgccaggcauagacguggugacauaacugugguauagagaagaggguucccaauggcuacauagcgaucauaggccaugacugcuaacaggcagcacucagcaucggccaacccggcaaagacaaacaucuggagggcacaggcuacauaagggaugguggcacgggacaguaggaggucaaccagcaucuuggggccaauggcagaggaauagaaggcauccagcagggagagguuggccaggaagaaguacauggguguguggagccuggcaucuauacgaaugaguagcaccaugcccacauuucccagcaggcugacgagauagaugggcaggaauaucaggaagagggucacacgcaugucccaacgauuugugauccccaagagaaugaacucagcaggcauaacucuggaccgggugaaguucucugaguucauu

SEQ ID NO: 797 - RNA, 54034 nt, Mus musculus
uguagcucccgauggaguuugaggcccugaaaccgccgccgagcucugccccggcgagacgaggcgccuccgucgccgagccgcgccgucgcggggcccccgggagcggcccuuagcgaccccgcccgggccccucagguagggcgggggcgggcaagaugcggcuggggcccuggcccggcugccggguccucagagguggggcggggagcugucucugcccggcggccugugcacgguggccgccgguaccccgaggguugggagucgcgggccgcaccugacacgacagagaggccccucgcucugguagggcuuuuugaugcgaagcgaaacgcucagauggccaccuuucuccagcaccggcugaagggacgccucugaccacugaggaucccacccgaacagaggccggcuuccuucuuugcuuaacccauguaggaagaggggcuuucgaaaagguccccgagaucagguccugucuuagcguuuucuuuucagcccuugggcuuaccgagaccacagcgcugggauggaggcgaucugaguguuguaaauagggacccuggcuaaacaaugcccagggagggcuuaaccucccuggagggagauggcuggaccaggggaugugacuaggagcgauggcaugaagcacagccagggaauucugcuauaguuuucuuucccccuuucuuauuauuuuccuugggggagccucauaaggagacucuuccaccaucuuaggagaaugguagaaagcaucuuuguuucuaagagaaacagcuguacuuuucugucguuaggaaggagauaaggguagcugucauuuccauccuugaaaucaccagaguuuuuaagauacuggcagacacagccuucagaccaaaauagucuaaaguaaucacagacauuaaguauucaaauucagugauucucaaccuguuuagauuuuuguuuaagcuccaccucgguucuuuuuaaucccacuguccuccuaaccuuaggacccuaaggaauuucuucucaucuugacccacuguaauuagaguugacuuuauaucccgaauaaaguguuaaaaguguuuuacaaaucuuccugucauuuuuaguagucaggcuuuaaaguuccaguaaaaacuuggaguuaaccagagaaagcuaauaauggcacacuaaagugauauuauuugacagaaggaaagaaacgaauguucuaguuggugggucuagucucuuugugguuaacuuguauacacagccuaagacuuggacucauuaagaauaguuuguagauuccuguuuuuaccuuuuaugugguuaaaaaacuacaucacugaucugacaucaauauccauguuaaauuguuuacuuaaauuguuuacuaacacagucaguucuugaaaacccagagacuauucuauccuauuaaaggcuauuuuccaauauuaccauuguuuuguugauuuggugauucauguuucccacauucagaguuuggaaaauugcuugaaggacaaaacacuuaauauauuuucuagucuuguuuagggaagacagguaccauaauuaaacaggcuuuuauucuucgagaauugaauugaaaucuaauucauuaguggagccuuugaauuaccccaugaguuauuguuguguuaguaugacaugcaagaagacguucuuguucauguuuucauuaauuuaguuucuguguuuguaauuugcugccuuccaguugucagaggcauuauuuucuacacuuaggauuuuauauuuuaagacuagagccuguacguuaugugauggguaaaaaugcuauaaauuuguaaaaaguuuuguuuauuuuguuuuuuguuuuguuuuguucuguucuuugagacaagauuccccuucacaaguagcccugacuguccuguaacucacuauguagacaaggcuaauauugaacucaagagaacaccuguuucugccucaugaacacugggacuaaaggugugcaccaccaucccuggcuuaacaaggcuguaauaaguacaugcuuauuuuugguuggaccugguugaaauuucauuuccuagagauggaaaagggaagucuaugauuaaaaauaaagcuaguuggaaauuaaagaugauuuguacccagucucgugagaauuguugauuacaucucuaauuucuaauuccauuucuaaauccuuaagugugugacucguaccucaaaauuucuaauaaaaaucagaucuugaguauuauuuuauauuauuuguagucgagauuugcuuuuacuacuugauagccacaugugacaguuaaggacuuaaaauggaguuaguguaauuugaaauguguuguuaaaugcaaaauguauacuacauuucaaagacuuaauggaauauucuauaacauuuuaauauuuagguuuuuacaugauuacauguuaaaaugauauuuuacuuauaaaauaaaccaccaaaauugauuccgcuaugguuuuuucuuuuugaaaaccagagauuguuguauuuuuuuguggguuuuuuuuuuauuuauuuauuuauuuuuuuuauguguaauccauccuggccuugaacucacagaaauccaccuacuucugccuccugagugcugggauaaaaggcaugugccaccacugcuggaaguuuuuugauauuuuugauucagggucucauuugacccagccuaggguggaacuugcucuguagccuaggcuaaccuuuagcuugcuaacuguccucuugcccugaacuuccuucguauuuauaggacucaacugccaugcgguggcaccauacauacauacauacauacauaaaaauauacauacauacauguggaacccaaaacuuucccaaugguauccuuuuagagucagaauaauuagaguaacuaagaacuucaguaauaagaaagauaagguuagccacaugguggcgugagccuuuggucccaguacuuggggaggcagaaacagguguaucucugaauguaaagccagccuggucuacaaauugaguuccaggacagcuaggaauggagaaagaagaaaagaaaagaaagauaaaguuauuuagaggcagaauaaguaaguucagucuugaaguauuucauguuuagccaucauuaagaagccuauuagaaugcauugaaagcucuaucuuauuuuaaaaauuggguucagccccuaauuugaagaguaaaauuugaucucaucaauuuuauagauuaaaacagaacaacaguuguugugauauagcucuuuuuuuauccaaaaucucuuucuugagagcugagauguagaauuugcuucuauuagcucuguuugcuuguuguuuuuagguuaaaucuuacauuguacuucugaugcuuuuaguaugauuuuaagucuaaagcuguguuuuguuuuguuuuguuuugcaguaccggggauugaauuuaaagcuucacaaacauuaggcaaguguucuacaacugagcuacauccuugaacaaaacuaauuacuuugauauguucuauauggggaagugucaguguaguccacuauaguacucaaauguaaauaaugauuguuuaacaaccaaccucuaaguguauaaguguauaaacagaauuauaaaauacuguguuacacuauuauguuuuacacacaaaguagugaaaaagacauaugcucuauucugacuuuuuaaaagugucaugguucugaacugacuauguaauacgaguaacagaaaaugaaaguauuuugcuaguacacuguuuauuucgguaaagaaguuuguaauuuacaucuauaaaacaagucuguuacucuuuguauauuaugaauuuggacuuauaucaaggaacuuauagcuugggagucugagccuguuuaagguucugccucuacuugaguauuucuccuucugugcuuuaucuuacgccuugucaguguuaaaaacuagguacugaaauuaguuaauagugagaauguuuucucaaucucuguaggcaucuagauuuuugggcuuuuuagucuauuuuaucucaacuugaaacaugugggaaguauauuugggauaagugcuuugcuagucacuauaaauguuagcaguuaugaugucauaucuacugaaucaaauaaguuauuguaaaauauguuacuauaagccuaaaaguucuauaaauuaguauacugagcucuugauuguuuauuuauaugcuuuuaaaacuauaaaaauaguaagagguugggcauauuaaaaaaauaggaggcuggaugguaguggugcacacuuuuuagccccaguacucaagaagcagaggcaggaguaucucugaguucaaggccaccguaguuuaugagcuccaggacaacuaggcuguuagaaagaaacccugcuucaaaaaaaaaauuugggggggauaauuguaaaaguauuuagauaaacucaagaaguaccuuucaaauagagagcugaaacuccuaugccaccaaugaaauauuuuaaugguuaugcauguuucucuguuuuggauaaaauguucauuuuuuuauuugcauaacuuagaauuuauugaccauaauacuaaaggaaagcaucuuuaggaaucaaaucauauuguguaaagaaaguuuaguaaguuuacuaucagaaucugugauauagcaggggaaaaaaauugacaguguggucaguuucauuugagcuauucuuuacauuuuacaggcauuuauuuaguuuuuaauaugaauuaguauuaaaagcucuugucuagauaaauauauguauguguguauguauguguguguguauacacauauauuaaagaacugucaggugcaucuggagcacugucccaauagucuuggagaaauaaggaaaaggguguuaguucuuuguuugcuguuaccaagcaguuugugaaacccuaaugcaguagagucuguguuucuacacaaaugucugucuagcaaaauaccaauuuauguuauuaauuuggcuuuccaguuguagauuuaaaugaaauucaucuuuugccuggauuuauaauucuauaaccagaaaauagaacaucaaauauguuaguuucaaaaaguauuugcucacuugcuuauuggcaaucucuacacgugguaguagacuaacugguuucagauugguggcucuaaucaguuugaggauaaaguguaaaaauuuauaucuugacaaauuugaguugcuuagaaguaaauauauugauauuaauauauaauuuuuucauuaaagcuguuuaguaaagauuuguacauuauaugggauacuuuuuuuguauauuaagaccuguuucaaguuuaccaaguaaauuuuaauuuuuuaaaaaaauuuuuaaaaaagucuuacuuuuuacuuuuuuguaaaaaaaauuuuucgagacaggguuucucuguguagcccuggcuguccuggaacucacucuguagaccaggcuggccucgaacucagaaauccgccugccucugccucacaaguggugggauuaaaggcgugagccaccacgccuggcacuuuuuaauuuuuuaagacagauuuucucuauguaguccuggcuguccuggaacuuguucuugugcaaggcugguuuugaauucacauaaaugccugugccucugagugcugagauuaaaggcaugugccacuacugcuugucuuaaaaaaaaaaaaaaagagccaggcaugguugggcaugccuuuaaucccagcacucgggaggcagaggcaggcggauuugaguucgagggcagccuggucuacagagugaguuccaggacagccacggcuacacagagaaacccugucuggaaaaccaaaaagaaaaaaagaaaaacuaaaacauuucauuugucucuugggguucuggggagugcuuacuguuacauguuucucuuuccugaugcuaacuacucuuucugagcaucuagcauucuguauaucuaauguauuuuguaagcauuuguaugaaauaaaguauuuggugguuuaauuauccuaaauaccuauauuuaauguuuaucugauggccuuugucauacuaauguaaguuuugaauuggaacauauuaaggaugugugaguuauaaguaguguaguuucgauugugacucuugcuaggcaaugguguuauacaccuuuaauccuagcacuuggaaggcagaggagguggaucucugaguucaaggccagccuggucuacagagugaauuccaggacagccagggcuacacagagaaaaccuguuucagaaacaaacaaaaaacaaaacaaaaacaaaaaaaagaaagaaagaaaaaagaaaagucaaaagaaacaaagcaaaacaaaaacccaaaaaguagauugugacucuugcuugcuuuacuaaaugcuauacaauuacuaaucaaacaagaaaauauguaaaaugauucucuuauaguuauuuuucuguguuuguacuauaauucagugcaaagauaaauauuuuauaccuuguuuucugcuuagaacuauuccaagagaauaauguuuuauuuuucuaagccaacucuauugggccugacaaguuuuaaaaacacagauacauacuuuugucaaaauuauuaugaacuaugacaaaaaauucuagguaauuuuuuuuccauuuuauuuuauagaggggcgagaugcauuggagccaugcgcauguuaacggacagcuugugagaguuuguucucucuuaccacaauguuggucccagggauggaacuugaguugccaaguugaauuguacaugcuuuuuucuguugagcugucuuacuggccauagacaguguuuucuuugcuuuugucauuauucuuuauuuuuucaguuauagacaacaucccugucaucacagucauccguagauuuucaguaacucacuaagcugaggcacauccuaauguagcauagacuuccuccuuuagaugccaaggugacagcucacaaacaaauguagcacauuguuuugaugauuguggugcuaggaauugaaucagggucuccugccugcugagcagacugacagagcuacaucuccaucccuacaguauuauuuugaucaauaguuucugaagcuuagcagcuauuaagacauaucaauauauuuugagguagugguuauccaaagaaaacacuucaaucuucaaacgguccaguaauuuguguucuuugguuuucccuuuuuuuuuauuuguuuguuuguuugcuugcuuguuuagguuuuucuuuuuccuuuuucuuuuuuuaaagauuuauuuauuuauaauauguaaguacacugcaacugucuucagacacaccagaagcgggcaucugaugucauuacggauggcugugagccaccauguuguuuugcuggguugaacucagucccuccagagcaguagucagugcucuuaaccacugagccaucuuuucagcucuuguuuagguuuuucaagacaggguuucacuguauagcuuuggcuguccuggaacucacucuguagacauacuaaccuugaccugacaaagauccaccuaccucugccucccaagugcugggguuaaaggcaugugugccaccaugaacacauuguugguguucuuaaguagagagugggagguaggggcugugagauguaaagaugcugccaagcuagaugaucuguguguccucagaccccacguuagaaggagagaacuaacuagcaugcacacauggcacacaugggcccacauacauacacauaaacccacacacaaaauaaaaacauuaagcaauaaaaaauagaauguauuagucacuaagaaaaauacaccaaaguuuugauuacuauugcaugaacaagcaguagaguuuaguugaaaggaauaguauuaauaaauugucucuggguaaaugugcaaaauguaauucaacuuacaguuuuguuauuuauuguuuguuauagagacaucuaaauccuauauuuagaaauguuuuagauucuggaguggugguaguugauuuuaacaguuaagugaaugacuaauaaauauauuguuaaugcuugcuuuuguccauuugcagcuuaaaaaacacuacacaucaaaauaaugaucugcuagacugcuaacccgagcaucagcuuccacaaugccugugcaggcagcucaauggacagaguuucuguccuguccaaucugcuauaaugaauuugaugagaaugugcacaaacccaucaguuuagguuguucacacacaguuugcaagaccugcuugaauaaacuucaccgaaaagcguguccuuuugaccagacugccauaaacacagacauugaugugcucccugucaacuuugcacuucuucaguuaguuggagcccagguaaguguccaguauuuuuacugguuuauuauaucaguugucaaaauuaguucuuuagcugguacagagcauguugaaagguagucgaaaccuaaaagguguauuuacuuuuugugauguguuccuacaaagauuuuucucacugcuauaaauucuuaagcaaaauaaugaaucccauuacaguuauauauuucuuuguucuggcuucaauaccaaagccagaauuuagauaucuaaguccuuugguaguugagaaacugugugacuauaucaguauuuauuuguuaagucaugaaaagaaguaaaaucagagguuuaguuagaaaaaaaacuaucuaaagcccuuagauggagauuuuguugaucuuauuuguaacuucaguugguugaucguauuaucacaaauacaaaauaacaaauucugugcaacaucuuaugcccuuauauguugugcaaugacuguuccauuuuauauaauuuuacugaauccuagcaagaauguagauuugauaaacaacuuuuauuugaugagggucuguucuauuguacauaugaaaauaaauauucuuuuuuuguguguuuuuguuuuuguuuuucgagacaggguuucucugcauagcccuggcuguccuggaauucacucuguagaccaggcuggccucaaacucagaaaucugccugccucugccucccaagugcugggauuaaaggcauguaccaccacgcccggcgaaaauaaauauucuaaauguucuuucugcuuuuuaccuuagcucuuuagguaccuuuuaccccuacuuacaaaugaggagaagaugaaauuucauacaugccauaguaaauguuaaaguaagaaagaaguagccgcgccugguggcacaugcuuggaaacucagcacuugagacaggaagauagaguucagggccauucuggccuacacaggaaaacccugucucaaaacucaagugaaaggaauaacaucuaaaaaaagaagaaaacaaaaacccaaaacuaaagcaaggaguuuacaguuuuauaagaaaauuuccaggcuuauuuaguaaauuuaauaacccacuguguucauuuuuuuaauaucuugauagaugaaguugucuuuuuaaauacucaaaaucuguuuucacuguuuuagaaucuuggcaguaacucuguaguuaguagggucauagcuuaauuggcagcauacuuuucuagugggucauaaaauaaugauaucucuugccaaaaucacacuuuaaaauccaauaaaauacuuacuuuuuugcaguagugcuaacuacugccugucuucuauagugcaggcagucuuaguguuccuucugaauaaauguguuauuuuaguauguaaaauaaccuauggaucuaugcauuguaacacaaucuuuucaggcucaucucuucacuaucucuacuuauauuggucuccugaccaguucuuagauauguuauguauauuaauguauagggauuuugaaaaugucuuugcuuacaacgauucuuuccucucuacuuucaagaaauuacaaauguugcaguucuccagaaaguuuauuaugaacuacacuaguaaauugcaacccuucucuaguucuuucuugugugagugugucuauccauguauguaucuguauguagggaugugcacagcuuuaaauccuuaccuuuauuuuugugucucugugugaaugucacaugcauacaguugcucuaaaaaggguguaaguuccuugaagcuggaguuacagcuauugacuguugcccaacauagcugaaccugcaacaucugggagagcaccaagagcucuuaaccaccaagccaucucuccaguccucuccauauuauauuucauuucauuuacaguugcauuguauuuucauugauugccuucuaacauaguauuuguuuauuuguuuauuuauuggcuugucucuuaucucuguagaauuugaacucuuugaagcaagacauuuucauuuucucuuuugauuauuaauagauccauacauaguguagacacaugagaaauggucuauaaaugucaguguuuguaggacuggauugaacuuucauaauaacauuauaaaacauguagaguuauuuuuauuuugcauauguggaauuugauaccaaguaaauaauuuuugcaaggucaaguuuaccuacauuuuucauuuuuuaauuuuuccuuuuucuggugguagagguuagacugacugccuaaucucugcuagaugggaauucucaucauugaguuacaucucugauacuaucuaucaagggaguauaggucauaaguuauaaauuuaauagguaaaucauauagaugcaguacuaaaugguaugugguagagacagacuccugacacuuucuuuuuuguuuugaaauacuuuuagauuuacaaagaaguugaaauaaaguaguaccaagaacacuuguauaauguuccacaacuuccccuuauauuagcaucuuuugaaaauuuuuaauuuuauguguuguuucugugugugcauauguacaucuaaguacaguaccugccaaugccaaagaucuuggaucccuaggagcuggauuuacagguggcugugagcugcccaaugugggugcugggaauugcacuugcauucucuggaaaaguaauguaugcucuuaauaucuaagcuaucuucugcagccaccucauauuaacauuuuucauaauuaugacauaguuaugaacuauaaaaaauuaacauuuauaaaauauuguuaaauuuaaagcuuuguuuuaaguugacuuauggcuuugacguagugucuuaguugggguuuuacugcugugaacagacaccaugaccaaggcaagucuuauaaaaaaccauuuaauuggggcuggcuuacagggucagagguucaguccauuaucaucaaggcgggagcauggcaguuucaggcaggcauggcacaggcagagcugugaguucuacaucuucauccaaaggcugcuaguggaagacugacuuccaggcaacuagggugagggucuuaagcccacaaccacagugacaucuacuccaaccaggucacaccuauuccaacaaggccacaccuccaaauggugccacacccugguccaagaauauacaaaccaugacacuuauuucuguauuacaauuuuauauuaagauuauuagcagauuuauaaagagaaggugcaugagcugaaugaauggaccucugcauauuuuuuuguagguaccagaucaucagucaauaaaguuaaguaaucuaggugagaauaaacacuaugaaguggcaaaaaaaugcguagaggacuuggcacucuacuuaaaaccacuaaguggagguaaagguaaguucauaagaaguguuguauugcuguggaugaccugaccaaguguuaaauguugagcucuuaacaguuguuugaaucacugccugucauugagcccacagucuuauuggaugaauauacagguauaauaaauuauuuuaauugcuuugacaaaagcagaauuauaguuuaucacuguuuuccuguuagcuagcuauuccuuauaaauguaauaguuuuugaaugagucaaauauuuguuuugugccugcuaauaaaacauggacuugggaugauuucaauacuuuacaggaaaauacauccuugaccuacauguaaaacguauuauuucaguaaaaggaaaaacuauaauaaauaguaugaugaacuagguuauauaguguaaaugauaauugauauaaaaagaaaauacguaggguuuagaauaucagugaaagaauaaugacucuuaaaagucuguaaauuuuuaagaaggucuaaugauguucuuguuuagaguguggcuuuugaaauugaauugagguaaaacaggugaaguagguacccauguaguuccuggaaaaguguuuucuaggcagaaggaauagccauccaggguauuguccccuuggccagaggagagugugcuugcaguaaugugagugaggaaacugucauaagaaaaguugaggugaaauauagugaggcaagguaacauacugacuuucaaaccauuuaaagacuugaaccuuuguucugaguaaaguugggaagugguguugaacagugauuuugguuuucaagacaggcuuuuucuuuguagcucugacuguccuagaacucacucuauagaccaggcuggccuuuaacucagaaaucugcuugccucuuccucccaagugcugggauuaaaggcaugcgccaccacugcccagcuuauuguuauuuuuuuaagauuuaaauuuauauucacuuaucagaaauuuaccucuaguuccuuuauuaagacagagaguaaaguaaguaucaauauauauuuggacagauccagccuauagaacaaggcaccaagaugaaaucugaagcacuuaagaauuaaguucuuuauuacuacagaaagguaauaaacagggacagaauauucacuuaaaaauaaaauuaucgggcuggagaaaugguucagugguaaggagcacugacuacucuuccagggguccugaguucaauucccagcaaccacaugguggcucacaaucaucuguaacgaacgggaucugaugcccucuucuggugugucugaagacagcuacaguguacuuaaauaaauaaauaaaaauaaauaaaucuuuuuuaaaaauuauaaaaauaaguaaauaaaauuauuagacaagggacucauaaagagcuauuauuuaagaauuaaauacaggugaugaaaauugucuuuauuuuaauugaaaauguuguuucuuuugucuccguuuguuaaagguguagcuaguuugaaccagagugcccugagccguccaaugcaaaggaaacuaguuacacuuguaaacugucaacugguggaagaagaaggucgugucagagcuaugcgagcggcccguucacuaggagaaagaacugugacagaacugauacugcagcaccagaacccucagcagcugucugccaaccugugggcugcugucagggcucgaggaugccaguuucuagggccagguaaaauagauccccauuuuaguguuuuuauugguuaucagacuuugaagacaccaauuuuuagggccaaguaaaaaugcuauguauccugacauaguauagucuauucugacauaguauauccugacaaagaaucagucuauucuuauagccagugcuuuggaagaaauuucucauuuaauccucaggcaucagugagauaaagggcucaucuccaauuugcaaauuuauuaaacugaucuaagaagcaaccuacaacugcacaggauggccucgagcucagaaauccgccugccucugccucccgagugcugggauuaaaggugugagccaccaacgcccggcuaugcuuuaaauuuugcacaguaaaaaguuuaauuuuuuuuuuuaaaaccuuauucuuuaugguuuuauuuuaaggauguuacuuuuggauacuuguucauguuugcuuuuuaucuguaaaagcacuagauaccaauauuauuguacuucaaagagacaaaaaccugauucaaaaguauaccaaaggacuuaaauaaaaaagagagagauggaaaacaagccuaucuagguguaguucucaagcuuccuaaugcugcaacccuuuaaugcauguaccaucauguaccucagccauaaaauuacuucaucucauuaaaauuaauaaaauucaauuuauaaaaucaguucauaaaauuacuauaauucugcuacuguuaggaauguaauauaaguaucugauaggauacaugggaggcgauaccaaagugguuauaacccacacagguugagaacaacucucacagaagauacugaaagucuuuaguuaguaugggauguaaaucagaaccagcaaggggcuucagggcagagcucuguugaaauucucucucucuucagggcagagcucuguugaaauucucucucucucucucucucucucucucucucuuuuuuuuuuuuuuuuuuugagacaggguuucucuguguagcccuggcuguccuggaacucaccuuguagaccaggcuggccucgaacucagaaauccgccuaccuaugccucccgagcgcugggauuaaaggcgugcaccacuacgcccggcucucucucuuuuuuuaaaagaugucuugagacagguuucucucuguagccuugggugcucuggaacuugcccuauaaaccaggccauccucgaacuuacagagaucugcugccuaaauguuagacuucaaggcaugugccaucaccauuuggcagcucucugguaauuguuaccuagcauauugcuaggccaugacugagguuaccccacaacacacacacacacacacacacacacacacacacacacacacacacacacacacaaaaugagauacuacuucauacauguuuuauuuguuaugauuaaaaccaaauaucuaccugacaaguuaguaaugauguggaaaauaugacauagaaaauguuuuccuguacagaaaagauuuuggcaauccuacuacaauuaaacaugacugaggaguuuacugggccuucugauacuuggacacaaguguuuauugcaauaauauuuauaauauuugagagguguacacaagcuggucaugaucaugcauacauguaauugcacuuggggggaucaaguagaaagauguauuggaggccagccugggauauauugaggacccugucucaagggcucucacuguugauuucacuaaugugccaccaugcuuggucuuaaugcuguuuuuuuucccccauuuauucauuuuacauccggauuacuguuccauccuuccccuucccagugaucuuuaguguucuuuuaucuggaaccauucccuguauuaucuugguaggaauagucucaaauauaggacauuuauuuuauaguauaaaaaagguaaaagcauucuucuugucagucacaauaaaaacauaauguauucauaaaguacugucuaaccauauaacaaaaugaaguaaaccaacauuugauauauccauagagugauacaugcugcuuauagaugauguuugaaaaugugauaggaaauaagugauugccgaggaaaaaagauugccagaaaugacuucuggauaaccgaguuuccuuuggaacagugaaaaaugucuuuaaacuacauacaguuaaugguuuuacagcauugugaauguacuaaaugccacuuggauauugcaaaacaccuuuuuguuuuacauugcugagauggaauuaagggccuugcauuauacuagguaaaaaaaacucuauggcuaaguuaauagcuauauuaacuugugucuguuuguuuuuucuuuucuuuucuuuuuuuuccuagacaguuucucuguguagaauugacaguccugaaacucaauuuguagaucaggcaggccucaaacucgucuguccugagagaaauagagacaggaagggagggaaggagauagagagugagcaagcacgagcacacaagcaagcaagcaguauaaaugaaauuaaugucuucuuuagguacucuauccaaaggccauuauuauuuaaaauuauagacaaaauaguuuuugacaggcacagaaaccgucuugugcauaaaccaaguuuguauguccuuauauuacugucaaagcaguauucuguuuuuaugaauuacauucucaugaaaaucauuaucuaauugauuguuguauaccuacagaagauauuuuauuaaaaguucuguucucuggguuggagcgaugacucggugguuaaaagcaguuacuguuugaauccuagaaucuacaucuaguuugaaaucuaguuugaauccuagaaucuaccuccagugacucauuuguaauuuagucucucaagugaucagaccucucuggccuaauaaugcagcuguaugcaauaugcauaagcucauacugaggcauacagaauuuuaaaaaauaauaauaauaaaagauaggaugggggcuggugagauggcucaguggguaagagcacccgacugcucuuccaaaggucuggaguucaaaucccagcaaccacaugguggcucgcaaccauccuaacgagaucugauucccucuucuggagugucugaagacagcuacaguguacuuacauauaaauaaauaaaucuuaaaaaaaaaaaaaaaaaaguaugacuggcuacccuuuuaaaaaaaaaaaaaaaaagauaggauguucuguucacaucuguguucugauugguuauuuagugcaaaguucccccccucccccuuugguaacuuuuaaaucuuuuauuuauauagcuguaaaggugacucaguggucaagaucagucuuuguuuuugccaaggaccucagguucaauucccaguacccauaugguggcuuaccaucuguaaacuccacuucuaggaguccuauauccuuuucuaaccgccaugggcacuaggcacacacauggaacaugcacacacaugaagggaagacuuugauucacauauauauguaaacauuuuuaaaaauuuuauuauuaugagcugaacaugauggcguauguuuuuaauuccaguacuuggaaggcagaggcaagcaauucugugaguaugagaccagccuggucuacagagcaaguuucaggacagccagggcuacauggagaaauccugucuugaaaaaccaaaagaaacaaauuuaauauuguauguguauauguuggaucuguuuaacugcaucaugaccugaguggaccucaggacaauuuuguggagucuuuucuuucacauuuaccuggguucuggggauuaaacucaagauugcuagccuugaucaacaaacaucuuuaccucaugaguugcuuugcuggcacuugauugauuuaaaaaugaauuguuuuuguauauugucauuuccuuuuuccauucuaauuagauguagauuauaucaccauaaguuaauacccaaguauaauuuugacagacaucaucaguauaaucuuuacuucuuuacuauuucuagcuaugcaagaagaagccuugaaguugguauugcuggcauuagaagaugguucugcucucucuaggaaaguucuaguacuuuuuguugugcaaagacuagaaccaagauuuccucaggcaucaaaaacaaguauuggccauguugugcagcuauuguaccgagcuucuuguuuuaagguaagcccuguacaacuguccaaagaccauggguuuauaccugagauggaggcuucugagaauuuauguugccaaucuagugacccucagaaauacagaacacuucuaaaguaaagaggagugguuuuucacuuuuccuuauucauuaauucaucuuugacaccagauacuuguuauuaccaguugguuucagaaauauugaauugaacauauguaaaauccuaacuuuagacucuucgaggaacuuguaaaaaugaauugagacaucucacuucuuuacaucaauugcuuuaacaaauauugcagacuucgauagaggaggaaauuuuuuuaauucauuauuuucuuuaucuuuuuuguacugauuaaagucuucaauauaaaauuaguccacaagaaauucaaaaguugagaagauugccaugcuguaugguauuuuguuugaugggaugugaaaacuauuuuuuaauggaauuuuuaggucauugauagaugagaaaaguuaccugaaucccuguuuucuaucuguuaacaguuguggaaaauauuucaucuguaucaggggcuucuacccugccuuugauuauucaguucccugauaaaagacaaacaacuuuuuuuaauuguaauaaccuuuaaaggggcuagagaaauggcucagcaguuaagagcacugacaguuccuccugaggucuugaguucaauuccaagcaaccacaugguggcucacaaccaucuguauugggauccaaugcccucuucugauaugucugaagacagcuacacuguacuuacauacauugaaaagaaagaaaagaauaagcacuagaacuggguggauaucuacucucuaagcuaauaaaaucuauuuucccaucaauaacccugaaauauaauuugccauguuccaucuaggcugcuuugacucacauuacccauagcaugaaaacaccuuucuaucucuucuugugguucuccucauaccccaaaccugccuaugucucuucugcauagcuauuaaccauaguuuuagauuaagaagcaaggucacauuguaugugucaauucucuggucccugggagcaaucaggccuugggggccaguauuuagcuuaacauacauagcaaaagagcaaaccucaauaguuauucaaguguagguuguuaucuagcaccugaaaaaccacagaaauuuauaaaucucacuguuuuugugaaaguaaaucacacguuaccuuccuuugcucguuuucaggcucuaagauuuaaaaagguuuccuuggaaguacucuaauuuagaaaacagguaguugaugauggaaguauguucaaguggauuuauuuaccuuugcuaaugaaguuuggauacuuuugccugauaguuguagugcuugaguucauguccuuaaaggagauaaggauuuaagugaugcucugguucuucaaacauaauguuuucaagcugaguagccaaauuaaagagaucauuugucauucucauuugucauaagcaaccagauuuuugugauuguaugaucuuuccucagaauuaagaucgcuauaaucaugaucaaauacaacagauuaucaguuaaagugauuucuaauaagaauuguaauucauggcaaugaaauaacuuuguggauaaaggugcuuugucuucugagccugaggacaaguuugaugccugaaucccacaugauagaaggagagugcugauggcugcuacuuuuccucucauguccacacacgugcaggcauguacaugcccacauauauacuuaccaaauaaauaauaucccuauauugauagauacuuuuauaugcagauucuuugcuuacuggacauggaaucagaacaaggagaauuaagauacaugcaugguguggugguucccaacugaaagcacagcauucgaaucaucugcauuauguuucugggcucuaauaccaggaauucuuauucaguagauuugagagugugucuuucaaagcuucauaaauaagaugugauugcuuuguguugguuuuaaagacauguucuccuguauccuagacugaccuugaccuuguuauuuggugaggaugacuuuaaacuuuugauccucuucuuuuuuaccucucaacugcugggauaaugggugugcaucacugcaauguuuauuuuuuaauguagugcuggggaucaaacguccccuuuguucaugcuagggaagcauuccaccaacuuagcuacaacuuuagcccuucacaaaugauuuuggugcauauuaguauuuuaaauggcucggacucucuuuauuacugaagucuucaacugcuuaggugcuuuuugcuauccauggggcacauguacacuauauggugcuuagguuugugcuauaauccucuagauaguuaguuuucuccucccauuuagguuaauaauuacccccuuuacuuucugauauucucuuaaaguggguuauagaagaauacaaacuuucuaaguuacauuuaccugcccacucacuaucaaauguuuaagauuguauugauuggggcuggagugacgaauggcucagugguuaagaauacuugcugcucuuaaagaagaccuggguuugauuuucaguaucuguauggugguucuggggaaucuugauacccuuuucuggccuccauggacacaaaguaacaccugugauguacaaauauacaugcaggugaauacucauucacauaaaauaaaagagcauauuaauuacaaucuauaauaucucaaacuauauuuuuagauucccaaauuuauggccuuucugaagugaugacugacuuuucucagucucauguuauuggggcauauuaccacugucugauauaccagcagcagaaauaaaaaucauuacuaaagcaggacauagaagucuacaccccauaaucccaguaccugggagguucagccaagggaauuucugcaguuuugaggcuauguuaggugacagaguaagacccucaauacacacauaaccacuaagauagcuggaggguuuuuuuuuuuuucauuuuuuuucuuuuaccaauuaggaaaacaaaauuauguuguuaugacagggucuuauuauauaauacaagccaaacuuugugcucaugauucuucuguuucggccucuugaaugcucguauuuuaggcaugcagcaucaugcucagcaggaaaauuugaguuuugaauagauaaaugauuuguccagucugaaucucaaauuuuggugugguuuuaugugcuuugagucuuaagucucggagcucauacagugagauggaugaaagacaaaagaaaguucccagaagcuauggccaauacaaacaaaaucgaagaugaagauucauucccaagguuauccucugaccuacacacagacauauacagacacacacagacuuaaucgcaguuaaaacaaggaaaacacuuacuucgcguagcacuguucuagguacacaguuucaaucuuaggaauucuaaucuccuuucugaaacuacaauaucuaucuggauuucucaaagaaccacaguaaauaaugcuccuacuaaucuaccccagcccucuuagaaaaguugugauguacucagccuguuccuccucaaacaagaaagcaguagucuuuuucacuaaaacaguuaaacaaaacaaaacaagacaagaaacccccacuuucuaagcaaggaaaaugauaguguuuuugagacaugugucuaaucauagugcuucuguaacaacucucagugacuuuucauucccuucagaauuuaauaucuaauuuaccauaguacuuacggucaucugugagucuuuucuugcauauaugagaacuuuuaauucuguccucugcucauuuggggugguugguugguuuguuuguuuaguagguugcuguuuuguuuuauuuucucccaucuucuagacaggguuucucuauguagcucuggcuguucuagaaaucacuguguagaccaggcuguccuugaacuuauagagaauugucugccucugccuccugaguggagugcugggaucaaaggcauauuuuaccacugccuggcauuguuuuuuagaauuugauuuuccucuuuuuccuaaagaaauucuauuuuuagagauguagcucacauagucgugagccaagagaaaacauuuucugaaaauuuuccuucuauuuacuugucguauuuauuuggcuuuguuuauguugcuguagacccuauaacuacacccuuacuauaauuuuuuguuucuaaaucuuucuuuccugccaaaugcugaugaacucaaugaagaaaaggauugcguacauaauuauauacuuucuguuuuguucugaaaaggaguuucuauuggcauuuuguacuuuuuguggugucugguauauaaccccuucagcccaauccccacacccacaguaaaugaacuggauaagagaaaaaggcagaccaauucuaaugaguuugauuuuuuuuuuccuucccauuuuuagguuacuaaaagggaugaagacucuucccugaugcagcuaaaggaggaauuucggaguuacgaggcacuacgcagagaacaugaugcccagauuguucauauugccauggaagcaggacuccguauuucaccugagcaguggucuucacugcuguauggggacuuggcucauaaaucacacaugcagucuaucauugauaagguuuguaagguuagauuuuguacccuuccugucucagaaaauacuguagcauagauccuuccuucucuguuaauaaccuaauaugccugccugaguagaaaauacacguaucuaaccuagugaacuugaugacuuagaacauuguccacgcuggucuuuguggaguauuagcuacuuaugugcucacugagagcuguaggucagugccauugucucaugacagugugacuacuguacuucacaucacuccccuugaugaaauuaaauguaaaauguggaacacucucuacugaauauauuuugccuuuguagcauuguaaaguugaaaacuuuuaucaacauucucaccccagagagcuaauauagcugauaaauaauguuuuuaagugucuagugaugaauuucauagggcagauucugaggugaaaauuuaguucaucauugauuguccuauuaugaaaucugaagacacuugaaaacuauuaaguaaggugauucauuggaaaacauuuugaauauagguauguucaaaaauccagaguaaaaaaucccuuuuuuucuuuuuccccuguuagcuacagucuccagaaucauuugcaaagaguguccaggaauugacaauuguuuugcagcgaacuggugacccugcuaauuuaaauaggcugagaccucauuuagagcuucuugcaaacauagacccuaauccagguaugugggaaaagugcuuauacuuuauggaacuuugagguaaauagcaccaggaaugacuguugauauguugucucuuccaaccccaaccccaucccuuugacucuuaauuuagaugcuguuucaccaacuugggagcaacuggaaaaugcaaugguagcuguuaaaacaguuguucauggucuuguggacuucauacaaaauuauaguagaaaaggccaugagacaccucagguaaauugacuacauuucuaacuacugcuguguccaagacagcuucauccugaacguacuaacaaucuuauuggcaaauggacuauguauauaacccuucccuauuagaaguuaugugugugaaaggaggguguucauguguaugugcauguguagcugcacaggcuuugagcccagggcuuccugucugacacugagugacaugcauagcauucuugcaaauuuuuauuuuguacuuuugagagaaacucccuuuuuauuguacuugguuggcauuucuuuuuauaaggaauuuagaggguauuuuuauagcugaaaguuuuuuuuucuuugcugucucucaaaugaauuuguuuuauaauauauuuggaauuugaaauuccuaaauauuuguaguguacuuuagaagaggaaguucaaauauaaucccuuauccaaaugucuuuucaguugaguuaaauaucauauuaaaaguuaugcuaucaauaucuaacaagguagggcuaaaaguacuccaaaaucuguuaacuuuuuauucuauucauauuuuauuuagaaacuacuauauuauuuagugucaacugaaugauaauuuuuuuauuuuuuaaggucacaauaguaagagcaauuucuuaagaauuugaugcauauuaugguuuuuuuuuuuaguuucuuuuuuuuuaguuuuuugagacaggguuucucuguguagcccugucuguccugaaacucucacagagauuugucugccuugcuuccugagugcugggauuauaaguaugcaccacuaccacagggucugucugauggugcauuuuauuguuuucccucauuguuugccuaugaauagaguugugccuguaaaucaacuaauaauguaauaauuuuuuacuucaacuuuuugggggaagcuuuuaaauggguaaagaucauagcuucccauuuucuuaaguuccuuuaaaaauuauuuuguuacuacaauuugaagauugagaaauagguagguauaaauuugaaucaauuucagauaaccuucagaaagaaggccugaaggcuuccuuaaggaucucuauuacucuuccaguaggaaauggugaauggaacuuguuucugcaugcaugagaauuaugugucugaugugaaaaagacuuaagucuuuuaaguucugaagucuaaugagugaauaauaauugauagcuuuuccauuugcuaaauauuuuguuuguguagccacagccaaacagcaaguauaaaacuaguaugugccgagauuuacgacaacaaggggguuguccacgaggaacaaauuguacauuugcccauucucaggaagagcuugaaaaguaagucuggaaaaauguuguuguuuuuuuuauguagggucauugagggagugcuauauacaguauuaacuuuugugauguuucaaagauacagguaaugugaauugcaaaauaaccauuuuuaugaauccaucagauuaaacuagguauaagauuaguguuaacaagucauauuugaaaaagucauauuuagaaacuggaauccguguuuccauuaccaauguagaaugaaaguacuguuauuugucuuauuugcucagguucaguugaacauaccagcaaaaucucaggcaaaauguuaaauauagauaauuuuucuuauucuggagauugcucuuuuuaacauuuuccuauaaguuacugaauaaaaacaaaguaaaaaggaggacaugacugcuccuagguaggguggaggagaaggcuuauuuuagauaaaagagagcauagccagaagcagagacauuugggagaguccaaagugaacaagacccugagccaggccuuaugaggugaugggggaggggugggaggccaagaaacgcagaggccaggagaguaaaugguagucaaaagggccagguaaaccaaaauggcuggauuauuuaggcaaaggcagcucuggguauagaauuuauaucaacaaaaauuuuaaauauuuauuuuuacuuauacauguguauguaucucuguaugaaugccaauggaagccagaagaguacauaugccccuuggagcuagaguucuaggcaauugugagucuuucccaguggguauucagaucugaacuuuggaagagcaguagaugcucucuuaaccacugugccauuuuuuuagguucuaggacagugguucuccaccucccuagugcugcgacccuuuaauacaguuccucauguuguaacgaccuccaaccguaaacuuguuuucacugcuacuguaauuuugcuacuguuaagaaucguaaauaucagcugggugugguggcacacgccuuuaaucccagcacuagggggcagaggcaggcggauuucugaguuugaggccagccuggucuacaaagugaguuccaggacagccagggcuacacagagaaacccugucucgaaaaaccaaaaaaaaaaaaaaaaaaaagaaucguaaauaucuguauuuugcaauggucuucuuaggugauuccugugaaagaguuauucaacgaccccaaagggguuaagacccacagguuaagaauugcugcucuaggaaauauguucagcuuauucauaccugaaauagaguauuuuagcuuuuaaacacuaauuuuaaaacacucauuguuaaaaauaacuaaagauuuugugguuuuaagaacuuuaaaaaaaaaaugaaauaauguauuuacauguggcauaugcuagcauguccaugcacauucucugacaguuauguggaagucauaagucagcuucuuggaagucaguuccuuccuuuuguuuuccuuccuuccuuccuuccuuccuuccuuccuuccuuccuuccucccuuccucccuuccucuccuuccucuccuuccucucccuucucuccuuccucucccuucucucccuuccuuuccuuccuuuccuucuuuuccuuccuuccacuuuguacucuggguuaccuggccaguucucaggugcuucccaucuuggucaugagaaugccaggguuacagauauccacaaucacauuuuucuuuuuuuuuauggauuuuugguuuuaaagucagauuguuauagguguguguggccagcauguuuacccagagucaucuugccagcucuaugauacaguucuuuugaaagaacuuggcuugaguuuaauuagaacaaaacaagccagaaaggaaucuguagguucagugucguuucacacucaccuagaacccguguguguguguguuuguguguguguguguguguguauguauauauaccuauaaaucagcuauaccuuucuuuuauccucucugaucuuuauccuuuuuggucguacaaaaacaguaauuaagagaacaguaauuauaauacccaguuuauugguuauauucuguacuagguaccauuuuuacuuaucaguuaauauaucaacucauccauuuuacuacuucuucaucuauuuacccuucucauuuuuauugaaaaugccuuguaagguaccugucuagucauuucuagccuuuguuuuaaauuguuaauugaugcuuuacuauacuacaugauugguucaauccuuccuuucaagccaugauucaucuuuuagauaauauaccaauaaagcacuaaguacuacuugucuuacuuuccuuggugauguaauacauuaugugacaaaugcaguuggaggauggaagccuuacaauauagagguacaguucaccaucauggggugaaaucaugagggacauuacauucacagucaggaaguagggauauguaaaugcugagucgacuugcauucuucuuuuuauucagucugggacucuacuccauguuauggugccaccugcuguuauggugagucuuuccacccaauuaaucaacaaaaucccucauagacucucugaaauguuucuagauuuuguaaagcuuucagucaauauuaacuaucaggaguccacccuucaguuugaugcugaaacaucauuuuuaaacuuacccuuuguuuuuuagaggcuugugacuauuucauaauguaaagugcauucaguucaacuucaaagggcccucugguuuuugacagcuccaacaacucuuuaaauuuucaaaguuucaccccacucggggauccaucccauaaucagccaccaaacccagacacuauugcauaugccagcaagauuuugcugaaaggacccugauauagcugucuugugugaggcuuugccagugccuggcaaauacagaaguggaugcucacagucagcuauuagauggaucacagggcccccaauggaggagcuagagaaaguacccaaggagcuaaagggaucugcagcccuauagguggaacaacauuauaaacuaaccaguaccccggagcucuugacucuagcugcauaugaaucagaagauggccuagucggccaucacuggaaagagaggcccauuggucuugcaaacuuuauaugccccaguacaggggaacaccagggccaagaagugggaguggguggguaggggagcagggcuggggaggaaauagggaaacuuucaggauagcauuugaaauguaaauaaagaaaacaucuaauaaaaaauacaauaaaaacuuuguuuucaaagucucaucugaguuuuaggcaauuaaaaauuuuaaauuuaccuuuuauauaugaauguuucauuugcauguuuguguauguacaugugugcaguuuccauagaggagcuggauccccagguacuggaguuauaacugaacaccuuguggguacugggaacugaacucagauccuuugcaagagcagcaaguguucuuuguugcagagccaccucuuuagccuuuuaggcaaccucuuaaauuuugaacccuauacaauuaaaaauaaaaaaaaugugucaaguaguuucaaccuaaaaucacacagagcaaacauuuucacuccaaaaaagaggaacuaggucacuacaaggaaaaguaaaaccaaacugaaacucagcagguaaacuucaaaccuauaacuguaugugugcaucugggguuuuaaugagucccaugaacuccaagcauuugaguagucucaucugucuagcucaagcauauagccucugucuugggccagcuccauacuuauuauagcuaaauaccaauuuggcuaaucaaucagauuuagauuccuggcaacuccaaaaucuugggagucgccaucuuagcuuuguuuacauuuucacugcuucauguaauggcccuuugaaguucaucuuugaauuucaugaaagaaauucauauuugggaagcaguaucaauugcaucuuugugaacuggaggccagccuggucuacauagcaaauuuuaagccauuaaaggcuacaaggaaacccugucucaaagggaaaaaaacaacauuccuaaaaauacauugccuggccuuaauggcuaacucugaacuccgugacacugaaaggcuacagccuggccccuuggaccaugguagcaguaguuucuguguguguugcccuagggaaauacuuccgugaguaguggcuaugaaggagcagaagauccuuuccgccagccuucucuguuuagucuguuucuuccaacugaguuguucuuugagaaggugaaccuguaccauacugguuuuccuaaccaaguauuuagggugucucaccacuuaaaacuuugaggauuaagauuccaaccuugaguccaggguggugagacgaaccuuuaauccuaucacucuggaggcaaagacaggcagaucucucaguucaaggccagccuggucuacagagugaguaguccacaggauagucaggauuuucauacagagaaauccuaucuuggaaaaaaaaauucuaaccuugaacuuugaagaacacauugaaauagcaauguucuuuacacaguuacuaauauuguaaacuuguuuuuuucuuuuucuuuucuucugguucuuccagacaggguuucucuguauagcuuuggccauccuagaacucagucuguagaccaggcuggccucgaauuccuaaauccgccugccucugccucccaaguguuggaauuugccaccaccacccugcugacuugcuuuuucuuaauuauucauuuaccuguauauuuccauuggacaucauuuaucucuuggguuauucauuuuuaucuuccuuguaccuagacaguauuucacauauaaacucaguguuuccaaugaagaaccagauaauuuccgguuuguucauauuuccaguuagccuuauucuuuguauugugcugcaaacaaacagagguuguacaaaggguuaaaaaagaaacaauguauauguagcauguuggcuuuuaaaaauuauauauuacugccucacugagauuuauaugcauauaauuauuauguuccuguguauauacauguuuguggaggugcauuccaugugugcgcaugugugugugauugugcaccucuccacuucaauuuuuuaagucagggucucucacugaacccagucucaccaguuugguucagccaaauaaaauguagacacucaagagucuguccguguuuuagguccuuguaaauuguugugauagcauuuaccuuuaauccuaacacccaggaggcgguggccguugcaucucuaucucugagcugcaggccagcuuaguuuacuuagcaaauuuucacccagcaaaggcuauauagagauccugucucaagggggaaaaaaaucucuaaaaacugccuucugagaaauagaaaaacccaagauaguuaauucaagaaauauuuauaauaauagguugcuucacgcucaauaucaugagaggugcuuuuaauaauuuaagaggaacaguaaaugaauucaaauagaugauuuuaaacauuuaguggccacaguguauuguauucuggucauagaagaaagcuacuacaaagcuuuauucauuugaaaugagaaauauugcucuaauguguauaugguugggagccauuuuaacuuuaugaugguccagguacaagauuggaaauguaaguuuuggggacuauagcaauaggaaugaugaaaaaucguuauuagaauuuacuuugaaaguggaacugauaagauagcuagcuauauuaaguauauguuuaaaaaagaaacaggccagaugugguggugcaugccuuuaaucucagcacuugggaggcagaggcagguggaucucucugugguugaugcuagcuugguccuacaaaacuuacaaaguuccaguaaggccagggcuacacagagaagcccugugguggggguugggaauggggagaugaagagauggcgcagcaguuaauaguuuaaguguagugaugccagauguuuuuuguugcguugaccacgaauguugagggaacauuauauaggaauuaagggccaagacuaagcuauauaauaaugagaauuuuuuuuuuuuuuaaauuuaaguaauucuguuagguguuugcuugcuugguuacugggcaugcagugagugcagaggccagaagauguuggaucuccuggaacuggaguuacaguugugagcugucauguggggucugggaacuuaaccuggguccuuuuaagaaagcagccuucagccaucucuccagucccauaauaaauuuuugguauaugucuuagucaggguuucuauuccugcacaaacaucaugaccaagaaacaaguuggggaagaagggguuuauucggcuuacacuuccauacugcuguucaucaccaaggaagccaggacuggaacucaagcaggucaggaagcaggagcugaugcagaggccauggagggauguucuuuacuggcuugccucaccuggcuugcucagccugcucucuuauagaacccaagacuaccagcccagagauggucccacccacaaggggaucucccccuugaucacuaauugagaaaaugccuuacaguuggaucucauggaggcauuuccucaacugaagcuucuuucucuaugauagcuccagcugugucaaguugacacaaaacuagccaguacaauugaccccuugucaacuugacacacaaaaacaucacuaguaagccucaacccuuacaaucuuauucauccccaagaucuaaauaacuuuaaaagucccacagucuuuacauauucuuaaaauuucaaucucuuuaaaauauccaucucuuuuaaaauccaaagucuuuuuacaauuaaaagucucuuaacugugggcuccacuaaaacaguuucuuccuucaagagggaaaauaucagggcacagccacaaccaaaagcaaaagucaaucuccaaccguccaauaucugggauccaacuuacgaucuucuggacuccuccaagggcuugggucacuucuccagccaugcccuuuguagcacacacaucguccucuaagcuccagaugccuguacuccacugcugcugcugcucuugguggucaucucaugguacuggcaucuccaaaacacugcaugaccccuucaguccugggccaucaauugcaacugaggcuggacuuucaccaauggccuuccauggccucucacagugccaagccucagcugcucugcucaacuucuucaugccuucaaaaccaguaccaccugggugacccuuacacauuaccaaguccagccacagcacaagguacaacuuuggcuauaucuggaauacagccacugugcuuucagaaaacacuucccagaagaugucaccucaaugaugcuggucucuucuuaaucaccgcuaauuucuuagcuccagcuaaccagcaucaguagucccaguaaugcaaagucuuugcuuuaguaguucugguaucuuguuaaucacagcugauucuucagccccagcuaaccagaacuacagaaucuucacaaucaaaacagcaauggcccugaaaagagucuuuaauuuucccucugaaauuucacaagccaggccuccaucuucugcacuguucucaacauuaucuuccaagguccuacacaacaucccacagagcucuuaacaacggauggaucuucaagcccaaaguuccaaaguccuuccacaguccuccccaaaacauggucagcuugucacaggaauaccccacucugcugguaccaauuuguaccaguauacaaauggaaguauuuuuauaugaaauccaagaucaaacaguuuuguauauuauaauuuauauaaauguaauaucagaaaaaucugugaucuuuauaaacauaaacuuauuuaggaauauaaaauuucuacauuuugauaaaguuuaaguaugaguuugaguuuuuuuuaauuauaaucugcuuguauaauuuaauaacaauaaagaaugcuuucaucucuugaauccuauccuguuuauucuguguuacuuuuaggauuuggugcuuuuuuuuuuuuguaucacauaaaauaaaauuucaaaccccacucuuuucagaaagcuucaagugcauguguacuuggcuugcuauauuaguuaugugccugcauuuguaugugacauguauauguaacauguagaguuuuugauauuuagcugaagaaaguucucagagcuguuuccuuuuuaaaacacauuuucauauuaaaauugagagcaguauuacaaacaugcugauuauuuuuaaacagguaccgauuaaggaacaaaaagaugagcgcgacuguaagaacauuuccucuucugaauaaaguugguguaaacagcacugucacaaccacagccggaaaugucauuucugucauaggaaguacugaaacaacugggaaaauuguugcaaguacaaauggaauuucaaauacagaaagcaguguuucucagcuaaucccacgaggcacugacagugcaguaaggacuuuggagacugugaagaaagucgggaagguuggcacuaaugcucagaaugcugggcccucugcagaguccgugucugaaaaguagguauggggugaaaaugauggaguuccuuaucccuuuuagaaaugaccuucuuuuuucauucugagauaccguaguaaauugaaauuuuuaugcaauuauucauguaauagaagaaaacacuaaauaccacaaaauuugaguucuaauccucacaaggcagccaacuaguucuauaaacuugaaagcuccuacucuugaguuuuguuuuuucaaauauauuaaguuuggaucagaauuaggcuuuccauaaguuauuuucuagcguuucaguauuaauuccauagagacguuaaaaaggaacuaaguagaaaccuaaacaggugagaaguuugaaugucuagccccauuuuagucagcuucuauggcuuucucugucguggugugugugugugugugugugugugugugugugugugugugugugucuauggggcucuuugggcucaaauuguggcucgguuuuuuucuacuauuugauauugaccagucuaccugccuccaaguauuaaaaaauuacuucauauauugauugugaaacuuaaacgaguuaauaucguacuaaauuuugaacagugccugcaacaucacauuucauuugacaagggauuauuuuuuuaccuuaugaaaaguguugggacuuucaaauuggaaguuacucccaguuuugaaauaccauauuuuagaaaucucaaauuuagaaguuuaaauuuaaaaauugaagguaaaagcauuuucaaauuucauugucuuugaguaaguuugucaguauaugccuacuggggauaaaagcaucaugcuuggcacacagcaaacuuuaaaugacuuaauguuggagacuguauaaaauaaauaugauauuuucaacuugaauaguuaaguuagaaaaauuuuuauuaaaaguaugaucuucacugggagguauuugagaaaaaaagagguuaaaaauauugacuacuucacaaguguuacugaguacccauuugcagacauugucacugguacuguuagauauagcugaaaaauagauaucucugccuuuaaaggacucauauugcuauuggauguggacauagcauuuauacaaaugaagcacauuaguuaaaagauaagggcaauuguauguuucuaguguaguauagaaguuuugagggcaaaaucuaguaugguuuaagcuuguuugugaauaugugaaguauuagggcuagccuuagagaacugacuguuuugguagcuagauagcucaaugcuagagugcuugcuuaguacucacaauguccuggguuugaucccuaauaucagauacacauuuauauaucugaaggguuauguuacugacugauacauaagguuacaaauacugauuguuacuagguuauggaaaccuuaugaggauauuaauaguaaagauuuggcgagguaagaauaugaaaccuuauacaauggguuauguuauucagccauaaaaacaaucaccaggccuaguggggcauguuuguagucucaggcacuugguagguugaguuaauaggauccuaugaucaagcuuagccuuaggcucacaguaaauucaaggccagcuuagacaacuuuguaagacauugucacacacacccaacuccaaaaagaaaaggaaaaagaagaacaauggagaacaauuuuaaaaaugggucaugaauauauagggcaaggccccacuuucaguauccaguuccaagagaaaaaaauguaugcugacugaaagaagguagauacaaaaugccauuuuaauggaaaugcccaaaauaggcaaacccauagagacagaaauaaaugcaguagucacugcugggagcuaagguuggaguggaaauagggagugaauguuaauggguacagauuucugauaacagguagaaaaucuuagggguauaucaaaaggcagugacacauaucuuaaaauuaugaauuacaguuaacguuugaauuuuuaacuuucuuauuuucuucuggucugggaaucaagcccaggaauuucuacauuugagguaccuauucuacugcuggagaaauggacggggcugcuaaaaugauugagugcuuugauaaagucucuugcugccuagccugaggacugaaguuuaguccccugaaaccauaugggagacggagagaauggacccccaaaaguuauccuccuguucuucauauguacucuuugccauauacaugucagugaauacacaaaacaaaugauuaggaaaaaaguaaaaguguuuauaagugcuggcaagaugauuugggcaagggaaaaucugcugcugccaaguugacaacugguauuugguccugaggacagaguguuguaaggagagaauguacuacaggcuguucuggcuucuacauguguaugcacacaugaguagauuaaguguaaugaaauauuucaaaaauuuaaagauacaagaaaacuacuuaaucauuuaaauauauggaucacuugauacaugccaaacuugagacuaacugauguccuuaauggaaaugaaccagauacaaucucugccucuaagagucuucuuguguaguuuugguguuagauauuuguaaguagauagaugcuauaugauaaacuuugaaagguuuuguguuacuggaacucaggaauauguguacucaguucuuuugaaagagguuuauaaugaugaaguuacguuaccugcauuguuucccaaagugugaauaauaaauaguagggagaucuuuaugaauagaggaagcagcacagauaaaaucauggagggaacaugaagggaacugauugggauaaugaaaucauagucaucugguucccugugagaauaggacagcagaucuacuuugcccuuacagccuaauguuuaggauggcuugugugaugguuucauaagccuaugaauuaaguuacuuugucauuaauuuuguuuuugguaaguuaagaaucugccauuucagaguacuaacuuauguuuuauaguauauaacauuguggcauggaaggaacagauaaaacauagaaaacguuuaaccuaggaucugcuagcugcucaguaauaaauaguuucauaaauguucacuguuuuauaagaaaccuuaguuuucuuacuauuguguuuaauuuauuaaaagacuaucuuuaaacauuaguacacaacuuucuaguuaucuacacuuauuuacuuuugauacagacuaccacagaaguaaacucuggcuacacgaaugucuugugguauauuaaaaggcagcccauauaccucuacuauuuacugguuuuucaaggucuuuucuacuuuggggaaaaaaacuuaaaaugugauugguuuguaauacauugaauucuuauauaauuagcaacaucaccucuugggacaaaacauuuuuaaagcucucuggaguguaaaauuuugaaagugaucagaauuauccugauaagauuaucugggaucauuauuugcuuauucaaccaagaaaauccuuuuauauuaaaacaaaaaauuauguccucccaacaaauauuuauuaaguacuuauuuugugcugaaauauauuuuauuucuucaaugaauguuuacuuagugucuguuccaagcugggaacuguuuucuagaagccagauacuuaagaguuaacagaauagacaaaagugggcuuuuuuggauuacguuuuagcuaaucagauuguuuuuuauuauuugucuuuuuaccccaaagacuuacacuguuagacuguauuguuuaccuuggaaacuuacuaagugggauuauuguuuuuuguuuuuuauguuuuuuguuuuucuauuuuuccaaccggaaaaucuuuaaaagaaugagucaagucaacugaaaagucacguuaguaccuggaguugauuuuuauauccugucacccucaccagaacaugagaucuguuauuauguggucuaaggaauugcaguaugagggggcagagaaauuucuugccagauauauuugccccugucaaaauaccugacuuguuuucuguugauaguuuugcuguauaauuuuauaauuuuuuuuccuaagaaagacuccgugaugauagugaauuauccuuuguuuuuuguuguauucucucuccaguaaaauugguucuccacccaagacuccuguaaguaaugcagcagcuaccuccgcugggcccucuaauuuuggaacagagcugaauucccugccucccaaauccagcccauuucuaacuagaguuccaguauauccucagcauucugaaagcauucaguauuuucaagauccaaggacucagauaccuuuugaagucccacaauacccacaaacaggcaaguaauuuuagucaaaucuaagaagcaaauguauguauuuauuaccuuaaauaaaugugugucuagacuaucuacauuaauaagugaauuucacucugugauccaugaguuuucuuccuguucuaagaaaucuuugcuucaaguuagcaguuuugucacuuggcagaugguggugggaaagaucaagaaggcaaagcuagccuuaucuacagaagugaguucaaagcagacaaaaaacuaaaacagaacaauaaaggcuauucuaauacugguauauuuucauuaauauuuguaccauuaauauaccuaagugaaaaugauuuuuacauuuguaucaguaauauacagggauucauauugcuauauauccuggucaauacuuauuaccuuugguuuugugugugugugcuugugugggguagaguuagauaaagggaguacauguaugccacauuauacuuauuauagucacaggccaauuuaugagucaguccuuuuguuuccccuauguggguuuugguuuugaacuuggauugaauuuauguccacauaauaggcgcucuuaccaacugagccauguuguuguuuuggcuuuuuuuuuuuuuuuuaauaauaaccauucuuacuggagugaggugauauuucauuuugauuuuuauuuauauauucuaaaauauuacugauguuaaacauucuuauuguacugguuggccauuugaaugucuucuuucgacaaacguuuauuuaacuuacuucuuauacuuaacaaguugauuuguuuugaauugcauuugucauauauauagcuugcaaauauuuucuuucauucucuggguugccuccucagucugaugauuuuuuuuuucaaugauuugauauaguuccgcuuaccugauuugccuuuguuuuuguguuuuccaguaccuuagguauuucucaugcuugcuucuaguagguuuauaguuccaggugauccauaccaaauucauaccaaauuaauuuuuauaacugguuagagauagagucuauuucacucuucugcccagguacuacuaguugucauuuguaagaaucaaauagagaaucuaugaaugaccuugaugaaaugguguauaaaauaugacgucuguguuuuuugugugcuguuaaaaaaaagguuuaggccgggcagugguggcucacgccuuuaaucccagcacuugggaggcagaggcaggcggauuucugaguucaaggccagccuggucuacaaagugaguuccagaacagccagggcuacacagagaaaaacccugucucaaaaaaaaaaaaaaaaaaaaagguuuaauuuuacucuuauauauacauaagcauuggccucuauaaauguguaacacauguuugcaguguucuuggagcugggguuacaaauggcugugagcucucuguaggugcugggaacugaauucagguucuuuguaagaacagaaaguggucuugaccaccgagccaucucuaaaacccugcuuuuauaauuuuuauuuauuuugagacaggaucccacuauauauauaacccuggcuggucugaaaaucauagacuuaagcuggccucagacuuaagagauccaccugcuucugccucuugaauuaaaggagaguaccacuacacuuuuuuuuuuuuuuuugguacaauuugaaaagaaaaugaauaauauaaauucugaaagaggucuuuuaaucucugaacccaaaaugcuucauaagagucagugauaugaaaccucaugcaaaagauucacuaaauggaaaucagucugucauuugccaacuucacuguaguuuuauuuuuaaggaauaguucuaagaauguugaauguucuuauuaguauaauuguaucuugacaguaauacaguuuguauaccaagauaaagaucaaugcugauuauauuuucccacauucagggcugccuuaaauuuaaaccauuuuaaaauguugguuuuuacuaagguauuacauugaauauucuucuuuucaauuuucaaggauacuacccaccaccuccaacgguaccagcuggugugacucccuguguuccucgcuuugugagguccaguaauguuccagaguccucccucccaccugcuuccaugccauaugcugaucauuacaguacauucuccccucgagaucgaaugaauucuucuccuuaccaaccuccuccuccgcagcaguauggaccaguuccuccaguacccucuggaauguaugcuccgguguaugacagcaggcgcaucuggcgcccagcuauguaccaacgagaugacauuauuagaagcaauucuuuaccuccaauggaugugaugcacucaucugucuaucagacaucuuuacgggaaagauacaacucauuagauggauauuauucaguggcuugucagccaccgaaugacccaaggacaacugugccuuuaccaagggugaguaauguugaaaauagaaauguugcugucaugccgggcagugguagcgcacaccuuuaauuccagcacuuggaaggcagaggcaggguauuucugaguucgaggccagccuggucuacaaagugaguuccaggacagccagggcuacacagagaaacccugucucgaaaaaccaaggggaaaaaaaauguugcuaucauguguuaguugagauccuugugucuugaaucaaaccagacagacucuuacugugugauuuagagaaguuacuugcccuuugcauggcacaggguuuuuuguuuuuucauguuugauggaaauaagaauaguacuuauuaauaaggcuguugugagaauuaaauucaaaaacaauaaagcuccuagaacaagacuugauacauaccaguguucaauguuauguucaauuaggaacugauauagaaauuuuaaaacaaggccucuuuucaguagcuucacauuuacacacacacacaacuucuaaccuagaaaaaugaguucucacauuugacuugacaucagcugaguauguuacccuuuuuuauugaauauauggagaaaacacuagguacuaaggcaauuuuuccucccccaccccucaccucuguguuuguguguguguguguccuaacaagauuaaacuuguuuacauuauucucacaacaucauuaaauuuauuuaccacucgaagggugaccaacaauuuuucuuuuauuccucuuaggaaccuuguggucauuugaagaccaguugugaggaacaguuaagaagaaagccagaucaguggacacaguaucauacccagaaaacaccugucucuucaacucuuccuguggccacacagucaccaacaccaccuucuccucuauucaguguagacuuccgaucggauguaagaaagguuuuauuuaaccuaauggucaaacagcuuuaacuaaggcaacuuuggauauuuuggaauaguuuuauauggaguuuaauuuaguuugguaaacaguguguagacuauggcuaaauguuaggagagucucaagguaagaguucacuaccaggauuucaaaagcuuugcagcauagacuuuaauauuuccuauuucuauuguuauguuuguguuuugguuuuaggcuaaguccaaaccuagagccuugaguauccucuaccacugagcuucacucuaaccccugauuggugcaugcuucaaaaucauaucuauaccuaccauauaccuaguaacuacuuuuaaaaaugcuauuuuauuuaauuuuuacaaaaccuuagagguuagccgggcaugguggcgcacgccuuuaaucccagcacucaggaggcagaggcaggcggauuucugaguucgaggcuagccuggucuacaaagugaguuccaggacagccaggacuacacagagaaacccugucucaaaaacaccaaaaaaaaaaaaaaaaaaaaaaaaaaccuuagagguugaguauuauccauaucuuauagguuauaacucagggagguuauguaauuacuuaaguaagaucuuucugcuuauaagaagcugcuauuugaauucuaauuuuuuuuucuguuucauaagaaguagagaaacgccugcuguauuacuucugcuauuuauauuucuguuaauuauucuuguuauaacaaaacaagaaaacaaggcuaugacagaaugauuucuauucuaccugucucuuuuaauguauguuauguguguguuucauuucucuaaauacaauauauuuauagaaaaaaaaaaacccuuuauuuauuuuuaagacagcauuucacuguguaacccugacuguccuggaacuaucuuuguagaccagacuggccuggaucugccugccucugccucccaaguacaggaauucuuaaaaggugugugccaccaucaucuggcuggagaaaaauuuuuuaacacacacacauucucugauuuauuccugaccccuaguguuuccaguacaaaaacaaaaacaaaaacaacaaaaaaaaaaaaacccacaguuuguaaaauaccuuuuauuaggaaaagcuucagacauacaaaauuguagacucacaauaaauugcacauaauuaucauaucauuuccauaauuaucaacuuguucagauuuguuucauuuguacuucuugccacuggguuguuuuguuacaguccuaaguauacauacauauuuguuuuuaauuuaauuuguuggguuuuauuugguuugguuugguuguuuaugauuuacuuuuacuuucuaauauuuguguguuugugcuuguguaugugaaugagagagagcaggguggggagagggcguggguauaugccaaauguacugaugcccacauugccuggaguuagagaagguuguuugcugccccccugugguagaaaccaaacagguacucuggaauagcaacaacagcaagcacauguaacugcucagccauuucuccagucuccuaauuuuguguuucacuagguagcccaggauguccucagaugcauaguaauucuccugcauuagccuuccuagugcugcauguacacguguuaagugaaacuaccaugauuagauucguacuuguguucaugagugugucauaaaacacugcauuuuuaacuuauucauauucaucucacuaaacuaagacugccucaaaucagguaaacagcauggcaaugauugauagagauaucauuuaauaggaagauauauuuucacuguuuuaugcagcauacuuuaagaaauaaguauuucucugauauucagcucuucuauuggcaaauugcauuaauuaggacaaaauguuugacuuuuccucaguuucccuaucucuauaauuaguaaacuagauuuaaugauucuuacuuuuggguccuguuaauauuacuauauugccuuauuuccuuucacaucuguucuuuuccuuucuuagcuucagagcugccauuaaauuccuuuuacuauuuaauacuguaugauuuauuauguuccuuuuuuugcuacaugaucuuuucucgagaguuacagaucacuuuuagacaugaaccguuuuguguuuauuuuuucucauuguucccaaguauauuacaccauguuagugugucauuguuaauugauuuugauaguacuggucaggaauuuuguaagagaacuaaaucaguaagacaucuuaggaaguaggggugcuugcagcagcaguuuucugggacucgcaugguagagggagagaaccaacuccuacagguugucuucuggcuucuauucacacauaaugacacuuguguacauauauaauaaauaauuaacauuuaaauuuuuuaaaaaaauuaaagaucacuuaauaggaccaaagugaaaaaagguauagaauaaauaacuuaugagacaaagggaaaaaagcugugauauuuucuauuauauauggauauuauugcuuagagcugauuucuuuauuuauuugcuucauucauuuugagagaaguuuugcuuugugcagccaggcuggaguggaacucaaauauauaucccaguugaccuugaacuccaugccuuagacuaccaaaugauguuuguuacggaagugagccaacauacccaacuguuauuuaguuaugggaaagaguuuacuuauuaacuacaugauccuuuaauuguaugauaguuacuuaguauuaguuaguuuacaagcuuguaaaguuagguuucauacuaauuuaccuucuuuccccccuucuuuuuuuaaucaguucucugagagugugaguggcgcaaaauuugaggaagaccaucuuucccauuauucucccuggucuugugguaccauaggcucuuguauaaaugccauugauucggagcccaaagacguaauugcuaauucaaaugcuguauugaugguaugauuugcuugauuggggaagggggugguggagguagggaagauaauguugguaucugaaguuuuuaaaugaauacuuuagucuuucauauucuggcuauguauaacuuaccuguaaguaucaggguaauauuucaacaaaacuaauuuuauguaauguuuaaauuauuuaaccguaguuugguaguuuaauauaguuguuauauaccauugagaucuaaaguuaguauaaaguugaccagaaaaaccuaauuauguguuuugagaacauacuuuaucuuuagcuacagcaaucgucagcagcucuuucauggguauuuuuuggucuguguaggaccuggacaguggggauguaaagagaagagugcauuuauuugaagcucagagaaggacaaaagaagaagacccaauuauucccuuuagugacggacccauuaucucaaaauggggugcaauuucccgauccucccgaacagguuaccauacaacagaucccguccaggcaacugcuucccaaggaagugcaacuaagcccaucagcguaucagguaagccauuuuacuaauaccaaggaauuuuuuuuaccauguacuguuuauuccuaaccucugagguagaaaacuuaauaauaugagaaugaaaugguuuaaguagaauuuuuggcuagugggaaaaaauacauugccauuuuaaauaguacauauuuauauucugauuuuuaaauuuucuuucuuucuuucuuucuuuuuuuuuuuuuuuuaguuuuuugagacagguucucacuauaucccagcuggccucaaagcauagcuguggcagugcuucugccuuagccuccugagugcugggauugcagauguguaccaccuugucuggcuuauuuucugccuuucuaaacuguuuuucuguguuccaugcagauuaugucccuuacgugaaugcugucgauucaagguggaguucauauggcaacgaugcuacaucaucagcacacuauauugaacgguaacuauacucucauuuccuuuacucucaaacuuacaugcaccuaaaauagaaaaaucauuacugguuguccauggauuaagccuugcuaauuugagcuguguaaaaacuuucugaaugcugggcgugguggcgcacgccuuuaaucccagcaccugggaggcagaggcaggcggauuucugaguucgaggccagccuggucuacagagugaguuccaggacagccagggcuacacagagaaacccugucucaaaaaaaaaaaaaaaaaaaaaaaaaacuuucuggaacaaauuuuacauuuggaauagugacuaaaacacauucagugaucguuacaaagaacauagagucauuauugcuuuggcuccuuuaugucucacuuuaacuacaguaaauauaauucuuuuuaaagggacagauucauuguuacugauuuaucuggucauagaaagcauucuaguaccggagaccuuuugagcauugaacuucagcagguaggcucuauauauuuagcuuugauuuuuaaaacguaaaauaauaauugaaagcuaagcuuauguuuucuucucucuucauggaggccaagaguaacucauuacuucuucagagggaagcuaaugcucuggccaugcaacaaaaguggaauucccuggaugaaggccgucaccuuacuuuaaaucuucuaagcaaggaaauugaacuaagaaauggagagguaagggaaccgaaccucucagcaauacacucucagacuucugaacuaaaucuuuaacuguaccauuaggcuucuuauuuuuauuuaaaagagauucugcagguauaaaauuaauauaauuuuuuuuuaauuuauagaaugacuacacagaagacacuguagauacaaagccugauagggauauugaguuagagcuuucagcccuugauacugaugaaccugauggccagagugaacaaauugaaguaaguuccucaauuggauaaguaguggcuuuguuuuguugcaaauuaaaauacauaaaauacugucauauugaaggauuaacauuuuauuuucucaggaaauuuuggacauacaacuugguaucaguucucaaaaugaccaguugcucaauggaacagcaguggaaaauggucauccagcccagcagcaccagaaggacccaggaaagccgaagagacagaguuuaggugaagaccaugugauucugugaguguuagacagacccuucauaaucagaggguagaggcgaucaauacuuagcgcuagaugugcugguagauucuugguuuuuuguuuuuuuuuuguuuuuuuuuuuuuuugccuuuuucuauuuauggggaaaccuuguauaauaaaguaaugauuuggucagucuguguuuuuagaggaauuugaacuaguaaagcaguuuauuuuaaaaccaaaacucaauuugggaaugaaaguucucuuaucucuaacaucagguuauaguucuucaauuugaccaaacuugaagaucauaggauggaaaaauaaauccuagauuauuucaguauuugggaagcacaggcagaaucugcuauuuauaugcucuaaguugucauggacuccagaggaagacaaaccacaaagucuaaaaagcaaaccacaaggggcuggagaggugacucagcaguuaagcgcacuuguuuuuuguagaagacucagguuuguuccugagccuaagcauucacaugguggcuuaugaccauccauaacucuuguuucaagugauucaaccccccucuugcaaccuccaagggcauuguacacauguggugcacauacauacaugaaagcaaaauacuguauacauaaauuuuauuuuaaaaaaccuuaaaaacuaaagcaaacaaaaaccugugcugaauguuucuuguuuuaaaaaaucuuguuaugauguucuuggcuauuauauugcuauuuuguauaauuuuugccaaauauuugguccuggucuuaaaauacugauuagaugacacaaauuaucaaguuuaauuuuuaaauuuugaaaauaugaccuuuuuagugacuuguaauacuuuaaaaauuauuuaauuuuuauuuauuagcuuuuauguguauggguguuuugacugcauauaugucuaugugugugcaagcuuugugcccaaagaggcccggaaggacauugcuuccucugagauuggaguuacagacugcugugugguuuuggcuguugaacccccagguccucuggaguagcaguugugcuuuaacuucugagccuucucuuuagccccuacuuaauacauuuuuuaauaaagaagauaggcuuuucugugggcuuagaguuugaaguagcuuucagagagcaaaugugauaacucuuaaauuguacauaaguuaauuugcuuucacugucauuuucucucagggaggagcaaaaaccaauucugccgguaacaucuugcuuuagccagccacguccaaugucuauuagcagugcaagcugccuccccaucaccacaucugucaguguuggcaaccucauucugaaaacucacguuaugucugaagauaaaaacgacuuuuuaaaaccuauugcaaaugggaagaugguuaacagcugaaaggaggcucagcuuucaaaucugugaccacaccauggaagcauuuacacuagcuuuuuauauauauaauauauauuauauaauguauauuuuuuuuaaaaaaaaagauauuacugggggcauccauuuccuguggacucuuugauacuucaagcccucuugcauuagcauuaugaaaaaaaagaaaauuuacuuuacuaggguaauguucacuuuccagaaauuauuggaauuuggacaacauuuaacuuaagcuucaagcagcuuuuuaugaguuuguagcaauccggugcaguaacugagccauuuccuauuuuaaauggcuucuacaguaaauuaacaacucaguuauuaaacuagcaggauccuacaaugauacaucuagugaaaguagaguuaauuaacuuauuucuauuuuauguuucacugagagaaauuuccaucucauuccagcugcuuuauuuaucuuuuucauuggacuuugcauggauuuuucuuucuuucuuuuuuuguuuuguuuuguuuuguuuuuccuuuucuuuucugucuuuuuuuuuuuuuuuugagaguggaguuagauguucuuaccauagaguuuuacaggguuauaauagcuuucuuuacugcauuauauguagaaguguagugcagugcuuuuaucuguagcauuuaauuuuuuaauuuuccauuuuucaagaauaguuucugcuuuguuaauauuuauacacaggcuacuuguugaaguaauuaauuaaaaauauaaccaagugccuaagucuuucagcugauguacuagauauuaaauucuccuaaguuaugcagaaucguuuuuacaauuuugauaaauuaugcacuaauguaauggcaauuuuuuaaaaugcagauuuaagccuguacauuauugaaucugaugacuuggcaaaagaaucaggugcuuucagcuuucuugagaaaacccuguauguagcguuugcacugacuaacaagaugguauugcugggucuuuaauuuaaagaaauuaauuuggguguucauugcauuauuuaguuagauauuguuuauuguuacuucauguuggguuuaauuuucuuguuuucugacuguuagguugauaagacuuugaaccauguaguaguagaacauuggcuaacauuacccauacuuaaaaacaugaauaauuucugcccugccauaaugugacugaaauuuucacuuggcaucugaaaguaugcaguauguucaaccagcucugccccagauuuguggguaguaguuuauugaagcuuaaauuucagucaauauuuaaaaacaaaagcagggcaugccuuucugguaguaaucuaauaguuuaucuuuuuguuuuucuuccauuucuuuaagauuaguuugacuuuuauuauuuuuuaauuaacuucugugaaguuguuuacucugaaaauuguacuggaauauuuuaagccaagcugaucuuucaccagguguacuguauguaagggcuucuccugcuagcaagaugcuuaaacaggaucauguuauuggucgucugagcuauuuaguuauuuuacaaaaaccacagcauuguaucagagaagauuuugauaaaaguuuugugcacauuuccaggggugggaggguuaacauuucccugaaauuucuugauuggaaugaguaaauacugguguuugauaccugucuuaaugaacaugcucauaaggugacugauacguuguaaauaauaccugagaaacaaagggguaguuuugauauucuggugucaguauggaagaucuuacacauuuauuuaauacucaaguguaugaagauguuuguuuauaacauaacagcacaguagccuugacuuaguuuuauuugguuaguacuguaccuuuuugccauggccagugcuccccaucccuacaaagacauuuuauuuauuuuacucuguaaccugaaaugaagaggaacaagaguuuuaaaccauguuacauuaacuuauuucugacauuauaaauuagccuaggauauuacaggaacaugauuguuauauaauuuauaucagaaccuuucuauaaauaugagcuuauuacauuugaaauguuuccaauguauuuuucuuuuccuucucuucucuucucuucucuucucucuucucucuucucucuucucucuucucucuucuuuucuuuucuuuucuuuucuuuucuuuucuuuucuuuucuuuucuuuucuuuucuuucuguuuguaauuccaaaaagguuauguaaaccagucugucuauuucauggauauuuaauagugagaucuuccauguugaagguaauguauuuuuuuuuaagauuuuaaaauugcuauuuuguuacaaaauagagaccuauuaacaguugagagcuccuuaugugcccucagggaaagaacccucugugcagcagagcuacacgaacaucuucagcacuuucugagggugauuauauacuacauaaauugaucuuguguauuuaaccuuaucuuuuuaauuuuaaaguugaaauuuugaaacgugguugugcucuucuggagggguugggaugcuuagguguuugccuacuuguucaguaaacugcauuucaucaguguauguguacaccugccaaccuuauuggugugucucaaacauuuauaggaaaauagugcuugucuugcagcagaugaucccauaaaacaauaacuucuaauucuuaaauguuuacucuuucucacuaacaacacaggaauuguuucuguguucacauuauucuguauugcauuuuuuauguggugacagcuuacuguauguuuuaguggguauaauuugaaauaaggcuauuggaucucugccacuuaagaagaaagaacaguucaucugaccuuucuucaaaaugauaccugcugaugucacagaggaaaauaguacaaacagaccuagaauguguuuuuuuuuaauuggggcaaucaucacuuugacccuuuaucaagaugacaugaugaacacauuuggaaucagaggcuacaaaacaauagaagagaaacuuuguaaugucgguaucuaaaaugcuuguaaagccuaugggucuaaucaggaaucaguaguaugaagucugaaaaaaagcagggaaaugguguagguuuccuuauauuuuuuaccugucaguuuucggagucccaauuccuagucugugugcugcauucagaugcugugaauauaucauuaguuuugugugggcuucuuuuauuuuaugaauucuaagaguucuguguauauuucuucuaguugguaccuacacaaauuagauuucucuugcuuuugccacuaugacuuauuucagugccaugcaacgagucaguguauguagggacagggacauuguacauuguaauuuucaagaaaagguaucucuuaaggcccguggcacugauucugcuuucauagcuacuuacucuacuaagagaauucaaugaaacuucauuuaaaaacuaaaauuucccauugguauggaucguagucacuuugacccagauuucaaguugaugcuaaguuuacaaagcacauccugauuuuauauacagaagauuacagaaugcaaugauuuguaggaccuuugagugggaucauuuaacuauuugaaaaaauuguuuaaaaaccaucuacccuauuuuugcauuuuagauguguuaaagcccauguugucuuuuuagccagggauagaacuuguaacauccagauucaguauguuaguuguaaaucugaguauuucuucccuugcaucuuugagucauuuucuaagcagacugucaccaauauugguaauuaaucauuaaagagaaaaguugcauugcagcuauauauuagugucuuagaacuguucuuuuguuuuagugaauaaagaguaccaaugggaucacuuacuguuaacuccuucuacugaagggccccuucugcaagcagaacacaaaugaacaugcucaaggaguaucccguuuucuagagauuaaguuugcuaguaacuccuuuacacuagcuauuucuuuguaucccuuugcuggcaagggaguacaaggagucaaaccacagaucagaacaccccacauuugaguggagacuuauuuuuacucuaaggggaguuauucccccaagucugaaacuggcaauuauuuuuuuuucucuuacauaaaaauuuaaaaauaucccccaaaccaguggaaaacagacacuggcugcacuuaguacugccaagagccaaggucauuugcacauauuccaucaaccugucaaaaauuaggccucacuuuauaacccaaggcauggaagugcaugcauucucuuagcugggcaagcaauuauacuguaguugugauacaacacauguggcuuuuauuuguacugcacauacccacuguacagccacuugggaguaucgugguuagcuugcagcaacugccgucugcauuuauacuguuuauugcauauucuuuucccuggaagugaaagagaaauguuuuucuuguugcauugauuacauuuuauaaauuugcuuagcuggaaaguuugggaaaagaggccuguuugucaauuguacaaccgauugugaagcuuagugugaauauuuuuacgucuguauuagacauuuucuuugcaaaucuauuguucgauugaaauguaaaugaaauuaaagaugguguacacccaucauguaaaacgcaggcaccaucucuaagauggauuuaaugcucauuuuuaaggcauauacucagcuucuauuuaaaacuauaaaauaauucuguacaaugaaauggggaauauauaugggaauaaauucuauuccauuuauuucaauuugaauuuccaaauuguaauguuucccuuugugcuauaggaauaggauuaaaugggggaaggcuaggacuuauaaggccuguauauggggggagggcagagauggaacaaugaggguugugaugauagugaauagcaaagagugaauucuguguguuuuugcuguagcacugaagugaagagauauuagcuuuggcuguucacaaaauagagcaucaugauuuucaguguuugagagaaaauugauggaaaaaguuugcaguacuugacauguauuugcaugcacaaaauaaaauuauuuguccaccuuaaaaguuguuuucuuagugucaauguuaaguuuaugguauguuuuaguuguccugauuuucuugauauaucuuaauaaaacuagaaagacacuacuaaacuagggacuuaauugaucaccuacuucauugguauaucauugggaaguaaauagacccaaagaaguugaaauacuucuuaauucugucuggcauuucauucaauagagagcgcuuucuaaaugggggaaugguguaaaauagauaauacugaacuuacagucuuugggacagauaaagagagaugcauaaauaaaacaaagucauucuguaggcuucagaaaaaauuuuaaagauggccuaaaucucagcaccauuuuuaaugaccccagaguaccuuuauuuauucacccagcugauguguccuaagcccccaucucuccuggucuuuuaagacuagguuaaugaaaugagcccuuucccuggaugcucauaguguagaaaugggaaagaccagauugaauagcucugagagcuacauacaaaggggccaguuguuauguugagcaagaggagguacuucugugagagacccucuggcuagacuuuaaaucuugcauaaccuuuuuaccaguagcagauuaccuuccugacccacuugaucuuuacaccuguuuuguauuuucauuguuuuauauuugagauguuauauaauuugccaaaaucuuacaaucagaaaguaauagagucagaguucugcugucuuucugucucucaaaaagguaauggugaugguaguuggauccauuuucacuuaaguagaaagugugauuaagagauagggcuucacugacuaauaaacagccaauucucagaauucuaaguguuauacuguagacuguugucaccauuuccagacaagaaaagggauacagauacuuuugagaauuuuccuaaguuuacacugcuagaagagguagaugggcauugaaagccauggaaguuaaauaaucugaaugauuuaagauuuuagaaaggauacuuuggcauugauguaaaauguagcuagagauaggccagcaagguggccaggucaacacuguagguaaaaaguguugacuacaugaccaagcagggguagaggaagagaugagcuucaagacuggggauaggggagaacaaccgacaaauuuccuaugcaaaaaaaaaaaaaaaaaaaaaaaaa

SEQ ID NO: 798 - RNA, 18217 nt, Mus musculus
cagggcugcccuuccgguuccguugggucccccuuuggcucagguugccugccccucccccuucccggagccccgaggggccgcagcuccugguuuugccagauguagauggcgaccuuccccccgggucuguaaguucggaggccacccgagagccgggcuagggugcggggucucuggaaauggagcccccguggggaccuggaucggccgcaaccugcccugggaugggagccaaggagcuggucuaggcccccagacuuuugagccauuggacuggcccaugcugcaucccacuuucuuccccuucccgaaucugcaguggggaaucucaggaugccccagggaccgcuuccugagacccucuauauagggcccuguagcuggccaggaagccagacucuggcauuuuguaaaaagugcugcaguugaggccggcagaaaacugaacggcgggagcuagccaaggcaaggccuucagugccaaccgcgagucuacuguaagugccagguuuugauggguuuuacccuugcucaaccgcggauuacagcaccuuuugaauuacugguguuaugccauucaauagagguucaucaaauauccaguguucaucuccaguuuggaagcgacauuuauaagcaaauugauguucguaagaggguggaggguaugcaauauguuacuuuaaucaacugcucuaaggacaguugcugggaagccuguagaagagaguggccucuaaauccuacuucuugauaaagagaacucgugaaauuacuuuuuccaaaaaaagaaaaguuguagugguacugagacguuacagacuaugagaaaaaggaauagggacagggagguuguguacauaagaguuugaguuggagaaguaaagugaaauccaaauagugaaaaguuuaaccaacacuaaaugagaugaauuaucuuuuugaagcucuuugagcaggaaacugauauggucagauuuguacuacagaaaguaauuuuguucucugggaagccuguagaauagaaauagcugacucuggguucucuuagcuaaagucuagguacuuauauuugagauuauuuugaaaaggugaugacguccuggugagaugcauuaaaaucuaaaguagaguuacgguauuguuacaagaaaggaggcaagugcuaaugugucauagauaauuauacgcugaaagagaagaaaaaguaagucuuagaauuuaagcaguugacauuugaagaauagcaaugccauaaucagaaauaaaaccacaaagaauuacaaauucaguuuuugaguuugaauuuaugucuaaagggauagugacauacagcugcccaguguaggagcuggggacacagauauggagaugagccucagcgucauagcauguagaccauaagaagaucuggcauccuagagggugcacugagaaagaagguuacugggaggacaauggcuacgcuaaugaagcaggaacuccaauuggagccaacaguaaaagggagaaaagaacacaggguugaagcaacuagggugacccaaauaucagaagaggauuuugaagagaaucccuuggaucuuuuuuguuaacaggauggguaagaagcaauuuuaguagaugagguaaugaaauauaaaauaucagaggccucaacugguuugauauuccauuggagaaacgugaaagauuuguuuauuuacugaacauguuuaaagagcacauagcaggcaccauucuaaguucauuugaaaauuaacuaauaggcuggaacgauagucaguagauacagcucuugcagaagauguggguuccguucucagagcucacacggugucucagaauuaucauaauuccaguuccaggggaucuccuaccuucuggccuccaugcgccaggcaugcgaguggugcacauacacacaugcaggcagacacucauaaaacaauuacuucuuuaaugaugaacuuacuuaauuuuccuuagcagccccauuuauuauugguugaaaagaauccugaaacagacuggauaaguaaguggcugaacagaguucuaacuguagaaauacgacuccagaguccgugcuguacucacuguacuguguuaugacuagaugggagucaaggagugggagaguguaaggaaaaauuggcuucuugauuaaaaaggagaccucuaagcauagcgagggugagaagagguaagugaugaguuuauguuguauuguguauauguuuuuucuuucuucuguccuaagguccacuuccauucuaugcaaacuuagguguacuuuuuguacucuaauguuuucauuuacaaucugcuuaccauuucagugagguuucuucuacagcuuuugaugugugguguguuucuaaccagcuccccugguggugccaggaaggcucuuuugguggauuuugauaagcagccuaugaucaucuccucuaguagucgcuagguuaacugaaugacauaccaagagauccagccacuaaagccaaauaucuuagaguuauuuggauaguuucucucuuguucuucaccuugaugagcauggucauuguuuagcugauucuuuguuuuaaauucuuuuuuaaauuucucuagauagucacaaucucaucauuucuguuuugaucuguuaaaaugauggcauuaguaaaaggcuguucacuuagccauuuccuauauauucuucaaauugcagaguuuuggcuagugcaagaguauaagcaucaucauuuuuaaauauuaaauaccuagaacaguaucuccuaguauauuguugagauuaaaguugauuaaauuuaguaaugaggauagggacuuaagaauucuuaccauaguaauaaguaaugaccucuugggaaaggaaacuaaugacaggaaauaacuaauggcuaaagugugugaccuaggacuacauuauuaagggauaauugggcugauagguauugggaaaaguuuccuaaaggaaaccacagacuucccuaacuuuuuuggacuaaagcagaaagauaaaaaagcaggcuuuuucuugagacaccucuucagcugcucauguugauaaguuucuggagaacucaggagugggaugcaaaugaaccugaauucuaguuuaucuguagaaaaacaagggacaaguuuccaaacugaauacauuugucauaaaacauucuaagugcuaccucacucuagcugaaaacaauguucacuuuugacuaugacuaggaaaauacuggucagcuucaugaauucaagaucagcucaacucgaaaaaaugaauggcacuuuuguuugggcacuugacauaauggucauuuuuauuauuucuggcuaaacuggaacauucaacauuuucaacauucacuuuugaaauuacagaaugaauauuuuaaagcuacugccacuaaaacugacugcuuuuuugaaguuuggcugcuucaaaauacugauaauauucccaguguuugaaaccuauugauuucucugccacauucacuucuuuguauuuagaaugccacacaggaagaaaagucacacuuugugauuauuagcaugcacaugccccacccuucugaagguuacuucuuucagcuaaauuauaagauugaagauauauauauauguguguguguguguguguguguguguguguguguguguguauguguguguguguauauguauauguauuguuguuguuuguuuuuuccagacaggguuucucuguguagcccuggcuguccuggaacucacucuguagaccagacuggccuugaacucagaaaucugccugccucugccucuggagugcugggauuaaaggcgugagccaccacgcccagcgauauuuuuuuauuguugagguuugaucucacaauguagcucaggcuggcuagaacuugaauucuaacccccucagccucuggguacugugugcauagauuugugccuucaggcccagcuugagguuuuguuuuuguuuuuaauauucuucucauuaucaguuaucaaggucccugaaaaagcuuuuacuauuuuuugcuuguuucuuauuacuauuuucauuccuuucuagucccuuguggccccaaacccauaaugccuccaaucuguucuauguaacaagguuauuuuuauuguaaaccuaacucuguaggcucaacuacugcauacugagccuuccuguguguuugguuugguacuaggugauaauagucugcaccaguuugaauagaagagagauaggauguggguguugccgccuaaugccagggaauuuguaguuuggacaggaaggaaguuucugaugaagcagugugaguguuauauagaaguacugugcugugggcucuacagacaacacuucucuuaaguggaaagaacuagagagccaggcuggcuagaaugcaguguucuagaguagucaaugugacaaacuuagagcaaguagauauauuguguaccugucagagaggaauaagaauaacaucuggacucuugucaucaggaacuguuacucugaaaaauuaagauuaugaauuuugugcuucagaaucuagaugugaugccaggcauagugaugcacgcacaccuuuaaucccagcacucaggaggcagaggcagguggaucucugugaguucuagaccagagugaguuccagaacagcuggggcuacacagaucuugccucaaaaaaaaaaaaaaaaaaaagaaagaaaaucuagauuugaccaggaaaagcugguugucucacuugacuaugaggaagagacuguugaguacacaaaauucaagcuggauuuccuaacauaccaaguuuauagaacuguuucucagagacagaacugacauauauugagcugauagaagacagguuuauaaaaagagaaugccaguuacuuuuagugaagacuggaauuaugguagugguguggcuaauucacccuuccuauuuuuuaacaguguugaggauugaauccagggcuucacauguggugaggcaaauugucuacugcuaaccuauauauguccucaauccuaugcagaaucuccucuguguggacuguauuacaccacaauuuacccuuauuaguuuuaguuaguugacuuauaaccaagaagcuagccuagcauuuuugaacuguacuguuugagagaagaggagcuagcagccaaggagaacauuuaggaauuaauucuaguaguucacaugaugaaaaaugacagacacgugggguaagaaggaaagaacaacuuaauaaauagugauguaucuuauucccacucacacccccauaguagggucauuguuuuuucuccauuuauaaagaaauguuucuuauaagagaguuuagauuuauccauaaugcacaggauaaagaauuguguguuuuggcagugaccaaaauugucucuuuaaaucucugacuuuuaucacagaaugguuauauaaauaaauucauaccaaaaaguagggagugauucuuaguaagcaauaucccuguagacucuuuacaauagaaagcaagggccuggagagagaaagcuuaguguuuaagaacacuugcuguuuuuccagggggcuccaguucuauucccaguauccguacaaccaucuuuaacuccaguucccguuuaucugacacccucuucuggccucuggggauacacacauggcacacagaugugcauacuggcaaaacagccauacgcauacauacagcaaaacagacugacaucaucaucauaggaaacaaaggaaaacaaagcaguugcuuuaggaaacaguagaugaacuaugcuguaugucuucuuguuacuuggguucugauguuuuuguuugaauagaauucucauuugauagugaaaaacuuuuuggacuaacucaagcauugcuuuggacuaacucaagcauugcucuuguguuaaguguauuaaaagauugagcgaaugcccaguuauuuacauuucuauauuucuacuccuuggguacaguugacaccuguuaaugguaagaaauaacuuuuagcagccauugaaagcuguuaucauagguuuuuggagacauauaaaacaagcaugacaacacauuugguuuugaaagguaaauccagauuucuaaauuguuuaaauuuuuacauuccaccuuuuuuacauuucuguccuuuaggucugccaaaaugucugaaagaucagaucuccuucacuucaaguuugaaaauuauggagauucaauguuacaaaaaaugaacaaauuaagagaagagaauaaauuuugugauguuacaguucucauagaugauguugaggugcaggggcauaaaauuguuuuugcugcagguucccccuucuuaagagaccaguuuuuacugaaugauucccgagaggugaaaaucuccauauuacagaguucugaaguggggagacaauugcucuuguccuguuauaguggugugcuggaauucccugagauggaacugguaaauuacuugacugcugcgaguuuucuucagaugagccacauuguagaacggugcacacaggcgcuguggaaguuuauaaagccaaaacaaccaauggauaguaaagagggaucugaaccacagagcgcuucuccccagucgaaagaacagcagggagaugccagaggcucuccaaagcaggacuuaccuuguauucauccaucugaagacaguauggauauggaggacagugauauucagauuguuaagguagaaucuauuggggauguaucagaggauagaaguaaaaaagaugagaaccaguacauuucuucugaacccacugcuuugcacucaucagagccccagcacucccugauaaacucaacuguggaaaacagaguuaaugaacuagaccagagccaucuccacaauuacgcccucucuuacacaggcaaugaugacaucaucaugaccucuaaagaugucuuugggccuaauauucgagguguagacaaaggcuuacaguggcaucaccagugcccaaaguguaccaggguauuccgucaccuggagaacuacgccaaccauuuaaaaaugcacaaacuguuuaugugucuacucugcggcaagacuuucacucagaaaggcaaucuucaucgacacaugcguguacaugccggaauuaaaccuuuccaguguaaaaucugugggaaaaccuuuucucagaaguguuccuuacaggaccaucuuaaccuucacaguggagauaagccccauaaauguaacuauugugacaugguuuuugcacauaagccaguuuugaggaaacaccuuaaacagcugcauggcaaaaacagcuuugauaaugccaaugagaggaguguacaagaccucacaguggauuuugacucuuuugcauguacaacagucacagacucuaauugccagccacaaccugaugcaacacagguccuggaugcagguaaacugacccaagcuguccucagcuuaaggagugacaguacaugugugaauugaacagggcuuagugcucacagccagagcuggcaguauggcaauagucgcugagucucuuuagaagucacuugguaguuucuucuacaaagccuccaagcaggugguagugagugaguugaagcacuagcagacuaggugacucccucuuaugguagcuuugcuuuccuuuggcccucuccugguuccuuuuugaguuauuuaaccugugauuucuguuuuccuuuucuaaggaauaauuccauuugucuaccuaguguugauauaugucuuagacuggcacuauuuuaaauuuuuuaccaagcacauucugaagguaccaacaaaugacauuaucuacuuccuacuaguaaacuguguuuaggaaaguuaauauuucuccuugggggaaaaaugaggcugggauagaaggugauacugcuguugaccuaaauaugugauagaguuucuguuugucuacugugauucauccaaggcugaugagugaaucugcuuccugccguuuguacuuuuuuggagcugcuguggagaaguguguggguuuguacuuuaaacacuaacugcccauugaaauuuucuuaaaacccagaauacaauuuuuuucagcaacuucuacagacaaaaagggacugccauggggcggauaaucaguaaaugauagaaauauaauaaaacaagagugggcauauggaaguuuuccuaaauauuaugaccuaacaagaggccaucugcguacauauauauccuguugaugcuuuaauaauuggaaauguuuuaggcaugcucaggugagcuaaagaauaauggauuauguuggagucuaaaugauguaucauuuuauacauaagaaaggugcauuuggccauaacuuguccaguauagaauuaaugucuccagccagucuuuccuuuucacauggaccuucaucuuagaaaucgaugaaaaaaauuaaaugugauacagaggaacuaccagaauuucugcauuuagauagccuuagagauacacaauacgcugucuacuuuugcuaccuuugauaguugaucuugaaggaugggggaaaaaaaaacaaacaauucuuuauccugaaguaaauuuuagacauuuguuugagccugcuucuuacccaaggguuacagggaggugauaggauugcuagagaucuuagaaacuuucaaaagauugcuuacacuaucugccauuuuaaauaggggcauuuagagucaaacagguagccuggccacuauuggcccaaauacacuugacaaaauaugauuaucccaauacaucucuuccacauaccuugucuuuaacgauggggaauaguaacacauuaacagaaaguuuccaauucuguuucacuauuguauaauugucccuuuugguuuucagagacagccaagaauucaccaacaaaaugucauagaaggacuuguaagaauuacuuuuuaaacuuuauuuuauuuuggugguuugugccuguaaccucagaauuuacaaaguuacaagaagguugccugggcuauagaaugaggcccuccuucaaaagaccuaaauaaauauaauuauuuuauaguaguggugcuggaagucgaacccagugucucauaggcacuggacaagcacuguaccaccuagauacagcucuagccugaucauuguucuuagcuagaugaacauuauacuauuucuaaaugacugguuuggcuaucaagggaacggcagguuagaauaaugcgaaaauaauccaaauaugaaacugauuuugucuaaaaaacuuuauuucuaccagacuuuuguuuuuuauuuuuaagcuaugagagcacauggacagaaaaauccaaaaauuuauauuaauuuauauauagacauaauuugauauauuuacacauagcucagauuugaggcauaauuuuuacuaaauauuuaaaugugaguacaguuagcuaacaugugugcuagguacuucaugcccaacaucacucaguauaguccuaauaaugccuccuagcauuccaaauuuugcaugauucauccaaagagcaccaguucuaugcaacagugggacucuaaucaucccauguuuuaaauauuuucucugaacaucauuugaagaugguggggcuccauauacuuauucuuguccaguuacuguuaguaguuugaagacuuaagaacggcauggguuuaaauagcacuggucucucuaguuggaggcuauuucuugauuaauuucagucacucagaaggccuuuuuucuuuucuuuuuuuuuuuuuccccuuuuuaaaaaaugcccgagacuuugaauccaaggccucaugcacauuaaacauguacuccagcacugagcuacucccacagccucaagaaguauuaguaaccaacuggaauuuccagguacuguguuauauucugaggauaggaagguaagauugauauauauggucccuguccuuauagggcaagcgauuuuagugagaugaugucucaaauuuauauccuaacaagaauaaaauugccucguuuucuuuaaucacuuaaagcagugguuuucuaccuguggaaucaagugauuuuuuuuuucacagagguugccuaagaccauagaaauuguuuuuguuuauauuacaauuuaauuacauuauaauucaaaacagcagaaaugcaguuaugaaauaaugaaaauauuuuuaugguugggcucaccacagcaugaggaacuguauuaaaggaucucacaauauuaggaagguugagaacccugacuuaaaguccacuuucuuagggguuucuguuaguaaaauuuuugguucuguuuguaaguguaaaccauuugcauaauuugugaucucuuccauuucuuggcuggagaggucuuauuuuugugugagauauuuaauuuugguggaacuugguuucuuugcuuacguguuucucagauuuuaaagcaaagagaagaggcauauauuuuauuguggaagaaggcuuuucacacuaguaauuauaugaggcagaggugagccuuaguuacucagcauuugguuuaauuuggcuuuuuguuuuuguuuuuguuuuuuugaggcaggaucuuacuauguggcccuggcugccucugccucugcugggaucacagguauaggccacgaugccagccucaguguuuguguuguauggauuccuaggaaaaccucaaaagaaagaggacccucuuuacuguaguuuguuuuuuuuaaaauuacuguuauuuauuuauuauuuaauaugaaaacaaucuccaaacugaaguggcucugagguaaaucaggugugauuuugcauuaguuuagaagauguguaagugaaaggugacuaaugucacuauuucuaaaauauuguccuaaacaacuuagaacauuuuauuucagcucaugaauggcuguucuaaaucuguuguauguuagacauacuugaacuaccucuuuacuuaauggggaaguuuccuuaauaaaaguuaaccauuaaccuguggugucauugacuucuuauucuacucucuucccuccuuauuucucaguuguuugaauuuaaggauucuuuaaggauggcaaagggcugaaaaugcagcucaauaguaguguuuucuggaggcccaggcuuaaucaucagccaucccuacacuucgcaaauagggacuuucugaauaacugugagaaugcaaagaaagauaaauauuguccuaaauaaucccccucccuugguuguggcauauauuucgauauggguauguacgugcaguuuugaagauagaucauuuccaacugaaucccaacuaauugaggugcaacucagaaauaaugugcaaucgguauaaaauggccgaccggccacgauguuccccugaggaaucaccaccaugagacaggucuaguacaaaaagaaguuuauugagugaagugaaggggaccuggaaaggggguagaggcagagaaggauauaaagaggaggaggcuugagggaaguccugggacuauugcuagucccauuguaauuggccauuguaaugacuuaccacgucuccuagcagagcacuuuaaauauucuuaauuaucuucuuaaauucccauccgaguuaacauuaugauuaaaaauaaggagaaggaggaaugaaaaaaaaugcucuuaugcuuaaaugguccgucaucuaacggggcgggggagcggggggggggggagagaagcacaaaacagcucccucaugccuggcaggugacuaugcaaacuguugcuaggagcuguugggcggagccuagaggaaucgcugacaaaggguaauuggggaggaaagcaaggcuuuacuuucauaaagcccuguguuuaauucccaucacccaaagagaagaaucuuuuagggguaggcugucaaaagcagcagggugaagaggaugccauuggaaacgacagaggaggggagggcaaagagacugguggagcuguguccugagguuagggccagguccugaugggaguagcccagcuacaauacauugcugcgagguccuuuccuucggcuccgccccucaacuccuuggcuccuuggcgguuccggcccugagcguucuucgcucgcagcaaacagcuucauaccggagcaggaacggccagaaagacccggcucgcugauauuuagauauuuuucugucuuuccugcagcggaaaaagagaggaagaaagagcaucucaggauguucuuccggggcguccagacagucuccgcgaagaauaaagcugguugacuccggaagcguuuccuuccaggcuaaguccaucuuccggccugggcugccauugccgcggaagccucaaagccaguuuugcuagucgguaagugaaagugacggagacaugcugggguuugaggcugaaggagugaguacaccccgcgguggccuccgcucuagccuggcaccgcacccaccugaccagucgggcccgacuucggaaggcucgacuugggaaccgugugccucguuggagggaguuggcaggcaggcggucuaggauuccagucagcuccucuugcuguaugggacccuuuacccacugggagaacacagaaccaggaggaaaagagucccugggagaggaggagucacguuaguuugggcucaacggagcuaaagcacaaguugggaaauggagcugaaaucgugaauguaauagauaggcaaaugggcguucccguguuuuauuuguacaaugaugaacaauuuaacauuaaggagcuggguguaugaaaaacggaccaagaucaaucaauaaaagguggguuagggugaaauccugaaggaguuugaauucuuuuuaagaacgaaaggcugucuaggaagugggggagaugcuggacgauuuaagcauaagagcauuaaagagugcuuugcuaggagaccugugggaagucauuacaauggccaauuacaaugggacuagcaauaguggugggacaauuugaagauuguguuuucuaacuuaagggguuaaguguacuuuuuuggugucacuacuguacugguauuuaaaaacuuacguaccaugauacagaaaugcauuuugaguuucugaguuuauagaugguuauugggaaacaguuuuacuccuagcacucaaaguuugggucuccauuauucccaauacaugcugggaagugggggacucaguaccauaaagcauugccuauccaguaucaaugcugugcucuguuuugcauagaucgugaccauggcugcugagucugauguucuacacuuccaguuugaacagcaaggagaugugguccuacagaaaaugaaucucuugagacagcagaauuuauuuugugauguauccauuuauauuaacgauacugaguuccaggggcacaaggugauuuuggcugcuugcuccacuuucaugagagaucaguuuuuacucacacagucaaaacaugucagaaucaccauucuacagagugcagaaguaggcuggaaguugcuguuguccugcuauacuggagcacuugaaguaaaaagaaaagagcuuuugaaauacuugacugcugccaguuaccuucagaugguucacauuguagaaaaaugcacagaagcuuugucaaaguauuuggaaauugaccuuucuaugaaaaauaaccaacacacugacuugugucagucuucagauacagauguuaagaaugaagaagaaaauucugauaaagacugugagaucauugaaauuucagaagauaguccuguaaaccuagauuuccaugucaaagaggaggaaagcaaugcauuacaaucugcugcagagacacugacaucagagcggaugagaaugcagucaccggagcucucugcaguagaugguggcuuuaaagagaaugaaauuuguauccuccauguagaauccauuaguacagaugauguagaaaaugggcaguuuucacagccuuguaccucauccaaagcaggcauauauuucccugaaacacagcauucauugaucaauucuacaguugagaacagagugacagaaguuccuggaaauacaaaucagggguuauuuucugagaauucugauggaagucaugguacgguaaaugagauccagaaucuggaugagaauuuuuccuugaggcaucagugccccagguguccaaggggauuucuucauguagaaaacuaucugcgacaccuuaagaugcauaaacucuuuuugugcuugcagugugggaaaacauuuacacagaagaaaaaucuuaaucggcauauucgaggacacauggguauaaggcccuuucaguguacuguguguuuaaagaccuuuacugcuaaaagcacacuucaggaccacuugaacauacacaguggggaucggccauauaaaugccauuguugugauauggauuucaaacacaaaucugcucucaaaaagcacuuaaccucuguucauggcaggagcaguggugaaaaauuaucuaggccugaucucaaacggcagaaucuacuguaaucaaaucaaugacuuuuuuagacacauuuuauaaaaaugcagcacauguaguguugccccccacccaaucuguaucauuuauuuuuguucuuacauguuauucauucugaacuucuaauaauuccaaaguugguggugugauuaaguuuaugagauucuacauugucucaaacauuauguauuaguccucuguucaggaguaauugcagauucugauuuguaguuuuuagauaagugauuuauuguugaccuauauagaauuuuaaggaaguaagauggcaagaaaauagauuugaaagcauaguguugcacaucgcuauuaauauugaaagcagauaggacuagcaguuuuuuuuuuuuuuaauuuaaccaguguucuugauuuauaaccagaacaccaagguacugucuuaaaacuaaaggagcacaauucaaauucacauggggccagcaaaaugucuuuagaaauacauuacuuaaauguccaaaagaauaugugauuagacccuuuuccugauuauauauauuguagccucccucagccuugaagcaggcugauccagacuuugaccuugcugccacuaagaaggagaggcuagagccuucugaccuugauggcucuauuugcucuucuccaagacugcuuccugcugaaaggucuuugagaccguccgaccuguagaucaccuacuggcuggcuccaggcaccaagaaugggcuggcagggaaugggccuacccucuuuauaagcauggacucucaguaaacuucagaggcuuugaacagaaagguuugucuuggccuaguucuuuucuugccucuggucucuuucagccccagcacgccuuucaggggaacccaguucucguucagcaggcggcuacaauauauaacaugguuggauuaagaacucuggccaaugcaaguauuuucuuaaauugacaauuuucuuagauuggcaaguuacuuuucuuaaauaguccacuuucaucaaagacauuguuacacuguuuacuuaggguuucuuuugguguuuguuuugguuuacaugcacuaaaauugaccucuguggaauuacauuucuacgaauuuaguacauaucuaauugucugcaauugggacacagaauaguuccaccagcuuccaaaauucccuuaugcugcucuuuuguaguccacccuuucuaacucuaaauucuacuaagaguucuucauuaauauaauuuguucuaaucugaggugauaauaaaacuggaaucuuauguucccuuuugauauuuuuuaaccccacauagugccauugagcucgauuuauauuugugaauauuuguguauauuaucaagucauuaaguuuucauaucucuuauuuuacuuuuggcaugauuugugcagcucgggcuggccucgaguuugccuugauucuugagcacugagauuaugucuuuguuuugaauugccucuguaugcauuuucuuuucgagcagucaucaggugaauaguuuuaauuuuuaaaagcuacuagaauuaguuauaaugucucauuauauguaugaauaucuguacauucaauuuuuuuguccuuacaaugaagagcaaaauuuacugccaggcaaaucaccuucucugaccacaagaagucacuuucaaacuguccuauuucucuacauaacucagcucuguguagaguuucuacaguauuuaaguuuuauugacucuuuucuauauuuuaacauguaaaauacuuuguacuauauaagagguuugugaaaauuaugugguauuauauauaauuuuugugauacuuuugugggaauaaugcucuacauugaauuuuuaacucugggagagacuuuaaagaauauaagucucaaagucacuucauaaaccaagucacuaauuaaucacauuaagcaggucaccuguccuucaacauucuuuuuguuuuuuuuuguuuuuuuuuguuuuuuuuuuguuuucgagacaggguuucucuguauagcccuggcuguccuggaacucacucuguagaccaggcuggccucgaacucagaaauccgccugccucuguccccugagugcugggauuaaaggugugugccaccaugccccgcaacuuuucuuaauuuuauauaaaauaacuuugaucuuccuaauuuguagaguuauuucuaaguaaauuucuacaaauuuauauucuucaugugaacagaggagacaugucuuuucaaacacugcuauuugcuauuugaguacucucuuggaaacagaacuuuuuuaaaaguaaacauuuuguuccacuuuauaauggauugguucaguggcuaauuuccuuucgcacauaacuuaagaauggccaguuauaguugugagcguauuccccucagagaaacaguuugugacugaagugcuucucuuauuuuugcuuccugaauugauuuuuggaagggaggguuagggauggguggaguaaacagugaguucuugggggaagugguauguacuauacuggguguucagaacauuuugaauguguuuuaaguuuuauucgugccuuguaagauuguuguaaaaucaaaauuugugagcacuuugaaaguuuugcuuguggggaggguguuuuauaaugugguuguuauuuauauuauuuauuuccauuacguggacaaauugauccuaggagcugggcaaagugcacaugccuauaauucuagcacuugggagauagaggcaagagauucaguucagggccagccuuucuuauauauagcuaaguuuuaggccagccucauauacaggagacauuguuuuaaggaaaacaaaauaaaaaaguaaaacaaaacaaaaacauuccugggagagcauccgcuugcaugacauuucugaaaaauucagcaaaguagaaucuguaaagauaugaagguaugacaaaguaaaguguagcauuuauucauuuuaaauacuuuuagcuguuuguuuaugucagaaaaagcaguauauuuggguugaaccuaguauguacugcauuuaaauguguaaaagaucuugaaaagguuguuacuuuguuguagagaaaauccuuuccucuuuucauuggauguaauuauguuuguaugaaacaauaaaccggaggugggaauggagaacuuugggcuuguguauuucuaugaauuuuaaaggaaucauuuucucuuuaguaauaauguuuuuuaaaauuaugugugugggguuauguguacauaagauuuauuauuauauuuuuaguuauguguaugugugggcauaugcuugcuagcagcuuuggauccccuccuggagcugcagugaaggcagcugugagcugggaacugcacucaguugcugugcaagaguagucagcuacauuaaccaccugguaaucuaugaagcccaaagacucacucucuccugccuguuuaauguaccaccaccuggcacauuucuguuauuuucaacuggacagugaaaaguagaacuaccuacuggggcuggagagauggcucagugguuaagagcauggacugcucuuccaaagguccugaguucaaauccuagcaaccacauaguggcucacaaccauccauaaugagaucugacgcccucuucuggugcaucugaagacagguacaguguacuuauaauaauaaauaaaucuuaa

SEQ ID NO: 799 - RNA, 7309 nt, Mus musculus
uuuuuuauaacaaugaauauuuaauuuccacaucacagaugaaaaagacucucugaagaagcauccaagggagacucaagagagggcagcuaaucagaagagggucuucucgggggcugcuuccacauagcucacuuuuuccuuaacuuuucccccuugauuacugaaguagagauaugcaugcugcaggaaaaaaaagaagaagaagaagaagcauaaggcggggucauccacaaucccacuagccacugcuggaauuuaagcacuugcuuuucuagucuuucuccugugcaguuucccacaagagaugagggauguaguauccucagggaaccaggucuggauggcaaaauccaggaugcucaugccuguucugugaaaugguauggugucugcagagagcccauacacacccuccaguacacugaaaccaucucuagguuacauuuuuuauaccuaauccagcaugcaugcuguguagaugccguugagcuguguugaggaagaacgugaugaugguacagaccgcacaugcucaguacagaugcaguuuuuccaagcauuuucuuuguuuuguuuugcaagacaggguuucucuguguagcucuggcuguucuagaacuugcucuguagaccaggcuggccuuaagcucaccgagauccaccugccucuaccuaccauugcugggauuaaaggccugcaccaccacacccacacauuuguaacucacagcugauuggaacuauagagauggagccuacaggugugggaagcccaaucauaaagagagcaacugugccaugcuuuuacauucucuucauuagcauuauauuuaaugggaagauagcuuucagccagcaguuccuagcucugcuugcugggaguguuuaguacuuuaagcauaagagauggcucagcgguuaagaauacuugacuacucuuccagagguccugaguucaauucccagcaaccacaugguggcucacaaccaucuguaaugagauccaaugcccucuucugaugugucugaagaccaagacaguguacucauauacauaaaauaaauaaaauuuauuuuaagaaaaaaaaauuaagccgggcaugguggcgcacaccuuuaaucccagcacucaggaggcagagguagguggauuucugaguucaaggccagccuggucuacaaagugaguuccaggacagccagggcuauacagagaaacucugucucgaaaacccccucccaaaaaaaaaaaaaaaaaaaaaaaaaaaaaggaagaaagaaaagaaaagaaaaaaauuuuaaaaaaaagaaaguaguguuauuuuaggguuagccugcuagaaguggguaaccaggucagacauucugggugagaguucaaagcccucggcacacauagcaaaugcagcuuccucucggcuuggaggcagccuccuuaccccaguggaugcccugggccuuccccucacccugugcucucaugguguccuaacugccucuucuuuucucucuuguccagccugguaaagcccuugcgacacuaugcugucuuccucucugaagacuccucugaugaggaaugccgacgggaagaggcccccagcacuggcuucacugaaagccuucucuucucugcucccuuugaauggucucucuuccucuuuccagcuccuugggcucagccuggugacucuuugggugcaguggggagcaugggggacuggggcugcuugcugccauggggagaaacguuccugggugccaacuuucaggguggcugccaugucuacaggccuucucucaggcucguacugugccggccccacagggcugugacagcaaagguaucaggugagacugaagcacugauccccauuccuuacaaggggagacgacuccaucaguggaacuggcgaccacaguaagccugacuccugacccuccuuuucucagugcaucuuagaaagccauggagauaggaaggcagauguaaaguaaaaggccauauacauauacaucugucgucucugcugagguagaaggacugugaguuugaggcuagccugggauacauagcaaauuccaggccagucugagcuauauacaugagccuuucuaaauauauauacuaugcauacacacacacacacacacacacacacacacacguuaugaucuacuuggguuucuuucuuuuucuuuuuuuucugagacaggguuucucuguguagcccuggcuguccuggaacacauucuaaaacucagagaucugccugccucugccuccugagugcuggguuuaaaggcauacacaccaccagcacuaccuagguuuccuaaaaguaauuucaucuuaacucuauuauuuuaugacguaaguuacauacaaauuccaaacaccauuuuucuuuucaaggaaaagaaggcuuaccuuacauacaaauggacuucccaggagccucagcgaugugcccacaacuaccagagugccagcugcuguccaccucacagucagggguccuugucgcccuccacuguccccauccucagccccucccagcucucugaccuuagcaaguucccagcaucagaucugcucccuauggcuucauccuggaccuucuaagucaaggcugcucugcccccugcucguuuccugcugccagcucacugguacaauagcagugguuugucccuguuaguucacagucccugggcuucacacauaccuuuuuaguaauuucauucucucuuugaucuuuuucuuuuaaauguuugaagauucagcuucuccccagcaggaaugucagugcuaucacaggucuaauguguccacugauguagcuauuacuagugggagcaaaaagagcuauugaaacaacacaugcucaucuaaguggcaacugcgacucacccugcaggaaagcaaccuacuuggaagacucccaccgacucugcccuaagccuuaccccaacaggccucugaacuaaaugauugacuggcauuuuuccccgaauuuuacaauguuaggaauggaacccaggaccucacaugcugcacauucuaccacugagaagcagugguuaaaauucauuuccuuagccuguacccagagccaguucaaggcuuccuguguguuuuuaaagggggaugucccauccuaauucacaacacaaaagggcuaagaaaacugucuccuguuuaggaaggagggacucuuccuaaccccagcccuuccuuugugcucagcuuagauuaaaggcucuugaguuccuuggucacagugaggaaaagacuuugaagagccaagccuggcgugguggcgcacgccuuucaucccagcacuugggaggcagaggcagguggauuucugaguucgaggccagccuggucuacagagugagcuccaggacugccagggcuacacagagaaacccugucucggaaaaaacaaaaacaaaaaacaaaacaaaacaaaaagacuuugaagagccuccaacuuugcuuccauuccaccccuugcugggugcugggacacacagaauuguuuuacuuaacuucucuggguuucccugcucucaucuguaagguaggguguaaguccuaaacagaaaagucugaugaauggaguugggacuuccuccucuuucaguggaccuuuggugucagccugcuugugaccagcagguggagcccucaguccacuucaccaacaccaugugcacagccagccugacccuaaaagggaggcauucauugcacuggccagccuucaccagaggucagggcuggugcugccucccgcagaucaguggugcccuaaaacucagugggaaagcaaaacgagucagcuguuacuuaccccagcucucccaaaaaguuguguggcuacacagagcucacagagggugggcugcuggcuggugcuuugcuccagccucagccuacccucugcgcuuguuuauggaaccacaccaccacuugagcagcugagauuuacaaagguuaacugacucagccagguuccccuggcaagguauggaaccagggcucaaacauaaaucauauaagcuaaggccuagaaguuucgcuagagaugcuagggcuccugguucaugcucuggaccugacucuaaagcuaagguuggccacuacucaggaagcaggugggacaaaggaaugcaugcaucugccugcuaugucccuccacuccuaccugggcuguauguuauagaccuugggcccuagggcgcuucaccaucuccucagagaaagugagaguuggagcaucccguccaaggcaccaaucauacuaaagaacccaauccggccccaggagcaccacaaaacauugguccuggggcuuggugucgcaagggcuagagccacuugcuccucccacagauucccuagaagaaaauccagcuggcuuugucuccuccuaggccacagccauaccggacauugaaagaaucagacagcgcagaaggugaugagaccgagaguccagagcagcuaguucgagaacccuggggaccuaccccugcuccaccugaccgagcugccagcauugaccuucuagaagaugucuucagcagccuagacguggaggcaccacugcagccgcugggccaagccaagagccuggaggaucuccgggcccccaaagacuugcgggaacagccagggagcuuugauuaccagguaugaugggaguagggaacaguaguugauggggugucuccuaaugagcaagguccuccuagucacaguggaaggggccagggagauaggacaucacauccccaccccuguguuaguacuccaaccccacccaauuuggagcaguacacuguuaccagcuaucacggggagcuaucuaucaugcuagcacagcagggggugucugccugccuccauucuuaucugauaguuggcugcugcaaggcuuguccaagcccaccaggcuccuuggaucaaacuccuggguuauggauugguucucccagugcgacuaucagucagcuccccucucugggauucauagauuaucccaccuucugggaaugaagcagcucuagucuagcccaggucaaauggaggcauggucaggacucaaauacaaucucuucucuggcuccugucccuucagccaggccuagaguuacacuugccccuuugaggguaaucaaagacaccacaaucucugaacagcaaaaaggcucaagccauuguuagguggcccacagauggaaacauuuuccugaaacugcuuggcaagcauaggcauuuguaaaaagacaggagauuccuuuguauuccuuuuguggaacacaguagggcuuggaucucugcaggugucuuggguaccugcaacuccucccagucccaggagcaaugugcuuggcaugcaggaaggguugccugggcuaaccaguggucaucacuuccucccuccuuccccacagagacuggaccugugcagaagugagaggggccuuagcauggcugcagccuugaagcuugcucauccauauacuaagcucuggagucugggucaggacgacauggccauccccagcaagcccuccauaaccuccccugagaagcccucagcucugcuugguacuuccccagcccugccucucagaccccagaaccaggagggcauccugagccccagcaucaaggaggagacucccaucccaacuccgggcagcaucaccauucccaggccacaaggcagaaagaccccugagcugggcaucgugccuccaccacccacugcccggccagccaagcuccaggcugcuggcggcccacuuggugacuucucuucagagccacugcagauggaccgggaaagacaagccgcucugaguccagcccuccugucagggcugcuccccagagcugucccccaaggucccacagaacuucugcagccacccagcccagccccaggagcugcaggcacaggcagcgaugcccugcucgcucuccuggauccacuuaacacagccuggucaggcagcaccaucccaucacauccugcuacccccagugcagccaccccauucaucccucagcucagcuuccccccaacagugacacccaccccuuuuguacagacaccacucaaucccuuugucccaucugugccaguaguaccacccuccaugccccugagcucuacaccagccaggccuuuugggaccccuccagcaucccuagggccagcauaugcaccuagcauucuauugucuaguucuggcuucuaugccccucacaggucucagcccaaccucucugcucucuccaugcccaaccucuuuggccagaucccaaugggugcccacacuaguccccugcagccacuuggccccccagccguugcccccuccaggauccgaacauugccucuggcccgcucaagugccagggcugcugaggccaagcagggguuggcccugaggccuggugaauccccacuguugccucccagaccgccccagagccuacagccaaccccgcagcccucuguuccuacacaggccagagaccccuuugaggauuugcugcgaaaaaccaagcaagaugugagcccaagcccagccccggcccuggccccagccuccaccuccguggagcagcuccgcagacagugggagaccuuugagugagcaggccugugccacugucuaauacugugccuccccaacgucccauuucuagccaggcuucauggggcaaagggacucugcccccuccuccacagcccaucucugaggccuggcccugggaauggccaucccagaagagcugccugccgccacccuuggcacccuguguggguuuugcacuauaugucaacuggaccagcuguauccuauccucccauagcccaagaggagucaagaagcucaaggcugcuuucaagcccagcucuccuccuuugcugggccccaccccacagggcagaugucaguaacaaccuguguaagcacagcuuugggggacauggguguuuggggggcugaaaugaggcccacuccuaggcuggcauuucucccugguggucaucuccaaaccucucuagcaauauacucuuuccugagucuucaccuaaccaccaacuggaguuguuccugaagggucaggggucuggagaccuaauggucagcaaacccagccccagccagcucuuccagggguugggaacaccagcaacucuaacuuauaagagaagcuccaaaccugagucuuaggagccgcccucagcucucugccacccucauaccucug

SEQ ID NO: 800 - RNA, 1575 nt, Mus musculus
ugcuuuaauuauuucuuguuuuaauuaauuugaccauaaugauugggucgguggucuuucuccuuccaucuuugguauuaacacuagcccauuguggguggugccauccuugggcaaggugguccuggguucuauaaaaagcaggcugagcagaccauggaggagcgaguuaguaagcagcacuccuucauggccucugcaucaguuucuuccuucaggcuccugcccugcuugaguuccuuuucugacuucagugaugggaccacagugugcaagaacaagccaaauaaacccuuugcuuccccacuuugcuuuuggucuuugguguuucaucauagcaacacuaacccuaaguaggagagaugggcgggacacuguagacagauaguccagugaauaugcccaagguagaaaggagcagucagguggcaugggugucgaugugugagcagagaagaugggggcuagggaauuccguuucugagggcugugucauggcuggggaggggguggcgguggcuuucuaaucucagcacagacaggucuccaaggagccaacgcagugacucggacccucugggaguguggaugagaguggcccggcugaaagccgccuuugccgucuccauacacgucucacugucuggggccuaaaauagagcaggaauagaaugaucccgugagaagauucuggugaaggacuacaggaaaagggacaugagucacgcugggaacccuugaguucgacacucccaaaguucugcugcccugcccaacaccauugggucucccacauccaucccugcccacuuuggucugguuggggagcuggcaggcuugguucugucaugaaggaacuaagucacuuacccaugcuucauuccccugagagccugcuucucagagguaccagaaauaagggaccucagacaucugcugugagggccaugguaauugaugagcaaaggggcccaacccaggaccagcaccacuaucggccucuguauuucucuggaccucaguuuccucaccuguaaagguuugucuucgcagguuucaggucaaaauccacguuacgauccuaagcgcuccugggaccucccuccuguacuuccagccccggacccucagacguuagcauagacuugacacauauuuuucaugcccugcguuaggcacacucugacuccugcuccuugcacccuggagguagaggaagauguucucagucccagggcggcucguggguacuaccaugugcuaggcucucacguguuuaacuacggacugugcuaaauccugcucugugagaggaaggaguccuuggggcgguacacugcgucccggugcgcggggccagcgcgcccucuagaggcuacucugcucaaagucuugcucgacagccagaggagcucuggaucuggccagcaggcagguuccaagguuggaagacucuuucuggugucuccugcuacucuaccuccacuuuaaccuaaaagugcucgccucacuaccaccuuccauggaggcggcucagagagcucccccacugcggcugcgccgccccgccccauu

SEQ ID NO: 801 - RNA, 1575 nt, Mus musculus
aauggggcggggcggcgcagccgcagugggggagcucucugagccgccuccauggaaggugguagugaggcgagcacuuuuagguuaaaguggagguagaguagcaggagacaccagaaagagucuuccaaccuuggaaccugccugcuggccagauccagagcuccucuggcugucgagcaagacuuugagcagaguagccucuagagggcgcgcuggccccgcgcaccgggacgcaguguaccgccccaaggacuccuuccucucacagagcaggauuuagcacaguccguaguuaaacacgugagagccuagcacaugguaguacccacgagccgcccugggacugagaacaucuuccucuaccuccagggugcaaggagcaggagucagagugugccuaacgcagggcaugaaaaauaugugucaagucuaugcuaacgucugaggguccggggcuggaaguacaggagggaggucccaggagcgcuuaggaucguaacguggauuuugaccugaaaccugcgaagacaaaccuuuacaggugaggaaacugagguccagagaaauacagaggccgauaguggugcugguccuggguugggccccuuugcucaucaauuaccauggcccucacagcagaugucugaggucccuuauuucugguaccucugagaagcaggcucucaggggaaugaagcauggguaagugacuuaguuccuucaugacagaaccaagccugccagcuccccaaccagaccaaagugggcagggauggaugugggagacccaaugguguugggcagggcagcagaacuuugggagugucgaacucaaggguucccagcgugacucaugucccuuuuccuguaguccuucaccagaaucuucucacgggaucauucuauuccugcucuauuuuaggccccagacagugagacguguauggagacggcaaaggcggcuuucagccgggccacucucauccacacucccagaggguccgagucacugcguuggcuccuuggagaccugucugugcugagauuagaaagccaccgccacccccuccccagccaugacacagcccucagaaacggaauucccuagcccccaucuucucugcucacacaucgacacccaugccaccugacugcuccuuucuaccuugggcauauucacuggacuaucugucuacagugucccgcccaucucuccuacuuaggguuaguguugcuaugaugaaacaccaaagaccaaaagcaaaguggggaagcaaaggguuuauuuggcuuguucuugcacacuguggucccaucacugaagucagaaaaggaacucaagcagggcaggagccugaaggaagaaacugaugcagaggccaugaaggagugcugcuuacuaacucgcuccuccauggucugcucagccugcuuuuuauagaacccaggaccaccuugcccaaggauggcaccacccacaaugggcuaguguuaauaccaaagauggaaggagaaagaccaccgacccaaucauuauggucaaauuaauuaaaacaagaaauaauuaaagca

SEQ ID NO: 802 - RNA, 1034 nt, Mus musculus
aaauuggguguaggaggggcuucggaggguguuugagcaguugacuuaggccguucucucggcccaaaguccccucagcaauggcgagucagucgcagggcauccagcagcuacugcaggccgagaagcgggccgccgagaagguguccgaggcccgcaagcgaaagaaccagaggcugaagcaggccaaagaagaagcccaggcugaaauugaacaguaccgccugcagagggagaaggaguucaaggccaaggaagcugaggcauugggcucccauggcagcugcagcagugagguggaaaaggagacccgggagaagaugaccguccuccagaacuacuucgagcagaacagggaugaaguccuggauaaccucuuggccuuugugugugacauccggccggaaauccaugaaaacuaccgcauaaacggauaggagguggaagugccugcucuguggguuggcaugagaucugcccccauagaauaggaaaccuucacagagcuggaguucuguucuggaaggcauuaaauuauuucucuaugcuguuguaggacccuucacuuuuugagaguaucaaaucuagcuuuuuguacagacuucuuauguaccugaaguuucaucuucuuaucuugugugucuuuaaggaguguaugucaccuguuuuccugugucuucaugcaaguaaucgauaucaauguugacuuuuuuuuuuuuuuaauuagccuaguaggaaaaauucuuugaaggaagaaggggaguaaacuguucccuucuccuuucuuacaggucaggggcguuaucuaugaaaaaguagaaguagcuauuaguaacuccugugaagaagcagccagccuuagaguacucuagccuggauaauuuaggacagucaauacgauaugcuuguuccggcugcuguuaguguaaccuaacccaaaucacuagaugcuaggacuuaacuuguuacauguuuuuggugugcuuauaaucauuuaaaaguaaaaauuugucuugcuuuucaaaaaaaaaaau

SEQ ID NO: 803 - RNA, 853 nt, Mus musculus
uuuuuuuuuuuuuuuuguguuguaagcaccaauuuauuaacauggagaaagccaaugccgucugcuccaggugucagacacacaacuuggcccacugugccuucgcaugagcuuucuugucaucaggcuggaaucaccagggagagggaggaggguguugguggaccaggaugggucuuacccaaaacaccuaggcuccacguaacccacaggugaguuuuucaaccuaauaaugcuuuauuaaacaaaaagaacacauguugccaaugcuuaaaagugaauaauuucauauuuagcccagcccacccuucccaaaucuuaccaugugaccucagauuccccuucccaguccuucccucauucauuauaacucccagacccuggguuuggaggcagacacgguacucuuggaacuagagcgggaaaugggacacaaaaggggugcucaacaauagcuagcugcagauaugacacaaaagguggcuccaaggauccggguggugcuauuaaaaggacccuuagggaccugaacaccagccucucauucuaagcugggaguguggggcucuuggagggcaaggggcaggaauccaggcaccccagagucacaaaggaugguucccuggccuggugggaaagaagugggguugguugagggaccaccaaggccaccucaccuggguucucaugacuggccaucugcugguccucagaauccaguggccccggagaccaagcuucuucucgaagcuccauaucugggucccuccgcggccccggggccgucacgccgcacucuuccucucgccugccucgcggaugguggcagcggcggcagcggcgacucagaccc

SEQ ID NO: 804 - RNA, 1195 nt, Mus musculus
aggugggugcagcgaacuuuauugaugguauuuaagagaguagggagggcucccuaggccccuccuguuauuaugggggucugggauggaaauugugagggagaugcucaguguugggggccgaguugggauagggccucucucuugcucaguguccuugcugggguggguaguccaggauuucuuacuccuuagaggccauguaggccaugagguccaccacccuguugccccggcaucgaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagauccacgacagacacauuggggguaggaacacggaaggccaugccagugagcuucccguucagcucugggaugaccuugcccacagccuuggcagcaccaguggaugcagggaugauguucugagcagccccacaaccaucacgccacagcuuuccagaggggccauccacagucuucuggguggcagugauggcauggacuguggucaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcggagaugaugacccuuuuggcuccacccuucaagugggccccggccuucuccaugguggugaagacaccaguagacuccacgacauacucagcaccggccucaccccauuugauguuaguggggucucgcuccuggaagauggugaugggcuucccguugaugacaagcuucccauucucggccuugacugugccguugaauuugccguggguggagucauacuggaacauguagaccauguaguugaggucaaugaaggggucguugauggcaacaaucuccacuuugccacugcagaugacagcccuggugaccaggcgcccaauacggccaaauccguucacaccgaccuucaccauuuugucuacgggacgaggcuggcacugcacaagaagaugcggcugucucuggaacagggaggagcagagaguagau

SEQ ID NO: 805 - RNA, 1195 nt, Mus musculus
aucuacucucugcuccucccuguuccagagacagccgcaucuucuugugcagugccagccucgucccguagacaaaauggugaaggucggugugaacggauuuggccguauugggcgccuggucaccagggcugucaucugcaguggcaaaguggagauuguugccaucaacgaccccuucauugaccucaacuacauggucuacauguuccaguaugacuccacccacggcaaauucaacggcacagucaaggccgagaaugggaagcuugucaucaacgggaagcccaucaccaucuuccaggagcgagaccccacuaacaucaaauggggugaggccggugcugaguaugucguggagucuacuggugucuucaccaccauggagaaggccggggcccacuugaaggguggagccaaaagggucaucaucuccgccccuucugccgaugcccccauguuugugaugggugugaaccacgagaaauaugacaacucacucaagauugucagcaaugcauccugcaccaccaacugcuuagccccccuggccaaggucauccaugacaacuuuggcauuguggaagggcucaugaccacaguccaugccaucacugccacccagaagacuguggauggccccucuggaaagcuguggcgugaugguuguggggcugcucagaacaucaucccugcauccacuggugcugccaaggcugugggcaaggucaucccagagcugaacgggaagcucacuggcauggccuuccguguuccuacccccaaugugucugucguggaucugacgugccgccuggagaaaccugccaaguaugaugacaucaagaagguggugaagcaggcaucugagggcccacugaagggcaucuugggcuacacugaggaccagguugucuccugcgacuucaacagcaacucccacucuuccaccuucgaugccggggcaacagggugguggaccucauggccuacauggccucuaaggaguaagaaauccuggacuacccaccccagcaaggacacugagcaagagagaggcccuaucccaacucggcccccaacacugagcaucucccucacaauuuccaucccagacccccauaauaacaggaggggccuagggagcccucccuacucucuuaaauaccaucaauaaaguucgcugcacccaccu

SEQ ID NO: 806 - RNA, 3186 nt, Mus musculus
guuuuuuguuuuuguuuuuguuuucuuccccucucaagaaaggaaagagaaaguccguggccacuauuuaaguuguucuaaaugaucguguccuuuuuggcuucgaaacuuuuguaccuaaaaaucgagggaggcgcugcauucuuucagcucaaacugucaaaacuuggagaaggggaaccucggaggcaggccggagaagaggagagcccugaaacuccgcggggugggaagacgcugugccucgaggauuaguuuaaacagcgggcuauaaaagauguaacagaugcaaacuguaacacaagggccauuaacccuuucucugccgcccagcacgcccagucccuacacccugcaccuauugucuccggugccacaagcuuugcggaaaaccuggaaagugaguaucaguuuccgcacauuugcugagcgggggugaaggggggcagagagaaggggaaguggguguuguaggaagcacuuuaaauuuacuuaggcauacagaguaggcuuuccaguuugacacauuaaaaaaaaauacaaauauaucauuuuuugaucuguccuacuaauuugaaauuguugggggggggggguccuggaauaaagaaauggucacacaagcuugugggaugaaacagcugucugucuguauuucugcugagacuuacaaaccacugcauauaaaauauauauuuaauaaaauaaguugcuaguuuuaugagccagugugugugugagggaaagacauggcauuugugcuguaaacuuuauuugugaauguuagucuuaacucuggaguaagcgaucuugcccucaucauuacaggguuagcaugugaaacauguaaguaggugggagauaaacacguuuauguuagcugagcucagcacugugccugugacucuugaacuccgacuuuucagucccaaagucuggaauggugugguguggugugguguggugugguguggugugguguggugugugugugugugugugugugugugugugugugugagagagagagagagagagagagagagagagagagagagagagagagagaggaguuccaugaaaaaucgauguguauauuacuuggucauuuaaaauaaaauaucaaaaguuacccuaauuuuaacccuauuauccugacagcaguuuucuucccagcuguugcgacccccccucucccauacacuuugguaaacgacucaaguuccaagagaacuuucacuucuuuauuuauaaucacagaagugagguguuacuucacacacacacacacacacacacacacacaaagaaugaaauaaagaaaugaaacucgcuaggcagacaaaaacagucaaguuucugcuuagaaaacagccuucuccggugggaaagguuagacuagucugccagaucuaagagaaggacuugcucccgaauuugguaggucuuucucgaauaaguuuuauaauuauuaacagguauuugccaaguuuuaauugcuugauauaaugaauugaaagucggugugagaacaaagcaguagaaacucuccacuugaugaguuuuuuaccccagccauucaguucucaacaaaacuuuuccuagacuauguagcaaaaaacaccuuugguuaccugaauggacagguacagggcgaauuacugggggaaggggaaaaagggagaggaaaggaaagagagaguaagggaaggcaugagaaagcaaagaagccacucuugggaaaagaaagccugccaccaaagagcuaaaaccaccugaaauuccuguccagagacacccggcucacuucagacuaacauucccacucaaaaugagaaaauuagagagggaggguggggggcaagagcaccaaaaaaggauaaaaagaggaggaaaagaaggggggggugggaaaccuaccugugaagucuuguuuguaguuuuggccagaaauggugagaagaaaaagcaugaagaagccgcgaagugugggggagaaaaagguggaggcgaagaaacagcucccggagcaaacugaacaaaaccucgccaagagugucuggaggcaggaccguuauuccugccgagcagguuagaacugaucucuuuucggccacuccaggaaacacaaaccuggggacggacugacguguuacgccucuucuaaugacauuuuuuucuuuuucuuuucuguaggggagagaagagagacccugaaacacgcgccaccuaucuuuguggggagggauaauugaagcgcccugagcgugagcaucaugugaaaacgugaucgccaaguuucucucugggaaaggaucugggauagauuauaccuugaagucuccgcaaacgcuuuaguggaagaaaugaaauuccaccucccucccuuccucucucccucccucccuucuccacgccccccccccccccccccccccccgucaagcaagccuuuggcaucauuauccucaucacuaaauccugcagaguacugggcggaaaacggugcacaccauucacagaacuggagaacuccaaggggcgaaaguuaaagggaaagcucucgggucuuccaugcagaucucuugucuuauacagauaucucuggugacuagguuugaggugcacgucaaguuguauggauaccucaagcaccguuuuuggaacuaaauucuugcccuuucucuuauuacauuuuuuuuuuuaaagaugccagagcuaggggagggaaaugcuacuuguacacugcaucuuaggaucucagugugcaguguauguguguaugugugugugugugugggggggagauuuucuggauuggaucccuauauuaaaaguuuggcauuuuaauaaagggucucuagguuaacauagagcuguacuaugcuggccaaucucuggaccccucuacaccucaugcagaccacauuacaaagugaggggacaggggcaggaggaagaaggagaaaggucagaggaacuuaggacgaaagaaagaagagggugacacuaaacuguguggggucuaaguuuugaagugcauauuuuugauauugcaauuaaacuaaaauuaaaaagaaaagacuccaccuuugcucugaagggauugguuaugcaaauauggaagggauuuccuggagaauacagcuuucuacuguaugguuaauuaaauaaucacucaaaaag

SEQ ID NO: 807 - RNA, 1845 nt, Mus musculus
cccuuuggaacagcgacagcauaagaguaagauauagcuguuagaguuuccugguaucauggcggaaccacaaggauucgccaccagaggaaucagauuuuaauaaggcuuacaagauuagguuuugguuguugcacuuagagauugaguuaccauuguuucugaacuaaguuuguguuguauuuuccuucacaggguggcuuuucuggguucaagagagaaugguaaagguacgagggcaaagugugaguuugccugaugugcaccacaagggccauggaggauuugaagcacagggcuggcaugguagugaccugcgagugagcuguguggagauuguggaguucugacucagugcaggcugaacguugccggcacaaauucaggaaccagcugguucauauuuuuuucaauaauuccugcagcacccacaugaagagcaaguugaacaucugguacauaugugaguggaugcuuagauacagcccauagacguccuuucguuggugguucagacucugagagccccaaggcuccagguuaguugacucuguuggucuuccugugaaguuccuauccccuuuggggccugcaauucuuccuccuauucuuccauaagaauccccaagcuccauccacuguuugcuuguauguguauuugagucacuguuugccugugggucucuguauguguaucugagucagcugcuggguagagccuucaagaauauauuuuuaaaucucaauauuuuugcuuauuuucugcuauuuuugcuauauaagauuugaugagagacaaaagauuauuuuguucuaucuugauaugugcgcuauaauauagacuauuuuagugauaguuucucuggcuacuaagaaaaagguucacucuguaucuuuugaauugauugauacuuuuauaugauauacuuuaaucauauucauuccauuccaaauccucccaguuccacccugaugcuccuacgcacuuaacauugugccuuuuuaaaaaaauaaaacuuugagucuaaguuuuguuucccuuauacucuugaguaugguuccauauacugaagcauggucgacauauuuaguagcuccauucuuuuuuuaaaaaaagcauucacaguauuggaagaaggaaauguagucaagaagucaucuuuagucucuuacuuugugcaccuaggucaauugcaaguuucucuguuagucacuauuaaacaacagauaggaacuucguuaaugaggguuuacaguuauguucaucuauaaguauagcaauaacucguuaguagcugguccaauauuauaccuauguccuaguuuucuuucuguuguuuugauugacauguuggggaagaacgguuuuauuuuaucuuacagauuaugguccaccauucagggaacucaugucagaaacucaaggcagaaguugaggccaugaagaaacacagcuuuucuagguccuccugacuugcuuauauaaccugggacuauuuguccagcagugucaccacuuacaaagcacugagucuucacacaucaaucacuauuuuuuuaaauccccauagucuugucuacaggucccaaucuuaugaaagcauugucuuaauuagcauucauuucugccugacaugucuaggauuaugucaaguugacaaaaaauggggaaaaaaaacccucaguaauuuugcauuuuuccuuuacaagucuuuguacauuugccauggggaagauuuaguaaggucaugacuguaacaagugccucauguauuugaaagucuuucuuuuuugaguuugggaaauguucuucuacaauggaauuaaagucuugauucucucugu

SEQ ID NO: 808 - RNA, 91492 nt, Mus musculus
cagcuucaggacggaaccggaaguguagggggcggggccggcggaggccaggagaccgaaaacgcggccgagccgggagccgggagccggagccacagccuggaccagaacuuggccgccgccugcgccaccgucucucccgucgccgucucccgcggccgccucgcaccgccaccgccgcgagcucggcuacugugguccgcggacuuuggguguccggguugaaggucgguccggacgucggagcagcucggcucccggaccguccgggcggcugcgggcgccgccgccgccgccucgucgccucagccaggcguuuuguucgcugagacgcgagaggcgagcggagcugacagugauuuugacagugauuccaacccgcuuuuguuguuguuggcuuuucguuguuugguuugguguguugugcguguauguggcgguuuuucccccgugguacauuuuuuuaaauuguugugccuuuuuuuuaaauccuuuuuuuuucaacccugugaacguuuuuugcuucccccucccccccgccucggggcuuccgaauauguuuuaugacgguugauuuuacaccaggagguuugucuccgaggaagacccagggaacuggauaucuagcgagaacuuccuacggcuucuccggcgccucgggaaaaugggagcugcugcaaaguuggcguucgccgucuuucuuaucucuugcucuucagguagguggaggagccggcgcggcggggcuguggccgggugccgggugccgucugcugggcaguucucgggccgaggcuuuucccgcgccuaaacccgcagccccgaucaucucgaaaucuccaugaauuccacuuguuuuggguugguguggcgaacugauagguugagugcuguguuguugugcaagugagaaagucaugguuuguggccauaacacucgaugacagcgcugguuggguugcuguucaagccgcaaauaccacaagugaaaauuuauguaaagguuugagacccagaaggagguauuccaaaaugucauuuagccuaagcuguuccaaaacaaggaccgguuuuggucgucaucuaauuagugcuucaccggugaauaucgagacauagaucaagugagcugguguuuaauuuugacugugagaaacaaugcauccuaucagcgauuuaaucuaggucuccucucacgucuucuccaacuacauuguccaguaguguuaaaaauaguuuuaguugccggaguauuaacccuaacccagugcagaagagguaugcugcuguguguugguggugugugcuggcuuucacccaccauuugggugcucuuuucaggcguagauucugcuuaccuacggaauacuuauuuuaaacgcuuugcaccgacacguuguuuucaguuaagaacaggccaugugaaauuguguucauguuaaauaugcuguucuugugagauguauuucuuuuucuuuucuuuucuuuuaacucaagguuaggagaauacucuggccauuuuauaucugaaaaauuugauuaugugaagauguuguaugguugcaaccagugguuggaaaaacuaggcuuuuguauugaaauucuggaaaugcauacauacaucuagcugaaaggugugcaaaugcacuuaaccggagaguuaguuggagggaugaaagaguuuaaaagucacagugaaugcauucauuauaaaaauucaguguauacuuccuagguuguggcaaacaggaggggugggggacaaauugacagguuucaugguugugucauucccucguaugucacagggaaauuagaaggugguagucuuuucuuuguguaccucucuguuguguguguguccaucuucccuaccccaccccccuuuuaauagaauccuuuguaauguauagaauuuugcugaaugguacauuuccuugugguuaauaaauggauaaagucuagucuuaugucuguagugguauugaucaguuccgggugggcugaauguguugugaaauggcgaucauugccagagauuaaccaaaagaaucaugucuguuuaaauggaagaaggaacaugcuuaaggcaggcggacaguucuuuuugugcucgguuuagagagcaagcuaaacaauggugucugaaaugaaugaaagcuuugaugauguuaaacgucuugcuuuucugaaccgacuuaacccuguaguuuuucccccucauagugcuuuucccccugacccuauauaucuagcugguaaacuccugcucaggucuccuuuuuuucugaucugcccuugaggaggaggggcaucauggccacugaccaacgacuguggacauuauucuuucucaaacccaccugagucucauuaauuggugagggagguuauucuugagcagccccaagguaucacuccuggaaaagcaagcugacacuacagaucuuacagcuuccucugcuuggcucggaguaagaggaaccgaguaguucaguaguucccuuugcgauuauuuucacugggcucacaggcuaauagcaaacauuucgagguugagaaguucugcuguuauagaacauauagauaauccauugaaauaauuugaaaaacuuuauccauauugauacaugaagguguguuugugcuuaaaaugucaaaaaaauuuuuaaaggacuuugucaggaaucaagugcacucuuaaaagguuucucucucucucucucuuucucucucucucucucucucucucucucucuguguguggugccuuuuaauugauuuuucuguguaauguguaaucuggcacuggaagcagaggguggcuauuuuuauuagaauuaaguaauuuacuaaauuaccaguuuguuucuggguaucugacuuaaaaaaaucaaaugggaaacaguaguaagggauguguuuauuguagguuuucaggaaggauacaugguugcugguuuuuaacuguuuuuuagacugguuuuuucagcuuccaucccauggugugugcuauggagacugauuaugcagacuauuccuguaggauauggccaaguguauaauuuccuccuugcucucauuccaggagaaacauuuuaaguuuugcccucauccuggaaugccuucagauucccgaugauuuuuaauuuuuauuccucuuuauccuucuuuagagucuguuucaaaacacaaaucugcuuuuuacuguuugaagcaucauggcuaauuugcguguuuuucucacaaguuguaaaaaugugaggcugaauuuaacauugcccaauacugagguuuauucuaccucaggugcuaaaagcuccugugguauuugaauuugauucuuuuggauuccaugugaacugguaacaguauguauggucaguauauucauaaagaagagcagaaauaacaguaguugcuagcuaggcaucacuguguaguuggagggagagcugauaguacaaucuucuaggacuucugaauguugguuaacaaaugauaaauaguaacgcuuuuucuuuugucccuuugcuuucauuuuuguagagaagagacuuauuuuuacuagucuuaauuauguguaggugugugucugcuuguggguggcaugugcauguaaaugcaaggaaacauaggugucaggccucuggaguuaguuaugagcugccuaauguaggugcugggaacugaacucugguccucuagaagagcagcaaauacucuuuacgugccagacugcuucuccagcucagugcuuuguuucuuaaagguagaaaucucuuaacauauaugcuguuaaaucccaguauacuaugcugaaacauauagacuagaugaaaaagcaaaacaaauucucccucccgcauuccacuuugagacuuuuccuguuuaugaucugagcuagugguucccaugcuggagugauuuuugucucucuuccucaggagaggcaucuggagacauuuuuuauuugucaaaauugggaagggaaugcuuacuuggcaccuaguggguggaaggaaaggauguugcuaaccauucuccacugcacaggacagcuacuacaacagagaauuaucuaucucaaagugugagcagugcucagacugaggagcuaacuuuuacauucuuaagcuuuaaaagcauaaauauguuagugaaggagcuaugggcucccuccugucaaagucaguugucaaaguuuuacuaguacaggguauuguugaaauccaggugacuguuggaagguuucauuaucguuuacauuuagaaugugauugaauuaggaaaauaaguucucauuauacauuauuucauccugauaugucauuuauacuauucugcugagaguugugaauaaagucucuagugcucuauucugacuguucaugggcaugauggauaauuggccaggguaucacguugagccauauuuguuuuugaucugcuauucucaccuuuuaagaucuuuccuuuuauucuuauugaaauucuggaacugcauggcuaugggcagugugugcuaaacaugcugucuaaaaaguuuuguaucauguagauuaagaauuacucauuaccugaguaauuccaagguauaaguguuaggguuaggguuagauaaguucauuauuucaaaaaggauauuucuuuuguuuacuuaacuuuaaaauuuuuauaguaauuucuugaugguauaauuuuuuugaggauaauuagcuggcuuuugguuaucauuacacucauuuaaaacacaucaaguacuauucuauaguccuuuaaagaccuuuguccuuuuuaaguuuaaaucuugauuguaauuaauaaaugcuuaccuuguuuugaacucuggguuuuaaaaacuuaagguagacaggcaagaugagaauuaugugguacuauaccauucaagagaaucuaggauguuugagaucagauagucuuuuuuuuuuuaauuauucuuauuuucaauuguauguugaugugugugugucugcaugugacuaugcguacaugaguuggaguuauagacaagcuguuggcuuuaugugggugcuagaaacagaacacugguacucuggaagagcagccaguguucugaugcugagccaucucuccagccccuucauagucuuucccacuguucuuucauuugguggguuuuggacuaucacacauauugagaguaguguacaucucugguuugaacuucaaauuguuccuauuuucuuuuucauauucaggguuuuucucguugcugccuuuuaaaaaucucuuacugugcuuuguucauugucuguuuaagccaaaauuugaccagaccugugaguggauuuauugccacugaugggcccacauuagaguuccucuguuguagauuuaauucuguuagguuguaacagucaugucuagacagaacauugauuuaaauugacuauugaagaugaaaguuccaggaauagaguauaaaggaagaagacaagaaaacuguugucaauggcaguuggcauucugucauucuugaccagauaucucaagucacugucauguauacccagugcaucuagugguuaggcuuugcuuaauaaagggacuuaaaagaauuacguaguucucugaagcuggaaguuuugaacuguuagcaugaugggcucagaaaaaaauauugggagauuuuuaugcagagugaacaaaaaugugguugugagugcuagagcagucuagcucauaugucuuuucuucuacuuacacuguuauaucuuuuuaaauaggaguaucuaguuuuguuguuguuguuguuuuguuuuuguuuuucugccccccaagcuauuacuuuccucccaaagcuacuacuucuccccccccccccaacaaccccccugccccaaccccgucuugcccccaaccuagucucuuuaaaaaagaaauccgaggcuggcuaugcugcucccagcacaugguaggcagaagcagaaaggucucagcaaguaccagcaugguuugauuuacauagugaaaaccuauccuaaaaaaaaaaucaaucagucaaucacucagucuugcuuacagucuuucacugacagaaucaccuuuagcauagugacauauuggguucuccaucauuugguccuucaucauucuugcuuuuucuaaccgcuugguaccaugguuaagacucugcauuccaaacucaaguuuccuugguuuaaauuggcaacaucuuugucaaacuuaguucauuuucuugugccucuacaaaaugguauacacuuuaggaagugguuugaugagguggcacaugagugcuagugugggguuuuguuguuguuuuuguuuugagacagggcuucccugugcaccuuuggcuagccuggauucuguguagacuggccuggccuugaacucagagguccaccuuccuuugccaccacaccuggcaagcacuccaacaauguugccacuccucaugaguucagugcuccagucuuaaaaacucaaaaugcaguuaccuuuuauugugugccuugugccuugguguguguuguuucuuccuacuuuauccaguuaacuccuguuauuuuuaagauugaaaaauguuauccuuagaaauauuuucucugccaccuaacuucuacuaagguguaguagcuuuuguucuuuaacacuuuggcgugaccuuaguuucaguaauugugguaaauguucacuggcuaauuuacuguuuaaacuaauacaaaugcuuaccuuguuguuuuuauuuuuugaagaguuuccuuuuaaccacuguguguacacccuggcauauaguagcuacucagaaacuacuuauuuagugaaugaaauggaacuguuuugcauguuuggugcauagauuucuauuuauguuaauaaguaaugagcuuggguuaggugauucccuagaagguuuccaauuucucaggauuugaucacaauaguggcauauuauuaugaaaauacauuuugcuagugguuguuuugauauucuuaaguuccguuugcuuuuagaagugcuuugucucuaauccuuagauuaacauuuuguuagaauuugaauuauguagauauauaaagaaucuucaauaucuucaaguucauugauguuccuaauuuuuaaacuaauccacagugagaauuuuacauuguaucaugacuuaguuuccaugugauggugucuguguguacgucagaauaaagcuucauggauuauuuacucuuacuguauacaggagggauacuuuuauuacuauauucuguuucauuuaaaaauggugaguauuggggcuggagaggugucucaucaguuaagggagcuuggguuuuguuaguuuccagcacucccauggugccucacaacucuuuaacaccaaucccaggagaucuggcacuuucuucuggccucuguggguggcaggcauggagguacuacccugccuuagaugcagaccaaacacccauacacacagaacaaaguaaaauuuuaaaaaaguugaguguggucaauucagucagugacuaacuaauugacuguaauugucaaaaacaccuaucuaguucuacaauucccuuauucccucugcccuguacuguuugaaugggauugaaaaaaauguaccaaaauggcuuuaaaauuaaucucuaauaguaugugccagugcguggaauacagagcagauuguccuaggggagaacuuggaccugacucuuugaacuccuuuuuucuucugguccaguuguuuaaauuacagucuaauucuguuuuagcaccuccuuguauuuugggggauguuuagaguuuuucacucagaaaauacuauuaguagaaauagauacaaggucuuaacaggaaauuuaaaaggauguuuauggaaugugaaggaaaagccacgaaggagcaucgaaaucauaggugauacuugaacauuaacuugagaaagauuggaagguaaggugggauagaccucaucugaaggaaggauuggaguccugaagaaugcuuauguuuugcuuaaagagauaugcagucucagcugagggcauaaauucagauggaagaucagaaacugaggugccguuggaggggaugauaaagauccugagggaugucccgaauccauauauuuggaguacaggacagaaaagcaaugugaagauuaagguagaugauaacauuacuaauacaagugguaaggaaguaacaggccagaggaguuagaaacuuuuuuauagcuaaguaagugucuagguggcuauggauuuacaugguaaauaugaaugaaaguacacaugugaauuuagaaaaauaaaaggguacuaaaauccaugagaaaaauguaauggcauuauuuguuuguuuauuuauuuauuuauuuauuuaaugugugugaguacaccauugcugucuucagacacaccagaagagggcaucagaucccauuacagaugguugugagccagcaugugguuucugggaauuggacucaggaccucuggaagagcauuuggugcucuuaaccacugagccaucucucuagcccguaaugauauuguaaaaggaaaaacaccaaugaagauaucuccauuguguugucagaaaugauucugaacauuaaugguucugcauguuugugcuuagaggauaguuaccuucuaguaguuacacuuuuaauucuuacuggugauuuaguuuccauucuuaauuuaugugagguauucuucacagagauacugcucuacuuaagcacacuaaggucuuugcugaaguuggugcuauucaggccugaagucuaccuguuccauaggcuauucuucuggaugagacaacaaacaaacaaacaaauaagcaagcaaacaaacaaaccaguuuuccuuuguuugcacucuuacuggguuuaacuuuacuuuccaguguugcugaaagaagcacauguaaagcaggaagacagcaacuagaaggacuggcugcacauguggggacagauuguuuuagaacaugucagcucuuuauauauuguaauaaaauaugccuguuacaaaacuuggagcuuuaaaaauuauaagcuucauucuuaguuagaauuauugauuuuaaaauuuauauuugguagaaauaauacaagugugguagcucacucauguaaucucagcauuuguaaggccgagguaggaggauugccaugauuucaaggacaguguaggcuacuuagugaguucugggccagccugaccuuuagaguaagacccuuccccacucuauaauaacauuaauuggcaaaaaaaccucuuguucacaucuuuaugaguauagguguuauaucaaacuuauacuaacacauuucaaggugacugggagugggugaguucugagagcuuggcaaguuccuaaaacucugagguuacauuuuaaaauuuauaagccaaguuguauuaaaugaaauacacuaaauaacauaguagcugcuccagaauaacguuaacauauguuaguaaucuuugagucuaauuuagaaggacauaguauauaagacauuuaaaauauagguucaguucuugggagauauuuuuaaauuuuuagucaaguuacugagcaauuauagcaaagcaauauucuaacaauaauuuagccaaagaaauuguaaguauagaacgccagagaggugcuaggauuaccuagaaucuucugauagagguuuuuuuucgggcuuuuugggaguuuguuuuguuuuaaaguucacuuguuuuagcauggauugaggcagagagauugcagugauuuugaaguuagccugggcuacauaguagcaggccagcuugagcgaaacagccaaacccugucucagaaaaacaaaaguaaaaacaaaacauuaagauaaauaucuuaucugauggaauuugaaauauucuucucgaacaacuacauuuaaauauuagguauuuuuuaaaaaacuuuuuuaugcaaagguaaacuuugaagguuucuuuuucuuuucuucuuuuuuuuuuaaaagauuuauuuuauguaugugaguauucuaugaauguacaccugugugccagaagagggccacagaucccauuguagaugacugugagccaugugguugcuggggaaugaacucaggacuucuugaagagcagauagauaguucccuuaaccacugacccaucucuccagcccaccaacuuugaggguuucuuaaguuuuaaaagauuaguuggucaguauuuuuaaaauucuuuuagaugaaaggucauauagccuagacuaucuucaaauguauugcauggcugagaguggccaugaguucuugauccuucugacuguaucuucacagugcuaggauuauuguacuaacugauuuguauguguaugccggaaugugugaugaaugcccgugagugugugcucuaguucaugugcauguagaggcaaagcaggucucuggguuucuuccuuuauugcugucuucuuuuuugccuugagcccuggguggucucucacugaagcagaugcucauaugagacuguuuuccuuauccgugaggcugguucaagaacauccccauaucagaaacuaguucuguuuagacuggugacauauuuacaagccuugauguaagugacauuuuauuuauaguuagcagcuuuguauugauguaaugaaagggacucacaucauuaaacuagagaacagaagcuguuagcccugcccugccuuuacauuuucagaaucuuuuacuauuggaacauggcacccuguaaaggaauaguuaagucugucuuugccuccccaguguuagaguuauaggcacuuacugccaugacagagcauguguugaguauucagacccuugugcucguagagcaagcacuguuacccauugagucuuuuguuugaauauuuuuaaagguuuuuauuuuuauuuuauuuaugugaauacacuguaacugucuucagacacaccagaagagggcaccggaucccauugcagacgguugugagccaccaugugguugcugggaauugaacuuaagaccucuggaagaacagucaguucucuuaaccggugagcuaucacuccagcuccgaguuguuugaauuuuaaagauaaauauuuugaagacuaggauguagcucaauugauaaaaugcuuacccauggagcauggagccccggguucaguucccuagcagcauguaaaagguaugacauaggcuuuuacucucaguacuugaggaggcagaaggcucaguaaugaguuugaggcuagguuagagcuacaggagacucaccaaacuaaaacaaacauugguauuuuaucuauuuauuuuaauuuuauuuuuuaauuaaauuuauguauguaugcauguauauacauauguauguauguauauauguauguauguuuucaacuaaggguuucucuguguagcccugacugaccuagaacucccucucucuguacuuccaacugcuucugccuucugagugccagaauuaaaggcauguaccacuaccaucuggcaaacaucaguauuuuaaauguauauuugggacuuaaaguguaugccacucaauucauuuuugacuuuuaacaacaucaagaccuuauuuuacucauuccugaauuaaaguagauaauauugauaacuucuucauuuaacagauaaacauguggauacaugguugucuuaggguuuaacuucugugaacagacaaccaugaccaagacaacucuuauaaggagaacauuuaauuggggauggcuaacaaguucagagguuaucaucaagguuagaucauggcagcauccaggcaggcaugcugcaggcagagcugagaguucuacgucuuuaucugaaggccacuaggagaauccugacuuucagggagcuaggaugaggguauuaaaguucauauacacagugacacaccuacuucaacaaggucauacacaccuccuaauagugccacucccugaaccaagcauauacagaccaucauaauggucaaugcuaaguguuucggugcugcagugaacaauacuaacaugguuauguccuauggagcucuugugauaaacauguagugaaaugaaucaaauaauuaugcauuucugaaugugcugucagaaauuaagaggugguaagagcuuaacaccucauuugccucaugucacacauuguauucucuaauuauuuaccuugguuuucuugucuuuuuauuauugcuagugugcaagcucaguaugggaagaaguguccccucccuuccuuacagugugccccaugacaugaccuaguuccugacaccaaguagaaagucuguagguacuuaacuggcugucugaagaaauuugugugugugggggggauggaugguagagagagguagggguaagaucaaauaggacuaacagaguuaggaguuagaauaaaaugcagaggacacugggaaguaaagagguuuaaagaggaaaugauuugguuaauaacuguuugcagauaagaguguacagaggcaaagagggagacuaauaagcagcuucucauaugaguguaagcuggagaggcuguuuaaagccucuucuggucuuucacaauaucugauuguauuguaggaaacuugucuguaauuaucaguuccuuuaacaucacccuucccccaauuugucauuacuuaaaacccaaaacuaaacuaaucaauguuugaccaaccuacaaaagagaugaucaaacccaggcuaguuuauuguguuuuggagacacuccugucuauuacuuuugugcauaugauaucuauuucauauucuuauuuuucucuucauauaucaacuuuuuuuaaaaauugcuaacucaguguuccaaacauacgguauacuguuuuaucgaugugguugaggauucagaaguaaaaauguaaguguaucuuguaucuucauccuuauuaauuuaucuucuuagaaguuuauuuacuuaaaaauuuaucuuuucaggauauggagaucuuauauaaaugcugaaaggauaaaucguacuuuggccugguaguuuuccucagggcuucagccucuaacuacauagacagcuugguauuuuauuuggagacauuucuagccugaacuguuugauggagacagguguacuuggugcaaggagacaaacucuuccuagggcagagguucacuagcagcugccuugacuaggaaaaacugcuuuccuucugaguagugcacaguggugcagccagaggagccugcccuuuccccggguuugaacagugagugguggcugcccuaaccauccuuuuagucuguauaaaguuauguaacaagucuuacuugguaaaaaccuuuucuuacucucuucuuuacuuccuuaaaaauuauauaaaccugguguugaauugggaauuaauugcuacuuccuuuuuuguuguuguuguuaaaauguaaauagagauugcuuauuagcugagagagcuagaaauaauagaaguaauuaaaguaggaaguuuugagcacugguggggucuaauaaacugucacgugccuuccuccaucuggaugguaggccuaagaagaccuaugcaguccccaguuuauaggcagaagugaagccuagguuaggauuagagacguguaggcagccuucauuucuaauggagagagugagacugagcuuuaccuguucucuacaggcuuucuuacuguugcccacauccccguaucagaaacuagugacaaguuuaucagccuugauuuaagugacaucuuuacaguuaguagucuugcauugaugccaugaaagcaacuuagcucauuagagaacagaagcuguugggccugccccuaaaacuacagaaucuuuuaccauuggaacaugguacauuguaaaggcuagugaaagaaguaaaaaccaauauugcugguuaauaaauguaauaaauguauaaauguaguuguuugguacaaaagcaacuuuuagaacaaauaaguaagaauuucccuuaucaugaaacuaauaauaguaauuaauuauacaauccuuggauuaguauaagaaaaauagcaagcauuuggcagggagaaaacauagguguuaggacuucucacuacaaugauguguaguuugcuuugaaccuggagaaauucuguauaaccuuaguuccuucacuugugaagugaaauuuguaauggucaacucacaagauuaauuggggaucuaagacuacacacagaaucucauauacccauguaaaaaaguauacaugaaauguaaaauuuugauuuuggucaccaaauguuuauaaguaauacacugauguuguucaaaguguacagagaaauguaaagguuuaacuaugacaaauccucuacuucagaauuuugugauucuuaauaauaagccauuuguuugaaagcugccaaugaauaaaguuguuacuucuguaagcaacuuaguaucaacugugaaagaaaugcuugcuucuuaccccuguccacucucaucauuugccauauugccuaucugaaaguuccuaccaauugcuuuuuauuccucuaacacucacccccgcgccaucucucauaauauguaagaggaccauuauucauuucacauuuucuaaugucugacauacaaaguuaauauuuuggacagugaacugacaguacuuacaaauuuuugggacugggggugggaugggucuauaagcauuuuuuauaaagggcuagauagccauaaauauuacauaaauaaacaacuauaaauauuuuguaauaagaauuacuuuguauaugcugaaaauuuaguuucacauacauaugucacaaaguauuauuguuuugauuuuuuuaaaaccauuuuaaaaugucauuguucagagacugagugaaaccaggccacaaacuagauuugaucuguagacuucuagucucuuggauacuugcagguggcccaucucuuucaauuagaaauaaauuauuacuaaacaaaacuuacuuuugaaccuagacacauuuucuuuccuuuucccuaccaguuauucuauuuuaaguguguagauguuugucugcauguuugucuguucaccacaugcuuggcuuggugccuacagaagccaaaacagaggccagaggaugcugucagaugcccuggaacuggaguuuacagcugguucuaagcugcuacgucggugcugggcaucgaaccugcauccucuggaagagcauccagugcuuuuaauaacugagcuagcccuggacaaaaucauugucaacauuuguuggcuaccaccccagaccaauccauaugccuguuuugccuauuuuguauucuggcaguacuguaaaacuuuacccuucagauuaacacugucucugaaagaagauggauuuaguguucucucuuaguucagagcaaauggucuccucauuaucaucaggauuucugucuuucuugaucucucuucugccuccuagacuuugcauucuaaaacuacccuguucuagguucuucuguaccguccuaugguaagguuucaaaaagcuuuuuguggauggcuagagagcagagaauggcagaaaaaaaguggggagggagagaaaagaauggaagguagguuuuuuuuauuuuuuauuuuuccaaacuacaaguugcaacuccuuagagcauuuugaaauucauguaguauggccauauuaauagaaaggaaauggacaauaaucagaaagaguuauucauaguaguuaaaggauguuuuguaaaauuucaguuguauuugugaacuagguuacagugaagugcacugugcucaggaaguuuaaaagccuguuuucuuaggguuugggauacugaucuugagauucccccuuccauuucuuguuaaucugugugagagccaaaugagauaugagcaggaauccugcuugcuuucuacagcaugcugcuuguacauaggagacugcuagccuacuaccuaagagaaggcagagugacaugguaacaagcuucagagcugaggcucagaggugcccaucucauuuagguaguaaaagaaguuauauauggccuuuguguuuuaggggacaaaacacaucccaguuggugacagcucaccagauaccaaggcaccgagaauuaguuucuguaauuggccacugguccagugaaaugaaaugaucucuacaagagugacaagugagagggccgauugcaccuucuuuauucuucccucuaccauuucccucuucuaauuaguauuuuuuuuuuuuuuuuuuuuuuugagacaggguuucucuguauagcccuggcuguccugcaacucacucuguagaccaggcuggccucgaacucagaaauccgccugccucugccucccagugcugggauuaaaggcuugcaccaccacgcccagcccuaauuaguaucuucuuaguuggacucaaugauccuuccaaugauaggaaaagcagaggacugagaggauacaauuggugagaaauagucauacagucguguauuuggcaaagagugaauuaggaaggaagcuaaaguagaagggccaucuggcuuugcuguccugagguggcaguuuacaaauggguaaaacaggaccugcucauacacuguuaggagucuuggcuuuugguaccuuugauaugcugauuggauauaguucucugagaaacuuaggugaacuuaggaacauuagauuagucuagaauaauuacucauuuuaagcacuuaaaagucauaguauguaucuuugagacauuuuuggcuauuguauguuaaguuagcaaauauggugaaaaugaacugauucugaucucuaacuugauuuggaaaugugagaagaaaaagauuggacaagcuaguuuuauucacuagaaaagaaacaaaacuauauauagcacaccacacauacuuagguuaaaaaaauggcaagacccuuaaaauguauucugcuuuucccaggcuggauaggcaagaaugcuuuugaaauggaauuaccaaucaucuggcaugaauuucagcuaguaguucccaaagacuuaacuuagacuuuucuaggccuaccacuugucuuuuagccuccuuuaauaacgugcuugccuuuccauauuauaauugcuuguuacuuuuauguguuugucuaucugcuuacccuaaguucuuuaaacuucacucacuacaaaauaagugguuagugcuuaacugagaacaggagagguagauggccugguucucauauaggacauguagaucuaucuacuauauguauaguauacgcacacacacacauacgaaguguaaguuacaguaaugugcuuggacugauuucucagauguaguauuguaacuaacucaauaaauaacuaauuucuggugcuguuuguuguuaucuugcagugccuaaauaaacuguuuauggaauacgaacaagccaaaauguaaugaguugaaaauugaaggcauucuaguauguuuauugagauacugcacuuuggcgcuuggccaucuuguuuugcucagaauacaaauaauauuguguuuguuuucuuauuuaguaguauuucuuugacucugcuuuaauuuuauaacauuauuugauuuuuagagaguaguguucucauuuuuuuuaagauuuauuuauuuauuuauuuauuuauuguauauaaguauacuguagcugucuucagacacaccaaaagagggcaucagaucccauuacagaugguugugagucagcaugugguugcugggauuugaacucuccaguccccaugcucucauuuucaaguaugugauuuagcaauauuauuuauauaaagacugagagaucuuaucaggaaauuauagaauagaauaaguuuucuuucagaaguauacuuccaagugaggaugcuucagaacuuucuuugcagaugagauaaagggaguagcuguguuaggagauaagaugagacuuccaaaaguuagccauguuuacuucugggaaaauaacuuuuauuuuuuuaagguuuuaaaaugauuauaugugccuguuugauucuuuugggguuuauuugaaguaaauuuuauaucuuuguuuaaucuagacuugagaugauguaauuugucugaaaucacuaaucuaugaggcuaagacuaaaggcuuaaguugagauuucuagaaagaguacguaccggagcuuaguccauucccacuauuuccagacuuaguggggagaaauuuugcaauaauuugucaguaguggcuuuguaucacacuuugaagaaaccgugguuugguccuuaggagccagaaauaguaauauagcaauaagcagcacucaagugaguucuaauuuuagggcaaauguucugcuucugcacugcgagauggcagccauaaacccauagguggugguguugccaggaaggauuauguguaaaugcugcccuuguucguuggagugcuuuucucacucauuuuugcuuuuugauaaggaauguuuagaauuguuuuucuaaugggucagucuugugcacaugugcuagauuuuuugcuuuacuacauuucuuuagucaaaauuagaacuggcaaguuauugcacagcccagucauauuguuagguucaauaauaauaauaauaauauugcuaaugacuaucauuuauuuaaacugccaucaucaacaaccauuacuugcaguauacuguggacuaagauuguaaguuuuggugauaguaugugugaaguaccuacccuaggagauaaaaauacuauucccacuucauagaugaggaaacggagacccagaaacuuaccuaaggcucuuugacugaauaagcaagagagcugggauauuuaagccugaaagacuuaaauugguucuauugaaucaaauauucuaaaauauauauugaaauaugaguuaaugauuuuugaacaguguuucuuuccaaccugucaggacaagguuucuuuuuccugcucccauuuuaaaagcagcugguauugcugguacccuuugcauccuaugauguagccagaaaugcuguucccaaacugagguguugauagucuguuauuguuucuguggcugauacagcagagcuuccuucaucuguagaauggaaauacagcuauguaaagacggagaaacaauuuuuuuuuuuuuuuuuuuuuuuuuuguuauacagaaaggcaggauuaggaccagggcagcaugcauuugcucuaaugaccaccugaguaauuagugauuugaacauuggaagugagugcccuuuaucuucuuaaagugaugaacuuaauucagagaaucugauuggaauuucuugugugggaaaaacaaauuugcauuguuucuccuucccauuugguaagucacuuaguaauggucguuacuugcuuacuugguacucauuaccuaugcugauucuguuauuaggguuugugguugcuuucuccucguuuauauuaagguauauugauaaaaagguauauuguugcucuauuuguccaaauucaaggaccucaaacuguuaaaguagcaauugagcuacuuuaguaagacagcaaagacaguaaaauaaaauagagaauaggaggaaaacuaauaugaauaaaauaugacacaugaauguuagagaaaaauaauaaaccuuugguuaauuugaguugaguuuagaugacugaauuuauggaaaaacuaaucucuguauuucauuuagcuauaaauaacaguagucaaaaauuaagggguaccuuacuagauaggcaccuuuuaguuugccaggcucuguagagccuaucaaaguccaagaaugaagucacuggaauuuuaauuaauuaauugacuuacuuucugucuggaucacagcuucccguccuuccucuccucccaggcucucccuuuccuuuccccucccccacucccucccugcuugucuccuuagagaaggggaggccucuagaggauaucuucaacaaauggugcuggucuaacuggaugaaugcauguaaaagaauguaaauagauccaugacuuauuaccuugcacaaaacucaaguccaagugggucaaagaccugauacacucaaucugauagaagaggaaguggggaauagccucacaugcauuggcacaggagacaacuuccugacagcucagguacuaagaucaacaauuaaacaggaccuuaugaaacuggaaagcuucuguaaggcagaggacacggucaguaggacaaaguggcagccuaaagaaugggacuuucaccaacccuguaucugacagauggcuaauauccaaaauauauaaagaacuccggaaacuagacaccaacaaaccaaaugacccaauuaaaaaaugggguauagagcuaaacagagaauucuagacagagaaaacucauguggccagaagcacuaaagaaauguucaacgaccuuagucacuagaauuuuaaaucuuacauucuacaacugagugauguauauaaauauuaggcacauugauuuuuaaaauuaaugaugucuggcaccaaauaacuuauuuuguugcuuagggauaugugugugugugugugugugugugugugugugugugugugugucugucugucugucugucugugucuuaguuacuuuucuacugcugugauaaaacagcaagguaacuuauaguaggaagcauuuaauuagagccuacaguccagagggauaggaguacaucaccauuauggccaggaacagggcagcugguagcaaguacucauaaccacugaacuaucuuaccagucaccaguuuuucuuuuaauuaguuaauuaauuaauuaauuaauuaauuaaguguuucaguuaccuuuuaguaagacuuuuacuagguuaagaguuucauugacucaaaaaaagucuuuuuuugaguuuuuuuuuuuuuugccaauuuucuucuggaauuuauugcuacuaaguaaaagccuuuuaaggauaaggauugugguccuuauaugugugcaauucuauuccuuguguucagggcucaaugaauguuuguugaauagauuaaugggaaagagucuuuaucuuguuuguaccuuuuguucucucuuuaucuuacuguuaacaugaaauaauucccacaaagauuaaugauauugaucaauuaaugauacccaaagagugcuuuucuguguuugguuuuuacuugacuuuucugauuugaaguuguugucugcauuccuucagauuuuguuuuguuguucccuuagugccuucccuucuugugacuauugucacuuacuguccuaucauuuauucucuucaugcaggauuuuuuucaguuuauugcuuaugcaaguuuuuuuuuugcuuaugcaaauuuuauucuaguuguccucugcugaaauaaugucaugucucaucuucaguucuaacuaaauguggagauccgaguuacauaucugacuuugauccucccucauaaguuucagacuuauuuauuaguuaucuuguaaacauuaaguauaugucggaucuggcacuauaaaaguggagaaggcaugguguuuccccuacaggauucacagccucucuugaggagaaagauuaguaaacuagcagugacacagccaucuuaaagauggccuuauuuaauuuugagggccauauucauuuugugcuuuccaucagcaguauuugaagugauccugaaggaugacuguaaagucaucaggugaauaaggugggaagagugguuuguuuguuuguuuguuuguuuguuuguuuuuccugauaucagugcucccuguguuuagaaagcucaguguaccaaguuuucuaaguccugagagccuuagguucuguugaaaauuacaggucagugucaugccagcaaagucaagcauugaauccagaaugggaugguugacugugaaaacaggacagucaacaacgcuuuuauuacuacguaguuauucaaaacacuguguguaagggaaugauguagaugaaagcucaaagaguguugugugcuuaauuugcccuuuucugauaccugcuacaucgugcaauugcaguaguggucccagcaaaguauaguuuuucuaagauuuggcccucaugauucacuuggagaaacuguuaaacugucaaguuugcuuuguuauguguggagcauugcugucuguucagagaugguacuuggaacugaacaggauuaaagacgcuaagagccaauagacaaaggggacaguuuauauggauauauacacaauugcuacauguuuuaaaaaacuagcucaggaaaccuauaucaugauauauauggaacauuaggcaguuguuggaagaugaaucaccgaagauguuggggagaggucaaauuacaaagggcuugauuugcuaaugugaaccuuuugcagaaggauggggaggggcccuuuugaguaacaguagaucaguuaauuuaacccuuuauaauaaagagaucuauuauuguuugucuaguugacagccuuauaggaaugucaagucacagauguagguccaaguugaagagguccagccauuagauuuauuggcauggaauauacuaagcaggaugaauaccaaaccaacaaaaggccaaaauuaggagaauaccaacauuagcagggcauagagaucagggaagagcuuguguagaaaaccaagaagaguccaauaauaaagaaaaguauuauuucauaagaaaucuggauagacagguuauucaacaacuugaaaucaagucagagucuuagaaaaaucacugcuacuuauuucaaccuaucuguaauuguguauauggauauauacacaauugcuacauguuuuaauaaacuagcucaggaaaccuauagaguauuuuuaacuuuacacauuguugguaacuccaggagauguuucuguggagugaugaagacaaaauacuaugcugugaaugaacuguagauacagauggaguuagcuguggucugucacuuuucaagauagggaagaaagcuagguuggaaguguuggagggaugcucaagauuaagcuuacagaaaagguaaaauuaaaucauacccagaaacugccaucuuuuuuuguuuguuuguuuuuuguuuuuugagacaggguuucucuguagcccuggcuguccuggaacucacucuguagaccaggcuggccucgaacucagaaauccgccugccucugccccccaagugcugggauuaaaggugugcgccaccacgcccgacaagaaacugccaucuuuaguguuguauagcgcucccaaaucuaguaacaaguaaauacuaugggucugacccauaguauuucagucuugucugcaguuccauuuccaucccuuggguuccagcccucagacccuugaguuuccuguucuuuuaugcauuucuuaggaaguuguuaagggcucuaaguugugguacauuguacuuauccauuauucuauguuauugauguuuuuccauuucucucuucacaugacaucuguaguaguuauuacugauucaucucucuguauuuggugucuggaucagugccaguggaguuuguguuuauuucauguucauuguguuaugaaaaaaguaaauaaaugaaacuuguggcauuugacuggaccugagaggaaucauuagauuuauucauacagcauuuuaugcaacauaggcagcauauguaagaauuuugagauacuauguguaauaguauaaacaauaucuugaauacuccuuuugaauaggugaguagaauuacagugggaagauagggcuggggaaguaauuugaguacaaaucgaauggaaucuucaguggcaugcuuaaaggcuuuuuuuuuuucacuguugcaaugggcaucccuucuuacuuugguaaguagugcuuaauuuuuaauuuugaggaaagguuugguauccaagauguagauaauucuguuccuuugugaaaugcuuuaauauuucccagcuuuuuuuuuauuuauuuauuuauuuauuuauuuauuuauuuauuuauuuuuuaguuuuuguucuaaagaguauaaaaccuuuuuugacuauauauguacuuucugucauugccuuuguaucuuuaaaauaaauguuuucauaguuuuucugagauacaaugauuuaauuucauguuuuaucuucuauuucuuuuucuaauagucacauauuuuacuccccuuagagaaauuccuaaaguuacugucuuuuggguugguaauuggcuauccagauuugcuugaggaagucuuuaaauuuuuauguuuugcuauucaugugcuuccccccccccaggauauuuguaaaaaguguuaaaguugauuuugcaucauuauucaagaagguaacuauucauccuugcuuuugguuauauucuuaagccaguauccaauuuaugauuguacgucccuuccaguuauauguggguguauuaaaaugcaauauuuugaauuugugggagaaaaucuaggaguugaauguauuuggggaacuaugaaacaauauuaggggaaagcagggaauaguguaugaaauuaagagccauucaaaagaaauguacugcuucuuacauugcugugaagaaaacagaaagcuugaguuugcuauucucuaguuguagaaaaaauucuguauauaaauugaauguaaauguuacaauaugguuuauaucuaagugaugaguugcaugagaaggcagcugaauacuagcugaaugcguaggaaaccaagcacagugaaaaaucaagaggcaagguagccugggaggcuuccugaggaaaacggggcaucaacgaagccugaagauuuagguagaugggagaguaguuguggauauugaggauaugaacaauaagaaugccaugcuugugguaaaaugaccugacaugggagauggauaaagagggugagugaaucauugccauguuucuuguaggaccuuggauucuagauaaugucuuuggugucuguaggaugauuaggggaugguauaggagaggaaagaguuggagaaguaaagggguaugagauaggugaguaaaaaugugcacagaaggauuugagagacucagauauucugacugaaacaaacaacaauuauuaaacaagugucuaagguauaagaagaccuucaguaucagacuucccuguugauuguuaacacuuguuacugcuggcuuauuucuuccuuccuucaauaucuuuuuguuugauuaucuuuuuguucuucauuuaaugaaaauguuacuuuuuuuaaaagauuuauuuacuuauuauauguaaguacacuguagcugucuucagacacuccagaagagggagucagaucucguuacggaugguugugagccaccaugugguugcugggauuugaacuccggaccuucggaagagcagucgagugcucuuacccacugagccaucucaccagcccgaaaauguuacuuuuaauauaacuugauauauuugcaccuccuugaaugaaucauucucaagccaaaauacuguuuuaacaucucucauuucuuucuuauuagagcauuuaugucuugaaacaguguugguguguaauucuuuggacugucuaguuccuuugugaguuacccaggcugaaguuuacagugaauagugaacuuuuacgaauuaucccuuacaacuucaaauuaaccugcaggaguuaguauacagggacacugaauucaugagucuuucagcuuauucacguaagaucuagccuauauaccucugcacuuauacauaugguauauuuaauuauaaauuuauuucauaagagauauagcacugccuuaugaaggaaaaaaguuuuuccuagcaaacuuguucauauacuaaucauuuuuuccucugaauuagugaaaacaugggcucacauguuuguauuccaauauaauuaagauuuuaauggucaucuaacuuuuagaaugugcaccacuaacuaguuuuacaucuaucaaagaagaaauuauaaauucuaaaucaacauaguauguaaagaacaacuaaaagucuagaauguuuuaguauaaagaacuucuauauauuagucaaagaauccucauugacuauucugcauguugcguaguugauuuaaagcacugguacaauacaguguaccauacuucauguuuucagaguacuucucgcccguuacuacugauuucauucucugucugauagcaauagacugaaaucuuuuucuugugguauuuugauuuaucauuaccauuucuacaucugucaucaacucauuucgugguuuauacaauuaaagauauaaugauuuuauuucuucuuugagaauggaacugcuaaaugaccacaguauucgaguugacuaccaagguccccaugucaucaguuaagcugggcuuagggcagauguccaguauagccuuucuaaauuuuuaauaauuuuccccuaagugcauucaacugaaaugcacaguaauagauauucuacuuaucaguccuuccuaugguuuuucuuuuccuuuguuaaguuagagaaaacgauuauguuaccuuggggcacauuuuuaaguacacagaagacuaaaaaaaaaaaaaaaguaagaaaaggucaauagaguacuuugaagagcuguauaagacuacuuauggaguagguggaguaauuuauacauaccauuugaauagggcauuugcuaccuaauuuguggcaaauuaacuauacuuuggagauguuucugguagcuuuauuuccagaaguguuccuuuaaauguucacaaacuuaucucuguucugaaacauuguuuuagaauuuuuguuaucagaugauaugauagauaaaguuuugagauguuuggacagagaaacuggguauguuuaaagaaggucuuauauugcaucuguuaaaugugggcagugggucagucagguuuagaauuuuuagugucuuuagaguuauguuuauacaagaaauauaaugcaaauguaagcuaguaagugaaauuucauauauuuuaguauauauauuuaaagguuuuaaaagugaaauuaauuuuaacuguguacuuagcacaguauaaacaaaauaugauuuuagcuuguaaucaaaauguaaugaaaaucguggaugagucucuuuguacugccuuuaaaauccagacuaugcuuuacauuucagccuguacauuaguaauauuucuaaggcucaguaauuagacaaggcuagugagcuugcuacugggcaacucagguguaagcauuuagcaaaauuggcguuagucugaaaacuuaacaaauacgacucccugacaagccuguuaaugguauucucuguaagagagugugucaauuguuuuuuguuuuuguuuugaagaauaggugcagagauuagauacuccccgugaauacaagguuugguagauuaugggcaaauuauccuuaaguuuagagcagcagaaguucagaagucaaaaauacaauggcagagcuggacacucagcaguauuccacaagaaggcuaaagcaguugguuaucauuuuaagaaaaucaucuuucacaacccagggcuuuuuagccuaggcuguguguuguugcauauggaggagagagguaguuauuacagugacagccaagacaaaccacuaagaucagauaaaauugauuacagaagcauaaugugagcgguagggaggaugguuugcuuuacuauaggagagaggaagagucagagguaaaugauugauuuuuaugaaguaaaaacugaacaaaguucuuugugaccuaaggacaaaugaaagagcaugcagaauacuguaucaaaauguauugcuuaagcagugguuagaggcccuaaugauaggcacauugcuguucuguacggcaaagagcucagcucucuaacuuaguucuguacugaccacuuuguauuccugacaacuaccaaagccuuuuuuuuuguuuuuuuuguacccauaaaacuggcagaaauaguagcuucuuaguaaaaugauagggauuaaaugaaacaagcacagaguaguguuuacuagugugauacauuucugguuaauucuuaguuucugguaugggcugggagaguauguuuucuuggagugugugaguacaucacugagcugugaacuccuuaaagugguuucagaguucagcuuggucaagccucuugauaaguacuuggugaaaaguucuuuacacacacauuucugugaggugaagaaagaacuugcuaaauuucguucaugaauggaguugauaaugaaaaggagaacagaagucagggauuaagucugagcuucuccauaaaaugacuuaucuuuuggucucaguugagauugucuuucaaacuaauauucgaggaccuuccagcaucagaaccauccuggauacugguuaaaaauuguggauuuuuaagcccuaucuuagaccuccugaaucaguugcucaugguagaggaaagaaaguuuuacacuugagcauagcuuuuauguauagauugcccauuuggagagccauuagacaggaugaucauaaaauuucauucaauucaaguacguaucuacucagaguagaauugguguugggauacagucucuuuccuuauauccuaugcaauugggaagaucaaaugagguauuucaacguuuguaaaaauuagauuuagugaacaaauuuuuaauuuuagacucugauaauuaaauggcacugauucuaaucuauaaugauuuauguaguagaugggucuugguggaucauaguuuuugaugcuugauuauguaucaacaaaaugagcuugcuuuuaucuccuuuguccccaguuaauuuuuaaucuuguaucaguacuccagcugagagugauucuaggagaugguugucauccauagccacgaguuucaccugacuuuauuuuuacauuuguguacaccuuucuugauguauuaaauaacccauuauaugacuguuuacauagcauuuauguuauauuugauaaaaauuauuuagagacaauuuauaguauacaggagauguguauugcuuauauacaaauauuaacauuauuucaccauuuuauaagguaaucugugaauucaggcauucuucacaggaggaugucugggaagaauuccgcagagauacugaggaugucaacauauaauuuuaaagaaagaguguuaucuguuuuaauuuuuaaauuuagagguuuacagccuaucaguaugaugugucuccccccaaaccccccacaauuucuguuacucuuguuuagauaguuuacuuaaggauuauggaaaaucuacucuuuuuuucuuugguuuuuugagacaggguuucucuguauagcccuggcuguccuggaacucacucuauagacuaggguggugucgaacucagaaauccgccugccucugccuccugagcgcugggauuaaaggcgugcaccaccaugccugguguaagagccauacuugccuguggauauaaggauaggcauuuacaaugauguugagaauuauacugguuuagauacacaguaguaguaaauugucuucuagggucucuagggucucugaccucaguagccacaggaagcuggcugaauuuacaguacugugcaugaauucccuccuauugagcaggccuuaaguccaauaagucagcugcuaguuacucuggagaaauaggugcaauuacuacauccuugcugauaucgugccguacuagauauuauuauaguuuguuggcuuuacauuuuaguaugauuuuuaauugcuuuucucccuuggaaguucacacaguacauuggaauauuaugagcuaguccucagaaaagaaacuuccaggucuucaagcauaggacuugguugugacuuguagauugugaguuuguuucuucauuuaagaucuguuaguaucauuaaaaguuacacacacacacacacacacacacacacacacacagacaggauauuuaacaccacugguaaguuuuaucauagugaaugccuacacccauguccccugaggaaacaguaacaugaggcaacaacguuucuuaaaaacaaguucuaccaaaacuuccagacugcugauuucuuggccuguuccagauucacuuggagaagucgguuuuuuuguuuuuuguuuuuuuuuuuuccagccucccuuuuuaugguauuaaaggguccaggaaaugcacgauauuagucaucagagaaaaugguuaagauucaauaguaaaaaaggaacagaagcauaacaaggcaggcacuauuuggcguuucugcugagugaaaccauugugcuucaugguguccauggcaucaugcuucccaguagcuucuuuaacaacacucacguucaccucuuaggcgugccuuuaucccuuuggacaguccugagguuuugucccccaccuuccccccauuucucauuaaacaguauauugcuuaauucuucuguuccucaguuuauugauccuacuuucccuuuuuacuauacuauguaauuugaaaaugaaugaaguaguuuauaaaggaaaaguaaaauaccuaagaaucaaaagaagcaaaaagcauuaaaaauuguuuuuauauuacucauucuauuuauaucaaugcucuuuccuuaucucauagauagauauuuauacuaacgccucugcugaggggugagguacauacuauaauuuauucauauuuagagaugcagauauuagaggcugagcuuuauucucuguggcaucuagacacacaguucucauuagccuguguccuuguuaucugacucaaugaggcuguuaauauauucuaaauucuaaaucgugcuucaguuucuucuuuuuaauuugucuuuauaaauuguaucuuggguauucugagcuucugggcuaauauccacuuaucagugagugcauaucauguguguucuuuuaugauuggguuacuucacuuaggaugauauccuccagauccauccauuugucuaagaauuucauaaauucauuguuuuuaacaacugcauaggacucuauuguguaaauguaccacauuuucuguauccauaccucuguuaagggacaucuggguucuuucuagcuucuggcuauuauaaguaaggcugcuaugaacauaguggaacauguguccuuauuacauguuggagcaucuuugggguaugugcccaggagugguauugcugggucuuccgguaguacuauguccaauuuucugaggaacugccagacugauuuccagagugguuuuaccagcuugcaaucccaccagcaguggaggaguguuccucuuucuccacauccucaccagcaucugcugucacuugaguuuuugaucuuagccauucugacuggugugagguggaaucucaggguugguuugauuugcauuucccugaugauuaaggauauggaacauuuuuucaggugcuucucagccauucaguauuccucaguugagaauucuuuguuuagcucuguacccaauuuuuuaauaggguuauuugguuuuccggagucuaacuucuugaguucuuugaauauauuugauauuagcccccuaucagauguaggauugguaaagaucuuuucccagucuguugccuuuuugucuuauugacaguguucuuugccuuacagaagcuuugaaauuuuuugaggucccauuugucgauucuugaucuuacagcacaagcuauugcuguucuguucaggaauuuuuccccugugcccauaucuucgaggcucuuccccacucucuccucuauaaguuucugaaacucaagaagaaggaagaccaaagugugauacuccgaucccucuuagaagggggaacaaaauacccauggaaggaguuacagagacaaaguuuggaacagagacuuaaggaaugaccauccagagacugccccaccuggguauccaucucauaaacaaucaccaaacccaaacacaaugguagaagccaacaagagcuugcugacaggaccugauaaugcuguuucaugagaggcucugccggugccugacaaauacaaaaguggaugcuuacagcuauccauuggacaaaagcacaggguucccaauggaggagcuagagaaagcacccaagaagcugaugggguuugcagccccauaggaggaacaauaugaacuagccaguacuccccagagcucccugggacuaaaccacaaucaaagaaaacacauggugggucucauggcucuagcaucauauguagcagcggauggccuaguugcucaucaauggaaggagaaucccucgguccugugaagguucuaugccacaguuauagggggcugccagggccaggaagcaggaguggguggguuguugagcauggggagaagagaggagaugggauuuucggaggggaaacuaggaaagaggauaacauuugaaaugcaaauaaagaaaauaucuaauaaaaaaaaggaaaaaauugucuuuaaaggguggauuuggagcuaggaacauggcuuagcuuagucagugaaaugcuggucaugaaaacauguauacauguauuuggauccucagcaauuacagcaccuauguaaaaaagcugggugugguggcauacaucuauaaccccagcacuggcaaaacagaagagaaugccugcagcucucugacuugccagccugcauugcugugucugagcuccaggaucagggagaaacccugucucaagacauuuaguggagagugauugaggaagacaugugauaugaaccucaggguuugcaugaguguucagacauuguacuuauacacacacacacacacacacacacacacacacacacacaccacacguucacaaacugcaaaaugaaagaacaaaugaaugaauaaaugcauuaaaagcaaaacuguucuucauuugcaauugaugcagauuuaagugauaagcaggaagaggguaugugaauuccacuaggaauugguuuucauauuuaguagaaagccagggguuagaauuguugaccccugacucaccaaccagcugcuuagcugaaauugauggaugggugcaguuguuuccaugucuuuucaacuucauuuugcuuccguucuuuuucuuccucuuauuccuccugguucuucccuuuucaguuagcaaguacaccauugacuauggugucuuguccuuaaagcuucugucuccugaucccaggcuucuaugcugagggauagacugacuuauauuugagccuuacuuauauuccggcaucucgaaguaacuuguuagaaaguaucuuaucauugaaccuuuuuucaguacuguuauuuuagaaguuuaccucauguuuaaaugcucccauaagugcuguagugaauaauucuaguuccuugagucuuuguuucuuacaagaacacugaauguaagcauucuuguaugggaggauuuagaaugguauuuaaaacgugcuagcaaaguuucagaguuuuuuuguaagacauuaauuuuauuuaaaacacagguaaauguuuuuauuuagacagaacuaguauuaauauuggaaaaguacagaaaauauucacauggccccaggaagcaguggcagccaugaagauuugugaggaauggaaauaaggagguauuauauuguuaaucuuuauuaucacuuuaguaagagugcguuguuuacucuucuugucuuguuugaauccacauugucauacuccuaaauuugaaaaagucuuuauucucucagcuuacuaaacaugacuuuccuggcuuaugcucuguacaggugggaacauauuagaaguucguucacuuaagcaguacagcgcaucaguuauugauuacaguugaaguaaauauaacauuccagaugcaaauucaguacuuuuugugaaugguaauuuucaauguugucuuaggcuguuuuuguuuuguuuugcuguuuuguuuguuuguuuguuuaagugcugugacaauauuugagugaggauaagggaaaguacuuauucugucauaguuuuggugacuuguccaagaucagaguguuaguuagggccugguauggaccuuacuguuuuauauuuucauggcacagaacaugaggaagaacacauuuucaaagcccccuuuuuuaugacagugggacuccauggcuuacauaguaacuauuugguccccccuccuaguaccuuucaacagaacuuuuggaagagacacagcacaagccauggccugcaaaccuuuccaggcauuuucuuaguuagcuucucauucaaacagcuuuaguacugaggagagaagguagacugcaucauggccuaagagaaccgauguuuaaaaaaagauuugaccacaagucaggguaugaaaggucuucugaaauuuguuugaguuugauugugggaucuacaagagugggaaaccagaggagugguuuaauuuuguuugcuguaguaaagauuugucuugauuuuuagaugaagaauugauugaaugggguaaauggaagcaggaggagagugugcaugucuuacauuguaagaauagacugauaauaacaugcaauagaguuuuuacuucaguuaacaccuucuuaacaacagcaacaaaggaacuugagauuuucuaaaaaucucuaagauuuuuuuuuuuuuuuugguauugcuuaugauuuaaauuucaggugaccugauuuuauucucuuuuguggggcagggaaaagggaacuucaguuacaaaauguuauuugaagaccuuagguaacauuaucuuguuuuauugacugaguacuaguaugaacaggugguuuuauagugagugugaaugucuuuauagaggcguacuuucugugguauccuuuuuacuguagaaucaacaaggagucaguguggcugcuggccucuuaacaggcaguagugaugaguaaccauguuucaugugcuagaauaggaaauguuccuuaacuuucacuuuguucaagauaaaauccugcuuuccucuaggcauucuacaugucucuuuaguaaaaaggcauuggugaugauacaugccuaaaauucacuaggacuuuugauuuuauauucaucauuccuugucagccaccucacaugaaaaauuagacuucuguggaucuucgaaagaauauauaauauaauauaauauaauauaauauuugugcauguuaugggguguguguuugugucugugugugucuguguuguccaugcaccuguguaugagggcuagggguugacauuggaugucuucuucaguuguucucuaccuuauuugugagauggaguuccacacagaacccagggacuugcugauuguguagaccgacuggcuggggagcccuaguaaucaggucuuuaugcuucugugacaaauaguaugggcugaacaaucccucauuuuuacuuugugaguuucauucuacuuucuauucccuguuuggaaaauuaagcuuuccauuguuuccuuccucucaguuuugaggagaugcuuugaaauuacuuucuuuuucaguauuuuuuuguuuaaugacaaauaucaagugccugggacauacuaaugaauucuguauauagguugauggcagacaaugcucugugugagagaugcaguaucccuuuaaaauucuguguagugugcccucaaaauaaacuuaucugggaguuucuuggcagugguggaaagccuagacaugugaauccuccucuuacuaaaggggaaaaauacuggacuuguaauaccagcuugagauagguuucugaacaacuaaaugcaaggcauucuuuagauguaagaugaugaaagccaaauacugauguuuugacauuuucccuguuugcauaccaaagugucuauaauuuuuaaagacuuuuuucauuuuuuuaaaagucuuuacagagaaaacaucuuaauggauuucuugauaaugaguaguucaggucaguugacaucuuccauuuugguuaguuacuuuuaaaauuuguguauauuuuacaaauaaguagguuuugcuauaccaucuuugcauaggaugcuuuaucaauauuuaacauccuucccauacuuucagcaucuuuuuagaacaaucucuggaaaauauuuuggggaagaguuuaaaugaugauuguugcaguugccagauaaucucuucucuaauugaccagagggugguggcacguguuccucacuauccaccccaguauucuagguucccgaaugauagauaaacacacacacacacacacaaacauauacacccacccaugcacagagcccuauauuuuaauaugccuuaaacaccuggaccacuuccaaaccuccauguggcuaacacuuccccuccaauauuccugaguuauuacuuacuaaagucuagauuccaucuuugcugcccuagacccaauccccccacccccggggccguucuuccccagcacuuacauuauugauaugcucucucuucuguauggcuuaggccugguccuuacuguuuuccuagcauggcaguucuauaucuuucugcuucccauuuaauuuuggggaucuaauuaacauaaguggcaacagacaaucuccucuacagguuucaccaguuaaaaaaaccauacuuuuuuguauuaucucuauuuauacuaacaugaguuaagaaauaagcacguuguaaagaugucuggcaaaaggacauccauuccaagaucugcaacuuuguguuguaguauuuuaagagaauuaguacauuuucaaaucuugaucuuuaucaaagacauauuuauuugguguugucuguauggggagaaacaaucauguaugcauuggaauacauuuauguugccaaacuuuguauuuauaguauguuagucaugcuggacccaacuugccuuacugaagaucuugguuuuccuuuugguauugucaggaauuugcauaaagaacuauuaaauaaucagugauuagauguggacuuuaaguacuuguacuuuucacaacauaugaauguuuguguauggcaucuagugccacaacauacauuguuuauauuuuuagcauauucaguaucuuuuaaaaauaaucuauaccauauagauguuacuugagagaucuaguaauauuuugccaaacugauagaguaagugcuaagaauggaaaucauacacacagcaaacauaacaaaacaaacaaaccaaaaaguucugggaagcaugccagaacauguuuguguuuuccuuuagaaaugauuguuuggugguagaaaggugcuuaguuuaaaaacaaaaaauaagagccuucaaauguugcauuucuaugcagaaauaauauuuaaaaauugauuccccuuaaucagaugccuagcauaucuaucagaagucuuugacagugauugauccuauaaagaacuugcaaauaaaaaacauuaugcauaaaaguuaaccagucccaaaggcagcuauaccucucagugaacguuuauccauugagaauagcccuuaaaacaaguaaaaagugcucugagcagccaagugugaaagguaacugcuuuuugauauacauugguauagaaaacaggauacuaaaagauguauaauuuacuuauaauuguauaaaaacaaacugaggaaggaguuuucuaauugaacuuaaggccugcucaauaggaggaaaaucaugccugguaaauagagacauagacaacuucuuggguagugaaguccuggaucucagaggaaaaccuauaaccuccguuuuaaucaagugggcaggagauccuacaacaaaaauguaaacagaaucuuuagaucccucuuucuucccuuuuucguccuuacucuucucaucucuuucuauucuccuuuuccccuccuguuccuuccucuuccucugcucuaucauagccuucuuucaacuaaagucucacuaugaagcccaugcuuauaaaaauaaguuuuauuuuccuguugcaauuaccuaggccuaguuuuggaaacuuugagccucuagaaucuaauagaauguuuucagccucagggacuuaacugcugaauaaacucacccuuucuuguucuuucuaaacucuggcuggcugguucaacucagcuguucuggcucaaacuccucuccaagcugauuuauucaauuuggcuuuucuuuuggccucugaauggcucugcuuggccucaaacuaauucuagcaacauuuucuaaucuucugccuuuugcuuguucuguaagaccugggucuaguuuguucucucuucaaccuaucucuguaaaacucucccaguaaaacugccuccuucucccucucugugcugcucuccuugaacucuacuguauuccugcacuguacuuucuucuuuuacugucucucucucccuuaaguagcuucccucucucuucucaugagaguggggaauauccuauucugucaaucuuucucugauuugucacuuuuccugccacucaauuagacaucacuuucaaacaugggugcuuccuucugcaaacuaacuuuaccuucauuguuugggauuaaaugugaguacuaagggugugccuguauuccagccagagagauuaaagguguaugcuaaaggcugagccacacccuagcuagaaauauuaaauauccuguaacacaugcuggucuugaacuuugaaugguccucaugccucagccuuuuuaauauuggugucaccagguuuguaauaccaugccaaacuuuuauuuauucaguuuuuauccauuugaaauugugcugcuuguaaacugaagaaacauaguuuaaaagauagaaggccaggcgugguggcauacgccuuuaaucccagcccuugggaggcagaggcaggcagauuuuugaguuugaggccagccucaucuacagagugaguuccaggauagcuagggcuauacagagaaacccugucucgaaaaaccaaaaaaaaaaaaaaaaaaaaaaaaaaagauagaaaaaguuguuggugauauuucuuuuaaaacuguguauggauauuuugaccauuuuguuguugugucuuuggaccacacaugugccugguacucaaagaggccagaagagagcacuauauccccuagaccugguauuuccaaugauuaugggucauuaugugggugcuagaaguggaucgcaggauccucugcuauuaugcuuagccaccagccccucaacugcaguuuuaagcugguggauguugagaagugccuuuuaugucccuacuuugguccucaagggugcugcugcuuguaacaucacagugcacaagugauuauucucaaagucacucacacuuaaacucaucucugcucccccuccauccucaccccaucuucacugucaguccugcucaggcuccuucuucacauccaucaccaucgucagcaucagcacucucugucaugcucaccuccaccccauuaguucucacuuucacuuuuuuugcuuagcuuugaugaguuuaaugagaagagggucagucuuccaagaacauaaagcaucaaaaaguuguaaugaggccugagcaucugcgggagacaucuugguucugggacuccaccgagacuagucugcacaggugaaaguguggacuacagaagcuaacagcuucugggacaggcgggagccacagagcuucugaggcagcccccuuuucgggcuccagacauccgggcacccucccugccagaggauagguguccgcccggcccaggagggcuuugcaggagcaccugggggagccaucuugauucccggaucccucugagacuagucugugcaggugagaguguggacuacagaggcuaacggcuucugugacaggccaaagcaacacagcuucugggacagguccuguuuugggccuucaucuucggccaggagggaggucugaacgucagauaucugugcaccuucucuguaagaguagagcuugccugcagagacugcucugaccacugaaacucagaggagagagcuagucucccaggucugcugauagaggcuaauagaaucaccagaggaacaaucucuaaccagagacaacuauaacaacaaacuccagagauuaccagauggcaaaaggcaaauguaagaaucuuaguaacagaaaccaagaccacucaccaucaucagaacccagcacucccaccucgcccaguccagggcaccccaacacacucgaaaagcuagaccugaauuuaaaagcauaucucaugaugaugguagaggacaucaagaaggacuuuaauaacucacuugaagaaauacaggagaacacugcuaaacagguaaaagaccuuaaagaggaaacacaaaaaucccuuaaagaauugcaggaaaacacgaccaaacaggugauggaauugaauaaaaccauccaagaccuaaaaagggaaguauacacaauaaagaaaacccaaagugaggcaaugcuggagauagaaacccuaggaaagaaaucuggaaccauagaugcgagcaucaguaacagaauaaaagagauggaagagagaaucucaggugcagaagauuccauagaaaacaucaguacaacaaucaaagaaaauggaaaaugcaaaaagauccuaacucaaaacauccaggaaauccaggacacaaugagaagaccaaaccuacagauaauaggaguagaugagaaugaagauuuucaacucaaaggaccagcaaauaucuucaacaaaauuauagaagaaaacuucccaaaucuaaagaaagagaugcccaugaacaugcaagaagccuacagaacuccaaauagacuggaccagaaaagaaauuccucccgacacauaaucagaacaacaaaugcacuaaauaaagacagaauauuaaaagcaguaagggaaaaaggucaaguaacauauaaaggcaggccuaucagaauuacaccagacuucucaccagagacuaugaaagccagaagagccuggacagauguuauacagacacuaagaguacacaaaugccaucccaggguacuauacccagccaaacuuucaauuaccuuagauggagaaacaaaaguauuccacaacagaaccaaauucacacauuaucucuccaggaaucccgcccuucaaaggauaauaacagaaaaaaaccaauacaaggacagaaaccacguccuagaaaaagcaagaaaguaaucccucaacaaaccuaaaagaagacagccacaagaacagaaugccaacuuuaacaacaaaaauaauaggaagcaacaauuacuuuuccuuaauaucucuuaauaucaauggacucaagucccuaauaaaaagacauagacuaacagacuggcuacacaaacaggacccaacauuuugcuucuuacaggaaacacaucucagggaaaaagacagacaccuccucagaaugaaaggauggaaaacaauuuuccaagcaaacacucugaagaaacaagcuggaguagccauucuaauauuuaauaaaaucgacuuccaacccaaagucaucaaaaaagacaaggaggggcacuucacacucaucaaagguaaaaucuuccaagaggaacucucaauucugaauaucucugcuccaaaugcaagggcagccacauucauuaaagaaacuuuauugaagcucaaagcacacauugcaccucacacaauaauagugggagacuucaacgcaccacuuucaccaauggagagauuauggaaacagaaacuaaacagggacacagugaaacuaacagaaguuaugaaauaaauggaucuaacagauaucuaaagaacauuuuauccuaaaacaaaaggauauaccuucuucucagcaccucaugguaccuucuccaaaauugaccacauaauuggucacaaaacaagcuucaauagauacaaaaauauugaaauugucccaugcauccuaucagaucaccaugaacuaaggcugaucuucaauaauagaaauaaauaauagaaagccaacauucacguggaaacugaacaacacucuucucaaugauaccuuggucaaggaaggaauaaagaaagaaauuaaggacuuuuuggaguuuaaugaaaaugaagccacaacauacccaaacuuaugggacauaaugaaagcauuucuaagagugaaacucauagcucugaaugccuccaaaaagaaacuagagagagcacacauuagcagcuugacaacacaucuaaaagcucuagaacagaaggaagcaaauucacccaagaggaguagacagcaggaaauaaucaaacucaguggcgaaaucaaccaaguggaaacaagaacuauucaaagaaucaaccaaaggaggagcugguucuuugagaaaaucaacaagauagauaaauccuucgccagacucacuagagggcauagggaaagcauccuaauuaacaaauucagaaaugaaaagggagacauaaaacagauccugaagaaauccaaaacaccaucagauccuucuauaaaaggcuaaaaucaacaaaacugaagaaccuggaugaaauggacaaauuucuauacagauaccagguacaaaaguuagaucaagaucagguuaaugaucuaaacaguccuauauccccuaaagaaauagaagcagucauuaauagucucccaaccaaaaaaagcccaggaccagauggguuuagugcagaguucuaucagaccuucaaagaagaucuaaucccaguucuucacaaacuauuccacaaaauagaagcagaagguacucuaccaauucuuucccuuaugaauaucaaugcaaaaauucucaauaaaguucucgcuaaccaaaucuaagaacacaucaaaacgaucauccauccucaccaaguagguuucuucccagggaugaagggaugguuaaauauauggaaauccaucaacguaaucagguauauaaacaaacucaaagacaaaaaccacaugaucaucuccuuagaugcggagaaagcauuugacaaaauccaacacccauucaugauaaaagucuuggaaagaucaggaguucaaggccuauaccuaaccaugauaaaagcaaucuagagcaaaccaguagccaacaucaaaguaaauggugagaagcuggaagcaaucccacuaaaaucagggacuagacaaggcugcccacuuucucccuaccuauucaacauuguacuugaaguucuagccagagcaauucgacaacaaaaggagaucaaggggauacaaauuggaaaggaagaagucaaaauaucacuuuuugcagaugauaugauaguauauauaagugacccuaaaaauuccaccagagaacuccuaagccugauaaacagcuucaaugaaguagcuggauauaaaauuaagucaaacaagccaauggccuuucuguacacaaaggauaaauaggcugagaaagaaauuagggaaacaacacccuucucaauagucagaaauaauauaaaauaccuuggcgugacucuuaaguaaggaagugaaaggucuguaugauaagaacuucaagucucugaagaaagaaauuaaagaagaucucagaagauggaaagaucucccaugcucauggauuggcaggauuaauauaguaaaaauggcuaucuugccaaaagcaaucuacagauucaaugcaauccccaucaaaauuccaacucaauucuucaaugaauuagaaagggcaaucuucaaauucaucuggaguaacaaaaaaccuaggauaguaaaaacugugcuuaaggauaaaaaaaaaaaaaccucuguuggaaucaccaugccugaccuaaaccugcacuauagagcaauugugauaaaaacugcaagguacugauauagggacagacaaguagaccaauggaauagaauugaagacacagaauugaacccacacaccuauggucacuuggucuucgacaagggagcaaaagccauccaguggaaaaaagacagcauuuucaacaauuggugcuggcacaacugguuguuaucauguagaagaaugcgaaucgauccauuccuaucuccuuguacuaaggucaaaucuaaguggauuaaggaucuccacauaaaaccagagacacugaaacuuaaagaggagaaaguagggaaaagccucgaagauaugggcacaggggaaaaauuccugaauagaacagcaauggcuugugcuguaauaucgagaaucuacaaaugaccucauaaaauugcagagcuucuacaaggcaaaagacacugucaauaagacaaaaagaccaccaacagauugggaaaggaucuuuaccuauacuaaaucagauaguggacuaauauccaauauauauauaaagaacucaagaagguguacuccagaaaaucaaauaaccucauuaaaaaauagggcucagagcuaaacaaagaauucucaccugaggaauaccgaauggcugagaagcaucugaaaaaaacguucaacauccuuaaucaucaaggaaaugcaaaucaaaacaauccugagauucuaccuuacaccagucagaauggcuaagaucaagaauucaggugacagcagauucugacgaggauguggagaaagaggaacacuccuccacucuuggugggauugcaagcuuguacaaccacucuggaaaucagucugguggauccucagaaaauuggacacaguauuacgggaggaucccgcaauaccucuccuggucauauauccagaaaauguuccaacugguaagaaggacacaugcuccacuauguucauagcagccuuauuuauaauagccagaagcuggaaagaacccagaugccccucaacagaggaauggauacagaaaauuuggcaaauuucacaauggaguacuacucagcuauuaaaaagaaugaauuugugaaauuccuaggcaaauggauggaccuggagggcaucauccugcgugagguaaccuaaucacaaaagaacucacacaauauguauucacugauaaguugauauuagcccagaaacuuagaauauccaagauauaagauacaauuugcaaaacacaugaaacucaagaagaacgaagaccaaaguguggacauuuugccccuucuuagaauugggaacaaaacacccauggaaggaguuacagagauaaaauuuggagcugagaugaaaggauggaccauuuagaaacugccauauccagggauccaucccauaaucagcuuccaaacgcugacaccuuugcaugcacuagcaagauuuugcugaaaggacccagauauagcugucucuugugagacuaugcuggggcuuagcaauuacauaaguggaugcucacagucagcuaauggauggaucacagggcccccaauggaggagcuagagaaaguacccaggagcuggggggaucugcaacccuauagguggaacaacaauaugaacuaaccaguauccccggagcucgugucucuagcugcauauauaucagaagauggccuaguuggccaucaguggaaauagaggcccauuggucaugcaaacuucauaugccucaguacagggaaacgccagggccaauaggcgggagugggaggaugggggaguuggugggcgagggcguuggggacuuuugggauagcauuggaaauguaaaugaaauaaauaccuaauuaaaaaaaauuaggggcuggugagauggcucaguggguaagaacacccgaaugcucuucgaaagguccagagaucaaaucccagcaaccacaugguggcucacgugguggcaaggagaucugacucccucuucuggaguaucugaagacagcuacaguguacuuacauauaauaaauaaauaaauacaucuaaaaaaaauuagaacaacaagaacaagaacaacaacaaaaguuguaaugauucugagaauuugcauuucaucucuuaauguagcuuucacuauugugcauuuuauaaauagcauauaaauuuuaauuugaauauucuaugccguuaaagaccauuccucaaauaugaguaucagaaauuuccuuuuuuuucuuuuuaaauuauuauuauuuuuaaaucuuuuuuacaacccauuuguuaucccccuccugaucuguccuccuacaguucuucauaccauuccuccugucccuacuccaccagaccuccccacugccugggcccucaagucaaguuaggugcuucuucucucacugaggccagaccagcaguuuucugcaguauaugugucuggggacucauaucaguuaguguauguuggugacucaguguuugggauaucccagggguccagguuaguugagauugcuggucuuccuaugggguugcccuccuccuuagcuucuucuagcuuuucccuuauuccccagcucuguccauuggauggguauaaguaucugcauaugacucuuucagcugcuuguugggccucucagagagcagccaugcuagccuccugucuguaagcagaccauaucgucaguaauagugucaggccuuggcuggaucccaauuugggccugucacuggaccuccuuucccucagucuguucuccauuuuuguucuugcaguucguuuagacagggacaauacuggaucagaguuuuugacugugggauggcaaccccaucccuccacuugaugcacugucuuucuacuggagguggauucuacaaguucucucuucucacuguugggcauuucaucuaagguccuuccuuccgagaccugaguccucaccuccuaggucucugguacacccuaccuccuacacacacacacacacacacacacacacacacacacacacacacacacccagagccuggcaaucuucauguucucucuuccccucucaguccucucuuccacccaggucccugcuucccuugguacugcaugauugcuuucuucuuccucccaagugagauugaggcauccuuauacuugggccauuaggcuuguuagcuuucuugaguucuguggauuauauccuagguauucuguaauuuuuuggcuaauauccgcuuauacauaccaugcauguacuuuugggacugaguuaccucacucaaaguccuuagucaucaggaaaugcaaaucaaaaugacccugagauucuaccuuacaccaaucagaauggauaagaucaaaagcucaggugauagcacauauuggcaagaauguggagaaggaggaacacgcuuccauugcugguuggauugcaaacugguacaaccauucuggaaaucaaucuggagguuccucagaaaauuagaacuagaccuacuugaagacucaguuauaccacucuuaggcauauacccaaaauauucccugucaugccauagcagcacauguuccacuuuguuuauagcagcauuacuugugauagccagaagcuggaaacaacccagaugucucaggacagaagaauggauacagagaauguacaaugcaauacuauucaguuauuaagaaugaggacaucaugaguuuuuccggcaaaugaauggaaccagacauuuccuuuuaaagacuugauaaaacuugauuaguuaguacuacuuugauguaaaucauccuuugaaagauugccagagaacuguagaaauucauggcuugacuugggccuuuaaagauagaaucccccaaguuugugucuauaggccaaaacuguuuccuggcuuaucuuuaaagcuguaacuuauacuggacagugacaauaagacaugaagaguuaacagagaagcagggaguuuggaaggaagcauugccaccuuagaaguacaagacaaacauuuagaagcagccaacuaccuaacccaauaaaaaugaaaacaucugauuucuuacuuugcuauucuguggaacugaggaaauuggaagcuuggaaguauucugugucaguucuuucaaugucugacucuuuugucaguguggauuuaagagaccauuaguuuuuaguguugguuuacuguggcuuuugaaguuuugucuucgugacaagaaccuuuacccauugggccaucuugcuggcucuguauauuuuauguuugugaaaaaaaauuaaaaguauuuuuggauaaaauuaggaauauuucauauuaaguauuaguauuccgguuguuuuucauaacauuuuaauuauuuacuuuauacauacaaauauuuugccugcaugaauauaugugaacuaugugcuugcuugguguccaaggaguucagaagagggcauuggaaacccuggguauggaauuauucaggaggugagcugucauguaugcacugggaaucgaacuugggcccucuggaagagcagugggugcuuuuaaaugcugagcucucucuccaacccuuuccuucucucccucccucccucccucccucccucccucccucccucccucccucccucccucccucucucuuucuuuagauuuauuucuuuuauuuauguaaaagacacuguagcugucuucagacacaccagaagagggcauugaauccauuacaguugguuuugagcuaccauguaguugcuggggauuuaauuuaggaccuuuggaagcauuuucagugcuccuaaccacugagcaccucuccagucccauuccaagcucuguuuaggaaagguuuuaaguuucuguguaugauuuuguaacaguaacaguaaagaacuguuaaauauuagugcuugaaauaauugugcaugcacacaacacaggcuugcacacacucacacacauauuuacuuacaagguuuucugauguauugaacuuccuaaaauuauucacuuguauaguguugcacaaaacauuuugauacugcuuuauuauuuaauuuguacaguaagaugaugaaugaaaaaaaaaucuuugguuucuuugaucugucuucuuuaacugauucucuggacuucuagucugucccuagagugguaggaagaguggaagggaaguaaaaauugcuuuucaaauuauauuuuaaacaucauugacuuuuucugguagauuaaguucccauugggaggcacaacauguccugaaauauaugcacauuguggaaugacuaagacacauaauuuacauguguauuccuauguagacuuaaaaucugauucccagugucauauauaacugguuggaaucaguggaucucugugauuagacaugggcuugguagcauguguccugccagaguguguacuuguucuauggucucuuguuugucuuguuuaaagcuucugggggagaaccuuagauuuuuaaguuaccaaaacauuuuuuuuuucucaauguuguuucacacauagaaaaauuacuagagggugagguuggucacgggguucucaaagaugcuuucuuaauuagaaaaaaauauaacaugaaauugaaaucacaaaugauaguuuauuuucaaccacccauuuaguacuuauacuuaguagaucucuuucaguuguugcaguauauuuuaccuuuuaucacuuauuaaguacuuuguauguuagagaguagguaagauugauaccaagcguguuuuugaaaaguacauuuguauguuuuuaauuaaaacuauuggccacgcagcuuuauaaaaugguuagaaguuggccuggagagauggcucagugguuaagagcacugacugcucauccagagguccugaguucaguuuccagcaaccacauggugucucacaaccaucuauagugagaucugaugcccucuucugucauacaggcauacgugcaaauagaguauucauacauaaauaauauaucuuaaaaaugguucaguguuuuauuuauaucgagauuaacacauuacaacuaauuaauaguuguacuucacaaaaaaccaaaagcuuaacaaggagaaauuguugaaaaaaauuaagaaaacauggaacaguuaaauaauuucaauuuuguguuaaguaauaucuagauauuaugcaggcaucuacauaucagugugcaucaggucaccaaauguugauuuucauguauuaugcuagauauaaggaucuagucaugaauaaaauacauuuuuuugcuaguaaaaaccuggcauucugauagaagacagggccaucagucaucaccauuuauuuuuugccuaucuaaaugaacacaugccauuucagcucauuucaagcguauagcuuuccuagucauuaaaccaaguaauuguucaugccuuuuuauaaauuaaauuuucuuugaaaaauugcguacauuuagcauguacagcauguuuuaaaauaacuauacauuauauaauggcuaaaccauauuaauuuacaugcacauuacuucauagauuuaaaaaucuuaacaaucaguggcauucuaacauggaaaaggauacaugcacacguguaucugcauguaugcaucuacaaacuauugcacccacagacugacuggcaucugugaauaggagcugggaaacaucuaaguggcaugugcuaggccuuagguuuguuugucagcauugcaaaaacccgagugaugauaauaauugaaacaaaagaaaucuagguuauuaauauuacguauaaaauaaaucaauagauacaaaucacuuuccauuggcucaaggaucuaaucaccuacauugaaucagugagccagugagugcuuuugagagaagaacgaaaggaguaaugaggaucagacuuuaggguuuugcucuguguaccagaaaaaaauuugaaaauagaaacauauuugcgauuuagccugcaaaguuuccugaaagagcuggcuuuuuaggaacugcuaggcuaacaauggugaggggacgagauucaaaacuacuguugcuuacacaguauaagcccuucagcaaucauuacugagaaagcuaccuugcauugcuuucauuuguuaaaaguuaauuggucugguuuguguggcucuauuucugguuuugucuguaucacacaucuguacuaucuuccuguacuaucacagcgucccaguuuguguagccacauaguacacccuaacccuggaaaagugaggaguaaucucuccaggguuauuuuuuuuuuaaaacuauuaucugauaauuuuuaugucuucaaaaauugagauuuugauugcauuuaaauaaaacuguacauaacuucagggagaacuaacauuuaauucugagcuuucuauuauaugaaaacuggauacuucuacaaguguuuggauauuuauuccauuaucauuuuauaauuuucaccacauuuguguuuuguuagauuauguuaguuucuaacauuauaucuagucuugaauuuuuuagaauuugauuucauuuugcuaauuguuaauguacagaagagcaacuuuuuuuuuuaaucuugucacuuaagaguuuuaguagauuuucuuuuauauagaauccuuggaauauuguuuagaaaaguaaugucaugugaaaauacaguuuuauuuuucuuuucucaagaugauaccugggauuucugucucuugcuuuuuagcagaaauccgaacauuaaguacugccuuaaauagaaggaagggucugaggaauguggaugaaugucugucucuguucucagccugaagccuucgucuuccccauuguguauagccauuaaguauaauguccugagcugggcgugguggcgcacaccuuuaaucccagcacuugggaggcagaggcaggcagauuucugaguucgaggcuagccuggucuacagagugaauuccaggacagccagggcuacacagagaaacccugucucaaaaaaaguauaauguccuugcugggcuucgcuuagacccucuuuaugauguugaagaaguucuuuuuuuaauuccaaguaugcuguuguuguuaauuauaaauggguguuaaauuuuaucugauguuucuucuguguugguuuaugugcuuauauuaauuuucacuagacugcagugacuaaguuugaaugcugaacuagccuugcauagcugaaguaagauguggugucuuaguuuucauuuuuuuaaauacauuauuagauuguguuugcuaacauuuuguuaagaacuuaacauccaaguuaguggccuguuuuuccucugcuguuacuuuauauaagugugguacaauuucacagucauauugaaauuaauuaguugauugaaaugaguuuuuacuuucaaaugaauaaggaaguauuguuuuuaauccagaagugauuguguauaaaacuagcauuguuauauuauuuuaauauuuggugccaaaaaccaaauuacaugaaaggcaaucuuuuaggugaaauuucuuuucuuuauauggaaaaguguuuuugauuugauugucuuggguguuuuuuuuuuuuuuuuuguucuaccaaauuucaaauccuuuuuauagcuuguuuuaauuuuuuuccuagugguaagaaaacgaagcaguuaaugcuaguuaucagugcaaguacuuuacaugaaauggugcauaagcuacugagaugcuugauugugauuagaguuucugauuuucuacaguuggacuugaauuauggaucuagagaaaaauguggacacugaauuagccugcuuaauuuauugauguggaaagagguagugaaggauuuguuugcuuguucaagguuagauaugagguuguagguuuaguccagaaacuuuaagcuaggaaggauuauuaggucuuccaugagggggaaaaaaacaaaacacauagauauauaaauauguaguaugcguaugugugugcaugugugugguuaaguuacugccucuuuuccagauacagaaaaugacaccaagaaugcaugaaacagcaugcaagagugugccuugcaugcacacuuuuaugccuaauuguuucuuuaaaaaauggcagcuuggacuauuuggaauuauuuugguagaauaaauuuagggagagaggcuuaacauuucagaaaccauuagauuagaauguaccaucugaacaauaguauccuaguauagaacuuuuugaaaucacaaugugaacauuaagacuuuaaaaaaauagauacauuuaguauguuuucauaaguaucaugcuauuuuauuuauuguuuugguagggaauguaugggacagaggcuaguuacccaacuagcuucagaagaagggaggaagauugucagauguuuucuuauaagcaauuuucuuuaccuauggaggaaaaaaugauggucuggaucuaggaaaucauccugagaauggguuuaacauuaaaagauaaauguuagaaguuuuuuucacagugauuaaagugacgauuuguuugucuuuugucuacaaacauaauacugauguuuccccuuccuugucaucccuaugugcuacaaaauuuucuucagacucucaguagaauacuucaaaaagcuacuguucauugacuggaaaccaaaagugcugcccauuugguacuuugucuacaagcaguguucguuuguuuuggucauaauuuaguuaagauauuccugugcuucaaugaacuccucuuuugaaaauugaaaauagccaugcaauacuuuuuuauuacuuuuauuuuucuacagucauuacccuccuccaggucugcccuuccacaguuccucaucccauucguccuccccacugucuccaagaggaucccuggcccugcuccccaacccccaggcuugcauauucccauucauucugcuggcccccagggcuuuucuccugcuccccccuccaauaccugaucauguuccccuuuuucccucccuuccccucacccacccagguuccucccucccucugccucccaugauugcuuucuucugccucccaugauugcuuucuucugccucccaugaguuaaguggagaggaaagcacacaaaacacccaucuaacaaaucaaacaaaggcaggucagccagucucuuggcaaugcuuuaagagggaguugcugcucacacaaccugugggccagaugcaucccagaaugaauuucuuuauuuaaguguuuggaaaaaauaucaaggauaauaguuugugagauguuaaaaaugacaaaaaguuuaguuuuucaucugcauaaauaaaguuuuauuggaauacaaacucuguucauucauuuagugucuauggauacuuucguacuucccaagcagaguaguugcuugugcagaccauauggccugcacagccuaaaauacauacugucuggaccuuuacagaacgcuugccaucccuguuuuaagauaagagugugggcaguacaugcuuuuagaauuuuuaguacaagagaaacuugguuugcucguguuuugaagaaguuucugaaaagaaauaacuuagaaaauguugcugauguguccagauaaauaguaguagcagaccuucucuagaauacagaugccauagcuaucauauaguuugcacuaugucauuucaugacagcauuucugcacauagacacuacaaacucauaauuacaucucuguuaguacauucuguuaguacauuguagaacagcuguucccaagacuuacuuagguucuuagaguuaagaaacuuguguuaguuuguuguugcuaggacaacauaccagccgucaaugacuuaaaagauuuaugcugcuggaucccuguuuucuugucucagacacuuguugguugguuucauugcuguggaccuuaguauagacgugaaccuuaugaaugggacugugcagucuagccacacaguucauggcagacaagaagcagagugagagaagagcuggggagaagggguugugucccaagugaccuauuucacuaggcccccagggaucuuguaaaauaccacacuguagggcacuaacaugggauuaacucauugguuguaucagagaccucagugucuagucaccucccaauaaugccacaucuggggaccaaaucuucaacacaugagccuuuugggcagauauuuccuggccauagcacaacuacucugagaguuuuuuuucuuuuaaaugcagauuguauguuuuccauguuagaaaugaggacauuuucaaauggcaguuuguuaaauggcagguguccauucuacauuaguaaaagaaaucuuuaugaaaaauauuuucugaaucaaaaagaaaugugauguuuuuguaacuuucaugaucuuuagguagaaaacaauaggauuccuuaucuaucuuuuuuuuauuuagcuaccaauauauguuacuuugauuguuguauuauuuuggucuauccauacacaauuaacuaguuagaaaagagaaaauauuuuaauaauuuauuuagagacuuacaucuuuuauaugauaccaaaauucacaaaguagccucauuuuaaaaaaaaaaaaucaguugauccuucucagcuugaguguuuuuuuacacaugaaugcuuuguaacauuacauuaauucuuuuauaaaauaaugauucucugaauuauguggaucuucugguuauuggcucauuucauuauucagaauuuaaaggcuacuuuuguuacuauuaccacugauaccauugucacauguuauccuaaugcuaguaguugcaaaucuuuccucacaaauccuguuuuuaccaacagauuccaauuuuaccacuggcaaugcauauuaauauaaauugcuuuacuggaguuaacagacucacuuuugagagcaugucugccagauuugaaagucuccauggcccugguuuguuuagucuacaaaguugaaggugcuacagccaaacuauacagagaauuguguuuucuuagguugcauuaugucacacaaaauauuaaaaaggaggucuaaccauggaaggguugaaagguaauaaaauuaacaauuuuugcuacuuuuuguauguuuaaaugaaacugacauuuucaagagaaauuuugugauauauguaggcaauuuagauuacugugguuauuuuuaugccuaaagcauggccauucaaaugcaaaguugcagcauuagggaauagagcuuuggacauugcaagaguaccuuaaguagcuuccugcuucagauccuugaccuuaggaguauauauuuacauuaaguuuucuguuaccuuacaggugcuauacuuggcagaucagaaacucaggagugucuuuucuuuaaugcuaauugggaaagagacagaaccaaccagacugguguugaaccuugcuauggugauaaagauaaacggcgacauuguuuugcuaccuggaagaauauuucugguuccauugaaauagugaagcaagguuguuggcuggaugauaucaacugcuaugacagguaagaauguauuuaauuuuuaugauggaguucagugacuuuccuucucucuguccugccuugaaaaggaaagaaagaucaaugcauggauuuucaaguauuucuugcuguuuugaagaugaaauuaugaagaccaucauaacauucaccagugacaagauuuuugaguaauugacauaccauauuucuacuuuauucuugauauguuuugaauaaucuacacguagugagaauccuuauauaugaauaauuuuuaccaucuuaguagcauuauaagcuuuaaugccaauuuaauaaucacuuuaaaagaaaaucuauguguugaaaguauauccuuaaggaggaguaaugauuuguugcaguguuccauauccauucaguuuucuucuuuauauauuuggaagauauugggacuuuuguuuuuuaccccaagagauauuuauguugacauuccgcauuauaucagaacuaaaaacucauacaaagcuauauuuucuuuaguacaucuuauuucaguuauuuuauacuggaauaaauaaaugguaaugcuauuaaguacuucugaucuuucuauaggaagggacaucaauauuggacugaucauuuuccugccugccugccacuuuugcacuagggguggguguuguaacaugguagaggccugcacagcccuaggcaaccagcuguuuuggacccaagaaguugugcuauagcugcugaccauucugucuuuuuccaggagccucaguuaccuacaguugaugauugauuagccauaugugaccuaggcauuagaguaaaguaaaaucauuuagcuauauuuuuaauauuuggguuaugcuucaaaguuucuaaaauuuccaagaauuauuucucuauacuuacauucuuuaccuguauuucuauuaguauaagugcauaauuaagugauaaucugcuauuauaaaaggaaaugggaaaacaguagaaaaaauguagggguuaucuuuacucugaucuuuuauuaguucauaugaggaagcugugaguguguuuguuuacaugugcacauguguauauguguuauauguauauggauacauacauacauaugcauguguaguaaaaacuccaguacuucuugccucuugacucaguguuuuacuugugugagacucaggcagcacugcagugcuuauugagccauucuuuggagccucacagagaguauuacucagcauaaagugcuugaucucagugaugaccacaccagcuuuguuuuuggggauuaaaugcuaauaauauagaaacucaugaauccaauauuuaugcucuaaaauugauugaauaaaucaauugaacaaauaaagauaguaugagaaaggggauuuuuuugaguuaaguguuuucagugcuuggaaacaugacuauuaauuuuuaaauuacauauuccuuauaaaacagcuugacuuaucuuuuaauucuucuuaguugacguuaguggauucucuuuggaguuuaauacugguaaagcuauuagcucuuaaacuugaacuuuuauccggaguugucucaguuauugcugaaugcuacacaaagcaggcucauugauguuuaacagcaguaaaguugauuuuuuaaaaggacagacuuauauagcugguuuuuuuuuuuguuuuuguuuuuguuuuuuuguuuguuuguuuuguuuuguuuuguuuuguuuuugagacaggauuucucuguagcccuggcuguccuggaacucacuuuguagaccaggcuggccucgaacugagaaauccgccugccucugccuccugagugcuggaauuaaaggcguguguuaccacgccaggcuauauagcugauuuuuaguagcugguugaaacuuguuucucaaggguaacucuuaucgaggcugcugcuuuuuauuuuaauucaguuugucuugauugugaucacucuuagggaugagguccucuauguuuguuguucauauuaguucucugcuuuuuuguuuucuuaaaacacaauccuguucaucuguucaagaauuguaaaacuacuacgugagaaaagcugguuugggucuuugauacugaaauaaguucuguuccuaagauacaaacucacauuacuuaguguauguguauauuuauuuagcuuuagaucuaguuuuuaguuuuuaauauucacaaaauagggaguuauauuucccaugagcaaaugcaacuccuagacuaaauugccucacugacuuuauguucuucuucaagcuucucuaauaauuaaaaagaaaacaaaggagauaguuaccuuagauugcuuauuuaaccacauuaaagcaauagucugaggaagccagugugaucaucauaaacucagauguuuguuuaucuuuucugcugagauuuacuaacagaagucuaaggacaguuuuaauuuuaagaguugauuauuggauacucacaaaugccuugaauuugaguauaaugacuccugucucagaagaaaugcaucuauuguggggucaauauaaugcuauauguguuaauuauucuuucuuuuuuuaaaauaggacugauuguauagaaaaaaaagacagcccugaaguguacuuuuguugcugugagggcaauauguguaaugaaaaguucucuuauuuuccggagauggaagucacacagcguaagugcauagugaaaauauacauuuguguuguugacuaauuuacuacuuucuuauacucuaucccuccaaccccuggcucucaucuaugguuacuacuuauagguuuguguagaccaaauccgagccauuuccucuucccucuuuugcagccacuucaaauccuguuacaccgaagccacccuauuacaacauucugcuguauuccuugguaccacuaauguuaauugcaggaauugucauuugugcauuuuggguguacagacaucacaagauggccuacccuccuguacuuguuccuacucaaguaaguuacuauccuguaguuucuuuuguacauuuuauauuguaaagaaguauuaacugcuguauaacugaguacucuguuaguuauuuucuuuggcguucauuguggaauguuuauugucauggaaacuagagccaauagcagucuuacuaauuuuguaugcuguaaacuucuuuuuuuuaauuagauauuuucuucauuuacauuucaaaugcuaucccaaaaguccccuguacccucuccccacccuguuccccaacccacccacuuccacuuccuggcccuggcguuccccuguacuggggcagauaaucuuugcaagaccaagggccucuucucccaaugauggccgaucuucugcuacauauguacuagagacacgagcucugggagguacuggguaguucauauuguuguuccuccuuuaggguugcagaccccuucagcuccuuggguacuucucuagcucuuccauugggggcccuguguuccauccaauagaugacugugagcauccacuucuguauuugccaugccucacaagagacaggguccugucagcaaaauagagcaagguauugauaucaucccuagucuccuguagucucacuccuacccaguuccuuaaauauggaaugcacucugcuuucauauugaaguuauuaaugaugaaaaguggucucagaaucuucuuugucuuuuuuaugcuuuucucuauucagauuuaaugccuuuuaaaagaucuuuugccaaaacacccuugauuguuagaaaugaccuauaaauuuaggcaagaaaguauggaaaaugaaagcuuuguaaaggcuuuagugauauacauuuguaaagaucuuucaaguaaaguugcagagaaauauuugccauguauuacugguaauucagguguguugauuuguuuacauagcaaauauaaauuagauaguaaaaacuuuaaaaaauguuuuugauuuuuauucacuuuauaaauauuucuaaaaauguaaacuggguaaucagauuaaaugcucugaauuuucuuuauuuccauuauguagagugcugucauuaguucagugccacacagaacuuuucauggaaguagcuaacaaucuacauguccaagaaaacugauaacuuguuuauacuucuuugagccaucuuuaaauccuaauuuuuacuuuguuucuuuuaacacuuuaagauuugaauaccuugggccuucugggucucuuaguuuaacuuuguuuuucuaauauuaguaggcuaaaugguaaaauuugauaaaagaaauuaggaaaaucugguauuuaaugauaagaacaauuccucuaagcauuaauuuacauaccauaccuaacaauauguuguugcaucagcucuuucaucucuguaaucuuugaagaaugcauguagaaaaauaaacccaaugguagauaacuuccauucuucugucagugauuuuguuucaguaucuaaauuuagaagagaaaguaaaguacuuugugugcccuaauaauuguuugaaauuacccuagauucauaaaugugacagagaaaucuaaaaaacacauuuaagagaacuuuauauauaauuauggaauuuuuauuaaaggaaguuuugaacauuaauauaauguuguagaugauagaacauugaaguauauccaaugcugguaugcaaguguuguuaagauguuucucguguguguguguguguguguguguguguguguguguguguguguguaucugugucuauauauuagaugacucucauaagaaguacuaauuaagagucuagcacuuuuuauuuaagaaagggaagacacuacuacaauucauaaauaauagaccgagaccuguuguagguacccccuggguuucagauguuuguugcuauugauauuguuguguguguuuaggaaugcugaaaaacacggccucacuuuugugcuugaguaacuuggcauggacaaaucuuuauaagaaagacaauccugaacugauuuauaacucucuguggauuuuaaacuuugugaaaaugacauuguuuuuuauguggaaucucacucuggacaccucagacuuucucugacauaguguaacugcaugguuuaagucucauuuuuggugagaguuuuuauauaaauuuuguaauccuuuuaaauuuaaaaauaauuggagguaauuacaucaaguauuuacugauuauuuaagugcuuguucuagggugguguuacgaauaauuauauacauacauacacaaaacaaacgcacaaagggcuucuuuucacugaauuuuaaauugugauacugguauguaaguaucaucuuugggauuuguuguaacauucacauuccucaaccauacuucugaaaguguagaauggagcuguugauaaaguauauuuaauaagcacuagcuuaauuaauuuuuaucucacaggacuuaguauguaguauuagauuauagauaaacugugauguauaaaggcuuacaaguaucagaucuggaaucuaagccaagaugcuuuuuaaacuuugcugcuucugcuuuucuaguuugcuccucuuuucaguuacuuuuaaauacuauuuagguaauuccauaacaucuuuggcaucucuauaucauguuguugucuaguuuagcuuucaauauugaauaguuugugagcacugccaucaucuuguuagccucaugaagaugaaagaacauaacaccacaucuguacagaaaacacacacucauguguuucucuuugaaaguuguuugaaaauguagaauacauuuuugaacaagugauucggccauagauagaaauuucuggcuacugguuugauuuuaccagugugcacucauuguuuaaaguguuugggaguaguaaugaguggguaggugagguauacugcacacuuaaagucuuguggacaugccuguacuuuaccugcuaggugcccaccuuccaacaguuaacagaccuguuaggaagagaucuugcauucuugccaagaacauuuucuuugcaccuuguuuuaaguucuuuaggaaaauggcauaguacuuuuuacugcuuagagaaacuuucauaucuuuagcuaauggcugguuuauguauaacugcuaucuuguaaggacuugaccuuaacaauaucaauaaguuggcuaugucaguuaaguaaugggagucauuauaacaaagacaucauuuauuuagaguauuuuuauuaguauuaucgucagugauaauaggacauacauaauuuaaaaucuguuucuuuaaaauuaugguucuuuauaagaaacaaaccauucacuguaaaauaauuuagcaugauuaaggaugcaaacaaggcaugccuccaugugauuaguaauugaagcuacugacgucuguuucuaacucaccguuguuucauggugucacugcuuucacagucgucucugauggaagcuggagagguaaugcucuaagcucucgcagaccccauccaccuuuuaccuugauggugugcuguucagagugugcugcccugcagguuauggacgucucuguaaccuuacagcucgucuuccugcuuucauguucuuccccucugcuauugcuacaauaguacuuuacauguuagauuauguucuucugugaucaaaaguacucaagggcucuuacugcuuuguacccuaucauaugugguccacuguacaucaucuucucauguuuuuucuccaugcuauacccaaaaccaucuaguauacacaucuagaguuauauucuucccucuuugauuccgauaaauaaucccaggagagaaaacucagaauaaucuguauaaauauuguaucauauuucauuauuccuaagcuucuugaagacaaaguauguaacugcuguguuuauaguguuggugagggaugaccacccugcaaguacugaacgcaauguugaguuuuucugucgagucuccuugagaugauaagaucaaucguaggaauuccuguaauaaacauccagauacuuuuagaaccuugccuugagacagaacuguaguuuuggaggauguacaauaaguugaaguaguccuagcuucuauaagacagagacaugguucccgagucaagaagcagccucucgcuuuguacuauauaggccacuuuucuuuugcuucugcuggagcucuuuccacacauaggaagaagcucauccacagggaguaaauugaaugcaaacugguuuuucuggugauggugagucaugaguaugagggaauugacggacugacucucuuauuaagccuuauugucguaaagaguuaaugugguuucaguaaaacuguuugugaacuuaaguuuccuguuuauaagaucuguguucaugcugagaauaccugccgcuugguaagguaaagauuagagucuagaaauugcuuaccuuaaauaagauacaaaguuagcuuuuuguucauuucaaaaggcuguauaucuagcacuuuaguauugcaacauuguucuuuuuaaagugacaucuacuuccuuaguccuuaugaaauuuugucugguuguugguuugagauggaguaagggcuuucauauguuggggauccccaaguugagcaugcaaaguaaccauugaccuuaauauuuaagcaguaauaggaugacauuucaugcugugccaaauuacuacccucugagaaaccaaaucaucucugaaaaugcuuuguagaguuuucuucuugauugugaacuuauauacauaucuauggaaaaguagugagaaaccaaguuguaggauaauauugaagccagcuuaggaaaaugugcuccuuucuuucuuaggaaagauguaggggaaacuuacuaaauguuauugauaauguuuagcauuuauagaagcauaccuuuuaaaauucauccguacuuaaaauauaacuacaucuucccuuuccccagguuaccguccuccaguuccuccaugucucccugccucccucucacauccacagcuuuguuuccucugagugcuuugguuaccuguauguaugcauaaauguaaagauacaaccugcugagucggaauuuguuguuuguguguaugguuucagauuccuuucuuagauaguuuuccccuuucucugccuauuaauuuccugguucuuuaccuagggguaaaauccuaugagauuucucuuuuuuggugauaauaccuguuuaugccgucauuucuuuuuucuuuuuucuuuuuuuuuuuuugguuaauuuuucuuuauuagauauuuucuucauuacaugucaaauacuauccagaaagcccccuauacccuccccucacccugcuccccaacccacccacuccugcuuccuggcccuggcauuccccuguacuggggcauaugaucuucgcaugacuaagggccucuccucccauugauggcugacuaggccauccucuaugcagucauuuuuagggaagacuuuuacuacaggcuuccuaguccucuagcucuuaaaauuuucccagccugucuugugcaguauucucugagccauagauacagaagcagcaauguagaugugcauaugaggcuuggcuuccacacucgguuaaucucugcuuguguuguguccaguugugguuuucugugauugucuccauuugauaguaaagaacuaugcagaccuagcaaaaucgugguauuagauucuuuucuaagguccaugaccucauuagcccugggaaucuggcuauguuuccgguaccaggcauucuuuuccuccuguugaguggaccuuuagugcagucagaugcuguugguuacauucacugcaucuugauggacauuucaucgugcugguuaguauuaugguucagaggugucacaacugggcaggguuuuaaauuacuucccucccuuggcagcgcgcauaggauuuucuagaaccauggaagcuggaccacaugaaggagguuuccagauuggauccauuuugaauuacuauuguguaacaaacuuuuuccugugcagaugcaauacacauaucuguuuacccuaggaauuccacaacagaccaaaguaacaaauaccaucaaagucgaacuuagugaaccaugaguuugauugggguuacaaucaaugugucacuuucaggaacaaauaugauucaaggacagcuacauuaucaaagcccaucgaguaugggugaccgcucacaacaacugagaaccuggagugcuuugcauaaccugcagguagcccaacagguuggagaguguccuuuauaggugacucuggucuaaaccucuuuuagacagcuccauugaucgccacuucuucuagguagcuggucugggcucagaguguucauuucaucuuuugcccuucugagucuucuuuacagcuuagccuauuaggucugagagggacucagcuuuuguggcagagagaggggccuagugaaucuggucaguuucagguauuuccuggaacuguuuugaguuguuuacuuucuuguuuuaaggcauuauccugaaggaugaaauguuuaaaucugggaagaagcuguuauagaaguaaguuggcggcuuaaugccuacaguuuauuaauacauguuguuuuucuucugcuugaaacaagacuuuguuugauuuauggagacaaaugauuuagaaugaauuguagcaaaaagggaaagaaaucauuugcauuucuuuuaucacuuucuguaaguaauuuuaagauugguguacauccuggaauaccuuucucuagccucaucuguuuuaguuuaugcauuuuuucuuaugaacuauuaaauauacuauuauccuuuuuuuaaaguuuauuuuuuuacauuccauaguccauuccccccauccaccuuccaacuacuccacaucccacaccuccucuucaccccaucccaucuccacgaggaugcccccaaccccuaaccacaccugaccucuaaacucccuggggccuccagucucuugaggguuagauacaucaucucugaaugaacacagacccggcaguccucuacuguauguguguuaggggccucauaucaguggguaauugcuaucuguuuggugguccaguguuugagagaucuccaggguccagauuaauuaaggcugcugguccuccuacaugaucgcccuucuccucagcuucuuucagccuuccccaauucaacaacaggggucagcugcuucuguccauugguuggguacaaauaucugacucuuucagggcugcuuguugggucuuccagaguacagucaugcuagguccauuuuuguuagcacuccauagccugaguaauagugucaggccuugggaccuccccuugaguuggaucccacuuugggccuguuacaggaccuucuuuuccucaggcuccucuccauuuccaucccuguaauucuuucagacaggaacaauuaugggucagagauaugacugugggauagcaaccccaccccucacuugauguccugucuuccugcucgaggugggcucuauaaguucccucucccuacuguugggcauuucaucuaaggucccuuccucccuuugaguccugggagucucuuaccucccaguucucuggugcauucuggggaguuccccuaaccuccuaucucccgagguugccuguuuccauucuuucugcuggcccucugggcuucagucuuuuucccucauccaguaccaaaucaggcuccccucuccuccccacuccccccacccuauccauugcuuucuucucucucccaagugggacugaggcguccucacuugggcaauucagcuuuguugaccuuuuugaguucuguggacuguaucuugggcauucucucucucucucucucucucucucucucucucucucucuauauauauauauauauauauauauauauauacagaauguauguauacacacacacacacacacauauacauacauauacacacacagacuauaguaguauagaaaaauagcuuuucaacuugaugugcuauuuaucucaauccauuaaaagauguaucuuuaagugaaacuuaguaaagugcuaauacaugcucaagaaauaccaaaauuuaguguuuugguacaaauuuuguacauuuaagguauacugugauauauguguguguaauauaauuauauaaaaauauauaaaaaugguaaaauguguauaugauauauguauguaauauaauuauauaagaauauauuuuaacauauuuauauacaauuauaauacuauauaauuacauacacauauaucacacacacacauuuugccaguuuaguaguuuguaugagauuucugauaggauaaucuauauuucauaaguauuuccaaccauguuuaaaauaugauauaaugcuguuuuaaacuugcacaucuuuguauauguauauucuuaagaaugguacaagauuguuguaguuguuuuuccuuuugugucccacugugauauauaauugcuuuuugauucaguaacuaaauuuucaccuucauuuagaguauacuuuuaagcaaauuuuuagaaauuauugauagacacaaagcuugaaaaguuaccuucaccaagcacauacauuuuuuucuccuacuuacaagugcuuagauauaguuauuuggagauugagaauucuguagccagaagcaaaacugguugggaggaagacaaaauccauagagcuuuacccaguuagagugaaucuguauaugacacuuaauuugugaaagugaguuuuaugagugcuuuggugacaaacauacuacugcaggugacccauucaguucuuaugccuggaaugcagcuuuucucuugccagccuagaaguggacuuucucuggagagcaacuauuagcaggaggaggcacaccuuugcuucucugcaucagucucauuuccugggucuuaccuuauguccauagaaaacuaaauuaagaaaaauuaauuagaguuuacuguuucauccugaauagagguuuuaccucauguccuuuuccuuuauuccuugcugugccacugcuuuaaaacccuuuucuucuaauuugaaauaguagaaguagaaaagcucauuuguuaaugaaguaguacugugggcugucuuucugguuuuggcgcucgcauaccugcucucaguccugcacugagcaucuguuuaguacuuguacaggaugcucucgguuugcucucuuggagcucacaguuacaaguaaagaugaaaacaaaccagcugcuuauugagcuuugcuacuuggaaaugaaggugaagagguucugcagggagugguagggaggacagaucugauuggcauuccgcacucccacacggcauuugagguguugaccaguguuaaaacgcucaguaaaugucagcugucauuggccuuucugucacagcuucagaacugaccagaaggagugacuuucauagaaagugcuacugcuguaauacucuaaaauaccuguucuaucgaguucauuuuauugaugagaaaagguaaaaugaccugacuuacaaucccgauccaagugggauuuacucaggaguuacuguccacugguugaacagcuuauuuucaaauaaguaauuugauggaguccauagaaaacuaaauuaagaaaaauuaauuagaguuuacuguuucauccugaauagagguuuuauuugugcuuauacagccugguggugaaauaauuuucgcauaccagaauuuauuucuauguacacauacucauuuucauuuuucaucuucacuuagagguuauaaacauuaaauuagauaaagguaagcuuucuuuauagcuagucauaacccucagcuuuugaacagcuacuaagaggagacugugcuuucucuguaucuccuggagacuuuccacccucgugcuggcaacccugugcugcuaacugauuagggaaucuuuucagaguccuuauuuuuauccacagugcauuuuuuauuuguuuguuuuggggaaaaguaaggagagaaacuaugaagaaacuugggaucuaauuaacagagucauggcugacccauaugacagcaucagauuuauucaucuauuaaucuaugccuuuuuucuaguucagaaacuuuuuuucugaaguuacugucuuauccucuauggauuuuauuucuguucuuguuuguuuauauuuauauguuugucuaagaaaugaagacuugugauauuucuaagaauauaugauaacuaaaugucuaagagaagauacauucagaauuugucaguuuucacauaguaugcacacuugauagucauaagaaaacauuguuauuguggugucaaaauaaauacaauuggaaacuaguuaucuagcuagcuagauacacuuaagauauuuucucucucucucuuucucucugucugucucucuguauguguguggguugggauuaaaggaguuuguaguccauguuauguguguauuuauuaguaguacauacaagucuguaguuuagaacgauuuacuugaauuuuagaugugcauagcuaaccuccuaccaaaucguuccaccuggacaugucuuaguacuucccauucaaggauaacgauugcuguuuccaaaucugguuuucaauaaauguagcacuuauaugugugaauauguaauugaaaaucuaggaugugucccaguauugauuuucagucccucuacugcguuauuuaucuauuuucuucggggugcucuccucacggaaaaacuagccaguuuauuuaagugagguuguuuuacagauacuuaacaagauagugacuucuuucuacugcuuuuacucuuuaaucauacauuuguuagugcaaaccauuaauagucuaucugcugugaaguucauaagagccugaguaguuaguauuugacaugaacaguauagucaguaaacauuguuugaaugaguggauaaaugaaugggugaauaaaguuuuauauuuucugauguuugacaguaauuucauuccuucaugauaagcagcaagucucuuucuaaucuggaaaccuaauucuuggcauuaagguacugauuugauuuuuaguuacauacaguuucagugcugaguacucaaagccaccauuuccauuuugggaauacaguuguaucuauuuguauagucagugaucucuuuuggcuguuuugacuauauacuguaacuauuucuacuuugaaaaagcaugcccuugguuccucuuauuacuuuguaucuuuuuguucuaauguucuuuuauugagaaguauaucuaaaaaaaaccuauacuuaaaaaaucuguuuuaguuauuuuaauucuuuugcuuuugucuugcccauuuuuagcacaaaaagguuugguuuugucuucauucguuuuuguguuggauguuuuauagcuuacucucuccauuaguuaggaaguuuccugaauaggcauaauacuuucuaagauuaagaguaacauuugcuugcacugacauugugagcucugaaaguucuuguguguaaacaagaucccaguaauuauugugccuucgcauucccugugaaagagagguucucucaugguauggaaguauuaagcuguuuuuuugauggauaaugaauagccuuggaugauaucaagcaaacaaccacuauagaaaagugaauugucauuucuuuuugucagguaguguucucuguagaaauaguggcagcgggggaacgugucaucuguuggaguuuucaagcucccuagcaguggcuaacauguauuuugcuuuauuuaaaauucaggcaguuaucucuuuuguggugacuuguucucuuuuacuaccugacuauccucagacugagaaaugugccuauauacuuauuuccaagggacuacuacuuauucaguuguuacauacuuccuaaauuuaaaguuguuauaguaccggaauuauaguuugaacugcuaacaauugcuuaauucagacuguggacuaagucauuuaaacucuguucugucaggguauauuuugauuuauucauguugcuacagcuggacagggagguuuguaacagagcuaguuuaucaccagguuuuauuuaauucuggccaucguucuuuguguuuucuuccugguuugucuuuccugagcacacacauagcauuauucuguguuucaccuaguacauuccaaaaaugugagugagauaauuuacucacuggaaguaggaaauuucagagggucuuaugaaaacuguuaaaaaaaaccaaacaaaccaaaaaacccaaaacaaaaccccaaaccaccaccaccacaacaaaaaacaacaaacaaaaacucaaaacaaaacaaaaccccaaaacaacaaccaaaaaaccuccaaaauaacacaacaacacaaaauaaaacaaagcagacaaacccuagaacuggaaagacaucacagcucacaaaagccuaaguuugauccuuagaacacacauggaaggaagggaauagaaaaauugccaaccacacaggcagccaggcuggguugaugaugcauguuugcaaccccagcacaaaaagaguuguggcaggugcauuccuggggcuugcuggccagccuagcuugcuuggagaguuccaggucacuuggaaauggcacuuuuggaaugacaccugagguggcucccuaaccuucaugcacacacucauaaaagcucuuagaaucccuggucugagagagcuggauuuccucagggcuuuguuuucugguauuuguuaaaggcaauacugcccucugcuguucagaaucuaauugcagcuccuguuccccagaauugccuguuuaaccacucacacuuuagacuuucaaaucuuuacaaguaauauguaauaucuaaaauuuauuuuacuugcuggcuugagcccauuguaucagguaauuuuggguuauuuuuacauccaaauuuauuuacugccacccuaauagguguaauuuaaggauuuuuccuuauauuuuuuaaaauaacacuuuccucugguuauaaggaaugaguuuuucauuuuuaucuuaagaauacagucugcugaaucacugucaacucuuaaaaagcuaaaucauucuuucaccuuuguaacugaugugucauuuuucauuucauucugaauacgaaucguaauuucuuuugccuguguuuuuucuucacaagcacgccuuucauauaaugauagagguaagacgcauugcuguuuguuucaugguugugaaagcuucuguggaugcacagcagccauuuguccuuacagucguguuauuguugcuuuacuuugcaucccuuauaguuuaucuacauuuuuguuauaaaaguccucucuuuuguauccaaauauuauucauuugacauaguaaaaacauuugguuuugaagaauuguuagcaguauuuaugcuuaucuaagguuucuucugauuggaagauaaaaccuaaugagggcauuagcccuaggaacccaguaguucuuuaaaugucagccuuacucauuuaaauaagagauaacuuucugguuuagcucauuaucuuuuaacuuaaaaucuauauuuuccaaugucaucucuagcuaaugaauuagcugcauaaauaacaccuuugacaaaucuguugcugccuugaaggauagggcuguuuguauuaguauguagaaguaucucaggaauaagcagacuugaugacagauggcuuugcuaaccccuuuaaagaguagcccagaauggguauacuaaugccacgguguaggggcuuuggacagucagacuuuaccaguaacugcaauuucagcauacauucuuaugucuugagaaggaaugcacagucagagccauuucugaugugugucuucuaaguuuuauauauugaaugguuguugaaacagcacugggaacucgagggaagauuuucagaaauucuguaguccuuggaauugcuaucuuccaaguguuucugugcaucacggcaaagcugugcuucacggaugccaugaguuacagaguuuaaguucccuuuuguugccuugggguuuacauguuuaaugauagaagucuuagguguucugaauacauuacuauucugauacuaauaaacugagaauaauuucuaauauaccuuauacaauaauuaaaacuuagauuuuagagauacauuuaaaacuucauucuaaucacuucuuguuaagaaaacaaaaagcuauaucaaugauugguauuuuguauuguguaguuauuuuuauuaugaagcugaguuuuaagcccacucuuagguauccaugaauauaaaacuauaauaagaguacaucaucauuggcaagagugagccuuugcagaucucuuucuuccuuuuugaauauuggccaguguuuugcuuuuuuauuuaaauuuuuuauacuguuaagaaaauuugacaguuguauguuuuguagcaauuaauagaaaaauucugaguaaauuguaauaucaaauguugaucccagauuucucucugagacgaaaguauguuacuaagggaagcccuguaauccuauaggaccuuugaaguuuaucuuucuaucuagaagacauuuaauauacuuugaacucccuguuguauuauuaaucugagcuauugaagacaugaccucaauccuguuucaugucuguagcugugcaauucugaacacaguagauguguguguucucucuagagacacuauugcucaguggcuuuguuguccuuuuuucucuguucaguuaucugaagauuguaguauugcugcuuugaaaaauugauuauugccauuucuauuuaguuauuucuuuauaaacuuauauguuuauucuuggaccuugcagacugucuaguuuucuuugccuuugcuagauugguguucgccuuuuccuuucaguccccucagucagccuguccaugccaguagaauccuauuacaggcagagguggcuguagaacgguaagggaggaucagcuucccauagcaacuucccagagagacagagucacagugagccuggccuuccuguagcguuuguagauagccucuuuggucugucacucugcuaaacggaagcacuuuggcuuuauuaaccuuuuauauuuuuaauuugagaagaacagcaauuuuuuagacauuuaaaaacaaacaugacuucagaaugaaucacaggaagucuuucuucugccuuacuuuaaaaaauaggaguuuucaagccuuuaaaggacuaccuacaaguugcauucuuuuucuauaaaauauuuugaacuuuuuuuuuuccccugggguaauuuugaugcuuaauugaaaacucauagacucccaaacagacuagugacuggaggaugccuauaaggagcacuguaaguuguggaacauuaugaagaucuaaaaggggagaagaaaguuagggcaagauguacugaucuuggauaaaaugucaucuuuuaguaucuaaagugcuacugguagucucuccuugccacaaaaauuuuaguuccuucucacaaaauguaaauaagcacugagacauuccugauguguguucugcuggcuuccagaagcuucuuccauucugcgugagcugcagacgguaaacugagaggacacuuuaaacaacggguugcuauucuguuggcauugggaguucucacuuuucuuucuccuuuauguaguucccuggcccuauuuuaaagauccaucaugguagcacucuugucucuuauucaacauucuaucuuuccaacuaugacuaccauuuuucuagauuuauuuauacuuuuauuuuucuuuucaguuauucuuagagaaugauuuuuauuucuggucaguuuggggaaauagcuaaagagauggacuguuaguaucuugaaaaguaaaaaugaacaaagauugucuauagaaaccuuucucuuuuuuguuugugguuuuucuuuuuguuuuguucuuguuuuuguuuuuguuuauuuugagacaggguuucucuguguagccuuggcuguccuggaacucacucuguaaaccaggcuggccucgaacucagaaauccaccugccucugucucccaggugcugggauugaagguguacaccacugccuggcuuucucucucuuucucucucucucucucucucucucucucucucucucucucucucucucucucucucucucucucucuuuauuuugagacaagguuucucuggguagcucucucugucaugguacuugcucuguagaccagaguggccucaaauucauagagaucuaccugccucugucuccugagugcugggauuauauacuuguuugaaacgacuggacauugugaaauuaaugaagaaaaaaguuaauguuagacagcuacuacagaaaguauuagauuuugagauuguuuuuuugagaaaugcucuuacuuugcuguuuugauacuuuuaaaaucuguguccuuuaagagauauaagcugaauaaggccaaugacauacuauuaagaguguucugaaauucacagaacaucuugcgaacauuggguagacuggcugccuacucuuuucaccuucuuuuccuaaguagcagcagcacugauguugcuaaacauugccugcuuugugguucccacuaaugcccuagcaucuaaguucucgcaggcuggaaguuaaagucacauugauguuauagucccucauaugccaugguuucuguuagagcauuauucaguauaaccacccuuuuuucauuucagaaucaacgucuuauuuucuacuuauuuauagcauuauuauuauuuaucucuaggacccaggaccacccccaccuuccccauuacuaggguugaagccauugcagcuguuagaagugaaagcaaggggaagauuugguugugucuggaaagcccaguugcucaaugaauauguggcugucaaaauauuuccaauacagguauguuuauugaaauucccuagucuaucuacuucuguauuuuuaaagcuguaacugguuaggacauuauagcucauaaacagccugacuauauaaacuauccauucuaaagugauugauugugauaguugggaaaguaaccuagccuuucugcgcugcugucacagcugagauggaaugacuuaaugcagcacuagacuuuguuggcaggauuggaaucacaguacaugcacauguagucaaucuuuuguuaauaaaaucuaaacuauuccagucaacaacuaagcuuccugucuggguaguuaucuugucuccucggcaggaaagagcaguagaccgugcuuuacucuagaauugguguuugcaguuacauggccagacugaugucuuuucauugcacuuugaguauuuguauguacuuuuuccccuauuuuuuguugguaauuccucagaggcagugauucagguuucaaaguauuaguuuacuuuguuuucccauucaaugcagcugaacucucacgacagccugaccaaucccagucuugcagugcugcugcguugcucauugcugguagacgucagggaucucaucuccccuccuccgucaguacacccacccugugccugagaggacccgcaguacugaagucucagcuacacacccaauccccaucacuccagagucacugcagaaacaguuuccuucauauaucuagguuuuaccuccucuccucaucgaaagccuguguuuaucuuggcaacaguguggcuuuucuagagagaagcauucuguugugcuaagauucauaauaagauucaugugaagaauuuuaacaauaagaaaaagauacuggauauuaagaguacaaacaacaguagccauuuuaucaaaugccuuuauugacaaaguaaugauuuaccugcuguauguucauauguuauuuagauauaaacauaaaauaagcacuuuagcaaccaauagcacaauuauucuuuuacuucacuggacaaacgaaugauuuuauaaaaggaaaaggaaaggccaaaauuuaaacuaaucuuggauccagagauuucuuaccauauauuacagugucacuaaucuuggauccgagauuuccuuaucauauauuauaguguaacucagcuuucaaugcccuuucauagugaaaagaaaugaaucuuuuguaagaaaguauacaguagauacagaucacuagcaggaaugaguaauuaauaauuuaaaaaaaaacauaagguacuguuaccuuuggcaggcugaauagagauuuuuaccuaagggucuaucuaaauuuauauuucagggagaugauugugacuguuagcauaaauaacuuaacaccauauagugcuugcaguagcuuguaacgauguguugccguuuacgauacagaaaugcagucauuuuuggugaaugucuguguauauaaacuuagcuacacagaaaaguagauuugagggaaugggaaaaaacaaggauucauuauggauuauuguuauuaccugucacagauuucuuuuauaaaaauauaacaaaagaccacuguaccuagcucauuuugauguuggaccacuuguauuagcuuguuuuguuguggucauuucuaguaaccucaguguuucuuguccucuguguucuuagugugcuuucauuucuuuacucuaggacaaacaguccuggcagaaugaauaugaagucuauagucuaccuggaaugaagcaugagaacauacuacaguucauuggugcagagaaaagaggcaccaguguggauguggaccuguggcuaaucacagcauuucaugaaaagguauaacgacauaauacuuaaguuuaguuaagcuggacuuggcuuaucuaauguuaacuauuuuauuucaagagaacaguauauuauuacgguugauuaauauuugacccaaaauauacaucacuuaugaauaaaaauauaaaaaaagugacuuuaaggaaagaacagcuuacagcuuaccuuagcccucuaaucauagaaaaacuuuagucuuugauuuccugugcugcaauuacuucucuuagggauacuuuagaauaaacaguguuuauuaccaaaacacauuugcuauuccaucauuuuucaauuaaaauauuuuuuaaaaaacaagucuucaguguagcacaggcuggucccaaacucauucuuguuuccuagcagccucucaagugcugugauuguggguuugcguuaccguggccagcuaagauguuugcuuuuuaugucuuuauauuucacuaaguauuuggccaugaugaucauaaucucucuagagaaggguuguaugugagcgugcaugugcacaagcgugugugauuaugaguaaggugcacguguggaggccccugguuuguuuuucagugucuuccucaguuacuuuucauguuuuuuuuguuuguuuguuugguuuuuuuugguuggauuuuuuuguuuguuuguuuguuuguuuuguuuuuuuuuuuguuuuuuuuuuguuuuugcuugagguagggucucuugcugaaccuguagcucacugaugcuuccagggaucuaccugugucuguguccuccuagcccuggguugguugauggacuaauguaggucugagucucagaacucagguccugaugcuguguaacaggcacuuugccaacugagccauuuccucgggaagagucuauauauuaguaguuaguuauguuuucaguguaguucuuuaucaauguuucaucuuagagacuaguuuuuuccuaacauuuuaaacuagucuguccuuuguucuuaaccucccaaagucaauuauuaacuuauuuugguaauaagacuuaaaaaaaaaaucaguccuuugugguugaauguuaauuacugugaauugaaaggaaauuuggacagcucuauagaauucuuucuuuuuuuuuuuuuuuuuuggaaaggaauguguugcuuuuauauccagagaaaaguuucuguuuaugugaaauugugaucaagagcuuauggguauuucccucccaccucuccuuucuuuagggcucacugucagacuuucuuaaggcuaauguggucucuuggaaugaacuuugucauauugcagaaaccauggcuagaggauuggcauauuuacaugaggauauaccuggcuuaaaagauggccacaagccugcaaucucucacagguagaacaaaaucuguauugucuuuucauccagcucaaauguuuacuacuuaaacuuuuaacucuuggaguaaaauuuauuuuugcagugauuauccaaucauauuugaagaggcaaagacuuuucaaguuuuuaaaauuaggugagauuggcuaggguguguuuugguauguacauguuaauguacauguuaaucuuguuaauaaagucuaaugaucccauguuuuaauuuguguaacuucugaaaguauguuugagaauaaaaguguauuuucucuauuucaaaggagaaaugauuuuaacucaaaauuuugaguuuaaagacaauuuuuaguaaauccacagugauagaauuaaggauaaaguauuuucucugucuuuuggaugaauaaauauaacauucauuccuugagcuaaaguagaagggaccaaccaagaggagacagcuagcucuugaguaaagaaauagugcucaucagugaaaugacuguuacagucuuaaaaaggaaaaauauuuguuucugggaaauaaauuuaguuugcuauuauuuaacuuccuuggaauaauaugggauugaguugucuuucuauucaguuuuaaaauggcuguuuuaaaagucgguauuaacauauugauuuagcagauguguaguugaguguuaccaaaccaugacuucuuuagaaaguccucuccuuucuuucauguuuaugaguccccuaacuuauuaguuauagggcccuuuaaaauguuugucaguuggugucuggagcauuugacucuaccuucaucuuuuuguagaacuaaaugacuacuucuaaguguaccuauugaugagagcauagacauguuugcuagaguugucuuuaaguugaaccagaugaggcacucuucuuugcucuaaauaaaguuucuuaguuuuaaguaacuuuauuuuuauaucauauucuccauguauucaguagaaaaauuugaaagauaacuugcuuaagauauuuuauuuuuauguuugaagggacaucaaaaguaaaaaugugcuguugaaaaacaaucugacagcuugcauugcugacuuuggguuggccuuaaaguucgaggcuggcaagucugcaggugacacccaugggcagguaagaacaacagcuguaaagugagcaaaacuaagcacauaauacuuuccuuagaucagcacuaauuugaucuaauguugcugggguagucauugaaguaucaucuaauacagagugauagauuuuaguuccugaaggcaacauuuuuacacuguuguauaacucagguuuaagcaagcaccagaagagcauucagcugugauaguauuguguuuuucuuuuucuuuuuuuaaacaauuggucagagaagaauccaguucuaaauaauuuaucuuuagcgaauucuuucauugguuaauucaucacccuaauaguggaggguaaugggucacuucuuacuacaguuuuaaauucucauuucucuauauaaaaguuuaucgcucuggcucuuuauugauucaauuacaauuuaaucuuuucuuuuaaauucuuucuagaauucggagcuccugaaaaggccagagcaaagugucuaacuccaguuaugguuugcacagauagauuuagcauccuuuaggaagaccaaaggagauacaauauaggaaauuucuuauuuugcuuaauccuguaauccaauuuuaaggacauuaaaaaaaugaugagucgggcuuuuuuuauccacagaaaaaacaugaggcuaggagaggugcuacacuuguauagauucacuuuuucacaagaacaggauaagagcaggagagaaggcccaaggauuaaagaguguuuacuuccuuugcaagaaccaaguucauuuccuggcucaggcugcucagaugucuguaagaccagguccaggugacccgccauccuuuuauagccuuugugggcacccacaaucacauaugcacauacaccuucugcaugugcaauuaaaaauaaauauauucuuaaaaauagcuugaagugugugacauuucuacgaggucaaaugauucuuccaaggcuuugcccuuauuaguucugucuuucaaauuauucaaguuauuugauuauucccaaguuuucuuuuucauuccauauccccuugauccccaggaacauagcuguaugcagucaugguacacugauuucuggcaauaaucaauaauuucagauuuguuucaauguaaugucagcagcuguagaauauuagaaaaguugacauguuugagggaaaauacugcuaagaauggaauagccuagagauaaagguuuguaauuagucuaugauuaauaauuccagggcacuauguauggaacagcuucaucuuuuggcauguagcaaaacuaguaacuuuuuuuuucuuaaagccugauucaugacauuaaguaauuuuuaauguccuuacaauuggauuauaggcuuaggcaaaauaagaaauugccuacaccaguaaagaguuucucuacugucauaucaccuuugacucauaaaagauaucuuagacuaaaauuagauaagcuguaauauuaaaagaagugaaagguagccuucugagagacauucagaauauagucaaaauguuugugcagaacaggaaacgccaaaaagcuacuuuauguucucauaaaauaaguuaaaaauugaacuuaaucguuuuauuagucuguccuuacuuuugaaaacuauugcuauaugugcauuuaacugcuaaaguauuagucaaaaaaucacuugccauuaccuaaggaugaaagccauaaugccaaaguugccuccuagaucuaacuagguauauacuuuagucuacuugacaauucauaaaauguguucauauuaaaaugcugucaagaccaacuggcacuagcugccguagcauaguggccacagcuaagguacuacgaaauaaauuguuggggacacauauaaauagagaccaaagacaggagaauuuaugaguaaauaauauuuuuuaaaaguagaauuaaaaaauauaucucaaacaauaugugaaguguucuguuuucuccauucccuccuucucccagcaaagcauuacuugguacuuugugauuagaucuagaaagggagggaaagcccuguauggcugucucgugagaguauccagaagucaucuguggugguauaaucauaauuuauuuucccuggauaaauagaacauauuuggcuuucuuuuuauaaaaccauagacaaaacauuaguucauaaugucaaugagugaguacuauuugauuucaaaaucuuuuuuagguugguacccggagguauauggcuccagagguguuggagggugcuauaaacuuccaaagggacgcauuucugaggauagauauguacgccaugggauuaguccuaugggaauuggcuucucguugcacugcugcagaugguaagggaaaaagcuguuuuuuuuaaaguauaugugccauauuuaugaaaagugguuauacaaaaagguaaguacauuuucuuguaugaacuccacaagguggcagaagaugcagacagcaaggugaacuuggaggggcuggguaugaaauaaacugguauugauacuuuggagaugaaguagguuacauagcacauacuaaaagaaaauagauugcuuaagaacuucaguguuaguccuucauaucaaacuaugacucggugugauggugacauaggcccuguuguuaaguaauacauaguuaaggugauaauauacuacuuucuguagagugaacucuagagugagguaagggugaaccauuggcccggaccugguaauauaaggcauugaaguaacuauaaugaggugcagucacagcugagaaauuuaaggugugguauacagaucaagaagaguuauuuuguggggaaaggaguuauagggaagggauucauagagcaagagacacgguuagaugaaguguucagugcaucauuauacuuugcacaaagcucaucuaugcauaucuauuucucucuggucaaugaaacugcacaguaaugacauguuugugucacagggagcaaagcacagacuucagauaagauuuagauuucaacucuacuucuuaauaaucagauaccucuguauaaaaucucauaacuuucugagcuaucauauuuacaaaauagagcaaauuccaacuucauugggggauaaaauaaugcacauucaugucugauaucuaagaagaacaaguuauguuccugaaaaaaauuugucauguguuacauuuugacuugauagaaauucugguugacgcaccuuuguuuuuauaaguaucauaaauauguuuuugagaggacagaaaauuguaaaguacaucaguuacucaaguaggguguagguggagcacuaaguuuccagaggugccagugugcuccaaauguuaauauucugauaugauaugaauugauugcuaaauaccaauagcucuuugucauaaauagacaugggcauucagcauauguauucuaaaacagccugguaaggcugaauaugaagaucacgaguucaaagccagccaaaccuuuuagucuggaccugucuucaacaagcagccaauuaagaacucauaaaaacagaccuuuuguuuucucauaaauuggauucugguuccacugugauacaaguucagcuaggaguccauuucuuuccuuucauuaucuaauagagaaugggaaaaauggggcacaaaguguguuuuaaccagcuuguaccagucaggaagcaugucaguggauucuccuucuuuuacauuucaggacccguagaugaguacauguuaccauuugaggaagaaauuggccagcauccaucucuugaagauaugcaggaaguuguugugcauaaaaaaaagaggccuguuuuaagagauuauuggcagaaacaugcaguaaguuuauacacuuauuuuccauuugagauuucaagaaaacacuuuuaggagaaugaucaauuccuucagggaagguggucuucacacaggggcuuuguaccuaagcuuagaggcagaaggcuuugucugaagucccagagccguauagagcagguuccucuuacuucagcaaucuaauuagguucgaguaucuccuguuuugaaagcuguaugaggaaacaugcuggcucugaacccauggaaagcuggauagucuuacuauuaccuucuaguaaaugucauuuuaacacuuacuaagcaccgaguugucucuauuccauuugaguugucucuauuccaugaagucuuaagucauuucuuucaagacuucacuuuacaguuagaguggacagaacagcauaaaauugugccggcaauuugguguuaauaucacuagaaacucaaguagaaauaaguaacuucauccugauaccagagaucugacucaagaguggccuuuuaaucuuaaaugaaagggagaaaagcuauuaucaauguaagaaaaugauguuaaagaaacaaaaacaacaacaaaaaaccuuguagcccacaucagacuugugagucuacuugaaaagcucaagcauugaaaugaucagauuuguaaacauggauuuuuagaacuuuaaaacauaccuguuguaaaucacuaaugcuuggaaaagugacuucucuuaaugguauguaaaaugacauucaauaaaaaugaaugaucaucuagcaauuguaucucacucacaugcagaggcagaaagaucaagacuuugagauaaaggcuggcuugcauaauacacccauuaaaaggauccagaguggguacgggucacacucugcucaucuugaaaccauugucaauggaaauagcuauuucauuaugacauuauuagccuguuuccugucagaaaacaauagcuguuaaguuugacuauucuucuccucuuagggaauggcaaugcucugugaaacgauagaagaauguugggaucaugaugcagaagccagguuaucagcuggauguguaggugaaagaauuacucagaugcaaagacuaacaaauaucauuacuacagaggacauuguaacaguggucacaauggugacaaauguugacuuuccucccaaagaaucuagucuaugaugguggcaccgucuguacacacugaggacugggacucugaacuggagcugcuaagcuaaggaaagugcuuaguugauuuucugugugaaaugaguaggaugccuccaggacauguacgcaagcagccccuuguggaaagcauggaucugggagauggaucugggaaacuuacugcaucgucugcagcacagauaugaagaggagucuaagggaaaagcugcaaacuguaaagaacuucugaaaauguacucgaagaauguggcccucuccaaaucaaggaucuuuuggaccuggcuaaucaaguauuugaaaacugacaucagauuucuuaaugucugucagaagacacuaauuccuuaaaugaacuacugcuauuuuuuuuaaaucaaaaacuuuucauuucagauuuuaaaaaggguaacuuuuuauugcauuugcuguuguuucuauaaaugacuauuguaaugccaacaugacacagcuugugaauguguagugugcugcuguucuguguacauagucaucaaagugggguacaguaaagaggcuuccaagcauuacuuuaaccucccucaacaagguauaccucaguuccacgguugcuaaauuauaaaauugaaaacacuaacagaauuugaauaaaucaguccauguuuuauaacaagguauuacaaauucacuguguuauuuaagaaaaaaugguaagcuaugcuuagugccaauaguaaguggcuauuuguaaagcaguguuuuagcuuuucuucuacuggcuuguaauuuagggaaaacaaagugcugucuuugaaauggaaaagaauauggugucacccuaccccccauacuuauaucaaggucccaaaauauugcauacuuaaguaguacuuuuuucuuuaaggugugcuguguuugggaaauauuugaaaacauaaagcaugauuuaaaauuuuuuaagugagcugugacacuggaaagcucuucauuuuucuuuuaaaauagauuuuuuuuuccuauuuauauauauaaaaugacgguguauuucuucuuuucaccaaacagugugugggauauucuuaucacuguuuuaugaucaccucaggaagugucauuacucagaauucuucacucugcuucuagacuuguaacuuuaucacuguacugcguggugccaucuugucagaguaauauuugaugucugugauauggagagaauuagcuuaggauaaagguagugaccuuuaagaacagauuucagauauuacugcuuuaagacaaaucagggauaacaaguugaacuuauaauaugcaaugacauuaagagguaaccagugcuggucuaaggaacacaacccagcuuccuccccaaauuacuuuuacagcuaauuuuagauaguucaugccuuauccuuacgaagaaaguggaauugauggcauguagguaccagagugcuuuaaaaaacauuauuacauuagaauauaauuggaucuuuccuaaagcuugcacgggcccaaguaaaaaauuaauucccugaauuuuaaauuaccaacaaauagccaguauuauguuauauacauuuuuguugagucacuuuaacauccauacauuaacuuuauaaacuucuacguuacuaucaggagcucacugugaaugcauuaucuucagaugguuaagacaucagacacuacauuuuacauauaaugugcacuaaucucuggggagaauaauuacaaacaauacauaggucaacagacuuuaaguggggaggauaauagcauucuuguuuguaugccacacaccauagagaacugugcguugucucuguacccaaggucucacuguauucguaagguugccaaguucaguguucauuguuuugauuucuacauauuuggccccucaaacucuugauauagguuugcuugcacuuguaagcuaaucaaggaaaaccauaagaaaauaugcauauaaggaaauuauuccucuccauaagcaaacuacuacugguuuuaaacauucaaccuccuuuaaaagcugauaaaugagggauaauacgacuguucggcuuaagaaagcacuacagauaaauuuuaccaagacugguucaugauauaagaugcuuugucuuuaugcuaaaauuuuuuuuuaaggaaaucuuggguauuguauguaaaucuagcuuaucaauuuuaaaacuuguauucucuuaagaacuacauuaacagaaagccuuuuuuauaagcaguaacguuaagaauguuccagugacuaccugcccuuauaccuagucuuguuaaaacuuucuuuugcagggcauuuuaguguuugguuuacaguaagugcagaaugggcagauaaaaagauugaguuagggacauugaaaaagaaagaucaaagaaugaaaacuuuuuuuuagggagauggcaaacuuggaccccuguauaucuucauguguauggugcucacgaugucuuguacuuugccuuucugauacccaccagaacugcugcucuuacucuaccuugcccaaaucucccaugugagaaaugcuuuaugaucaacugccauaggacugacugauggaguaaccaguguuugaauuuauuugaagucuaucuaugcccugcacagaucuuguauguauuuuagaugcuaggaguuuuagcaugugauuugugacucuuguuuggauguuuauuacagguaccuugugaauuccagaacagagacugugccucacaauuauuggucccaugaacuugcacuaucuuucaugguaauauucuaaaaauauaaccaggaaaaacaaaaaacaaacaccuuuggacuuaaagacagaauuauguaucacacacaauuaugaaaacaucgcuucugacccuuuuucuuauccuuaauaauuaagucacauuuaaguaaaauucaaaugguugggaaaaacaaaacaaaacaaaacaaaaccaaacuccucaccagauagaugguaguuuaguggaauagaaugauuacuguuuuuuaaaaaaaaaugcuucaucagauauuuuccaguuucucuuuuuuacuuuuuugaaaaauuacuuuuuaggaagauuugguauaaugugcauaaaauuauuuacaauuuauggacaaagauacaaguagcaucuugauuaaacaucauuuaccucagauauucaaccagcaguacguuuuuuaugcagucucaacccguaucucccuauuuguuaccucucaaaauauugguaaacaauuauuuuagcuuuacucuguauuucuugucaguguuuugggcacagguuguuguacuacugucauauuguacuugcuauuuuuuuuuucugcaaguauuuaacagaaagcuaaaaaugaaaaaaauccccauaaaaucccaccuugaauaagugauuguuaaauauuguacaaauaaaauguaugcuauccccauuccauccccauguuaaauaaaaaaugaauaugguauuauuugcacaugcaguuuuucuuuagcuaugaauuuauguuguuaaagaggguaaugagagcuuuccaacuuauggucaggcuucggucuugagguuuucaagggucauaagaucaaggagguugugaauuagggacuuuuccuuacaccguugcuugaucagacuguauuucuacccaagugucuauguuggcccuucuugcccaugaccauaggcuuauucuuagucacacaugcaucagauuaugugcucucaggguuaacagugaaggcaacaagaaccugcacuguuaagucacucacagcaaaaggcacaccaugguagaaaguaccucacuggaguagaaacaccacugcagagucugugauggaugucuaaaucuuuagggcaguggauaccauguccuuacauuauaagacguuaccuaauguauggaaguuuggacaauggauuuuaauuuuucagacacgugucugcauaaaaucagaugccuuuuaaacaagauccauguuucacuaggccacauggaggaaggcuacauggaaaguccuuuuuguuuguucuuccaucucuuggcccaguggagucuugagcagagugaaugaaugaauucucuucauugcagagaaucuucaagucagacuuuguguucacaaucauucgucccccuccgcuccuguaguugagauagcuugggcuaguuuggaaauguuuuuuaggcuccuaaaaguauauaccuuucuugcuucuacucuuguggaaucacauguuaaagccagacacuucaauaucaaacguucuugugauuuguguuuuagaaucuaauuuuucucacuuuagaauuaucuaauaauguauuuugaacaacuuguaagguggaaguaguuuaaaaauuggacauauauguuuauacuuguaugaccuugauauuacagcuucauuuuuaucaugacuaaaagaaagacacagaaagcuaagcauguuuuacugugaaagggaaaggcugugaaugaagaaaguuuuaacuaugagguacuacauuaaugcacagaaaauuuauauuuaagauuucuuaaaagucaaauuauuccuuacaguauccuguaaaaauaguaaaacauuuguugcuaagcuuuaguuuuuaacacuggcuuuaaugucagucaaaccaagcugcauucaaggucacaucagucauucccauacugugauccugacacugguguuaguuuucugaucuguaaauaagagcauuuaauucugcagauacuuuacaaacugcacauacaaaggauuauguauuuuauaaaaucuuacuacaacuaaauaugcaaucaaauauucuugaacaaaggaucucugagauuaaauuccauuuuaaccugugaguuuugccuaugagcuuaggagguggacgcugaccaacauagcauguuaagagaauuccuuuuuuugaagccaacagccaacacuguggaauacguauuaguuguggaaguagaugcccaggaauccuuuaagguaccuguuagauggcaauuuugaucccuucugaacauauacaaagaauguacauggaaaaaaaaauccuacaauuguggugagauaugcagagaagaaaaugaugaguuguuuggacucuuuccacacaaguucuucagcccaaaugggccaguuuacuaaacuagaacacugggggaucuguagaagauccaaaauuggaggauccuauaggaaccaauucaggaaaaucaacccaacuccaauauccacaggcgccuaaucuagccggaauauuccucauguaauuucuguucguauuucucuccugacugcuuaggauuaugaucuguaaacuaaaugcuuuguuggaauuaaccuuucuaauggaccacauacacuuuaaaagaguaucaaaucauuuuauggaccaugcguaaaauaagcacauuuuauucuuaugaacugcuacuuguguggugcaauuuaaauuaaugaaacuguguccaugcguggucauuauucaaaacauacuaagugcaaauuucccauaaacuauuuauaaacaaagcaauguaguagcguaucuuauuaaauaaagaacaguacuuuaaggucuucacagaaauguacuuaaaaucuucacagccagcuuagugaggauguugcccacugccuaacaucuguagggcaguuggaguauuucuguagagcauucauaauuugaguauuauccaaaaguaguuucacuagcugguauucucucugagaauuuacugaaguucuuuccacggguuuuauuaauuccaacuguuguaagugcucaaaugc

SEQ ID NO: 809 - RNA, 2753 nt, Mus musculus
caaagccuuggaagaaucauuugaccucguagaaaugucacacacuucaagcuauuuuuaagaauauauuuauuuuuaauugcacaugcagaagguguaugugcauaugugauugugggugcccacaaaggcuauaaaaggauggcgggucaccuggaccuggucuuacagacaucugagcagccugagccaggaaaugaacuugguucuugcaaaggaaguaaacacucuuuaauccuugggccuucucuccugcucuuauccuguucuugugaaaaagugaaucuauacaaguguagcaccucuccuagccucauguuuuuucuguggauaaaaaaagcccgacucaucauuuuuuuaauguccuuaaaauuggauuacaggauuaagcaaaauaagaaauuuccuauauuguaucuccuuuggucuuccuaaaggaugcuaaaucuaucugugcaaaccauaacuggaguuagacacuuugcucuggccuuuucaggagcuccgaauucuagaaagaauuuaaaagaaaagauuaaauuguaauugaaucaauaaagagccagagcgauaaacuuuuauauagagaaaugagaauuuaaaacuguaguaagaagugacccauuacccuccacuauuagggugaugaauuaaccaaugaaagaauucgcuaaagauaaauuauuuagaacuggauucuucucugaccaauuguuuaaaaaaagaaaaagaaaaacacaauacuaucacagcugaaugcucuucuggugcuugcuuaaaccugaguuauacaacaguguaaaaauguugccuucaggaacuaaaaucuaucacucuguauuagaugauacuucaaugacuaccccagcaacauuagaucaaauuagugcugaucuaaggaaaguauuaugugcuuaguuuugcucacuuuacagcuguuguucuuaccugcccaugggugucaccugcagacuugccagccucgaacuuuaaggccaacccaaagucagcaaugcaagcugucagauuguuuuucaacagcacauuuuuacuuuugaugucccuucaaacauaaaaauaaaauaucuuaagcaaguuaucuuucaaauuuuucuacugaauacauggagaauaugauauaaaaauaaaguuacuuaaaacuaagaaacuuuauuuagagcaaagaagagugccucaucugguucaacuuaaagacaacucuagcaaacaugucuaugcucucaucaauagguacacuuagaaguagucauuuaguucuacaaaaagaugaagguagagucaaaugcuccagacaccaacugacaaacauuuuaaagggcccuauaacuaauaaguuaggggacucauaaacaugaaagaaaggagaggacuuucuaaagaagucaugguuugguaacacucaacuacacaucugcuaaaucaauauguuaauaccgacuuuuaaaacagccauuuuaaaacugaauagaaagacaacucaaucccauauuauuccaaggaaguuaaauaauagcaaacuaaauuuauuucccagaaacaaauauuuuuccuuuuuaagacuguaacagucauuucacugaugagcacuauuucuuuacucaagagcuagcugucuccucuugguuggucccuucuacuuuagcucaaggaaugaauguuauauuuauucauccaaaagacagagaaaauacuuuauccuuaauucuaucacuguggauuuacuaaaaauugucuuuaaacucaaaauuuugaguuaaaaucauuucuccuuugaaauagagaaaauacacuuuuauucucaaacauacuuucagaaguuacacaaauuaaaacaugggaucauuagacuuuauuaacaagauuaacauguacauuaacauguacauaccaaaacacacccuagccaaucucaccuaauuuuaaaaacuugaaaagucuuugccucuucaaauaugauuggauaaucacugcaaaaauaaauuuuacuccaagaguuaaaaguuuaaguaguaaacauuugagcuggaugaaaagacaauacagauuuuguucuaccugugagagauugcaggcuuguggccaucuuuuaagccagguauauccucauguaaauaugccaauccucuagccaugguuucugcaauaugacaaaguucauuccaagagaccacauuagccuuaagaaagucugacagugagcccuaaagaaaggagaggugggagggaaauacccauaagcucuugaucacaauuucacauaaacagaaacuuuucucuggauauaaaagcaacacauuccuuuccaaaaaaaaaaaaaaaaaagaaagaauucuauagagcuguccaaauuuccuuucaauucacaguaauuaacauucaaccacaaaggacugauuuuuuuuuuaagucuuauuaccaaaauaaguuaauaauugacuuugggagguuaagaacaaaggacagacuaguuuaaaauguuaggaaaaaacuagucucuaagaugaaacauugauaaagaacuacacugaaaacauaacuaacuacuaauauauagacucuucccgaggaaauggcucaguuggcaaagugccuguuacacagcaucaggaccugaguucugagacucagaccuacauuaguccaucaaccaacccagggcuaggaggacacagacacagguagaucccuggaagcaucagugagcuacagguucagcaagagacccuaccuca

SEQ ID NO: 810 - RNA, 47428 nt, Mus musculus
ugaaaaauuacuuuuuaggaagauuugguauaaugugcauaaaauuauuuacaauuuauggacaaagauacaaguagcaucuugauuaaacaucauuuaccucagauauucaaccagcaguacguuuuuuaugcagucucaacccguaucucccuauuuguuaccucucaaaauauugguaaacaauuauuuuagcuuuacucuguauuucuugucaguguuuugggcacagguuguuguacuacugucauauuguacuugcuauuuuuuuuuucugcaaguauuuaacagaaagcuaaaaaugaaaaaaauccccauaaaaucccaccuugaauaagugauuguuaaauauuguacaaauaaaauguaugcuauccccauuccauccccauguuaaauaaaaaaugaauaugguauuauuugcacaugcaguuuuucuuuagcuaugaauuuauguuguuaaagaggguaaugagagcuuuccaacuuauggucaggcuucggucuugagguuuucaagggucauaagaucaaggagguugugaauuagggacuuuuccuuacaccguugcuugaucagacuguauuucuacccaagugucuauguuggcccuucuugcccaugaccauaggcuuauucuuagucacacaugcaucagauuaugugcucucaggguuaacagugaaggcaacaagaaccugcacuguuaagucacucacagcaaaaggcacaccaugguagaaaguaccucacuggaguagaaacaccacugcagagucugugauggaugucuaaaucuuuagggcaguggauaccauguccuuacauuauaagacguuaccuaauguauggaaguuuggacaauggauuuuaauuuuucagacacgugucugcauaaaaucagaugccuuuuaaacaagauccauguuucacuaggccacauggaggaaggcuacauggaaaguccuuuuuguuuguucuuccaucucuuggcccaguggagucuugagcagagugaaugaaugaauucucuucauugcagagaaucuucaagucagacuuuguguucacaaucauucgucccccuccgcuccuguaguugagauagcuugggcuaguuuggaaauguuuuuuaggcuccuaaaaguauauaccuuucuugcuucuacucuuguggaaucacauguuaaagccagacacuucaauaucaaacguucuugugauuuguguuuuagaaucuaauuuuucucacuuuagaauuaucuaauaauguauuuugaacaacuuguaagguggaaguaguuuaaaaauuggacauauauguuuauacuuguaugaccuugauauuacagcuucauuuuuaucaugacuaaaagaaagacacagaaagcuaagcauguuuuacugugaaagggaaaggcugugaaugaagaaaguuuuaacuaugagguacuacauuaaugcacagaaaauuuauauuuaagauuucuuaaaagucaaauuauuccuuacaguauccuguaaaaauaguaaaacauuuguugcuaagcuuuaguuuuuaacacuggcuuuaaugucagucaaaccaagcugcauucaaggucacaucagucauucccauacugugauccugacacugguguuaguuuucugaucuguaaauaagagcauuuaauucugcagauacuuuacaaacugcacauacaaaggauuauguauuuuauaaaaucuuacuacaacuaaauaugcaaucaaauauucuugaacaaaggaucucugagauuaaauuccauuuuaaccugugaguuuugccuaugagcuuaggagguggacgcugaccaacauagcauguuaagagaauuccuuuuuuugaagccaacagccaacacuguggaauacguauuaguuguggaaguagaugcccaggaauccuuuaagguaccuguuagauggcaauuuugaucccuucugaacauauacaaagaauguacauggaaaaaaaaauccuacaauuguggugagauaugcagagaagaaaaugaugaguuguuuggacucuuuccacacaaguucuucagcccaaaugggccaguuuacuaaacuagaacacugggggaucuguagaagauccaaaauuggaggauccuauaggaaccaauucaggaaaaucaacccaacuccaauauccacaggcgccuaaucuagccggaauauuccucauguaauuucuguucguauuucucuccugacugcuuaggauuaugaucuguaaacuaaaugcuuuguuggaauuaaccuuucuaauggaccacauacacuuuaaaagaguaucaaaucauuuuauggaccaugcguaaaauaagcacauuuuauucuuaugaacugcuacuuguguggugcaauuuaaauuaaugaaacuguguccaugcguggucauuauucaaaacauacuaagugcaaauuucccauaaacuauuuauaaacaaagcaauguaguagcguaucuuauuaaauaaagaacaguacuuuaaggucuucacagaaauguacuuaaaaucuucacagccagcuuagugaggauguugcccacugccuaacaucuguagggcaguuggaguauuucuguagagcauucauaauuugaguauuauccaaaaguaguuucacuagcugguauucucucugagaauuuacugaaguucuuuccacggguuuuauuaauuccaacuguuguaagugcucaaaugccugcaagagaaaagacaaagcuuagauguaaggggacacguguuaaacccagaggauaguuauugcugugaaacaguggcagguggaaaagagggaggagaaaucagcacaucugaacugccuuuuuccuaaguacucucucuaccauucacacuugaauuuauguucagaucuuuucuucauucgcccauccauuaagguuuugaagacaggcuuuccuuguauaguccuggcuguccuggauuuugcuuuauagaccaggccuccaacucagagauccacuugcuucugccucugaagugcugggauuaaaacugugugucaccagggcagaucugacgcuaaaaucucuuuccuaauaaacuccaacuuugcucaugacacacagaggaaaaaaggaauagaauggaaaggucaccaauagaguuaacaaucauccuuaggaaugggaauugagcucagcaggauaaagugcuuaccuugcaccacuaaacagaauagcccuaccccacccucagacacaaguuuaucaaacccauaagaacuguacauuuggagaacauguuuugauauauguccccauaaugcucaauguaaaucaggcaaauauuaauuuuaccugaaccuuaaucaugagguuuuguuucuaggcagacuguauaucauagauuccuuuuggacuuuuccaauggugggugauuaguacuguaccuaaaucuuacuuaugcucagcauggauuccaccugagcuuuguagcuccaguccuuugucuauuaguuugaucuuaaaaccuuaaucugauaagacuuuggaaugagaugguacagcuagauaucccaauagaacagugugcugccuagauaucaguaaagcagaugggaacuaauagagacaacuggaacaugugcagaaugagagaccuucaaacacuuaguccuaaauggaaguuuuucaucagagccuuccacuucaaggaucaaggaaacucugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauugugaaaaaggaggcaaaaccacuguccaaaccagauggggucucaaguguugagauggggaauuagacucccuugcucuaaccaagaagcuaccuccaauuacaauuguuugcaaaggagaaaauaguucuccaaucucucuggguauacaaacuauacuuaaggauauggaccauaaggauuaaggauagccaauacaaaauaaacccaaaagauuuaguguguguguguguguguauguguaggggucaguuucauauggcuuuguuucagcauuuucucccguaccguucucuucucuagcuuauguauucuggcuuccaauuuuguauucacggguucuuuuugugugccugugugaaugcuuucuaccgaugcucuuucuuucucuuucugcuguuaguuugcuguuuuauucuugcuuuucuuuucuauuugccugucuuuuugugagagagagagagagagagaggaaaaaagaggggcucgugggugagaagaaucugaaagaagggaauccaugacugauagaugcaugaaaauaacuacuuucaauaaaaaauuaaauaaaauuuuaaaaagauaaaaguuaacagcuauaguacaagagguaagaaagacccuagaguacaaaaagccuacugggcucaucauguaagcaaaggaccuuguaagauugcaaagaccagggggugggacaggggaccauguuuguuuaacccccagucuucuuagcaccuuaauggagcucuucauuguuugguuccucuuacucuacaacucaugcaucacuuaauaauuguuuaagaauguuaauaagacaagaaggaaaaacuauacucugaugaaauauuagaaucgggacacacugaaguagauucuugagcauucucacaguucccugugaaaaguaucacugggacauauucuguuuaucauaaaaauucuuacugggaggaaaaaaccuugaauaaugagaaaauauuaaauucuucagguguagcuuaacaacacugaaaacauauuuccaagaugcauuaaaauguacaaagagcaucuacaaauuauucccagacacgugcagaugcccuuuccaaaacugcaacaaugagaaggaucuacccucaggaugcuaggacugcuguggccugaauacaagacucugcucacuuuuuaacaacugcuacagaaaaugaaguucuagcugugcuguacaaggaauacccaaggcccaagcuuguauugcuuuacaagaaaaaaaaaaaaggccuuugcuuccauaugguccccagaaccacacugugccaacaacacuggacaaacaggaccucgaaauguguccuguuuaauuuaauuuccauuaaauaaauauaagcuuaaagugcuuagacuaaauuacuuagaaaaaugaauauaguugguauaauuuuaaaauauaaaucagucuuuuuagcuacauauuaaaugaguuuaaaagaaugaauuucuaauguacauuuacuaaaauggaaucugcuguaacuuuuuauaaauauaccaaauuuuaaagacacaaaggaaaauaguucaggaaauacuuuuaucauaaauuugaaaauauuuuucaucaauuggguuauacuguuacaauuuuuugaccuuuauuuccuaugccuauagaaaauguaaaauuauaugagauuuacauuuucuuuguagugaaggaguauauuuuaggaugucauuuuaaaguuguaaacugacaucuuacccuaaauaauaaacuugacaucuuguaacugccaacuuguggacugcagaggguuaguuccuuuucagugggcaagugcuaagaacagacagcagagggcaauauaucuucacaaacuguaaaacgggcuagcuacagaauuauugaagcaguucauuuuauaacauuuugcugaaaaaauuccuauaauaaaauacucaaggguucaaagaguuuugaagcaaguuaaaaaaaaaaaaaaaaaaucgcuggaucugaugaaaaauacaaccaaaucaaaccauaccuucaugaccacagguuucucaaaguuauaaacagaaugggccuuucuuugaaugaauuucugaaauucugcagaguaagcaaugagaacauuaguacuuucaaauaagaaaaaggcaagaaaccaacaagaaaaugaugcacuucaucuuaccauuauacaccauuugaaaauuaaagggcuccucuucauauaugucauuuaaauguuucauugcuauuauaagacagauuuccaagacugacagaccuagaauuaaagggagauggacuccugaguuucagccaaggguucauaccacuaaacaaacuguuaucuagaaaauaacgcaagguuuugaaggguagaggucagcauuucucuauuuuuaaagguauuccaacaacuauuaucuauaaaaacacgagucauuuaacuuguuagacuuuaaggccuuuuugcuaggggugggaugaucuacaacauaaggauuuuuuuuucuaaacuucaaggaaugugcuauaaguagaaaagauuugauaccacaacaaacagcaaauauugugaauaucauguaauuucaaguaucauaggccuuugggaagcauuuaugcagagaauuucuggaaaacagaucuaaaauauaucuuauauuucaaaagagauagugaaugcaaaugagcaagugucaacaaauauaauagcacuuaggguaagcaaggagaacaucaacaauaguccuaccuggacuccccaugugguaugggaugcagaacacaaagagugauaauauacuuauuacaguaucaauuaaaaguuguauauaaaaagcauucuguauacagagcaccaugcucaacacucauuaucucagaaaacaucuaaaucugaacuuuuaaaaucaaaacaucaaaagaaagauuagcaaugcaguuucucaccauguacaauauucgccuuagaauccaagcuacacauaugcugugccuccaucagaucugcugaagucauaaaugggugugauacgguuacucgauuuaaagcaagcaucuaaagaaagguguauuuuaaaaaguacuuauuuacuugaauauucuggagauauuuuagaacaaucuuauuuaaugucuuauaguuuauucuuguaagauagaaacuagguaaauaaccuuaaacuuugcuccaugaaaauguagcaaugacuuaguucagaugcuguuuucucuacuacuuugcauuggaaucaaauuuauuacucuccaaaagaaaaaacauuuuuaaaaagucuaauaagaaaaaaacugaaagaauacuaaucaaauaucacacaccuuaaaagaauagcuauguuuuauacagauuuuuacaaacauguaaagguaaguucaguuuagaaguuacuaauuuugaaaacaauuauaaacuuagacaauuauccucuucauuuaguucucuuuaggcaaacaucaccuucuaguacuaaguuuacccucaauuaacgauuuguauuuggaauacaagaauuuagaauuuguagguguaguagauguauuauguagcaauauauagauagauagauguagcaaacauacagcuucagguuaaauggggacuucagauacuuuacaguuaaugacaagagguugggaaucccugaaguucacucuucuacaaguuaaaacucagaccauuuguggcucuuuuguuuucuauuuuuuuccauuuauuguaagguauuucuuacauuaaaaaaaacaaaacaaaacagaauuauauauaauauuccacguuuauauuuuuaaaauauaccuguuacagaguugugcacaguggccuugaguguacugcaccuuuugccacauaaaauagucaauaucuuuauauuaauauauucuuauaaacuauaaacucuauacugcagguauuaauagauaacacaauuuaauuucuaagcguucuauaaccaaugcaaucuaguuuuagaacuuaucuucaaaugaaaaugagaauuaauccacauuuagauuucaauucuaguucauucauuuucuauuauacuccuuuguaauuacucacauuuccucacuuccuguugauaaacacaugccauuuuuuauuuuuuguaaugauaaaaaaagacugcaguaaaaaaaaaaaauguuguuuaugcaucuuuauuuguggauggauacauaaagauucuuaauccauaacuucacuauagccaaguugcuaaaaaugacaguauacuuuugauggguagaagggaauuaaacuaaugagauaggaaguuuauuuagagaaagacagcauuccuuaguaaaagccgauguggggaauaagaaucaguaaagauaccaugguagaaaauuaugagacaugccauuagauugauuaaaacagacuaaauggagauccagcuuugccauuuaccugcugugaaagaaggggaagaaggagaaagaagaaggggaaagggaagaaggaaaggggaaaggaaagggggaaggggaaaagaggggaaaagagggaaaaaagggaaaaaggggaaaagaagggggaaaagggggaaaaggaggagaaaggaggaaagguggaaagggggaaagggaaagaaaagagaaaaggaaaagaaagggaaggaaaagaagaaaaaagaaaagacuacaaagggaccaagaagacacaccuccuuccuagaagacaaucugaguguguccacagaaaauccuaaagaaucuaauuuuacaagucugagaguucagcaaaacugaaugaagaacauaaaauuaacauacaaaaaagcccaaucacauuuuuaugcaguaacaauaaaaauccuaaucauaaagcaacugcuuuaaaggaaagugagaugcuuaagaaugauacaguuaaaguacugcucuggaucucugcuggagaacuacagaguaucaaugaaaauaaccaaacaagaacucuacaaguaagcugugcauuaucuucaaauaccagcauaauuaauguaggacauaagacauuucuccucaaaugcaucuauaagauucaaaguuuuauaucaagauauaaguaguacucuugaguuacauacuauuggugggaaugcugaaauagucuagcuaguauugaaaacuguuugaaggcacuucaaaauguuaauacagauuauuaaugaauguaucaaaacauaagauaguccauuaauauguauaguuuuuauaugcaaaauaggcauaauacguauguacuuauacauaaaaaaaucauccauaauauguauaaguuauuuucauagauuagguaaaaguacaaaccaauagcauguguaaugacugcaaguuuuuguugacacugaaauguuucuguaggacuucaagcacaguugaaucuucagagagacacuaaaaaacaaaaacaacaaaaucaacgaaaacauagcuugaucccaaauucccaaucuauaauggggaaacuauauagucaaaacuagugagauggaugaaaagaauguagcacaaaucacaacagagaauaagaguucuaauauuugagaaaacaguggaguuacaagaauauaguggggaaauuaugaagagcuauaagaacaugagcugaaacaagaucaugucacagugacaacaaaacggugucaucauauaccuuaagcacagcuaucugcaaagggauugaaaaggaagaaaaaagaaagcccaacuagaggccauuacaacuguggagagaauucagacauucacagaagacuugccugaugaagccuucauugaaaaggaaacaacaacugagaaugaugaacuaugggggugggcagaguaucugugcagaguaagcuguggucaagaaguuauagagugguagacagaaaaaggagcagugaaaaaugacacacuaaagccuguaagaauguacaagauaccacaacaaucuagaaaacaagcuguauacauuaaacauuccucacaauaaagcagcuuaagggaguguuuauuuugguccuacuuuugaaggguacaauccagcauggaggggaagguaccauuacaggagcuuaaggcagcaugugccaguguauaugcacugucaggaaggaggcaaaaaugaaugcuaguucuuagcucauguuuuccuuuccauucaguauggaacucuagcacauuggaauggugacacccacauuuaggauaggucuucucucuguaguuaauuuuuuucuggaaauacaugcaugcagaaauguguuuccauggccaucuaaacuagucacaaugacaugaagauuaaucaucacacaagcgaagaagcuucaagagggaagagauaaucaacgauauaauacaaaguaauuuuuaaaacuuuacaagguacauuaagaaaaugccaauggauagagagacaauucuagagaaaugggauuuaauggaagguaaggaauagagaugaaaagagugaauuuaacaaaguaagcaaagaugcaucggcacuuggcauaauuuuucaaaaguccucugcuggcuacaagucagaacaaaaccaugaucagcauggcaagcuaugcccaugggaggaguagggcugcaaauaugaacuagauuuaagacucucuacaggaggaacaugccuagaacuguaaauuaggcccaaaaccuauggcuggagcgcuuuacucuacuauucuacuacauggacacuguaucaaacugcccucuaaauuuguaucugguacaaugcucagaccucuuuuaaaaagauuauauagcagaugguaguuaauggagaaacucacaacuggucaaagugcagaguauaagugacugauuaguauauggucagaaauggaauaucuauauauuacaacuuuuucccaaaguucugagaccaucucagaagagggaaaaaagauucuaagagccaaagggcaaggaagaccagaguagaaaugcuaauucauuaacucaugguagcuguggcuaucuggacacuaucaagccuguuagcauuauucuagcacaauaugggaagggguucaugagcccccaaacauuggcugaggggcuaggacauuugauagguucuaggagagguagagucaguuguuccugacaggcugggcagucuccagcagauggccccacgaccaagucuauacuuagcacuauuaggacaggauaaguuguuuuuaaaaaaaagcaacaacaacaacaaacaaaccaacccauauaauugaaggacauuguauggcauguuaaaaaaauuaaaagaccauuaaaaaucccaacaaauauaaaaacugaacuaaaccuccauaaacaaugacaaaaagucaaaagccccagaaaacuaaauguuuucaucccuacuggagcuauaacaccaugguuugcuucuuuuacccaaaaaauaucuaaauuuagggaauaagcuuuuaucucuugaaaugaaguuuaacauuuucagcagauuuauuuccuacuuaaauauucauuuucuauugcuuuuaaagugcugguugaaacuacagguuuaucuuaaaccuaagcaagcaaguaaacaaaccaacaaaaagcucacuacaaugucagcacuggcauagaggcuagcuccccaaaccaccuucaccacaaacucacucaauaagggacaaggacucuggccauguuacugacagacuuucuaaguauauuuuacaaaaauaccuauccaugcaaagcaacucaagaugauugucuaaagagaagaaaauaagagcucuaaacccuaauagugauagcucuccuuuggucaguaaagcuacaagacugccacaaugaaagagaucauccccuaccauguaccauuuaaguuugggggcuauaaauucuggaaaaacaacaagaaaacugaaagcagguugucggcaaaucacagcugauguaacgaggaaaacugcagcuaggucauuauuacaccuaauuauuaagggaauaacaaauaaaaacccauuuauguaccacauaauugucacuauuuuauucgcuuuaauuuucauuugugguugcaccucacaaugcagggcccauggguuuaaaaaauacauauauaguuauagacacucacaauauaacagauggaugauggccuuggcuguaaagucaccagaggaaaagagagaaaauaggcauggaaauaauaauaucaacaggaaaacugauauuuaaaugcaaaggaacaacugcauucaaauuucucaaaaacaugacagaguuuuuaaugagcucaggggauauagaaagggaaugaaagccuguuaggcacugagaaguaaagcaagcagccagggaccuagauguuaaauuccagacaauaguaagaaaaagaacaaugugaagugccaacuacaaggaacaugccccauagagaucuugcaucagacacgguuuuaauacgagaaaacuuguuuaguuagcaaucuucugaguccuaugaaagauuagucugauggaagacccaaacuaauuacucuuaaaauuaagauauuauacaucuuaauauaaacauauagugguugugauggauaauauugacuguugacuuguuaaugagaaauuaucaggauuaggagagccuguggcacauuccuguaaaggauuaucuagauuaguuuaaugagguggggcauuaaucaccaagaaacagaacuguuugaaaggauuaggaaauguggccuuguaggaggaagugugucacugggagugggcuuugagguuucacaagccccugacaggcucagugucuuucccuugccucugcuuguggaugaggauguagcucacagcuacuucucuagcacuaugcauggcuguguccaugcucccugcuguaauaauagaauaagccucugaagcacuaauauagccucuaaaguauguaauuuacuuuccuuuaaaaaguuaccuuuggucaugguaucucuucacaucaaaauaacagugacuaauacucucgacuaacauucucgacuguggguagcacuacauggguugagauucugggugaaaaggagaaagagcuaaauaggaacauccaucacugucuccuaacugcagaugcuacugaccagcugcugaaagcucuuggccuccaugacuucuccaccucuauauccucaaacucaacuacauaaucucaaaauaaacucuuccuaucguaaauagauuuuccuaugcauuuuuuuacaacaaugauuauuauagguggggaauuaugaaucagaacaaaguuaaaaauaaaaagaaauuauaucuaagcacugaaccuguguaaaacaagauguaguuucccaaguaaggucuggcugucugguugcccggaauacauaagagcggaaccacagccuggacagugucuuaauaaacuaaugccgagagucacuaucagcuaacaaaccaaagcaaaguuguuuauaagaacuggaaauaaaauaaaaacauauauagaaauaaauauuagcugggcauaguggugcaugccuuuaaucccggcacuugggaggcagaggcagguggauuucggaguuugaggccagccuggucuacagaaugaguuccaggacugccagggauacacagagaaacccugucucaaaaaaucaaaagaaagaaagaaauaugaaauaucaaugcaguuucuuucuaaauuuauaaaauuuauaaaauuuagacuaugcaaauucacuaaaaaauuaucuaaaauguaaaccagguauggauuaaaaacuucaacuacugacacccgaaguuuuuuggaagagauuguuuuaggagacaggauauucuauugcuuuuaaauaagaaaaaguuuauaauuccggucccuuaguaacauguaaagauaaauacagcuuugugauuauugccaacuuacgugaacauucucauuccaucucucagcaaaagccuuaucugggaauucugcagguagagauaacuguucuuuaaauauuuucaaauauuguggaaaaucaaaugaauucauuaaauguaucugccggugagaaaaucgugacuucacucucuuuucuaagaguuccaaaauauccuugaaaacaaaaaugaaauucauauaagaugcauguugaaaaaaugcuguuagucccuuccgccugguccuuggugcuggggcagaccccuagcccuaguuggucugcuccccugcacacuccauauccugauccauccuagagaacccccugcacucagagaaguugguaagaacccccaccccccccaacccccacccuugggagccugguggacucaggacacaucacccaccaaaccccugcccucccuuuccaucccuucuaccccuucagcccgguccuugcuucuggggcagaccccuaguuugguuugcuccaguaaaguuucccuauccugaucuauccuagaggaccagcuucacucagagcaguggacugaaggccucccaggagaucuacugcagccagggcaacagaucagcagcccccaguuuggaaggcuccacagguggucugauacagccagggcagcaggccuaccugagaccugaagcaacccagggacaaaagaggcagacuucauagagucaccuagaccaacaaacaccagggauauccagauagugaaaggcaaaugcaagaccacaaacaacaaaagccaaaauauuugggcaucaucagaacccaguucucacaccacagcaagcccugaauacaccaacacacugaaaaucaggaaucuguccuaaaauccuaucuuaugaagauaauagaguccuuuaaggaguauaucaauaacucacuaaaagaaauagagaaaaccacaggcaaacagguaaaggaauugaaugaagugauacacaagaccuaaaaguggaaguagaaacauuaaagaaaacacaaauggaggcaaaccuggaaauggaaaaccuaugaaagaggucaggaauuacagauauaaguauuaccaacagaauacaagagauagaagagagaaucucagguguagaagauacaguagaagagauggacacaacugucaagaaaauucaaaacauaaaaacuccuaacccaaagcauucaggaaauucaggaaacaaugaaaagaccaaaucuaagaauaaucagaauagaugagaacgaagauucccugcucaaaggacaugaaaaugucuucaacaaaaucauagaagaaaacauccccaacauaaagagagagaaggcaauaaagguacaagaagcauauagaacaccaaauaaaugggaucagauaagaaaaucuucuugucacauaauuauaaaaacaagaaaugcacagagcaaagaaagaauauuaaaagcugcaagggaaaaaggccaaguaacauacaaagguagaucuaucagaauuacaccagacuucucaacagagacuaugaaagccagaagaggcuggucagaggucaugcagacucuaagagaacacaaaugccagccuaggcuacuauacccagcaaaacucucuaucaacccagccuuacagaggauucuggaaggaaaacuccaacaccaaagaaaggacaaguuacuaagcaucucacaacaaagucagaagcagagugucacaagcacauaaagcgaccuaaggaaacaaacauaccaggaaccaacaacagucgucccucuuuaauaucucugaauauuaauggacucaagucaccuuuagagacauaagcuaacagacaggauaugcaaacaagauccagcauuuugcugcauacaagaaaaauaccucaauaacaaagacaggcccaaucucagaauaaaaggauggaaaaaggucccccaagcaaauggaguugccauccuaauauccaauaaaauagacuuucaaccaaaaguuaucaagugugaugaagaagggcacuucaaauucaucgaggggacaauccaccaagagaaagucucaauucugaacaucuaugccccaaaugcaagagcacccacauucauaaaagaaacuuuacuaaagcucaaaacacacaaugaaccccaacaauaauagcgggagauuucaacaacccacucucaccaauggauaggucauugaaacagaaacuaaacagagacacagugaaacuaaaagaaguaugaaccaaauggauuuaacagauaucuauagaacauuucaccuuaaaacaaaagaauaaaccuuuuucucagcaucucauggcaccuucuccaauauugaccauauaauuuaucacgaaacaacccuccacugauacaagaagauugaaauaauaccaugcauccuaucaguucaccauggcuuacggcuggucuuuaauaacagcaaaaacuacagaaagcccacauauauguagaaacugaacauuucucuacacaauggcaacauggucagguaagaaaaagaaauuaaaguguuccuggaauuuaaugaaaauauugacauaccauacccaaacuuaugagacaaaaugaaagcagugcuaagaggaaaguucauagcacuaagugcccugauaaagaaacuggagagaucuuauacuaacaacuuaacagcacaccugagaggucuagaacaaaaagaagcaaacucaaccaagaacaguagacaguaggaaauagucaaacucagggccugaaauaaaccaaauagaaacaaagagaacaauacaaagaaucaaaaaaaccaaaaucugguucuuugagagaaucaacaagauagauaaaccccuagucaaacuaacuaaagugucaagaggcagaauucaaauuaauaaacuaaaaaaugaaaaugacauaacaacagaaauggaggaaauuaaaaaaaaaucaugagauccuacuauuaaagucuauacucaaaaugacauaacaacagaaacggaggaaauuaaaaaaaaaaucaugagauccuacuauuaagaucuauacccaacaaaacagggacauguagaugaaauggaugguuuucuaaagagaugccacauaucaaaguuaaaucaagagcagguaaacuaucuaaacaggcccauaucacauaaggaaauagaagaagucauuaaaaaaaccucccaaccaaaaaaagcacagagccagauggauuuagugcagaauucuaccagaccuuuaaaagagaccugauaccaauuuuccucgaacuauuccauaaaauagaaacagaaggaacacuacuuaacuuguucuaugaagaaacaauuauucugauaccuaaaccacacaaggagccaaccaaaaaagagaacuucagucuaauccugcuuaugaauaucgauacaaacaaacucaauaaaauucuugcaaaucaaauccaagaacacauuaaaacaaucauucaucaugauaaaguaggcuucauucccgggaugcaagguuggaucaauaugugaaaauccauuaauguaauaaacuauauuaaaaaacucaaaaaguacaugaucaucuccuuagaugcagaauaggcauuugacaaaauacaauaccccuuccuguuaaaaguauuggagagaucaggaauugaaggcccauaccuaaacauaauaaaagcaauuuacuguaaaccaacagcaaauaucaaauuaaaugcagaauucuaccagaauucagaaaggugaagcaaucccaccgaaauugggggcaagacaaggauacccacucuccccauaucuauucaauauaguacuggaacugcuagcuagaacaauaagacaacaaaaagagaucaaggggauacaaauuuguaaagaagaaauaaauguaucacuauuugcagaugauaggauaguauacauaagugaccccaaaaauucuaccagagaacuucucugguugauaaacaacuuuagcaaaguggucagauauaaaauuaacucaaauaaaucaguagcuuuccuuuauacaaaggauaaacagacugagaaggaaaccagaaaagcaucuccauucacaauagucaggaaaaauguaaaauaucuugggguaacucuaaccaaagaagggaaagaccuauaugacaauaacuucaaaucucuuaagaaagaaaucgaagaucucagaaaauggagagacuucccaugaucauggauuggcagaauuaacauaguaaaaauggccauccuaccaaaggaaaucuauagauucaaggcauuccccuucaaaaucccaacacaauucuugauauggaaagauauggaaagagcaauucuuaaauucaucugaaaaggcaaaaaacucagaauagcaaaaauaauucuuaacaauaaaagaacagcagggggaaucaccaucccugaccucaagcuuuacuacagaucaaucaucauaaaacuguaugguauuggcacaaagacagacagguuggucaauggaauagaauugaagacuuggaaaugaaaccacacuuacgaucacuugaucuuugacaaaggcgccaaaaauuacaguggaaaacagaaagcaucuucaauaaauuaaauggcuggucuagcuggcuggcuguauguagaaaaaugaaaaaauuugugaccuugcaaaaagcugaaguccaaguagaucaagcaccuuaacauaaaaacugacacacugaaucuuucuagaagagaaagugggaaagagcuuugaacucauuggcacagggggaaaccugaacagaacuccagugguucaugcucuaagaucaagaauugaugggcuggugagauggcucaguggguaagagcacccgacugcucuuccgaagguccagaguucaaaucccagcaaccacaugguggcucacaaccauccguaacgagaucugacuccuucuucuggagugucugaagacagcuacaguguacuuacauauaauaaauaaugaaaucuaaaaaaaaaaaaaaaaaaaaaaaaagaaccuaaguuaaucaccaaaaaaccccaaacaccaaucaaaaaaugggguauagaauuaaacugagaauucacaacugaggaaucuugaauagcugagaaacaccuaaagaauguccuccacccaaugugaucagagaaauguaaaucaaaaugacccugagaguccaccuuacaccaaucagaauggauaagaucaaaaccuaggugacaacauacauuagaaaggauacagagaaagagaaauacuccuccaaucucgguaggauuggaaacugguacaaccacucuggaaaucaaucuggaggauccucagaaaauuggaaauagcuguaccugccagcuauuucacucuuggaaauauacccaaaagaugccccaccaugccuuacgugugauagccagaagcuggaaacaaccuagauguuccacaacagaagaauagacacagaaaaugugguuuauuuacacaauggaaugcuacucagcuauuaagaacgaaagaauuacagggcugaguggugguggugcaugccuuuaaucccggcacuugggaggcagaggcagguggauuucugaguuugagcccagccuggacuacagagugaguuccaggacagccagggcuacacagagaaacccugucucgaaaaaccaaacaaacaaauaaaacaacaacaacaacaacaaaauuacagggauggaaauggcgagcagccugaggaaaagaagguccugaaacaggcccaaagugagauccagcucaaggggaggucucaaggccugacacuauuauuaaggcuauggagcacucacaaaaaaggaaccuagcaugacuguacucuggaagacccaacaagcagcucugaaagucagauauucgcacccaacccaguggacagaagcugcuguccccuaugacugaauuagggaaagcugaaagaagcugaggaggaggguaacucuguaggaggaccagcagucucaauuaaucuggacccccgagaucucucaaacacuggacuaccaaacaggcagcauaaacuagcugauaugaggcccccaacacacauacaauagaggacuuccaggucuguguucauucaaagauggugcaccuaacccucaagagacuggaggccccagggaguuuagaggucagaugggguggggcuagggcauccacauggagguaggggguuuggggaggugugggauguggagcauucagaggguggauggggaaagcggaauggaauauggaguauauaacauaaauuaauuuuaaaaaugcugcuagauaguaaguuaacuauagcuuguaacucguaacauguauaaugucuaaguaagcaugugaaaugagaggaacugaagucaguguucucaacccuucuaaugcuguugucaugacccccagacaguauuuucauugccauuuccuaacuguaauuuugcuacuguuauaaauuauacuacaaauaucugauaugaaggauggucucagcuuaccccuuugaucucuguagaagcguuguucaaccccgauauggguugcaaaccacaaauugauaacuacugaacuaaaugauuccuuucuaggcaccaguaucauugugauugcauuuuggccucauuaucgagugcuaacauucucaaaccuacuaaggacauacaaacagcuacuguuccugaucagagagacauuaagcacaccaguguggaauucugcacagccuacaaaaaaauucacaaaaaaaucugagguaacaaaaugcuaugagauuugcuaccauuaacaaaaauucagauaucuucaugauuuuguuuaagaacuucaagaaacaugauguacaauggagcaaaauucuauuugaugaacuacaguauuaucaagcugcugugaugaguggaaggacugaguucucauccuuuccaaugagaacaaaugcucuuacaggcugagccauuucuccauccaauuauugucuauuuuuaagguggaacuaaaugcaaaugaacuucgaguauuucucaucuucuuacaauauacugaaaaacauaaccaugagaugaaauuauuauuguuuugccucaacauuuuacagggaagacagacauagauuagaucauuuuauguaguuauuaaaauuacuaaauaaaugcuggagagagccucauuauacuacuaucuccaacaagaauugauuuucuacaauaaaauuuucuuuuuuaaaaagguacuggcuccagaaauguauuuuuuuguuuuuuaccugaaugauccuaacaaaguaaaacaagcaaaaggguuaauaagccaugauaugcaugaaaaauuucaguaaucuuagguuauuuaggaagucaaauagcaaagagagaaaaacaaauaccucaaauguuuuuaaauguauuauagugacaacugcugaauuauagggacaagauggaaagaucuaaauuuaguauacacaccaauuuauuuucuacuaaagagaaguuguaaguuacuuguauaaauaaguaguggaaaggcaaugauuaauaaagcaaacucuaagcaaauauuaagaaccuguacuugggugcugggaagauggcuaagagugaaacggccccugaagucaaggcugaggauuuguauucaauuccaggaacccacggcacuaggaggagacccagcuccuccaaggugccacugggcagucacauguccaccauggcaugcaccuuccaaauaaguaagaaggaacugcaaagaaaaaaaucuugcuuccgagaauggagaaaagaaggaacugagaagcugcuccaguguuagucaguaaugacagaaguuacaaauacaaggcuacagggaugauaaagcaaaagcaaacacuaaagugaaauuuuaaaaagaaggguuucuugcugacauagcaacuguuuuuauaccuauucuuugguuuuucucucucuauauauauuucuauaaauauauaugagcaugauucaacauaaaagaaauacagaauuagaaaaauaugcauaagcuacucaugaauguuuguauauggaacguguuugaggccagagguuaagacuggguguuaggcucaacugcucucugguuuacaguuuuuaagacagggauucucaggaacagugagccgguucagaagguaaagacacuuucuaccaagccugagguccuuaguuugauccccagacucacaugguagaaggagaaaagggacuccuaaaaguuauucuguuguucacauacaugcuacaguacauguaccuuuuacauaccuauugcauccacauacaaaaaaaaggacagaaacagcaagacucucacugagcccaaggguugcuuauuuagcuagauaggcuggcuaagaaggcacaaaaauucuguauauaucuccccagugcuuguuuaaaguggcccacaucuauguguguugaagucugaauucaaaucuucaugauauuuucacccaaaggauuauuuucuuauguauaugugucaugcuuugcauauauaugaguguguguguauauguguguaggccugaguuugaggucaagaguauucaucauggcuucccaucuuucuuguucauugaggcauagauucucaauuuaacccccaaguccaccaauuagacuaguuuggucagauagcuugcgcuagagauacaugguaggucuuagacuucugggauugcaaguggguugucaggcccauucccuuuaggcaaauaaguauauuuugaggacuugauuuuguuccucccaucugacaagcucagcuccaguucccuauccguuucuuuaaagaaagauguguuucuuuuagccuggugauagcuucuuauuuggggagaagauaaguagaguaaguaucaaugauaaauacaaaagaaugaucucaaagcacaugaaguauaccaaagaguauuuaaaaacaugucaaagacagaaauuucagagaaaagcaauaaagugaaaauuucauaaaaaaacagagggaggauuguuaaaagaugaauuaaccaacugaaagaacauuuauaaaaaggaaaaagagcuguaggaaaaaaauaaagaaaugagcaagccugaaauaaaacuacgaaauaagaagcugggaaaugggaaccgugaagaaauuugcagacauagcauuuacaguaaguuagagaaaagaagguucucaguuuuacauguauacaggagugcacaccguagauacagauaguucugguaguauaauccuguaaccuguccucagagugaucacaaaaucaagaucuuucugagacuuacaauaaguuaaaggacagucagagcaacuuauaagugaauuuugcuaucaaaauagugaauacaauucaguaguaacagugcuugucuacuauguguaaugucuuagauuuaguucucaggauuagacaaaaacaaaacagcaaaaaaguuaaacacagaaagacucauguaagugucuauaauuuuccuuacuuaggaauucagguaagaccauuuaaaaaccuaugccaaagcaagaauucauucgacuguuuuauuccaaauugaaaauuaaucuuguaugaaaaaguaaaauauauuaccaauuuguauaaaauauuacugcuauuacauaacugauccuuuacuugccagaguagauaucucacuuaauucguauuuuagaguuuuauuccauuucacugguaggacuaaaaucauaguuuauagaacauguagcaaucuuuucuuguuuaccucaacuggaaagcaguauuaauguauaaagaauggaagaaagauaaauuucaaaaauauuaaguuaaauaacaugucaguauaaugaagauugaauuuuugaaaucuacacagacuuaccaaucuacauguaaguccaauaacugcuacuggugucugugcagauugagaaaugucaaaaagauuauaaaggaguguuugauuuuucugaugagcaaaaauaucaaauucauccaguaugaagaucacugggcaacugcuaguccggucaccuaaaaaaagaaaaaaaaaagaguuuagauugacaagaaauuacauaaacuuuucuuguauuuucaaaauguuauaccucaguuuaaauuucaggucaacacacauugguaaguuacucugggcagggcauuuacacaugcaggcuuacuucuacauaagaaguuagacucaggacaaagauggccauuguuguaaagcaguuuacaggagucuagcaguuugaugaaauaaauugagaaaauuaauuugcaacauaguuuuauaauuaugaaaauguaguuccuuaauaauuacaauaauaaauaaaaaaauaauaauaauuacaauuuuucaguauuaucaaacacucuaggagucacuaaugaauaaaaacuguuucauaagacaaauuuucagccauuuaaguuaucucuacaaacaccaucuagaauauaaaguguaauuuaaaaaacaagguaaaaaaacccacaauaauucuuuuuaauccaaguuuuaacauuucauucaggaggaaacguucaguaggacucaauacauucucuuuuuacuuugaauggaaacuucucuaauagaaaauuaagacuuuaagaauacauaauuuacauuuauguaaaaucuuucaagcaaagauuaagagguuuaucuauuucgauaauaaaacaaaaugaucugagaauaaagauaauuuuggcaaaaaaaacaaaaaaaacaaaaaacaaaacaaaaaaaaacaaaaaaaaaugucucccacuauuauugugugagaugcaaugugugcucugagcuuuacuaaaguuucuuuaaugaauguggcugcccuugcauuuggagcauagauguucagaauugagaguuacucuuggaagauuuuaccuuugaugagugugaagugcccuccuugucuuuuuugauaacuuuggauuggaagcugauuuuauucgauauuagaauggcuacuucagcuuguuucuugggaccauuugcuuggaaaacuguuuuccagccuuuuacucugagguagugucuguuuuugugccugagguggguuuccuguaugcagcaaaauguuggguccuguuuaauuagacagucuguuagucugucuuuuuauugaggaauugaguccauugauauuaagagauauuaaggaaaaguaauuguugcuuccuguuauuuuuauuguuagaguugggauucuucuguucauguggcugucuuauuagguuuguugaaagauuacuuucuugcuuuuucuaggguguaauuucccuccuugucuuggaguuuucccuuuauuacccuuugaagggcuggauucauggaaagauacugaguaaauuugguuuugucauggaauacuuugguuucuccaucuaugguaauugaaaguuuugcuggguauaguagucuaggcuggcauuuguguucucuuagggucuguauaauauuuguccaggaccuucuggcuuucauagucucuggugagaagucugguguaauucgaauaggucuguccuuauaaguuacuugaccauuuucccuuacggcuuuuaauauucuaucuuuguucugugcauuugguguuuugauuauaauguguccagaggaauuucuucucugauccagucuauuuggaguucuguaggcuucuuguauguucaugggcaucucuuucacuagguuagggaagaucaugucuaugauuuuguugaagauguuuucugacccuuuuagccaaagauacaauuuuguaauugucuuugaacucuggauauaaaggacucucaaacaugcuucaaagauauuuaugcaauuauauuuucaaccugguacuuuuuaaucuaaaauuuugccuauuauaaccuauccaggaaaauacaugaauaaucuuuuaaacauuuuuuccuagguaaaaaacaaaaacauguaacuuuuauagcaucuuuauauucaagacaaccauaauaaccaaauaauaugaaaauuuauuuuauuauuguuugucugagacggucccauuucuuccuaucuuaagcucuuaaguguugugauuacagguaagcaauuuuagcuuuuuaaauuugaauuauuaguaugucuguaugaugucuuuguguacaugcucuaguguguuauggugagcauguggaaguuggagggcaccuuuacaucuuggcuuugaggagcaaacucagguugucaagauagugugcuaagugcuuauuacaugcugagcaaccucacagauacugaguuuaccccuuuaaaaaaaucauauucuaugaaucauuacaguggccauuagaucacuuauuuaaauuauuuaacuuccauaccuuuuucuuuccuuuuucugauuuuuuuguaaaaaucuguaauacuuaaauaaucagagaagacugaagguaaaaucaagaauccuuaacauguaccuuuuugcaaagcuuccagaagaaaugaaagguuuucagcaaagcuucccugcacaauaaaaauagauaagaccgaagcuuaauaaaauaaauuagaaugaauauuaaaacauuuacaaaagaacauaucuaugcauuguuuuuauugggaaauuagccauugaacagauucucaauugaauaucugcauuaauuaucuguaacuuaaauacaaaaggagaggaaaguauaagaacugaaauugauagaaguaugucaugugugaaguuuccuuuuuauuuuuuccuggauaauacugguagaaauguuagauaacaguauaguuucuggaggauugcuagauucuaaauauagcugaggacuagaaauauauuccacuuuauaucuuuaaacacaacacuuucuuucuagucucaaauuaauuuacaccagcaaaaaacuuaacauggguuaaaaucagauccaaacuggggaguuugcuuaaaauauuaaccaucgauuuucuagauaagaacgccuauuuagcaauuuguguuuaccacauuaucuguuucuuuggaauacaucuaaaguacuuuuggaaaaaacuuaaacauuuuggaagaauguuuguccacauguggguaugugcacauugaaggcacagaggccagagauacugcucccugaccuggauuuagaacauaguugugaaccaacugacacagguauuugaauccaaacucagcuccucuggaagagcaguaagcaccuuucuggugaaccuauccacuuccucaaucacguauuuuaaagaaaaagucaacuuuaaauuugaggaacuauaaaaagagaaaagaaacacaauagguuucuuuuccagaaagaaccuuauguaacauaaacauuuuuaguuuuuuuuacacuuaauuauuuugugugucugugcagcacaauguacauuuggagggcagagagcauuuuauaggagugcauucuuuccuuccuuuaaguggguucugauauguugucacgcuagguagcaagagugucuaagcgcagagccaaaucaccaguucagcaugaugauuuaaguguaaccaccuacaauaauaaucacaugcuaauaccaagaaugagugagucuacacaauuaauuacuguaacuaacacugccuuguagagauaaucuguuuggaaaucagcagucaauuacuuauucaaagauacguugucuucuguuuuuuuucaauaguucauuauaccucaucauaaaguaugcacacacauuuauucaaauauauaugaaaaaguauauguacauacauacacagaaaaauauauaugauguaccuauaaaauauauuuacucaaagacuaugaacacaguaaaguucuggcuuaagcaacuuuuguucuuucauguccagacuacaaaaacuuaugagcucaggcaaacucaucagucucuauuugagaccuaaucuccaaaaaagaggagauuaugagauaauaaucuuuuaauagccaucccuuguuauuguggaggauuggauauuggacccccuuuucauacacacaaauaccaaauguuuaagugaucaaucccacuaaguaaaauagcauaguauuuacaaauuaauugcauaccauaauccauuacuucuauauuacucucaauaccuuaauagagugcaguacuagaugucauauuuaguuuuugccuacuugaccaaaaucuacacagauauuggaaaagaaaaucuugacuaaaaacugcuuccaucagacuggccuaugagcaaguuuuuaaagcccuuuccugacugcuaauuuacauauggggcccagcucacuaugagcaguacuaauccugggcagauggaccugaguuccuccaugguuccagccucuguuccugcuugaguuccuauaaucuggaagcaguuagccagauuauuaacccuguuaucgccagauuaguuuugauuaauauauuaaagaaacagaaagcaaccuaaaaauauuaucuagauauuauuuauuagcucuucuaauguauuauuuaaaaauauaaaaacaaaauacaaagccgggcgugguggcgcacuguuuuaaucccagcacuccggaggcagaggcagguggauuacugaguucgaggccagccuguucuacaaagugaguuccaggacagccagggcuauacagagaaacccugccucggaaaaaacaacaacaacaacaacaacaaaaaccaaaaaccaaacaaaaaaaaaacccaaagucuguccaagcuuagcauaaaugcauuuauuuuucuugaauaucuucaguuugauauugguugcauauacagauaucggaccuaaauauacaaaggacugacuuucaugauaaucacaauagccgugauuggaaugagauuguaauacaacugccucuuucaugaauuuacacaaauacaguacuaauauauccaucuaggaacauuagaauuaacccccccacagaucauuugcuacaguuuuaauaggaauucuuguugaacacaguuauuaauaaaggaacacucugacuuuauuucucaacaguuuguagagcaggaaaggagaaaauauaguuggcucaacuuuuuguugcuaacuuaaagaaugcaauuccuagauacuagaagcgugugugcauagcuguauucagaucacugcagcacagagcaaagagugguaagauaagaaagacaguacugcaggcacagcaguaaacagaaaauggacuugggaaauguguaucucaucugcauauggagucucggacauggauuacucaugucuuccuuaggucauuuaugugagguaaacagcugaaugagacauuuccaacacuacagucugaagcacuaucgguacuuugagacuucaaggcacaccagcauacccuaagugacggaaaugaaguaacagauauucauacagcacauuagcauccaacagaguauuuaaucaaaaggacauuuacgccccuucuuuagaauaaucuuguuacauacacaaaguaaguauacuuagucaaagaaucugauauugagagagauucauugauccgacagccuaguaucaccaacagggaaucaacucuuaacaacaagucaauccacgaugccauuuuuaaauucaaaauaguaucuaauaugcucacgcuacuucauaagucuugauuuaaaaagacuuuuacuuaaacagucauaaaaauacauaaaaacaaccaccaaaauaaaaaaaagcuugaugacuaaauaugccauacauuaagucuuauccuaacaaaaaucuuacaucaacuucuaacauauauauuacauaacuuucuaauaugacucuccuagccuuccagaaauaaaauaucugaaaugauacuuacaaaaacuuuaucuucaacuacauugucuagauuuaauugucuugugaucucuuucagagcaauuuuuucauuugucugcaggaguccugaaacagaguacaauuaauggugucuaaauaaaaagaagcaaguauuugacacagauuauuuuccaaguaaauguauuuucuaaugcuuuuaaaaauuuaauuagaaagaauauaaucagauugcuauuucauauuacuucuucuaaaaauaugguaaucgaagcauuccuuggagauggcacuauuuaagaaaaaaaaacuauuuaacuauuugaaaauauacacuuuuaccauauauacuuuccuuuaauaucuaaaagccauuaaacaggcauacaguuuuuaauauauagacagacuuaaaacacaaaugaauuuauuaucaucauaugcaaaacuaguucacauuguuucuuaauggaaaaauaaugauauacucaccauuuaagugaacuuguaucacauuuucacucacuucuauuuccaugaguucuuucaaagcaugauuuaauaacuaaauauaaaaauguguaaaauguuuaauuuggaaaagauaaaaugaagcuauucuuucuuaaaaucauaaauguugagaauaaauauaaacaaauaaauuacuuuauagcuaauagguuuagauauauacaauucauuaugucuaagucuaauggcaaagccuaacugaaacuuuaauaucuuaauaauuuauauaaacuauuaauaaacauuggaagcaaucauaaaaccuucuuuuguaaucucuaugacucaguacauuuuacuauucaguaacauuucucuaccaggugccacugaaagcaguuaaaagcuauagaaaaaaauaaaccuaaauaguuguaaaagguuuguccuccaaugucaauuuuaugcaacacuguugauagucugcauauugucaugaaauaagaaauagcaaauaguuaaaaagaaaaauauaaacuauuuacucaugaacaagaauagaaaagcauagugaugaaauuuagcuggacgcagcagcaauuagccuguaaucccagcacucaggaggugaaggcaaagagugagaaauugaagagucaggaugaccugcaaccugaacuauaugaaauuguuucacaaacaaauaaucaaaacaaaacaaaaaacaaaacaaaacaaaaaacaauacaaaaguuaguaaaagguuagaugaaauuguaagauuaccaauaauaauuacuaugaaaauguacuuauacugagaauguauuauuguaauauaaaauuuguaaaugaagaagauuaagggcaauguaaaacacuuuuauucacaucaaaaaugguccaggagacacuauugcauaugccagcaagauuuugcugaagggacccugauauagcugucuccugugaggcuuugccagugccuggcaaauacagaaguggaugcucacagucaucuaauggauagaacacagggcccccaauggaggagcuagagaaaguacccaaggagcugaaggggucugcaacccuauagguggaacaacaauacgaacuaaccaguacccccagagugagugucucuagcugcauauguagcagaagauggccuagucggccaucauugagaaaagaggccccuuggucuugcaaacuuuauaugccccaggacaggggagcaccagggccaagaaguaggagugaguggauaggggaguagggcuuggggaggguauaggggacuuuugggauagcauuugaaauguaaaugaagaaaauaucuaauaaaaaauguggggaaaaaagauauaaaauuuaaaaaaaaaaagugguccaggaaaacagagguuagguguacauauaaguaaagagaguagacagauuuuacaaaaggauaguaaacauagaaauuaacuuugguauguguggauuuuaagcacauggaauuauacacagguacucuugaucuagauucucuuaaaaaaacaaacaaacaaacaaacaaacaaaaaaaaacaaaaaaaccucucuggguacaacugucugacuucuguaguaguucagcugagaagaaacaauaaaagcaaccauaagagauaagacaguacuuuccuaucuuucaaucagaucgacucuaucacaagagaacaucugugacucauacaaacuuucucccuaacaacacuacuuucaacguauuuuuaaaaaguauugcauugugugcugccuccuaucucuuacauuucacugacauuuauauuuuacuugggagccauuuuguuucaauucaugaaucacacauuagaaaacauuucaaauccuuuaaaggauagacauuaguaaaacuuuuuaucuccuaaguguaucaagagagucugagcacucuuccacugagcucaucuacacaagcuugcuuccuuugauuuguacacuguuaugauagacgguacaaagaaagauaaaauguccuacuaagccacagggaucugagacuucugugaggcucagccacuuauauaaucuaaauacagcaaaaagaaaagaaaaaagaaaaacuaaagaaaaucucacuccaggauuuucuccacaaaacaaaauucaugcaaaauccuugcaauucuaaggagaggaaaaacaaaaacaaaaacaaaaacaccugugaggaagccuauaaccccaggcaguagauacauuaaggaaaacaaucaaaaccacaaauguauuuuacauaguucuucuguugaaaaaaguuguuaaauuaaagcaaaagaaaauuauaaaaaccaaacaacaacaaauggcaaagaauuggaaauuauaccaaguaagcaggaggaccaaagcaggcuagaguaagacaucuuauaagaaauguauaaauucuugaaacaguaauaaaguugucaauuaccaaguuauguucuuuaaauggaaaugguaguauaaauaaaaauucuucaucuuacauaauauagaaccaacauguacuauuuuaaaaaauagaaacaguuuuaauuuacuaucuuaacuauuuuuaagguauaauaauaugccugaacaaaauauuaauuugcuauuacagaauacuagaaaaauacaauuuauacaacuuagcacauuaaaauuuaauaguaauacauucaaauguugauguauuuguuuuguauauuguaaaaaggaacagaugagagggagaagaauuuuugagauuaacuaagucagaagaagagaaauaugacauaaauacugaugaccuugacaugaaagauuuguuugaagguuaaaaauaaauuguaaaacugugaaaacuguaaaaagggguaaaaaugcuuguggggaaucacuguaugaugaugacccgugaaguccugaguugggacccucagagcccauguauguauggaagcauggaccuuauacucucaguggcagaugggaggauugaaaucccugccccaguauagggcaauauaccaagcagagaacauaaaaagcaugaucaacucccauaccacaaccuaacuuuguagaauaccugcauggauuuugucauuuaaaaggaauagaaaacaaagaauguugcaagacaauaaaacgaaaaacauuuuuaguguaucugauauaaaaacuucaaauguguauuaaagcaaugauauaugagaaacuuaagucuuuuacuguggucuuuccugauccucgugguccaacaaugaguacagaauugcuuucuccauagauagcaguucuuuugaguagcucaaucaaaugccuaaaaugauacggaaaggcagaauuaauaaaaaaaaaaggugaaauaauuuauugggucauacuuuuaaaaggcuaaaccugaaagucaguauuaauuuuacccuuuuggcucucuagcccaaaggaucuaaauuuuccugcauauagaaaauacacagaaaagaacauuagccgcuagagauucucuagagaccagaaaaggaaauccaggaaagugggaauucauuuggucucauagugggagaagauaagggacaauuaagcuaacuuuuagguccucuaggcuuagagagaauuauuuuugcuagcacuuugguccuuaucaccugagcuggcuaccagguguuaaguaccagaauucuuucaauaauagcagguaauuaacacaaaagaaguauuagggaccauauguccuuaucaauaacauuaugagacauuaaguacuuacauguguuccuguuuuacaauauuguuucuauauauaaaacauaacuucaucauaacuuaagauaaugcauauuaucuuuucaaaacucagagaggaaaugaaaaugaacuuauaauggaggagcugauaucagacucacuuguauuguacuugcacuccaaagagguugcuauguggacuaugaugacaaaaucuuucacguaaaauucuuuguaccugauaaacauaagaugaacagauguaauaaaaauauuacacauguaauaaaagugaauguuaaagcuuauuuguagcagccaggaauuaaauacuaacugcucuggcaccauuuuucugaguuauaaaaauagauucuucuuuuaucuagugucagguaaauaaugagaugucacgucagugaauggcagaacuacuucuuuacaucaccaacucaaaagcuguuucagugcacgggcaaagcaaucuaaccuaacagugccagugcaaccacacagucucuccuaaaaugucuuggcgucauaacaaucagucuggaccaccugcccuaaaggucaagauuccacaggaaacuaagcuuggagaucuguguagguuuaaauauccauuagauucugagcacagaaacacuacaagguuacuauucacagcuuaaaagucacugcaaaaaaggcagaaauauaaauucaaauaacaaacuacaaaacaaaacuaguucaaucuacaagccaguauuuaauuauguguaagaaacgacauuuaacuagacuauagaauaaagaauuagacccagggauguaguuccaugacagacauacugccuaguauauauguucagacccugguuucugucaccauaacugcaaaaauaaauacaugaauuaaaagaagaaaaaccuuaaaaccauuauuccuuuucuggaucuggugcuacuagaguaaucauucaaggacaauccuuagguagcugucuaagaccugaacaaaugugcuggaauaaagacuguagcauucuuugcugcuucaagacagagucuagaagucuagacucugcuuucagagucuaaaaguaccaaagauauagugaggguuauuuuuuuaaacacauauaaaaggauaaaguuaaugauucauguuuauuauuuuagaugaagcacaaauaauggaauuagugucaaaggagucauuuaagucaacauuaaaagaucaagucuuuuucagaucuaaacaucuaaauagagaauuaacacuuuucugucaggccuauuuugaagauuaaagcaguauuaucuauaauacaauauaggaauuauaugaguaauaguugauucccauuaaucacuaaaauggauuuuuagacaucuaaagaaucaaugaauuauaucuaucauccacaagguuaauauaauauuaauuggaagaaccguccacuuuacauacaaaaaaaaaaaaaaaagagcuccuuaucuuucuuaucuuuuaagcaguaauuuuucuuaaaaaagaaaaaugaggucaagauugagcagauagcucaguugauaaauuguuugcugugcugaagcuaaguucagauucucaacaccuacauaaaaugccuggcacaacaagcucaugccaguaacuccagaccuggaaaguggagaugggagacuauggagcuugcugcccagucagucuagccaacuggcaagaucuauguccagcaagagaccucauuuaauaauaucuuggagaaugacagaggaggauacuuagcaacccuuacuggccuagagacacauaucuaacacauauacauguauuuaagaaaaaaaaaguguuuuuaagucuuucaaauuuaacauugcuuuuuaaaaguaauguggcugaggucaaugcagauccaaguuaggguagaauuagcauggcaauuaccuaucagauuguagacuucauauggaaaacacacauaucuacacacuuagcaugcuuaagauaauaacaaacauuuaauauuaaaaaccucaacaaacuaaaaauauaaaaagacuugcucagauugguaaaggguaucagcaaaguauggugacagucuguuuuccuuuugccaucugaaucuuguagcuuagaacaguacucuucuagcauguuagcaugcucaaaccucuggggauauuccuagugcugcccuuuccacugccauagcucuccuuaaagaaaaauaagaaaggaaggaaggaaggaaggaaggaaggaaggagcaagcauauucaaacugaaaagagaaaauaaaauuucuauuuaaagaugacacaacauugaacauaaagcauuccaaaauaaacuaaaaaacuauuuauuacauuaaccauauuucuauaaacaaugaccaaaacaaagacgaaauuaagaaaauaguucacauaaaacagcaucuaaaagaauaaaaauacuuaauauauuuaauaggccgggugugguggcgcacaccuuuaaucccagcacuuggaggcaaaggcaggcaaauuucugaguucaaggccagccuggucuacagagugaguuccaggacagccagggcuacacagagaaaaaaagaaagaaagaaagagagagagagagagagagagagagagagagagagagaagaauauauucaauagaaggggugcaagccuuguauguuacuauuuaacuaaacuuaaaacggacuauuuuagaaagacacaguaaagguuaggauucaacuauccaaauaaaaggagugaaguuacacagcacccccagaaaucaacaaguucauggaacagaagccuucaauaacuucaauaguaaaaacacaauguaucauuucacauuuaauuuuacaauuuagagauuuguuucuacccauugauuuuuccaacuuguaaagcuaucuccacuagaaaagugcuaagaaaaaaaaaucagauuaaaaagaugaucauuuuucugaucaccuuuagcaagauuuugagauuaaggugcaggcuuuuagauuaaggaacauauauacuaaccugugaaagacacucugcaugugcauuacucuugguuuuacgacugcucaucucgauuaauucaaauccuaaaaaaaaaaaaaaagaaaaagaaaaagaaaauagggugaauaaacaucuguuuuaaaagauaauuuaaaaacuacauuuacagagucaaauacaaguucuuaaauauuaaaaaugucuaaaauuuucaaaugacaaaccuacaacugcuuuuauugguucaugaacaagcuuacuuggcacucucauucaucuggcuuuccugauuacucccccuccccgcuucuccauaaaugaacaacucaaauauuuuucuuucauacaaaauguuucuccuacccauccauccaacuggaaccauucuuuacaguacaucuuccauuuuuuuucuaugugagaccaccacauaaccuacacaauaagguuuaauuaauuaauaucuuaguucaagaaaacacaguauaugggugaauaaaaugacaaagacaacucaggaauucagcaaagagaaagauggaaaugaaaaacuuaauagccaaguagaaaacccagggaaagucuuucuaguacacuagaacaggaaaaacacagaauuaucagaauuuaaggcuugaacgauucaggcaaagaaaaugaggggguugggaaauguugacaccacacaagaacaguggaacaccaugaaaagaucuaaucuuaaauuacagacauagaugaaagagaacucaaaaucaaaauaauucaggucuaaaaacaaacaaacaaacaagauuaaagaaaaucuccccaaauuaaggaaagauauucagacacaagaaguauacagaacaccaaguaauacuagaaaagagguccuuauggcauauuaugguuaaaacauuaaacagaacaaagagaguacugaaagcaguaagaaacaaaucaagacaaccacauguuaauuaugauagaaauauaucacaacaauagcugauuuaucaauggaaaccuuuuuaaauccagaagacuauggaugccgucuuauauacuguagccaccaaaacuaccuacaauaguugaaguagaaagaaaagcuuucagugagagauacaagcuaaaauaauucguguccuaaguccaauuagauauaaguucuacuagacacuuagggauaguguguuagucuuagcacguaugcuaauauuauugguauccugcucagaaagucaaucccugugccaaauaauucaaucaaaaucaggguugucuggucuuuugcugggguccuugauccauuugggguugaguucuguuuguguugauaaauauggaucuauuugcauuauucuacauccagcauagcuuacugcuaugcuguguuuucuccaacguuguauuauuccaauguuguauuauuagcuucuuuguaaaaauuaagccuauaguuguacguacuuagaagugggucucaaauuugacuccauuugucaauguguaugcuuucaagccaauaccacacuguacuaccugaaauaugcgauauaccuuagcauucuuuuuuuaaauucaggauuguuuuggcuauccugucuguaggaguguguaugcacuuccaugaggcagaaaauuguuaauucaauuucagugaagaauuguguuggaauuuggaugaggauuguguugaacuguagauggcuuuggguagaaaggcaauuuucacuaucauaaucuuaacaaucuaugagcaugaagauccuguggucuucuggccucuuuuucaauuucuuucaucgguaucuuauuauacaacucuuucacgugcuugguuaaaaauguucaacugugcugacaguacucccaagagccaaagaccaucuaaugaaaccccaauagcagacaagagaaauucucuuuugaauuauuggccagggcugucuaggagauucccaaaacaaacauccuacugcuguuuuucuuggugacaccaggagaucugaugaagaaacaguucuacaugacaccucugaaaugugucaaugaccagcauagcucaauaacucugcaaauacauugaaaacaacuguuagugcaagaauacuacgguaacaagguaaacaauuucuuccuacauggagaaacacuggcagauauuuaggauuucaauguaauagagcaagagcagaaacuggaauaaagaugguuucaggucagcuugaaugcucuugguguaaagagguuagccuggcaugguggugcacaccuuacuuucagcacuagauaggcugaagcagauggaucccugaacuugaagauagccuggucuacaaaaggaguuccaugaccaaggcuacagagaaacugucuugaaaaccaaaacgaaaccaaaccaaaccaaaacaaccaaccaaccaccaaaccaaaccaaccaaccaaccaaccaaccaaacaaacaaaaacuuacagaaaaaccaagccuuacacuuuagaagucuaaacacuuucuuaaacuaaucuucaggaauucuacuaauaucacucagaaaaacuaccuuucuguggcaggcauauucucuagaaguaagauaaucacagaauauguugcaguacuuaacagaacuugucuucagaaaaaaguacuuuaacaugauuuaacuagaacuuuaccagaaagccuaauugccaggaagacaaccaaccaacuucaguagccucuacuagguaguucugggacaaauacaaaacuugagaucuaaugauaggaauauagaauguuucccuaccgccacacauuuuuaagcagguuccguuaccaguugaaguucuuauuuaaacucccccgccccccccccaaaaaaaaaacccaagcaaaacuuuauaggaacaagagcaaagacacaagaagaacuuuuagcuuuuggaacuguauuuuggcaaacaguaaguacauccuaagucugaacuugauaaauauaaaaucuauuauagauuuacuugcugucagcccuccaacccauaccaagucuugugagacaccaaauguaauccucuaguauuaaagaaggaaauacuauacgcuuguaaacuagugcgcaacccccccccccacugccauucgacaaaacacaacacugauccuugaauuuuaaaaaaaauauagcaaaguaggacgagaauauuuuucgacauuguaaauaaauauuaagaaaaauaucuagagcuaguguggucguuugaauacacuugacccagggaguggcacuauuacacuucaaaugguauaggaagucuuauaaaauguuagguaagaaaagucaaagacacagauauaaugggaaaaaaauggucuuguuucacagauauuauacugucuauguauaaaauccuuaaacaucacauaaucccuauuauauuguuuaugcauaaaaauaugcaaugcuauugcuuuccuauaacaaaccuaauuuccaaauuaaaauauauucacauuugcacauaugucaagugcauauguaaaugugcucauucaugcaaacagccacacccaccagcgugagagauauaauucuuugggcuugguguucuugaucuguuuaaguauaaaaagcgcugaacccuagcaucauugcauuauuaauucacugguucuugcuucugacaguggauguaaucugacuucucaagucacugcugcugacugagacuuucuugucaugauaagacuagaaccugaagcugaguguauaugcuuuuuuuguuagacaauuuuacaacagcuuuaauaagaaacuuacgguuguauuuauuuucuuugagauugaugacucauuuggaacucccaaauucaaguuauuuaauacauaaauaccuguacagcugugauuaaaacuacauguuaccaucccaccgagaauuuuuauuaguuaucauggaaauuuagaagcaguauguuuuuugauagaauggauaaacugguacagcccugcaaugauuauuucugugcuauagagccaugaagccaugaaaagccaggaauaaacuuuagauagcuacuccuaagugaaagaagaaugcauuauucaacucuauaaaugacaaaagaggcaaaacuugagaaacauugacaacauaucaaugguuguccgaugucugaggaaaguuaauaggggacagucacaagagauuuuuuuuucucagaauauauaacacaaagacaauuccauugucaacucuggacuaaaacuaauacaacuuacuaaggcaagaguucauacuagaaacuaggucaauaguagagaagauuggacaguguuuauaagcaggaauguaggaacuuacucuaaucaaauuugccucugugguacaagaagacauuucagauauuaaaacgacaaaauauuuuuaaacacuuuguuuuuguuauaaggcaauaauuucaaagguaaaaaucacuacuucauauagcaguucaagcuuuaauuuuguauuuuagacucugaagagauucaugguaaacucaaggccagccuaggcaacacagggagucuauaaauagccuggaacuacauaagaaaaucuugucuuaaaaccaacaaaaaagcaaaacacacaaacaaaagaagauguaccccuacaugguuuauauuuaaaaucaccucacuacucuuuguuacaggagaggcuaaaauauuuuguucuuuacuuggcacuuugcuuagcccaggaagguuauaauauugcuugucaguuuccugucucaggacauuuuuucaguuauuuuaucuaauucuucuacuauuaagcuucaaauaauauugcuuuacaauuuuaggaauaauuauuaaagaugauauagauguagcuuuuuaauacaaauaucuuagccuuuuauauaucuuuucacuauauaugaauguaagagauauuaguauaugguaacgaaaauggaugaauuauagcuuaauguaccaaugaaguuaaaucuuggcagcaaaagaaaaguaaaauacaauauauaaucuguuuacauauauauauuuguuuacauauacuaaaaaagggaaacuaauuuuauauuuuuacugacauaggcgguuaaggaugcuaaaagaaaaaccaaaaaccagagcaggccuauucucucacuaauaccuuacuuuuggauagagagcuauugaguauuucuguaauuucuaguccaaaacaacugcuacuggucaacauauccuugccacauauucacaaaaaucaugaacuucauucauuuaaaccaacaacaaaaagaguauaugagguuuaaaguuaugguuaaggcaaacuggacagaucaucuugcugaagucaaaacacagacaugugcacacacuugauaauaaaagauauaaagcaauuugaaauuacauggaucuagaaagaagagagucagagaaaagcuccacauccagucauuucugccuaagaaaaaggaugagucaacugaggccacaacuccagguccaccaaaaguggguacucagaaacuacccaucuuaccuugagaaauuaagggcaaccuaaggaggauaagggaaaauggcaagauuuuaacauauguuuaaguccuguaaaauguugucuauaguaaggaauuccaagauuuagauagaagucauuuaugacugauaguaacccuaggaaucuuuccuaguaaagugugauuucucaaaaacaccauuaucccauaccuaccuauuccucuaauuuccuaaaguauauaacugcugcacuccccugagaaauaaguacauauuauaaguaagcaaaaacacacuaaaaaaauuauaaccuugaauucuuugaauuaacaaugaaagugaagguuuaauuagaggagguaaguacuaacacuuccuucuauguuuuauaaagacaaugauaugcugaucugacaauccagaaggacucuaaagcaugaccaagaauuccaccuggcccccaucagaguaaaaaagcagacaaaguauuaaaaaaaaaaaaaaaaaaaaaaaagauucucuuuaaaugcaacaggaauuagauuuagagcaaauuucugcaaauuaauaagagaagcuaaaaaaacaauuagaauguuaucuucaaaguguugaaaacuauccacaaagcuguaagaaaccauaauuccuuagaacugaaagcaaaacaagagcuuugaagcaaagaaacaagagaacugguuaaaugcauuaaggaacuucugcagacuauccuaagaaaaaggaaaaggaugccaaaaagacaguuagaaaugcaagacauuaaucagaagaaaguggccaagauauagaaacaucuaugucaauauuuauuguuaauauugcuguccaacauaaauguaaauccuaauuuaacauuuucuaguauauuuaauaaagcaaaaaaggugaaaguaguuaaaauuuuaacaagcaaauauaaugagaagcugagguguuuuacacacuuuucaaauauaaaaugaaacaacaaaacacuaaaaaaaauuccuacuguaagucaaacuaccuauaacaauacauuucaagugcucaaaagccacauggggcugguggccaaguugaaacccuauguccuggaguuaaagcuaaauagaaaguucaagaaacaauaacaagauauaaauuaaaaaaguaacacuaggccggguggugguggcagcggcggugcacgccuuuaaucccagcacuuggaggcagaggcaggcggauuucugaguucgaggccagccuggucuacaaagugaguuccaggacagccagggcuacacagagaaacccugucuugaaaaaacaauaaaaaaaaaaaaaaaagaaaaaaaaagaaaagaauguaauauuacaagaacagauuaucuaucugccgcaaugcuacaaauccuuauggaaaacagcaaaauagaaaaagaaacuauacaaaagacuuuaaaaggaugauuuaaaagacaauuucugaaugaauaaauccaaacagccaaguuucugaaaacagucaauaucaccaguacagaacuuuacucaacacagagcaaauuauaaaacuacccucauuagauugacaaaauuaaaagcuaguuguuggugagaagguacaaguaaggcucgcucacaccugaggccgggggaugagacagcaugccagucuaaauguuuggugaaacugaagacagccacauacaacucauaaaaauacauagcuauauucacauaaaauuauguaguauucagaucauuauuauguagcuauguagaucauuuaguaguaaagaaaugaauacaagucaaaguccauuaagacuaaugguggcuuaguuauaaaaacagugccuuuaccuuagaaacucuuacaccacaacaaaaaaauauauaaauuacagcaaaauguauuaacagggucaaaucucagccagguaaauaaaggguccgacuuaauagggugugugaacuaccuaccuacaagcagauaaaaagaggccaauugagaauuuguuuagaagcgcugacauacauuuuuacuaaaagaaaagcagugaaucacaagaaucaagauaauaguaagguggcaccagaggaagagaggccuggaagcaauuagugggccuguuccugccagcugcuacccauguuuugguucuugauucauagugguuacagguuauguaugcuacagucguucucuacaucuguguuuugugcaguuucccacacacuuaggccauuacacaaaacaggauuuaaaaguuuuaccuaggucauaauaguuuucuauaagaagauugagacuugguuuucuaauaaaaauuuuagggcacuggaguuuuguuuugaacccaucugacauaauuaccucccuaggacgaaggaaaaaaaaaaaaaagcaccgugcaauggauacauuaaauagcguacuguauagacuugcaccaagaacaauucgggaaaauguguaacuuuuaacagacugaauccuacugagcagaacuaaaauaguuaagacuaaguaagaguaagugcgaagaucuccgauuuugaauuuuuuuuaauguaacuuggauuauuaaagacgagguaauaguccuccgauguaucuugacaaaaaccagcuaaaagacuaacgaagaaaguuaaaaugaaaaagaagccguuauuucacuauaaaaaaaagaaacacccagacaaaaagcuuucucuuuagcuccacaagaaaagaauauuucaaggcuuuucuuuuuuagugacaaaacucuguaugaaagaccaaacaaucccaagcauccucaaacgggcagucuuuuguguuugcagcauuaaggcagagagcaugcagggagcccucacucagaccuuuccugcccguuccuugccuacaugccuacagcuucuccaaaaucccaaagaaaacagaaaagucaggaaggcaggauguguaugagcaaggcuaccgcagaagcugaucaaaaggcacacaucugguuagguuuuuccaaauaugucgcacgcucuaaagcagguagugcuucucucucugcagagaaccugaccucucaacacugcccaaucauguuccucacccaaaagccuucuguagcccgucucugcugagcucugugcccgcuucguccacagcagcucccggaagccgagagccaggggcaggccuccugcuuuaggccuacccggccugcacgagccucccacuccccucagauuguccacccgcccguagccacugcggcccucaccuugccuacgagaccggccuuaccucucccagucaagccugccuaaaucgggcaaagccggccgccgccgacggugaggaccgaaggauguucaccaccuucucagucccgcugcuccuacugcagcccaccgcgcacagcaacucccagcaugcacggcgaccggccggcuuuggcggccccgcccccgcuccgccccaccacgugaccugcuuucaggucgguccccgccuacuuccgucccuccgcucucccagaggagggaggaggcagcuggggcugcucuagaguagcaacuuccucccucuucccgcccccgcccggcuacccccugcuuacaauggcuuccgggucgccagcgccuuggagccuucugggaaaaccaucucauuuccuccccucccccuccuccuugccuuccaccaaccagccucccgucagaacgggacaugcgcagugagugccucccgucucgucuccccgagcccccccucccccccaagcagagagaccccagcagcagcagcagcugaugaugaagagagaggcaguggcagagggggggcaccuuuuauuucuauuuuuaaagggacaggacacuaauuuuaccccacuucaaccuugaauugagggggguggggggaaggcggccgaguuccucccccacccuccagcucugagccccgagugggggaauugagccugagagaggagaggaguuucuucuucuuagaaaaacccccauccacgacuccuacccgcucagcccuccacacgccugcuuccagagcccccuccacccuccuucucuguggccgggagagaaggagagaaagagaccaaaagccucuuagcaacacagacccuuggcugcugcugcugcuacugcugcugcugcugcugcuguugcuguugcugcugcuuggcccuggcugaagacaucucccuacaccgggagcagccacuuccccagcucuccuccuccuccuucgccuccuccuccuccacucccccccuuuauuacccuuugugucauccuccacagcuccagggaaggcacucaaaaguggggggcaggaaagguaagugugucugugggggcuccauugccuuccucuggcucugacuuucacuccggggcagcaguagcaccaaaccucauacgcaguggagcuccggggugag

SEQ ID NO: 811 - RNA, 47428 nt, Mus musculus
cucaccccggagcuccacugcguaugagguuuggugcuacugcugccccggagugaaagucagagccagaggaaggcaauggagcccccacagacacacuuaccuuuccugccccccacuuuugagugccuucccuggagcuguggaggaugacacaaaggguaauaaagggggggaguggaggaggaggaggcgaaggaggaggaggagagcuggggaaguggcugcucccgguguagggagaugucuucagccagggccaagcagcagcaacagcaacagcagcagcagcagcagcaguagcagcagcagcagccaagggucuguguugcuaagaggcuuuuggucucuuucucuccuucucucccggccacagagaaggaggguggagggggcucuggaagcaggcguguggagggcugagcggguaggagucguggauggggguuuuucuaagaagaagaaacuccucuccucucucaggcucaauucccccacucggggcucagagcuggagggugggggaggaacucggccgccuuccccccaccccccucaauucaagguugaagugggguaaaauuaguguccugucccuuuaaaaauagaaauaaaaggugcccccccucugccacugccucucucuucaucaucagcugcugcugcugcuggggucucucugcuugggggggagggggggcucggggagacgagacgggaggcacucacugcgcaugucccguucugacgggaggcugguugguggaaggcaaggaggagggggaggggaggaaaugagaugguuuucccagaaggcuccaaggcgcuggcgacccggaagccauuguaagcaggggguagccgggcgggggcgggaagagggaggaaguugcuacucuagagcagccccagcugccuccucccuccucugggagagcggagggacggaaguaggcggggaccgaccugaaagcaggucacgugguggggcggagcgggggcggggccgccaaagccggccggucgccgugcaugcugggaguugcugugcgcggugggcugcaguaggagcagcgggacugagaagguggugaacauccuucgguccucaccgucggcggcggccggcuuugcccgauuuaggcaggcuugacugggagagguaaggccggucucguaggcaaggugagggccgcaguggcuacgggcggguggacaaucugaggggagugggaggcucgugcaggccggguaggccuaaagcaggaggccugccccuggcucucggcuuccgggagcugcuguggacgaagcgggcacagagcucagcagagacgggcuacagaaggcuuuugggugaggaacaugauugggcaguguugagaggucagguucucugcagagagagaagcacuaccugcuuuagagcgugcgacauauuuggaaaaaccuaaccagaugugugccuuuugaucagcuucugcgguagccuugcucauacacauccugccuuccugacuuuucuguuuucuuugggauuuuggagaagcuguaggcauguaggcaaggaacgggcaggaaaggucugagugagggcucccugcaugcucucugccuuaaugcugcaaacacaaaagacugcccguuugaggaugcuugggauuguuuggucuuucauacagaguuuugucacuaaaaaagaaaagccuugaaauauucuuuucuuguggagcuaaagagaaagcuuuuugucuggguguuucuuuuuuuuauagugaaauaacggcuucuuuuucauuuuaacuuucuucguuagucuuuuagcugguuuuugucaagauacaucggaggacuauuaccucgucuuuaauaauccaaguuacauuaaaaaaaauucaaaaucggagaucuucgcacuuacucuuacuuagucuuaacuauuuuaguucugcucaguaggauucagucuguuaaaaguuacacauuuucccgaauuguucuuggugcaagucuauacaguacgcuauuuaauguauccauugcacggugcuuuuuuuuuuuuuuccuucguccuagggagguaauuaugucagauggguucaaaacaaaacuccagugcccuaaaauuuuuauuagaaaaccaagucucaaucuucuuauagaaaacuauuaugaccuagguaaaacuuuuaaauccuguuuuguguaauggccuaagugugugggaaacugcacaaaacacagauguagagaacgacuguagcauacauaaccuguaaccacuaugaaucaagaaccaaaacauggguagcagcuggcaggaacaggcccacuaauugcuuccaggccucucuuccucuggugccaccuuacuauuaucuugauucuugugauucacugcuuuucuuuuaguaaaaauguaugucagcgcuucuaaacaaauucucaauuggccucuuuuuaucugcuuguagguagguaguucacacacccuauuaagucggacccuuuauuuaccuggcugagauuugacccuguuaauacauuuugcuguaauuuauauauuuuuuuguugugguguaagaguuucuaagguaaaggcacuguuuuuauaacuaagccaccauuagucuuaauggacuuugacuuguauucauuucuuuacuacuaaaugaucuacauagcuacauaauaaugaucugaauacuacauaauuuuaugugaauauagcuauguauuuuuaugaguuguauguggcugucuucaguuucaccaaacauuuagacuggcaugcugucucaucccccggccucaggugugagcgagccuuacuuguaccuucucaccaacaacuagcuuuuaauuuugucaaucuaaugaggguaguuuuauaauuugcucuguguugaguaaaguucuguacuggugauauugacuguuuucagaaacuuggcuguuuggauuuauucauucagaaauugucuuuuaaaucauccuuuuaaagucuuuuguauaguuucuuuuucuauuuugcuguuuuccauaaggauuuguagcauugcggcagauagauaaucuguucuuguaauauuacauucuuuucuuuuuuuuucuuuuuuuuuuuuuuuuauuguuuuuucaagacaggguuucucuguguagcccuggcuguccuggaacucacuuuguagaccaggcuggccucgaacucagaaauccgccugccucugccuccaagugcugggauuaaaggcgugcaccgccgcugccaccaccacccggccuaguguuacuuuuuuaauuuauaucuuguuauuguuucuugaacuuucuauuuagcuuuaacuccaggacauaggguuucaacuuggccaccagccccauguggcuuuugagcacuugaaauguauuguuauagguaguuugacuuacaguaggaauuuuuuuuaguguuuuguuguuucauuuuauauuugaaaaguguguaaaacaccucagcuucucauuauauuugcuuguuaaaauuuuaacuacuuucaccuuuuuugcuuuauuaaauauacuagaaaauguuaaauuaggauuuacauuuauguuggacagcaauauuaacaauaaauauugacauagauguuucuauaucuuggccacuuucuucugauuaaugucuugcauuucuaacugucuuuuuggcauccuuuuccuuuuucuuaggauagucugcagaaguuccuuaaugcauuuaaccaguucucuuguuucuuugcuucaaagcucuuguuuugcuuucaguucuaaggaauuaugguuucuuacagcuuuguggauaguuuucaacacuuugaagauaacauucuaauuguuuuuuuagcuucucuuauuaauuugcagaaauuugcucuaaaucuaauuccuguugcauuuaaagagaaucuuuuuuuuuuuuuuuuuuuuuuuuaauacuuugucugcuuuuuuacucugaugggggccagguggaauucuuggucaugcuuuagaguccuucuggauugucagaucagcauaucauugucuuuauaaaacauagaaggaaguguuaguacuuaccuccucuaauuaaaccuucacuuucauuguuaauucaaagaauucaagguuauaauuuuuuuaguguguuuuugcuuacuuauaauauguacuuauuucucaggggagugcagcaguuauauacuuuaggaaauuagaggaauagguagguaugggauaaugguguuuuugagaaaucacacuuuacuaggaaagauuccuaggguuacuaucagucauaaaugacuucuaucuaaaucuuggaauuccuuacuauagacaacauuuuacaggacuuaaacauauguuaaaaucuugccauuuucccuuauccuccuuagguugcccuuaauuucucaagguaagauggguaguuucugaguacccacuuuugguggaccuggaguuguggccucaguugacucauccuuuuucuuaggcagaaaugacuggauguggagcuuuucucugacucucuucuuucuagauccauguaauuucaaauugcuuuauaucuuuuauuaucaagugugugcacaugucuguguuuugacuucagcaagaugaucuguccaguuugccuuaaccauaacuuuaaaccucauauacucuuuuuguuguugguuuaaaugaaugaaguucaugauuuuugugaauauguggcaaggauauguugaccaguagcaguuguuuuggacuagaaauuacagaaauacucaauagcucucuauccaaaaguaagguauuagugagagaauaggccugcucugguuuuugguuuuucuuuuagcauccuuaaccgccuaugucaguaaaaauauaaaauuaguuucccuuuuuuaguauauguaaacaaauauauauauguaaacagauuauauauuguauuuuacuuuucuuuugcugccaagauuuaacuucauugguacauuaagcuauaauucauccauuuucguuaccauauacuaauaucucuuacauucauauauagugaaaagauauauaaaaggcuaagauauuuguauuaaaaagcuacaucuauaucaucuuuaauaauuauuccuaaaauuguaaagcaauauuauuugaagcuuaauaguagaagaauuagauaaaauaacugaaaaaauguccugagacaggaaacugacaagcaauauuauaaccuuccugggcuaagcaaagugccaaguaaagaacaaaauauuuuagccucuccuguaacaaagaguagugaggugauuuuaaauauaaaccauguagggguacaucuucuuuuguuuguguguuuugcuuuuuuguugguuuuaagacaagauuuucuuauguaguuccaggcuauuuauagacucccuguguugccuaggcuggccuugaguuuaccaugaaucucuucagagucuaaaauacaaaauuaaagcuugaacugcuauaugaaguagugauuuuuaccuuugaaauuauugccuuauaacaaaaacaaaguguuuaaaaauauuuugucguuuuaauaucugaaaugucuucuuguaccacagaggcaaauuugauuagaguaaguuccuacauuccugcuuauaaacacuguccaaucuucucuacuauugaccuaguuucuaguaugaacucuugccuuaguaaguuguauuaguuuuaguccagaguugacaauggaauugucuuuguguuauauauucugagaaaaaaaaaucucuugugacuguccccuauuaacuuuccucagacaucggacaaccauugauauguugucaauguuucucaaguuuugccucuuuugucauuuauagaguugaauaaugcauucuucuuucacuuaggaguagcuaucuaaaguuuauuccuggcuuuucauggcuucauggcucuauagcacagaaauaaucauugcagggcuguaccaguuuauccauucuaucaaaaaacauacugcuucuaaauuuccaugauaacuaauaaaaauucucggugggaugguaacauguaguuuuaaucacagcuguacagguauuuauguauuaaauaacuugaauuugggaguuccaaaugagucaucaaucucaaagaaaauaaauacaaccguaaguuucuuauuaaagcuguuguaaaauugucuaacaaaaaaagcauauacacucagcuucagguucuagucuuaucaugacaagaaagucucagucagcagcagugacuugagaagucagauuacauccacugucagaagcaagaaccagugaauuaauaaugcaaugaugcuaggguucagcgcuuuuuauacuuaaacagaucaagaacaccaagcccaaagaauuauaucucucacgcugguggguguggcuguuugcaugaaugagcacauuuacauaugcacuugacauaugugcaaaugugaauauauuuuaauuuggaaauuagguuuguuauaggaaagcaauagcauugcauauuuuuaugcauaaacaauauaauagggauuaugugauguuuaaggauuuuauacauagacaguauaauaucugugaaacaagaccauuuuuuucccauuauaucugugucuuugacuuuucuuaccuaacauuuuauaagacuuccuauaccauuugaaguguaauagugccacucccugggucaaguguauucaaacgaccacacuagcucuagauauuuuucuuaauauuuauuuacaaugucgaaaaauauucucguccuacuuugcuauauuuuuuuuaaaauucaaggaucaguguuguguuuugucgaauggcaguggggggggggguugcgcacuaguuuacaagcguauaguauuuccuucuuuaauacuagaggauuacauuuggugucucacaagacuugguauggguuggagggcugacagcaaguaaaucuauaauagauuuuauauuuaucaaguucagacuuaggauguacuuacuguuugccaaaauacaguuccaaaagcuaaaaguucuucuugugucuuugcucuuguuccuauaaaguuuugcuuggguuuuuuuuuuggggggggggcgggggaguuuaaauaagaacuucaacugguaacggaaccugcuuaaaaauguguggcgguagggaaacauucuauauuccuaucauuagaucucaaguuuuguauuugucccagaacuaccuaguagaggcuacugaaguugguugguugucuuccuggcaauuaggcuuucugguaaaguucuaguuaaaucauguuaaaguacuuuuuucugaagacaaguucuguuaaguacugcaacauauucugugauuaucuuacuucuagagaauaugccugccacagaaagguaguuuuucugagugauauuaguagaauuccugaagauuaguuuaagaaaguguuuagacuucuaaaguguaaggcuugguuuuucuguaaguuuuuguuuguuugguugguugguugguugguugguuugguuuggugguugguugguuguuuugguuugguuugguuucguuuugguuuucaagacaguuucucuguagccuuggucauggaacuccuuuuguagaccaggcuaucuucaaguucagggauccaucugcuucagccuaucuagugcugaaaguaaggugugcaccaccaugccaggcuaaccucuuuacaccaagagcauucaagcugaccugaaaccaucuuuauuccaguuucugcucuugcucuauuacauugaaauccuaaauaucugccaguguuucuccauguaggaagaaauuguuuaccuuguuaccguaguauucuugcacuaacaguuguuuucaauguauuugcagaguuauugagcuaugcuggucauugacacauuucagaggugucauguagaacuguuucuucaucagaucuccuggugucaccaagaaaaacagcaguaggauguuuguuuugggaaucuccuagacagcccuggccaauaauucaaaagagaauuucucuugucugcuauugggguuucauuagauggucuuuggcucuugggaguacugucagcacaguugaacauuuuuaaccaagcacgugaaagaguuguauaauaagauaccgaugaaagaaauugaaaaagaggccagaagaccacaggaucuucaugcucauagauuguuaagauuaugauagugaaaauugccuuucuacccaaagccaucuacaguucaacacaauccucauccaaauuccaacacaauucuucacugaaauugaauuaacaauuuucugccucauggaagugcauacacacuccuacagacaggauagccaaaacaauccugaauuuaaaaaaagaaugcuaagguauaucgcauauuucagguaguacagugugguauuggcuugaaagcauacacauugacaaauggagucaaauuugagacccacuucuaaguacguacaacuauaggcuuaauuuuuacaaagaagcuaauaauacaacauuggaauaauacaacguuggagaaaacacagcauagcaguaagcuaugcuggauguagaauaaugcaaauagauccauauuuaucaacacaaacagaacucaaccccaaauggaucaaggaccccagcaaaagaccagacaacccugauuuugauugaauuauuuggcacagggauugacuuucugagcaggauaccaauaauauuagcauacgugcuaagacuaacacacuaucccuaagugucuaguagaacuuauaucuaauuggacuuaggacacgaauuauuuuagcuuguaucucucacugaaagcuuuucuuucuacuucaacuauuguagguaguuuugguggcuacaguauauaagacggcauccauagucuucuggauuuaaaaagguuuccauugauaaaucagcuauuguugugauauauuucuaucauaauuaacaugugguugucuugauuuguuucuuacugcuuucaguacucucuuuguucuguuuaauguuuuaaccauaauaugccauaaggaccucuuuucuaguauuacuugguguucuguauacuucuugugucugaauaucuuuccuuaauuuggggagauuuucuuuaaucuuguuuguuuguuuguuuuuagaccugaauuauuuugauuuugaguucucuuucaucuaugucuguaauuuaagauuagaucuuuucaugguguuccacuguucuuguguggugucaacauuucccaacccccucauuuucuuugccugaaucguucaagccuuaaauucugauaauucuguguuuuuccuguucuaguguacuagaaagacuuucccuggguuuucuacuuggcuauuaaguuuuucauuuccaucuuucucuuugcugaauuccugaguugucuuugucauuuuauucacccauauacuguguuuucuugaacuaagauauuaauuaauuaaaccuuauuguguagguuaugugguggucucacauagaaaaaaaauggaagauguacuguaaagaaugguuccaguuggauggauggguaggagaaacauuuuguaugaaagaaaaauauuugaguuguucauuuauggagaagcggggagggggaguaaucaggaaagccagaugaaugagagugccaaguaagcuuguucaugaaccaauaaaagcaguuguagguuugucauuugaaaauuuuagacauuuuuaauauuuaagaacuuguauuugacucuguaaauguaguuuuuaaauuaucuuuuaaaacagauguuuauucacccuauuuucuuuuucuuuuucuuuuuuuuuuuuuuuaggauuugaauuaaucgagaugagcagucguaaaaccaagaguaaugcacaugcagagugucuuucacagguuaguauauauguuccuuaaucuaaaagccugcaccuuaaucucaaaaucuugcuaaaggugaucagaaaaaugaucaucuuuuuaaucugauuuuuuuuucuuagcacuuuucuaguggagauagcuuuacaaguuggaaaaaucaauggguagaaacaaaucucuaaauuguaaaauuaaaugugaaaugauacauuguguuuuuacuauugaaguuauugaaggcuucuguuccaugaacuuguugauuucugggggugcuguguaacuucacuccuuuuauuuggauaguugaauccuaaccuuuacugugucuuucuaaaauaguccguuuuaaguuuaguuaaauaguaacauacaaggcuugcaccccuucuauugaauauauucuucucucucucucucucucucucucucucucucucucucuuucuuucuuucuuuuuuucucuguguagcccuggcuguccuggaacucacucuguagaccaggcuggccuugaacucagaaauuugccugccuuugccuccaagugcugggauuaaaggugugcgccaccacacccggccuauuaaauauauuaaguauuuuuauucuuuuagaugcuguuuuaugugaacuauuuucuuaauuucgucuuuguuuuggucauuguuuauagaaauaugguuaauguaauaaauaguuuuuuaguuuauuuuggaaugcuuuauguucaauguugugucaucuuuaaauagaaauuuuauuuucucuuuucaguuugaauaugcuugcuccuuccuuccuuccuuccuuccuuccuuccuuucuuauuuuucuuuaaggagagcuauggcaguggaaagggcagcacuaggaauauccccagagguuugagcaugcuaacaugcuagaagaguacuguucuaagcuacaagauucagauggcaaaaggaaaacagacugucaccauacuuugcugauacccuuuaccaaucugagcaagucuuuuuauauuuuuaguuuguugagguuuuuaauauuaaauguuuguuauuaucuuaagcaugcuaaguguguagauauguguguuuuccauaugaagucuacaaucugauagguaauugccaugcuaauucuacccuaacuuggaucugcauugaccucagccacauuacuuuuaaaaagcaauguuaaauuugaaagacuuaaaaacacuuuuuuuuucuuaaauacauguauauguguuagauaugugucucuaggccaguaaggguugcuaaguauccuccucugucauucuccaagauauuauuaaaugaggucucuugcuggacauagaucuugccaguuggcuagacugacugggcagcaagcuccauagucucccaucuccacuuuccaggucuggaguuacuggcaugagcuuguugugccaggcauuuuauguagguguugagaaucugaacuuagcuucagcacagcaaacaauuuaucaacugagcuaucugcucaaucuugaccucauuuuucuuuuuuaagaaaaauuacugcuuaaaagauaagaaagauaaggagcucuuuuuuuuuuuuuuuuguauguaaaguggacgguucuuccaauuaauauuauauuaaccuuguggaugauagauauaauucauugauucuuuagaugucuaaaaauccauuuuagugauuaaugggaaucaacuauuacucauauaauuccuauauuguauuauagauaauacugcuuuaaucuucaaaauaggccugacagaaaaguguuaauucucuauuuagauguuuagaucugaaaaagacuugaucuuuuaauguugacuuaaaugacuccuuugacacuaauuccauuauuugugcuucaucuaaaauaauaaacaugaaucauuaacuuuauccuuuuauauguguuuaaaaaaauaacccucacuauaucuuugguacuuuuagacucugaaagcagagucuagacuucuagacucugucuugaagcagcaaagaaugcuacagucuuuauuccagcacauuuguucaggucuuagacagcuaccuaaggauuguccuugaaugauuacucuaguagcaccagauccagaaaaggaauaaugguuuuaagguuuuucuucuuuuaauucauguauuuauuuuugcaguuauggugacagaaaccagggucugaacauauauacuaggcaguaugucugucauggaacuacaucccugggucuaauucuuuauucuauagucuaguuaaaugucguuucuuacacauaauuaaauacuggcuuguagauugaacuaguuuuguuuuguaguuuguuauuugaauuuauauuucugccuuuuuugcagugacuuuuaagcugugaauaguaaccuuguaguguuucugugcucagaaucuaauggauauuuaaaccuacacagaucuccaagcuuaguuuccuguggaaucuugaccuuuagggcaggugguccagacugauuguuaugacgccaagacauuuuaggagagacugugugguugcacuggcacuguuagguuagauugcuuugcccgugcacugaaacagcuuuugaguuggugauguaaagaaguaguucugccauucacugacgugacaucucauuauuuaccugacacuagauaaaagaagaaucuauuuuuauaacucagaaaaauggugccagagcaguuaguauuuaauuccuggcugcuacaaauaagcuuuaacauucacuuuuauuacauguguaauauuuuuauuacaucuguucaucuuauguuuaucagguacaaagaauuuuacgugaaagauuuugucaucauaguccacauagcaaccucuuuggagugcaaguacaauacaagugagucugauaucagcuccuccauuauaaguucauuuucauuuccucucugaguuuugaaaagauaauaugcauuaucuuaaguuaugaugaaguuauguuuuauauauagaaacaauauuguaaaacaggaacacauguaaguacuuaaugucucauaauguuauugauaaggacauauggucccuaauacuucuuuuguguuaauuaccugcuauuauugaaagaauucugguacuuaacaccugguagccagcucaggugauaaggaccaaagugcuagcaaaaauaauucucucuaagccuagaggaccuaaaaguuagcuuaauugucccuuaucuucucccacuaugagaccaaaugaauucccacuuuccuggauuuccuuuucuggucucuagagaaucucuagcggcuaauguucuuuucuguguauuuucuauaugcaggaaaauuuagauccuuugggcuagagagccaaaaggguaaaauuaauacugacuuucagguuuagccuuuuaaaaguaugacccaauaaauuauuucaccuuuuuuuuuuauuaauucugccuuuccguaucauuuuaggcauuugauugagcuacucaaaagaacugcuaucuauggagaaagcaauucuguacucauuguuggaccacgaggaucaggaaagaccacaguaaaagacuuaaguuucucauauaucauugcuuuaauacacauuugaaguuuuuauaucagauacacuaaaaauguuuuucguuuuauugucuugcaacauucuuuguuuucuauuccuuuuaaaugacaaaauccaugcagguauucuacaaaguuagguugugguaugggaguugaucaugcuuuuuauguucucugcuugguauauugcccuauacuggggcagggauuucaauccucccaucugccacugagaguauaagguccaugcuuccauacauacaugggcucugagggucccaacucaggacuucacgggucaucaucauacagugauuccccacaagcauuuuuaccccuuuuuacaguuuucacaguuuuacaauuuauuuuuaaccuucaaacaaaucuuucaugucaaggucaucaguauuuaugucauauuucucuucuucugacuuaguuaaucucaaaaauucuucucccucucaucuguuccuuuuuacaauauacaaaacaaauacaucaacauuugaauguauuacuauuaaauuuuaaugugcuaaguuguauaaauuguauuuuucuaguauucuguaauagcaaauuaauauuuuguucaggcauauuauuauaccuuaaaaauaguuaagauaguaaauuaaaacuguuucuauuuuuuaaaauaguacauguugguucuauauuauguaagaugaagaauuuuuauuuauacuaccauuuccauuuaaagaacauaacuugguaauugacaacuuuauuacuguuucaagaauuuauacauuucuuauaagaugucuuacucuagccugcuuugguccuccugcuuacuugguauaauuuccaauucuuugccauuuguuguuguuugguuuuuauaauuuucuuuugcuuuaauuuaacaacuuuuuucaacagaagaacuauguaaaauacauuugugguuuugauuguuuuccuuaauguaucuacugccugggguuauaggcuuccucacagguguuuuuguuuuuguuuuuguuuuuccucuccuuagaauugcaaggauuuugcaugaauuuuguuuuguggagaaaauccuggagugagauuuucuuuaguuuuucuuuuuucuuuucuuuuugcuguauuuagauuauauaaguggcugagccucacagaagucucagaucccuguggcuuaguaggacauuuuaucuuucuuuguaccgucuaucauaacaguguacaaaucaaaggaagcaagcuuguguagaugagcucaguggaagagugcucagacucucuugauacacuuaggagauaaaaaguuuuacuaaugucuauccuuuaaaggauuugaaauguuuucuaaugugugauucaugaauugaaacaaaauggcucccaaguaaaauauaaaugucagugaaauguaagagauaggaggcagcacacaaugcaauacuuuuuaaaaauacguugaaaguaguguuguuagggagaaaguuuguaugagucacagauguucucuugugauagagucgaucugauugaaagauaggaaaguacugucuuaucucuuaugguugcuuuuauuguuucuucucagcugaacuacuacagaagucagacaguuguacccagagagguuuuuuuguuuuuuuuuguuuguuuguuuguuuguuuguuuuuuuaagagaaucuagaucaagaguaccuguguauaauuccaugugcuuaaaauccacacauaccaaaguuaauuucuauguuuacuauccuuuuguaaaaucugucuacucucuuuacuuauauguacaccuaaccucuguuuuccuggaccacuuuuuuuuuuuaaauuuuauaucuuuuuuccccacauuuuuuauuagauauuuucuucauuuacauuucaaaugcuaucccaaaaguccccuauacccuccccaagcccuacuccccuauccacucacuccuacuucuuggcccuggugcuccccuguccuggggcauauaaaguuugcaagaccaaggggccucuuuucucaaugauggccgacuaggccaucuucugcuacauaugcagcuagagacacucacucuggggguacugguuaguucguauuguuguuccaccuauaggguugcagaccccuucagcuccuuggguacuuucucuagcuccuccauugggggcccuguguucuauccauuagaugacugugagcauccacuucuguauuugccaggcacuggcaaagccucacaggagacagcuauaucagggucccuucagcaaaaucuugcuggcauaugcaauagugucuccuggaccauuuuugaugugaauaaaaguguuuuacauugcccuuaaucuucuucauuuacaaauuuuauauuacaauaauacauucucaguauaaguacauuuucauaguaauuauuauugguaaucuuacaauuucaucuaaccuuuuacuaacuuuuguauuguuuuuuguuuuguuuuguuuuuuguuuuguuuugauuauuuguuugugaaacaauuucauauaguucagguugcaggucauccugacucuucaauuucucacucuuugccuucaccuccugagugcugggauuacaggcuaauugcugcugcguccagcuaaauuucaucacuaugcuuuucuauucuuguucaugaguaaauaguuuauauuuuucuuuuuaacuauuugcuauuucuuauuucaugacaauaugcagacuaucaacaguguugcauaaaauugacauuggaggacaaaccuuuuacaacuauuuagguuuauuuuuuucuauagcuuuuaacugcuuucaguggcaccugguagagaaauguuacugaauaguaaaauguacugagucauagagauuacaaaagaagguuuuaugauugcuuccaauguuuauuaauaguuuauauaaauuauuaagauauuaaaguuucaguuaggcuuugccauuagacuuagacauaaugaauuguauauaucuaaaccuauuagcuauaaaguaauuuauuuguuuauauuuauucucaacauuuaugauuuuaagaaagaauagcuucauuuuaucuuuuccaaauuaaacauuuuacacauuuuuauauuuaguuauuaaaucaugcuuugaaagaacucauggaaauagaagugagugaaaaugugauacaaguucacuuaaauggugaguauaucauuauuuuuccauuaagaaacaaugugaacuaguuuugcauaugaugauaauaaauucauuuguguuuuaagucugucuauauauuaaaaacuguaugccuguuuaauggcuuuuagauauuaaaggaaaguauauaugguaaaaguguauauuuucaaauaguuaaauaguuuuuuuuucuuaaauagugccaucuccaaggaaugcuucgauuaccauauuuuuagaagaaguaauaugaaauagcaaucugauuauauucuuucuaauuaaauuuuuaaaagcauuagaaaauacauuuacuuggaaaauaaucugugucaaauacuugcuucuuuuuauuuagacaccauuaauuguacucuguuucaggacuccugcagacaaaugaaaaaauugcucugaaagagaucacaagacaauuaaaucuagacaauguaguugaagauaaaguuuuuguaaguaucauuucagauauuuuauuucuggaaggcuaggagagucauauuagaaaguuauguaauauauauguuagaaguugauguaagauuuuuguuaggauaagacuuaauguauggcauauuuagucaucaagcuuuuuuuuauuuuggugguuguuuuuauguauuuuuaugacuguuuaaguaaaagucuuuuuaaaucaagacuuaugaaguagcgugagcauauuagauacuauuuugaauuuaaaaauggcaucguggauugacuuguuguuaagaguugauucccuguuggugauacuaggcugucggaucaaugaaucucucucaauaucagauucuuugacuaaguauacuuacuuuguguauguaacaagauuauucuaaagaaggggcguaaauguccuuuugauuaaauacucuguuggaugcuaaugugcuguaugaauaucuguuacuucauuuccgucacuuaggguaugcuggugugccuugaagucucaaaguaccgauagugcuucagacuguaguguuggaaaugucucauucagcuguuuaccucacauaaaugaccuaaggaagacaugaguaauccauguccgagacuccauaugcagaugagauacacauuucccaaguccauuuucuguuuacugcugugccugcaguacugucuuucuuaucuuaccacucuuugcucugugcugcagugaucugaauacagcuaugcacacacgcuucuaguaucuaggaauugcauucuuuaaguuagcaacaaaaaguugagccaacuauauuuucuccuuuccugcucuacaaacuguugagaaauaaagucagaguguuccuuuauuaauaacuguguucaacaagaauuccuauuaaaacuguagcaaaugaucuguggggggguuaauucuaauguuccuagauggauauauuaguacuguauuuguguaaauucaugaaagaggcaguuguauuacaaucucauuccaaucacggcuauugugauuaucaugaaagucaguccuuuguauauuuagguccgauaucuguauaugcaaccaauaucaaacugaagauauucaagaaaaauaaaugcauuuaugcuaagcuuggacagacuuuggguuuuuuuuuuguuugguuuuugguuuuuguuguuguuguuguuguuguuuuuuccgaggcaggguuucucuguauagcccuggcuguccuggaacucacuuuguagaacaggcuggccucgaacucaguaauccaccugccucugccuccggagugcugggauuaaaacagugcgccaccacgcccggcuuuguauuuuguuuuuauauuuuuaaauaauacauuagaagagcuaauaaauaauaucuagauaauauuuuuagguugcuuucuguuucuuuaauauauuaaucaaaacuaaucuggcgauaacaggguuaauaaucuggcuaacugcuuccagauuauaggaacucaagcaggaacagaggcuggaaccauggaggaacucagguccaucugcccaggauuaguacugcucauagugagcugggccccauauguaaauuagcagucaggaaagggcuuuaaaaacuugcucauaggccagucugauggaagcaguuuuuagucaagauuuucuuuuccaauaucuguguagauuuuggucaaguaggcaaaaacuaaauaugacaucuaguacugcacucuauuaagguauugagaguaauauagaaguaauggauuaugguaugcaauuaauuuguaaauacuaugcuauuuuacuuagugggauugaucacuuaaacauuugguauuuguguguaugaaaaggggguccaauauccaauccuccacaauaacaagggauggcuauuaaaagauuauuaucucauaaucuccucuuuuuuggagauuaggucucaaauagagacugaugaguuugccugagcucauaaguuuuuguagucuggacaugaaagaacaaaaguugcuuaagccagaacuuuacuguguucauagucuuugaguaaauauauuuuauagguacaucauauauauuuuucuguguauguauguacauauacuuuuucauauauauuugaauaaaugugugugcauacuuuaugaugagguauaaugaacuauugaaaaaaaacagaagacaacguaucuuugaauaaguaauugacugcugauuuccaaacagauuaucucuacaaggcaguguuaguuacaguaauuaauuguguagacucacucauucuugguauuagcaugugauuauuauuguaggugguuacacuuaaaucaucaugcugaacuggugauuuggcucugcgcuuagacacucuugcuaccuagcgugacaacauaucagaacccacuuaaaggaaggaaagaaugcacuccuauaaaaugcucucugcccuccaaauguacauugugcugcacagacacacaaaauaauuaaguguaaaaaaaacuaaaaauguuuauguuacauaagguucuuucuggaaaagaaaccuauuguguuucuuuucucuuuuuauaguuccucaaauuuaaaguugacuuuuucuuuaaaauacgugauugaggaaguggauagguucaccagaaaggugcuuacugcucuuccagaggagcugaguuuggauucaaauaccugugucaguugguucacaacuauguucuaaauccaggucagggagcaguaucucuggccucugugccuucaaugugcacauacccacauguggacaaacauucuuccaaaauguuuaaguuuuuuccaaaaguacuuuagauguauuccaaagaaacagauaaugugguaaacacaaauugcuaaauaggcguucuuaucuagaaaaucgaugguuaauauuuuaagcaaacuccccaguuuggaucugauuuuaacccauguuaaguuuuuugcugguguaaauuaauuugagacuagaaagaaaguguuguguuuaaagauauaaaguggaauauauuucuaguccucagcuauauuuagaaucuagcaauccuccagaaacuauacuguuaucuaacauuucuaccaguauuauccaggaaaaaauaaaaaggaaacuucacacaugacauacuucuaucaauuucaguucuuauacuuuccucuccuuuuguauuuaaguuacagauaauuaaugcagauauucaauugagaaucuguucaauggcuaauuucccaauaaaaacaaugcauagauauguucuuuuguaaauguuuuaauauucauucuaauuuauuuuauuaagcuucggucuuaucuauuuuuauugugcagggaagcuuugcugaaaaccuuucauuucuucuggaagcuuugcaaaaagguacauguuaaggauucuugauuuuaccuucagucuucucugauuauuuaaguauuacagauuuuuacaaaaaaaucagaaaaaggaaagaaaaagguauggaaguuaaauaauuuaaauaagugaucuaauggccacuguaaugauucauagaauaugauuuuuuuaaagggguaaacucaguaucugugagguugcucagcauguaauaagcacuuagcacacuaucuugacaaccugaguuugcuccucaaagccaagauguaaaggugcccuccaacuuccacaugcucaccauaacacacuagagcauguacacaaagacaucauacagacauacuaauaauucaaauuuaaaaagcuaaaauugcuuaccuguaaucacaacacuuaagagcuuaagauaggaagaaaugggaccgucucagacaaacaauaauaaaauaaauuuucauauuauuugguuauuaugguugucuugaauauaaagaugcuauaaaaguuacauguuuuuguuuuuuaccuaggaaaaaauguuuaaaagauuauucauguauuuuccuggauagguuauaauaggcaaaauuuuagauuaaaaaguaccagguugaaaauauaauugcauaaauaucuuugaagcauguuugagaguccuuuauauccagaguucaaagacaauuacaaaauuguaucuuuggcuaaaagggucagaaaacaucuucaacaaaaucauagacaugaucuucccuaaccuagugaaagagaugcccaugaacauacaagaagccuacagaacuccaaauagacuggaucagagaagaaauuccucuggacacauuauaaucaaaacaccaaaugcacagaacaaagauagaauauuaaaagccguaagggaaaauggucaaguaacuuauaaggacagaccuauucgaauuacaccagacuucucaccagagacuaugaaagccagaagguccuggacaaauauuauacagacccuaagagaacacaaaugccagccuagacuacuauacccagcaaaacuuucaauuaccauagauggagaaaccaaaguauuccaugacaaaaccaaauuuacucaguaucuuuccaugaauccagcccuucaaaggguaauaaagggaaaacuccaagacaaggagggaaauuacacccuagaaaaagcaagaaaguaaucuuucaacaaaccuaauaagacagccacaugaacagaagaaucccaacucuaacaauaaaaauaacaggaagcaacaauuacuuuuccuuaauaucucuuaauaucaauggacucaauuccucaauaaaaagacagacuaacagacugucuaauuaaacaggacccaacauuuugcugcauacaggaaacccaccucaggcacaaaaacagacacuaccucagaguaaaaggcuggaaaacaguuuuccaagcaaauggucccaagaaacaagcugaaguagccauucuaauaucgaauaaaaucagcuuccaauccaaaguuaucaaaaaagacaaggagggcacuucacacucaucaaagguaaaaucuuccaagaguaacucucaauucugaacaucuaugcuccaaaugcaagggcagccacauucauuaaagaaacuuuaguaaagcucagagcacacauugcaucucacacaauaauagugggagacauuuuuuuuuguuuuuuuuuguuuuguuuuuuguuuuuuuuguuuuuuuugccaaaauuaucuuuauucucagaucauuuuguuuuauuaucgaaauagauaaaccucuuaaucuuugcuugaaagauuuuacauaaauguaaauuauguauucuuaaagucuuaauuuucuauuagagaaguuuccauucaaaguaaaaagagaauguauugaguccuacugaacguuuccuccugaaugaaauguuaaaacuuggauuaaaaagaauuauuguggguuuuuuuaccuuguuuuuuaaauuacacuuuauauucuagaugguguuuguagagauaacuuaaauggcugaaaauuugucuuaugaaacaguuuuuauucauuagugacuccuagaguguuugauaauacugaaaaauuguaauuauuauuauuuuuuuauuuauuauuguaauuauuaaggaacuacauuuucauaauuauaaaacuauguugcaaauuaauuuucucaauuuauuucaucaaacugcuagacuccuguaaacugcuuuacaacaauggccaucuuuguccugagucuaacuucuuauguagaaguaagccugcauguguaaaugcccugcccagaguaacuuaccaauguguguugaccugaaauuuaaacugagguauaacauuuugaaaauacaagaaaaguuuauguaauuucuugucaaucuaaacucuuuuuuuuuucuuuuuuuaggugaccggacuagcaguugcccagugaucuucauacuggaugaauuugauauuuuugcucaucagaaaaaucaaacacuccuuuauaaucuuuuugacauuucucaaucugcacagacaccaguagcaguuauuggacuuacauguagauugguaagucuguguagauuucaaaaauucaaucuucauuauacugacauguuauuuaacuuaauauuuuugaaauuuaucuuucuuccauucuuuauacauuaauacugcuuuccaguugagguaaacaagaaaagauugcuacauguucuauaaacuaugauuuuaguccuaccagugaaauggaauaaaacucuaaaauacgaauuaagugagauaucuacucuggcaaguaaaggaucaguuauguaauagcaguaauauuuuauacaaauugguaauauauuuuacuuuuucauacaagauuaauuuucaauuuggaauaaaacagucgaaugaauucuugcuuuggcauagguuuuuaaauggucuuaccugaauuccuaaguaaggaaaauuauagacacuuacaugagucuuucuguguuuaacuuuuuugcuguuuuguuuuugucuaauccugagaacuaaaucuaagacauuacacauaguagacaagcacuguuacuacugaauuguauucacuauuuugauagcaaaauucacuuauaaguugcucugacuguccuuuaacuuauuguaagucucagaaagaucuugauuuugugaucacucugaggacagguuacaggauuauacuaccagaacuaucuguaucuacggugugcacuccuguauacauguaaaacugagaaccuucuuuucucuaacuuacuguaaaugcuaugucugcaaauuucuucacgguucccauuucccagcuucuuauuucguaguuuuauuucaggcuugcucauuucuuuauuuuuuuccuacagcucuuuuuccuuuuuauaaauguucuuucaguugguuaauucaucuuuuaacaauccucccucuguuuuuuuaugaaauuuucacuuuauugcuuuucucugaaauuucugucuuugacauguuuuuaaauacucuuugguauacuucaugugcuuugagaucauucuuuuguauuuaucauugauacuuacucuacuuaucuucuccccaaauaagaagcuaucaccaggcuaaaagaaacacaucuuucuuuaaagaaacggauagggaacuggagcugagcuugucagaugggaggaacaaaaucaaguccucaaaauauacuuauuugccuaaagggaaugggccugacaacccacuugcaaucccagaagucuaagaccuaccauguaucucuagcgcaagcuaucugaccaaacuagucuaauugguggacuuggggguuaaauugagaaucuaugccucaaugaacaagaaagaugggaagccaugaugaauacucuugaccucaaacucaggccuacacacauauacacacacacucauauauaugcaaagcaugacacauauacauaagaaaauaauccuuugggugaaaauaucaugaagauuugaauucagacuucaacacacauagaugugggccacuuuaaacaagcacuggggagauauauacagaauuuuugugccuucuuagccagccuaucuagcuaaauaagcaacccuugggcucagugagagucuugcuguuucuguccuuuuuuuuguauguggaugcaauagguauguaaaagguacauguacuguagcauguaugugaacaacagaauaacuuuuaggagucccuuuucuccuucuaccaugugagucuggggaucaaacuaaggaccucaggcuugguagaaagugucuuuaccuucugaaccggcucacuguuccugagaaucccugucuuaaaaacuguaaaccagagagcaguugagccuaacacccagucuuaaccucuggccucaaacacguuccauauacaaacauucaugaguagcuuaugcauauuuuucuaauucuguauuucuuuuauguugaaucaugcucauauauauuuauagaaauauauauagagagagaaaaaccaaagaauagguauaaaaacaguugcuaugucagcaagaaacccuucuuuuuaaaauuucacuuuaguguuugcuuuugcuuuaucaucccuguagccuuguauuuguaacuucugucauuacugacuaacacuggagcagcuucucaguuccuucuuuucuccauucucggaagcaagauuuuuuucuuugcaguuccuucuuacuuauuuggaaggugcaugccaugguggacaugugacugcccaguggcaccuuggaggagcugggucuccuccuagugccguggguuccuggaauugaauacaaauccucagccuugacuucaggggccguuucacucuuagccaucuucccagcacccaaguacagguucuuaauauuugcuuagaguuugcuuuauuaaucauugccuuuccacuacuuauuuauacaaguaacuuacaacuucucuuuaguagaaaauaaauugguguguauacuaaauuuagaucuuuccaucuugucccuauaauucagcaguugucacuauaauacauuuaaaaacauuugagguauuuguuuuucucucuuugcuauuugacuuccuaaauaaccuaagauuacugaaauuuuucaugcauaucauggcuuauuaacccuuuugcuuguuuuacuuuguuaggaucauucagguaaaaaacaaaaaaauacauuucuggagccaguaccuuuuuaaaaaagaaaauuuuauuguagaaaaucaauucuuguuggagauaguaguauaaugaggcucucuccagcauuuauuuaguaauuuuaauaacuacauaaaaugaucuaaucuaugucugucuucccuguaaaauguugaggcaaaacaauaauaauuucaucucaugguuauguuuuucaguauauuguaagaagaugagaaauacucgaaguucauuugcauuuaguuccaccuuaaaaauagacaauaauuggauggagaaauggcucagccuguaagagcauuuguucucauuggaaaggaugagaacucaguccuuccacucaucacagcagcuugauaauacuguaguucaucaaauagaauuuugcuccauuguacaucauguuucuugaaguucuuaaacaaaaucaugaagauaucugaauuuuuguuaaugguagcaaaucucauagcauuuuguuaccucagauuuuuuugugaauuuuuuuguaggcugugcagaauuccacacuggugugcuuaaugucucucugaucaggaacaguagcuguuuguauguccuuaguagguuugagaauguuagcacucgauaaugaggccaaaaugcaaucacaaugauacuggugccuagaaaggaaucauuuaguucaguaguuaucaauuugugguuugcaacccauaucgggguugaacaacgcuucuacagagaucaaagggguaagcugagaccauccuucauaucagauauuuguaguauaauuuauaacaguagcaaaauuacaguuaggaaauggcaaugaaaauacugucugggggucaugacaacagcauuagaaggguugagaacacugacuucaguuccucucauuucacaugcuuacuuagacauuauacauguuacgaguuacaagcuauaguuaacuuacuaucuagcagcauuuuuaaaauuaauuuauguuauauacuccauauuccauuccgcuuuccccauccacccucugaaugcuccacaucccacaccuccccaaacccccuaccuccauguggaugcccuagccccaccccaucugaccucuaaacucccuggggccuccagucucuugaggguuaggugcaccaucuuugaaugaacacagaccuggaaguccucuauuguauguguguugggggccucauaucagcuaguuuaugcugccuguuugguaguccaguguuugagagaucucggggguccagauuaauugagacugcugguccuccuacagaguuacccuccuccucagcuucuuucagcuuucccuaauucagucauaggggacagcagcuucuguccacuggguugggugcgaauaucugacuuucagagcugcuuguugggucuuccagaguacagucaugcuagguuccuuuuuugugagugcuccauagccuuaauaauagugucaggccuugagaccuccccuugagcuggaucucacuuugggccuguuucaggaccuucuuuuccucaggcugcucgccauuuccaucccuguaauuuuguuguuguuguuguuguuuuauuuguuuguuugguuuuucgagacaggguuucucuguguagcccuggcuguccuggaacucacucuguaguccaggcugggcucaaacucagaaauccaccugccucugccucccaagugccgggauuaaaggcaugcaccaccaccacucagcccuguaauucuuucguucuuaauagcugaguagcauuccauuguguaaauaaaccacauuuucugugucuauucuucuguuguggaacaucuagguuguuuccagcuucuggcuaucacacguaaggcaugguggggcaucuuuuggguauauuuccaagagugaaauagcuggcagguacagcuauuuccaauuuucugaggauccuccagauugauuuccagagugguuguaccaguuuccaauccuaccgagauuggaggaguauuucucuuucucuguauccuuucuaauguauguugucaccuagguuuugaucuuauccauucugauugguguaagguggacucucagggucauuuugauuuacauuucucugaucacauuggguggaggacauucuuuagguguuucucagcuauucaagauuccucaguugugaauucucaguuuaauucuauaccccauuuuuugauugguguuugggguuuuuuggugauuaacuuagguucuuuuuuuuuuuuuuuuuuuuuuuuuagauuucauuauuuauuauauguaaguacacuguagcugucuucagacacuccagaagaaggagucagaucucguuacggaugguugugagccaccaugugguugcugggauuugaacucuggaccuucggaagagcagucgggugcucuuacccacugagccaucucaccagcccaucaauucuugaucuuagagcaugaaccacuggaguucuguucagguuucccccugugccaaugaguucaaagcucuuucccacuuucucuucuagaaagauucagugugucaguuuuuauguuaaggugcuugaucuacuuggacuucagcuuuuugcaaggucacaaauuuuuucauuuuucuacauacagccagccagcuagaccagccauuuaauuuauugaagaugcuuucuguuuuccacuguaauuuuuggcgccuuugucaaagaucaagugaucguaagugugguuucauuuccaagucuucaauucuauuccauugaccaaccugucugucuuugugccaauaccauacaguuuuaugaugauugaucuguaguaaagcuugaggucagggauggugauucccccugcuguucuuuuauuguuaagaauuauuuuugcuauucugaguuuuuugccuuuucagaugaauuuaagaauugcucuuuccauaucuuuccauaucaagaauuguguugggauuuugaaggggaaugccuugaaucuauagauuuccuuugguaggauggccauuuuuacuauguuaauucugccaauccaugaucaugggaagucucuccauuuucugagaucuucgauuucuuucuuaagagauuugaaguuauugucauauaggucuuucccuucuuugguuagaguuaccccaagauauuuuacauuuuuccugacuauugugaauggagaugcuuuucugguuuccuucucagucuguuuauccuuuguauaaaggaaagcuacugauuuauuugaguuaauuuuauaucugaccacuuugcuaaaguuguuuaucaaccagagaaguucucugguagaauuuuuggggucacuuauguauacuauccuaucaucugcaaauagugauacauuuauuucuucuuuacaaauuuguauccccuugaucucuuuuuguugucuuauuguucuagcuagcaguuccaguacuauauugaauagauauggggagaguggguauccuugucuugcccccaauuucggugggauugcuucaccuuucugaauucugguagaauucugcauuuaauuugauauuugcuguugguuuacaguaaauugcuuuuauuauguuuagguaugggccuucaauuccugaucucuccaauacuuuuaacaggaagggguauuguauuuugucaaaugccuauucugcaucuaaggagaugaucauguacuuuuugaguuuuuuaauauaguuuauuacauuaauggauuuucacauauugauccaaccuugcaucccgggaaugaagccuacuuuaucaugaugaaugauuguuuuaauguguucuuggauuugauuugcaagaauuuuauugaguuuguuuguaucgauauucauaagcaggauuagacugaaguucucuuuuuugguuggcuccuugugugguuuagguaucagaauaauuguuucuucauagaacaaguuaaguaguguuccuucuguuucuauuuuauggaauaguucgaggaaaauugguaucaggucucuuuuaaaggucugguagaauucugcacuaaauccaucuggcucugugcuuuuuuugguugggagguuuuuuuaaugacuucuucuauuuccuuaugugauaugggccuguuuagauaguuuaccugcucuugauuuaacuuugauauguggcaucucuuuagaaaaccauccauuucaucuacaugucccuguuuuguuggguauagaucuuaauaguaggaucucaugauuuuuuuuuuaauuuccuccguuucuguuguuaugucauuuugaguauagacuuuaauaguaggaucucaugauuuuuuuuuaauuuccuccauuucuguuguuaugucauuuucauuuuuuaguuuauuaauuugaauucugccucuugacacuuuaguuaguuugacuagggguuuaucuaucuuguugauucucucaaagaaccagauuuugguuuuuuugauucuuuguauuguucucuuuguuucuauuugguuuauuucaggcccugaguuugacuauuuccuacugucuacuguucuugguugaguuugcuucuuuuuguucuagaccucucaggugugcuguuaaguuguuaguauaagaucucuccaguuucuuuaucagggcacuuagugcuaugaacuuuccucuuagcacugcuuucauuuugucucauaaguuuggguaugguaugucaauauuuucauuaaauuccaggaacacuuuaauuucuuuuucuuaccugaccauguugccauuguguagagaaauguucaguuucuacauauaugugggcuuucuguaguuuuugcuguuauuaaagaccagccguaagccauggugaacugauaggaugcaugguauuauuucaaucuucuuguaucaguggaggguuguuucgugauaaauuauauggucaauauuggagaaggugccaugagaugcugagaaaaagguuuauucuuuuguuuuaaggugaaauguucuauagauaucuguuaaauccauuugguucauacuucuuuuaguuucacugugucucuguuuaguuucuguuucaaugaccuauccauuggugagaguggguuguugaaaucucccgcuauuauuguugggguucauuguguguuuugagcuuuaguaaaguuucuuuuaugaaugugggugcucuugcauuuggggcauagauguucagaauugagacuuucucuugguggauuguccccucgaugaauuugaagugcccuucuucaucacacuugauaacuuuugguugaaagucuauuuuauuggauauuaggauggcaacuccauuugcuugggggaccuuuuuccauccuuuuauucugagauugggccugucuuuguuauugagguauuuuucuuguaugcagcaaaaugcuggaucuuguuugcauauccugucuguuagcuuaugucucuaaaggugacuugaguccauuaauauucagagauauuaaagagggacgacuguuguugguuccugguauguuuguuuccuuaggucgcuuuaugugcuugugacacucugcuucugacuuuguugugagaugcuuaguaacuuguccuuucuuugguguuggaguuuuccuuccagaauccucuguaaggcuggguugauagagaguuuugcuggguauaguagccuaggcuggcauuuguguucucuuagagucugcaugaccucugaccagccucuucuggcuuucauagucucuguugagaagucugguguaauucugauagaucuaccuuuguauguuacuuggccuuuuucccuugcagcuuuuaauauucuuucuuugcucugugcauuucuuguuuuuauaauuaugugacaagaagauuuucuuaucugaucccauuuauuugguguucuauaugcuucuuguaccuuuauugccuucucucucuuuauguuggggauguuuucuucuaugauuuuguugaagacauuuucauguccuuugagcagggaaucuucguucucaucuauucugauuauucuuagauuuggucuuuucauuguuuccugaauuuccugaaugcuuuggguuaggaguuuuuauguuuugaauuuucuugacaguuguguccaucucuucuacuguaucuucuacaccugagauucucucuucuaucucuuguauucuguugguaauacuuauaucuguaauuccugaccucuuucauagguuuuccauuuccagguuugccuccauuuguguuuucuuuaauguuucuacuuccacuuuuaggucuuguguaucacuucauucaauuccuuuaccuguuugccugugguuuucucuauuucuuuuagugaguuauugauauacuccuuaaaggacucuauuaucuucauaagauaggauuuuaggacagauuccugauuuucaguguguugguguauucagggcuugcuguggugugagaacuggguucugaugaugcccaaauauuuuggcuuuuguuguuuguggucuugcauuugccuuucacuaucuggauaucccugguguuuguuggucuaggugacucuaugaagucugccucuuuugucccuggguugcuucaggucucagguaggccugcugcccuggcuguaucagaccaccuguggagccuuccaaacugggggcugcugaucuguugcccuggcugcaguagaucuccugggaggccuucaguccacugcucugagugaagcugguccucuaggauagaucaggauagggaaacuuuacuggagcaaaccaaacuaggggucugccccagaagcaaggaccgggcugaagggguagaagggauggaaagggagggcagggguuuggugggugauguguccugaguccaccaggcucccaaggguggggguugggggggguggggguucuuaccaacuucucugagugcaggggguucucuaggauggaucaggauauggagugugcaggggagcagaccaacuagggcuaggggucugccccagcaccaaggaccaggcggaagggacuaacagcauuuuuucaacaugcaucuuauaugaauuucauuuuuguuuucaaggauauuuuggaacucuuagaaaagagagugaagucacgauuuucucaccggcagauacauuuaaugaauucauuugauuuuccacaauauuugaaaauauuuaaagaacaguuaucucuaccugcagaauucccagauaaggcuuuugcugagagauggaaugagaauguucacguaaguuggcaauaaucacaaagcuguauuuaucuuuacauguuacuaagggaccggaauuauaaacuuuuucuuauuuaaaagcaauagaauauccugucuccuaaaacaaucucuuccaaaaaacuucgggugucaguaguugaaguuuuuaauccauaccugguuuacauuuuagauaauuuuuuagugaauuugcauagucuaaauuuuauaaauuuuauaaauuuagaaagaaacugcauugauauuucauauuucuuucuuucuuuugauuuuuugagacaggguuucucuguguaucccuggcaguccuggaacucauucuguagaccaggcuggccucaaacuccgaaauccaccugccucugccucccaagugccgggauuaaaggcaugcaccacuaugcccagcuaauauuuauuucuauauauguuuuuauuuuauuuccaguucuuauaaacaacuuugcuuugguuuguuagcugauagugacucucggcauuaguuuauuaagacacuguccaggcugugguuccgcucuuauguauuccgggcaaccagacagccagaccuuacuugggaaacuacaucuuguuuuacacagguucagugcuuagauauaauuucuuuuuauuuuuaacuuuguucugauucauaauuccccaccuauaauaaucauuguuguaaaaaaaugcauaggaaaaucuauuuacgauaggaagaguuuauuuugagauuauguaguugaguuugaggauauagagguggagaagucauggaggccaagagcuuucagcagcuggucaguagcaucugcaguuaggagacagugauggauguuccuauuuagcucuuucuccuuuucacccagaaucucaacccauguagugcuacccacagucgagaauguuagucgagaguauuagucacuguuauuuugaugugaagagauaccaugaccaaagguaacuuuuuaaaggaaaguaaauuacauacuuuagaggcuauauuagugcuucagaggcuuauucuauuauuacagcagggagcauggacacagccaugcauagugcuagagaaguagcugugagcuacauccucauccacaagcagaggcaagggaaagacacugagccugucaggggcuugugaaaccucaaagcccacucccagugacacacuuccuccuacaaggccacauuuccuaauccuuucaaacaguucuguuucuuggugauuaaugccccaccucauuaaacuaaucuagauaauccuuuacaggaaugugccacaggcucuccuaauccugauaauuucucauuaacaagucaacagucaauauuauccaucacaaccacuauauguuuauauuaagauguauaauaucuuaauuuuaagaguaauuaguuugggucuuccaucagacuaaucuuucauaggacucagaagauugcuaacuaaacaaguuuucucguauuaaaaccgugucugaugcaagaucucuauggggcauguuccuuguaguuggcacuucacauuguucuuuuucuuacuauugucuggaauuuaacaucuaggucccuggcugcuugcuuuacuucucagugccuaacaggcuuucauucccuuucuauauccccugagcucauuaaaaacucugucauguuuuugagaaauuugaaugcaguuguuccuuugcauuuaaauaucaguuuuccuguugauauuauuauuuccaugccuauuuucucucuuuuccucuggugacuuuacagccaaggccaucauccaucuguuauauugugagugucuauaacuauauauguauuuuuuaaacccaugggcccugcauugugaggugcaaccacaaaugaaaauuaaagcgaauaaaauagugacaauuaugugguacauaaauggguuuuuauuuguuauucccuuaauaauuagguguaauaaugaccuagcugcaguuuuccucguuacaucagcugugauuugccgacaaccugcuuucaguuuucuuguuguuuuuccagaauuuauagcccccaaacuuaaaugguacaugguaggggaugaucucuuucauuguggcagucuuguagcuuuacugaccaaaggagagcuaucacuauuaggguuuagagcucuuauuuucuucucuuuagacaaucaucuugaguugcuuugcauggauagguauuuuuguaaaauauacuuagaaagucugucaguaacauggccagaguccuugucccuuauugagugaguuuguggugaaggugguuuggggagcuagccucuaugccagugcugacauuguagugagcuuuuuguugguuuguuuacuugcuugcuuagguuuaagauaaaccuguaguuucaaccagcacuuuaaaagcaauagaaaaugaauauuuaaguaggaaauaaaucugcugaaaauguuaaacuucauuucaagagauaaaagcuuauucccuaaauuuagauauuuuuuggguaaaagaagcaaaccaugguguuauagcuccaguagggaugaaaacauuuaguuuucuggggcuuuugacuuuuugucauuguuuauggagguuuaguucaguuuuuauauuuguugggauuuuuaauggucuuuuaauuuuuuuaacaugccauacaauguccuucaauuauauggguugguuuguuuguuguuguuguugcuuuuuuuuaaaaacaacuuauccuguccuaauagugcuaaguauagacuuggucguggggccaucugcuggagacugcccagccugucaggaacaacugacucuaccucuccuagaaccuaucaaauguccuagccccucagccaauguuugggggcucaugaaccccuucccauauugugcuagaauaaugcuaacaggcuugauaguguccagauagccacagcuaccaugaguuaaugaauuagcauuucuacucuggucuuccuugcccuuuggcucuuagaaucuuuuuucccucuucugagauggucucagaacuuugggaaaaaguuguaauauauagauauuccauuucugaccauauacuaaucagucacuuauacucugcacuuugaccaguugugaguuucuccauuaacuaccaucugcuauauaaucuuuuuaaaagaggucugagcauuguaccagauacaaauuuagagggcaguuugauacaguguccauguaguagaauaguagaguaaagcgcuccagccauagguuuugggccuaauuuacaguucuaggcauguuccuccuguagagagucuuaaaucuaguucauauuugcagcccuacuccucccaugggcauagcuugccaugcugaucaugguuuuguucugacuuguagccagcagaggacuuuugaaaaauuaugccaagugccgaugcaucuuugcuuacuuuguuaaauucacucuuuucaucucuauuccuuaccuuccauuaaaucccauuucucuagaauugucucucuauccauuggcauuuucuuaauguaccuuguaaaguuuuaaaaauuacuuuguauuauaucguugauuaucucuucccucuugaagcuucuucgcuugugugaugauuaaucuucaugucauugugacuaguuuagauggccauggaaacacauuucugcaugcauguauuuccagaaaaaaauuaacuacagagagaagaccuauccuaaaugugggugucaccauuccaaugugcuagaguuccauacugaauggaaaggaaaacaugagcuaagaacuagcauucauuuuugccuccuuccugacagugcauauacacuggcacaugcugccuuaagcuccuguaaugguaccuuccccuccaugcuggauuguacccuucaaaaguaggaccaaaauaaacacucccuuaagcugcuuuauugugaggaauguuuaauguauacagcuuguuuucuagauuguugugguaucuuguacauucuuacaggcuuuagugugucauuuuucacugcuccuuuuucugucuaccacucuauaacuucuugaccacagcuuacucugcacagauacucugcccacccccauaguucaucauucucaguuguuguuuccuuuucaaugaaggcuucaucaggcaagucuucugugaaugucugaauucucuccacaguuguaauggccucuaguugggcuuucuuuuuucuuccuuuucaaucccuuugcagauagcugugcuuaagguauaugaugacaccguuuuguugucacugugacaugaucuuguuucagcucauguucuuauagcucuucauaauuuccccacuauauucuuguaacuccacuguuuucucaaauauuagaacucuuauucucuguugugauuugugcuacauucuuuucauccaucucacuaguuuugacuauauaguuuccccauuauagauugggaauuugggaucaagcuauguuuucguugauuuuguuguuuuuguuuuuuagugucucucugaagauucaacugugcuugaaguccuacagaaacauuucagugucaacaaaaacuugcagucauuacacaugcuauugguuuguacuuuuaccuaaucuaugaaaauaacuuauacauauuauggaugauuuuuuuauguauaaguacauacguauuaugccuauuuugcauauaaaaacuauacauauuaauggacuaucuuauguuuugauacauucauuaauaaucuguauuaacauuuugaagugccuucaaacaguuuucaauacuagcuagacuauuucagcauucccaccaauaguauguaacucaagaguacuacuuauaucuugauauaaaacuuugaaucuuauagaugcauuugaggagaaaugucuuauguccuacauuaauuaugcugguauuugaagauaaugcacagcuuacuuguagaguucuuguuugguuauuuucauugauacucuguaguucuccagcagagauccagagcaguacuuuaacuguaucauucuuaagcaucucacuuuccuuuaaagcaguugcuuuaugauuaggauuuuuauuguuacugcauaaaaaugugauugggcuuuuuuguauguuaauuuuauguucuucauucaguuuugcugaacucucagacuuguaaaauuagauucuuuaggauuuucuguggacacacucagauugucuucuaggaaggaggugugucuucuuggucccuuuguagucuuuucuuuuuucuucuuuuccuucccuuucuuuuccuuuucucuuuucuuucccuuucccccuuuccaccuuuccuccuuucuccuccuuuucccccuuuucccccuucuuuuccccuuuuucccuuuuuucccucuuuuccccucuuuuccccuucccccuuuccuuuccccuuuccuucuucccuuuccccuucuucuuucuccuucuuccccuucuuucacagcagguaaauggcaaagcuggaucuccauuuagucuguuuuaaucaaucuaauggcaugucucauaauuuucuaccaugguaucuuuacugauucuuauuccccacaucggcuuuuacuaaggaaugcugucuuucucuaaauaaacuuccuaucucauuaguuuaauucccuucuacccaucaaaaguauacugucauuuuuagcaacuuggcuauagugaaguuauggauuaagaaucuuuauguauccauccacaaauaaagaugcauaaacaacauuuuuuuuuuuuacugcagucuuuuuuuaucauuacaaaaaauaaaaaauggcauguguuuaucaacaggaagugaggaaaugugaguaauuacaaaggaguauaauagaaaaugaaugaacuagaauugaaaucuaaauguggauuaauucucauuuucauuugaagauaaguucuaaaacuagauugcauugguuauagaacgcuuagaaauuaaauuguguuaucuauuaauaccugcaguauagaguuuauaguuuauaagaauauauuaauauaaagauauugacuauuuuauguggcaaaaggugcaguacacucaaggccacugugcacaacucuguaacagguauauuuuaaaaauauaaacguggaauauuauauauaauucuguuuuguuuuguuuuuuuuaauguaagaaauaccuuacaauaaauggaaaaaaauagaaaacaaaagagccacaaauggucugaguuuuaacuuguagaagagugaacuucagggauucccaaccucuugucauuaacuguaaaguaucugaaguccccauuuaaccugaagcuguauguuugcuacaucuaucuaucuauauauugcuacauaauacaucuacuacaccuacaaauucuaaauucuuguauuccaaauacaaaucguuaauugaggguaaacuuaguacuagaaggugauguuugccuaaagagaacuaaaugaagaggauaauugucuaaguuuauaauuguuuucaaaauuaguaacuucuaaacugaacuuaccuuuacauguuuguaaaaaucuguauaaaacauagcuauucuuuuaaggugugugauauuugauuaguauucuuucaguuuuuuucuuauuagacuuuuuaaaaauguuuuuucuuuuggagaguaauaaauuugauuccaaugcaaaguaguagagaaaacagcaucugaacuaagucauugcuacauuuucauggagcaaaguuuaagguuauuuaccuaguuucuaucuuacaagaauaaacuauaagacauuaaauaagauuguucuaaaauaucuccagaauauucaaguaaauaaguacuuuuuaaaauacaccuuucuuuagaugcuugcuuuaaaucgaguaaccguaucacacccauuuaugacuucagcagaucugauggaggcacagcauauguguagcuuggauucuaaggcgaauauuguacauggugagaaacugcauugcuaaucuuucuuuugauguuuugauuuuaaaaguucagauuuagauguuuucugagauaaugaguguugagcauggugcucuguauacagaaugcuuuuuauauacaacuuuuaauugauacuguaauaaguauauuaucacucuuuguguucugcaucccauaccacauggggaguccagguaggacuauuguugauguucuccuugcuuacccuaagugcuauuauauuuguugacacuugcucauuugcauucacuaucucuuuugaaauauaagauauauuuuagaucuguuuuccagaaauucucugcauaaaugcuucccaaaggccuaugauacuugaaauuacaugauauucacaauauuugcuguuuguugugguaucaaaucuuuucuacuuauagcacauuccuugaaguuuagaaaaaaaaauccuuauguuguagaucaucccaccccuagcaaaaaggccuuaaagucuaacaaguuaaaugacucguguuuuuauagauaauaguuguuggaauaccuuuaaaaauagagaaaugcugaccucuacccuucaaaaccuugcguuauuuucuagauaacaguuuguuuagugguaugaacccuuggcugaaacucaggaguccaucucccuuuaauucuaggucugucagucuuggaaaucugucuuauaauagcaaugaaacauuuaaaugacauauaugaagaggagcccuuuaauuuucaaaugguguauaaugguaagaugaagugcaucauuuucuuguugguuucuugccuuuuucuuauuugaaaguacuaauguucucauugcuuacucugcagaauuucagaaauucauucaaagaaaggcccauucuguuuauaacuuugagaaaccuguggucaugaagguaugguuugauuugguuguauuuuucaucagauccagcgauuuuuuuuuuuuuuuuuuaacuugcuucaaaacucuuugaacccuugaguauuuuauuauaggaauuuuuucagcaaaauguuauaaaaugaacugcuucaauaauucuguagcuagcccguuuuacaguuugugaagauauauugcccucugcugucuguucuuagcacuugcccacugaaaaggaacuaacccucugcaguccacaaguuggcaguuacaagaugucaaguuuauuauuuaggguaagaugucaguuuacaacuuuaaaaugacauccuaaaauauacuccuucacuacaaagaaaauguaaaucucauauaauuuuacauuuucuauaggcauaggaaauaaaggucaaaaaauuguaacaguauaacccaauugaugaaaaauauuuucaaauuuaugauaaaaguauuuccugaacuauuuuccuuugugucuuuaaaauuugguauauuuauaaaaaguuacagcagauuccauuuuaguaaauguacauuagaaauucauucuuuuaaacucauuuaauauguagcuaaaaagacugauuuauauuuuaaaauuauaccaacuauauucauuuuucuaaguaauuuagucuaagcacuuuaagcuuauauuuauuuaauggaaauuaaauuaaacaggacacauuucgagguccuguuuguccaguguuguuggcacagugugguucuggggaccauauggaagcaaaggccuuuuuuuuuuuucuuguaaagcaauacaagcuugggccuuggguauuccuuguacagcacagcuagaacuucauuuucuguagcaguuguuaaaaagugagcagagucuuguauucaggccacagcaguccuagcauccugaggguagauccuucucauuguugcaguuuuggaaagggcaucugcacgugucugggaauaauuuguagaugcucuuuguacauuuuaaugcaucuuggaaauauguuuucaguguuguuaagcuacaccugaagaauuuaauauuuucucauuauucaagguuuuuuccucccaguaagaauuuuuaugauaaacagaauaugucccagugauacuuuucacagggaacugugagaaugcucaagaaucuacuucagugugucccgauucuaauauuucaucagaguauaguuuuuccuucuugucuuauuaacauucuuaaacaauuauuaagugaugcaugaguuguagaguaagaggaaccaaacaaugaagagcuccauuaaggugcuaagaagacuggggguuaaacaaacaugguccccugucccacccccuggucuuugcaaucuuacaagguccuuugcuuacaugaugagcccaguaggcuuuuuguacucuagggucuuucuuaccucuuguacuauagcuguuaacuuuuaucuuuuuaaaauuuuauuuaauuuuuuauugaaaguaguuauuuucaugcaucuaucagucauggauucccuucuuucagauucuucucacccacgagccccucuuuuuuccucucucucucucucucucucacaaaaagacaggcaaauagaaaagaaaagcaagaauaaaacagcaaacuaacagcagaaagagaaagaaagagcaucgguagaaagcauucacacaggcacacaaaaagaacccgugaauacaaaauuggaagccagaauacauaagcuagagaagagaacgguacgggagaaaaugcugaaacaaagccauaugaaacugaccccuacacauacacacacacacacacacuaaaucuuuuggguuuauuuuguauuggcuauccuuaauccuuaugguccauauccuuaaguauaguuuguauacccagagagauuggagaacuauuuucuccuuugcaaacaauuguaauuggagguagcuucuugguuagagcaagggagucuaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacaauuccccaucucaacacuugagaccccaucugguuuggacagugguuuugccuccuuuuucacagaguuuccuugauccuugaaguggaaggcucugaugaaaaacuuccauuuaggacuaaguguuugaaggucucucauucugcacauguuccaguugucucuauuaguucccaucugcuuuacugauaucuaggcagcacacuguucuauugggauaucuagcuguaccaucucauuccaaagucuuaucagauuaagguuuuaagaucaaacuaauagacaaaggacuggagcuacaaagcucagguggaauccaugcugagcauaaguaagauuuagguacaguacuaaucacccaccauuggaaaaguccaaaaggaaucuaugauauacagucugccuagaaacaaaaccucaugauuaagguucagguaaaauuaauauuugccugauuuacauugagcauuauggggacauauaucaaaacauguucuccaaauguacaguucuuauggguuugauaaacuugugucugagggugggguagggcuauucuguuuaguggugcaagguaagcacuuuauccugcugagcucaauucccauuccuaaggaugauuguuaacucuauuggugaccuuuccauucuauuccuuuuuuccucugugugucaugagcaaaguuggaguuuauuaggaaagagauuuuagcgucagaucugcccuggugacacacaguuuuaaucccagcacuucagaggcagaagcaaguggaucucugaguuggaggccuggucuauaaagcaaaauccaggacagccaggacuauacaaggaaagccugucuucaaaaccuuaauggaugggcgaaugaagaaaagaucugaacauaaauucaagugugaaugguagagagaguacuuaggaaaaaggcaguucagaugugcugauuucuccucccucuuuuccaccugccacuguuucacagcaauaacuauccucuggguuuaacacguguccccuuacaucuaagcuuugucuuuucucuugcaggcauuugagcacuuacaacaguuggaauuaauaaaacccguggaaagaacuucaguaaauucucagagagaauaccagcuagugaaacuacuuuuggauaauacucaaauuaugaaugcucuacagaaauacuccaacugcccuacagauguuaggcagugggcaacauccucacuaagcuggcugugaagauuuuaaguacauuucugugaagaccuuaaaguacuguucuuuauuuaauaagauacgcuacuacauugcuuuguuuauaaauaguuuaugggaaauuugcacuuaguauguuuugaauaaugaccacgcauggacacaguuucauuaauuuaaauugcaccacacaaguagcaguucauaagaauaaaaugugcuuauuuuacgcaugguccauaaaaugauuugauacucuuuuaaaguguaugugguccauuagaaagguuaauuccaacaaagcauuuaguuuacagaucauaauccuaagcagucaggagagaaauacgaacagaaauuacaugaggaauauuccggcuagauuaggcgccuguggauauuggaguuggguugauuuuccugaauugguuccuauaggauccuccaauuuuggaucuucuacagaucccccaguguucuaguuuaguaaacuggcccauuugggcugaagaacuuguguggaaagaguccaaacaacucaucauuuucuucucugcauaucucaccacaauuguaggauuuuuuuuuccauguacauucuuuguauauguucagaagggaucaaaauugccaucuaacagguaccuuaaaggauuccugggcaucuacuuccacaacuaauacguauuccacaguguuggcuguuggcuucaaaaaaaggaauucucuuaacaugcuauguuggucagcguccaccuccuaagcucauaggcaaaacucacagguuaaaauggaauuuaaucucagagauccuuuguucaagaauauuugauugcauauuuaguuguaguaagauuuuauaaaauacauaauccuuuguaugugcaguuuguaaaguaucugcagaauuaaaugcucuuauuuacagaucagaaaacuaacaccagugucaggaucacaguaugggaaugacugaugugaccuugaaugcagcuugguuugacugacauuaaagccaguguuaaaaacuaaagcuuagcaacaaauguuuuacuauuuuuacaggauacuguaaggaauaauuugacuuuuaagaaaucuuaaauauaaauuuucugugcauuaauguaguaccucauaguuaaaacuuucuucauucacagccuuucccuuucacaguaaaacaugcuuagcuuucugugucuuucuuuuagucaugauaaaaaugaagcuguaauaucaaggucauacaaguauaaacauauauguccaauuuuuaaacuacuuccaccuuacaaguuguucaaaauacauuauuagauaauucuaaagugagaaaaauuagauucuaaaacacaaaucacaagaacguuugauauugaagugucuggcuuuaacaugugauuccacaagaguagaagcaagaaagguauauacuuuuaggagccuaaaaaacauuuccaaacuagcccaagcuaucucaacuacaggagcggagggggacgaaugauugugaacacaaagucugacuugaagauucucugcaaugaagagaauucauucauucacucugcucaagacuccacugggccaagagauggaagaacaaacaaaaaggacuuuccauguagccuuccuccauguggccuagugaaacauggaucuuguuuaaaaggcaucugauuuuaugcagacacgugucugaaaaauuaaaauccauuguccaaacuuccauacauuagguaacgucuuauaauguaaggacaugguauccacugcccuaaagauuuagacauccaucacagacucugcagugguguuucuacuccagugagguacuuucuaccauggugugccuuuugcugugagugacuuaacagugcagguucuuguugccuucacuguuaacccugagagcacauaaucugaugcaugugugacuaagaauaagccuauggucaugggcaagaagggccaacauagacacuuggguagaaauacagucugaucaagcaacgguguaaggaaaagucccuaauucacaaccuccuugaucuuaugacccuugaaaaccucaagaccgaagccugaccauaaguuggaaagcucucauuacccucuuuaacaacauaaauucauagcuaaagaaaaacugcaugugcaaauaauaccauauucauuuuuuauuuaacauggggauggaauggggauagcauacauuuuauuuguacaauauuuaacaaucacuuauucaaggugggauuuuauggggauuuuuuucauuuuuagcuuucuguuaaauacuugcagaaaaaaaaaauagcaaguacaauaugacaguaguacaacaaccugugcccaaaacacugacaagaaauacagaguaaagcuaaaauaauuguuuaccaauauuuugagagguaacaaauagggagauacggguugagacugcauaaaaaacguacugcugguugaauaucugagguaaaugauguuuaaucaagaugcuacuuguaucuuuguccauaaauuguaaauaauuuuaugcacauuauaccaaaucuuccuaaaaaguaauuuuuca

SEQ ID NO: 812 - RNA, 2113 nt, Mus musculus
cuuuggguuucagcagaggauacucauagguuaacacugcugacugaugucacuaugcaggucuguaauugucgcagucuccugguacuugggcuucauucgaaucuaguuuuucaaauggagaaagcuccguuuccaagcuccuuggguuguaacauuucaucuuaggauggccaugaaauucauguuuaugaagccaucacugaaggucaugucugcugccuggugaugaaauuauuugccagauuguauaaaaacaaaacaaaaaacgauuuaagccacucaaguacuaacagcuguuuugcugggccagcuaucaggucagggcugaaaaagacacagcagcaaccuugaagccuuuguagacgcuggauucaagaacagugagcaacaggacccgagcaccuggcuacugggcaaggugggggaggagccaaggaaggaagagggcggacaugauggagaaccaugcagaagcugagggagagaggagcacucagaagacgggcauagaaguccucgggcugugggaagucagaugaggagaugugaggaagccugaggaugguuccauucauuguuccugggccucaagaacugagauuugagaacuacauagcaggccaugagucccagcuacuuaggaagcugaagcugggccacagcgauaccaguccaaguggcagaaaguuccugaaaauaaagguaggugcucaugccuuccaggcugauuggaccggggucaccagaauugagucgggauauuauuuugugcuuagauccuuucaugccuuugcuucugucguugagugagucgauggguugguuguucccaagcuuccuugccacauaauaacugcagcggaaguuaacauuucugcuuuauaguugugauaguaugcaagcaacugcuuagaagcacaggcaaauaagugcaacaaaggauuuucccagcuucaauagcuucccuaaaauacaaacauuucucugacuaggcauauuuccagucacuagaagucaugcagauuucauauauauacguguguguguguguguguauauauauguauauguguauauauguguguaucagcugcuuuucuuuaccuacuccuuuaagcauguaagaguguguggggcagguuuucuuucagcaguccacugcagauuuuaaaugcgauccuuuauuuucuacauaaguccuagacagacuucauaccuugaccaucucaagcaagccaggcuuccaaguaacuuccagaacauuaugugcuccaugccaguggguugagcacauucuauccguucgucuauuuacuguucaagguuugcagccucuccagaccacuucugcgugugugugugugugugugucugugugugugugugugugugugucugugugugugugugugugugucugugugugugugugucacugugguagacccauggggauacaucccaagaccuccaguggaugucugaagcccagaagagaauggaaucuauucaguguaucaguuaucucaaagaaagguguucuagaacccaaauggguaucaaaauccauagauauuuaggauucaauucuaaaguggcacagcauuugcauuggcugacauacauucuccaguagacuuuauuuuuaaauaauauuacuuuuugaaauuauaauuaccucacuucucccuuuguuguugcgguucauugguuccauagcuggacaggaauauugaguguuuuccucccuuggaagcuugcauggaaccuucuaguacuaugaaagccagucaucagggagaggcuuucaucucacaaccagcucagguccucuggucuugcauccaagaugcaagcugucuucugcaguagggacuuaccuucuacugggaggcaaccaaggacaacaacaacaauagccuguaauguuuugggagucucucagcucugaccaaaaacucaaaaggaugcuucccacgcccgguguugggguuuuuguuauacagucugucgcucuuggggguagcauugucauuuguaauguauaugcacauuuauuauauguaauuuugugggaaugaauaauaauuugucauaauuugacuccuua

SEQ ID NO: 813 - RNA, 18743 nt, Mus musculus
agagacugacaugguuacuuuuuuauuugaagaaaaaaaaaaacccauacguuuuaauaaauacuguggaaacacugaccaaacaaacauacaaagugacuucaacauuaaaaaaaaaaaaagcaacaaaaaguucugcuuuauaacaguuauaacuuauuuucuuuuuacaauauuuaaauacagaaagcacuugccagcgauuuuguaauacugcccaaagcauaaugcuguaccagucagagcguauuauguugguaagaugucugaguuucaugggaaaugacugagauggcauuuucuugcagagacaaaacaaagcgcuugugaagacacagagcuggguguuguaguuaccuucaccuccccuucugccgcgguuuaagggagacaccgcuccagcgcuucaaaaaugaagcgucaucauuggggaaaaaaaaaaaaaagcuuguuuuuaacaagcaccaacucucaaagaucguaaaugauuucuucucugaaaggaacugcucaaaaggagaaaccuguaaacuauuuuaaaugcuuauuaucacucuggcaacgaucaacauuuucaaccuggcccuggccauguaugguuaagugagguuuagcagucacuugagaaacgcccuaggcucauaccagggcagacauuauaggcuucuuugcaaacugggguuuacuaaagcaugagcaaauggggguuuugccagaacagcauuucuuugaaggaaguggcaccagacgacagcuuacuuucuguugcuagucuaggggcaccauccccagacacgagugcuuuugcucuguguauuugacguauaauuuuguuccagacagccccauucaccaacugugcucucggcuacuacuacuccuucauucaaggucucuccuggugaaaucggcaaccaccugccucuucuuuaaucacgcuaucacaucugacgaucacaucuuuuauuugacuucucguuuucaucaacgauggcaaaaagaaaaacaaagccacacacacucuucuaaacagcgcacaaaaaauauuacacggaacaauuuaccacuuguuaaggacaaucacaaggaugaacaaaaccaucagacagaauaaaaagcaacacucucuucuaguugaucuacgcaaucucuguagugcuggucuaugcaucuuguaagggcucugaagcuugcuuucaaaccaucuugcucagcagcgaccuucaggaagucaagauuucaaagccgcaucaaguuuuccucucgaaucccagcgggucccaguacaauuuccauuuuaaugaugagcuaggaggaaauuagaucgcauccucuagaaaacuaaacgcuaaggucacagugcgaguuccccaaugaggacggucuacuaauauauauuuuuuggaaaaagggauuaaaacauugaaaaacgaaaucaaaaaguagagauccacgaauagguuguaacaaaaccacaaacacaaaaccgaaaauacucaagcaccauucagagcguggauguucuucuuggagguacuggcgucccccacuucucuagcgcucgccuguucauagcucccuuuguuuuuggcggauuuuucaagucacacuucuugucacacaaaacucuucaaugcauucgcuucucaccacucggucuacaugccgaaacuaaggacaggauuccgaaaaguggguauccuuucaagggccuccuaagccuguaucuaugugacuuuggcugugcacuucauuugacuccaucuuuccgguuugcuccugcuuuuuacauuuuuuaauuugaauuauuaauuuuuuaaaacaccagauauucccgcguccuccuuauagacggcgaagccucacaucacaguacagcucuucgcuuuguccuuucguaaguccguagcaacugcugagaguucuggucugcuaggcaugugcgaaauccgcuuuguggcccucugcgauuuguuccgcuuaacguuuuuauuugucuuauuuacacacgccaagguggcgacgugaaaaaugucucugacgcuguuuucugacuguaaagcugagcauucuauguaaguggcugcuccgaucugcuuggccauauuugcccccugugaaguaaaagaaagaauuuccgucagcagcgagacuuuggagagacacuggaaaguguugaaauaccacaaaacugucuugaauuggaacauaccuaauaugccaaauggacuucccaagugguguucaaaauaaaaaacagauuuuauuuuaaaaugaguuacuuuguuacuacuucccaacugcugaagacccaguccgaaggcccugaauuauauuacucuguagaaaccccucuagcuccccacagcuucuaguauggcgauuugcucuugcaagagaauccaagcauccagcucucacuaggaggaugcaaagaagagacaggugcaaagguagcaguugacccucagugaugcuuuaagcagguugugaguaaccugcuguguagguaucauuuggggccauugugaggcauggucucuugcuacuggaguaagucuccugauaccauaaacauccuuccuauagaucugaccaaggugcuuuggcccucagaguccucgccagcauuucaggaggcucucguuuucucuuguagagacuauuaaugaccuucaaccccagccaacagguuguacaaaacauagggcugacagauguuacugaacaccaauuuaaauaaaaaucagcuucuaagauuguauugaguuuguuaaugaggaaugcaagauaaagaugaguauaaugcuuuuacucugcacuuuugucacacuggggaugaugggacccuaagccuuucucaugcugggcaagagcucuaugacugaucaauguccccagcccuacaauagaauacuuuaaaugaugcaugccacauauaccuauuuuaacaggaacccucuuuagaaucugguggugaguuuuaggagaauagauuccucaacagauucuccuuucuuugagugaacacucauaucacaaaaaacaaucaaaagauggcaucacagagugaucuuuuuuuuuuaacaauggcuuaauugaggauauuauugggcaagagaacaauaagcucuuuuaagagaacuaauuuuaaucacauucucucuuuaaaaacacugguguaguagaagcauccaagguuagcaccuaucaauuguuugugcacccuaccccuugcugacuuuugcuacagaaagucagacagcuccuauuccaguugacuccugcuucaucucuugaaaaagcgcugcgucucauuuaucacaaauaauaauucucuacauauuuccuuucauuuuuauugaaaggugacuuuucagggcuuggagugauggcuccgugguuaagagagcccuggcuacucuugcgagugacucagguuuaauucccagaacccacaaggcagcucacaacugucucuaauucuagauccaggggacucaauacccucacacagauaaacauucaggcaaaacaccaaugcacauaaaauaaaaauaaauauauccuaauaaagaaagaaaggaaggagaaagggaaggaaggaaggaaggaaggaaggagacuuucccacagugacaacacacuuaccuggucauaugacacaggagucugccugugauuugagaguuccacuaaugugcugacaucuguccgcagaucagacuugcagcccaccaacagcaucuugguauugggacaaaacuccuggauuucaccuuuccacuagggaggagggaaagaaaaauuaaugaaguauugacacauacauauacaauaaaaacaauagcuccccugacagacuuugaagugcaacuuuaagugaagaagccagguuauguuggauuaauuaguaaguggguaccaaacuuuagagacuguuguuauagucugugugacuccgugguuccucccacaaugaacuuauuuuguaucaacacaagguaacuucaacaaugucuuaauuauggagguauuugaaagguaaaagcaccuuaauagucacaauccaaauggauuuuacauccugggauauacugaguuccuuauuacccagccuaauauauaguaaguggaagggugggcauaaggaauaggccacacuagcaaaaaugugcauucacacacuccaucaugacagacuaggacaugcuugcuuucgugugcuggccucccgugguaggucagugucuggccuaugauuacuaaagcauagugucuugcuucaaggaucuuccacucaaguggcuggauggacacagacuacagcuuaagcagagaacuaccucuugacaucccaggacagcaccuaguuuauagcccauaaagacuuugaguuaauuuuuaacugucagccauuacugucuagucuacaauuuaacuauuuucuguccuaacaugaaucaggagaacuuugagaaguuucuggaagggauuccagcugccucaagcaucuaaacagcugaucaugguuuugcuucuucuaacuuguguuuuccaucaucagaugagcaacuagagggguugagacucuucugcccacacuuaugaugccuuuggugcucuaggaagaauguaauggugguggagcucugacuuucaggaauucacagagcagaagaggcaauaaagauuuguaagucuaauacuagguaagagggacauucugaaagagugacuuaggagagagaccucgagaggcuaccuccagaucucaggguguagcugagccaaugacaucuaguucuaaagugcuccagcaugaggagggcaguaacacaccgagugccugaucuguccauugagccuuuccuuucuuccucccuccuacaauuauuuaggaacaucuagcauguucuucuaaagaauuaaaaaacagaauaagacuuaguuuuuuuguacuuuuucuauuuuaaguuacuuuaaacucuugacucaauggacuuuaagacucaauuaagacaaaacacagaugaacuaaguaaguuauggugagcuuuuaagccucacacaaagaaaacauacuaauaucuacagguccaaugucacuaucugaucuuaguaaauaaaaaucaaaguagaagaggagaaaagcuuucugacauaaauuauguauaagcugguacuacaucagguacaaacaccagugaauaaguggccccuuuucucuucaaacacagccagacauguucucagcuugugauguugcgagucucucucuaucuguuuacaggaggacaagaaaguuguauucccugaagacaggaaacuuguauucuugacagaaucugacaaaaagccaacccucuguuuuauacauuacucagaacgaaaagguguuacaaacuaaaaggaccccuugaucuaucaagaguucaauuucauugaacugcuugcaaucaauguuuagcaaaaaacugaaggaaggcuauaccucaaaccuaaauuugucuacucaggcaauuaaguaccaugaggaaaaauaaacuaauaaaaauaaaauaaaaaacccacccaaaaugcaaaugucacugaaaguagaaaccaaaagcacacagcccaaauggaccaaaccuggacaucuacaggggcacuucucccuuuaugcuaucugcccucaugcugacaggaacacagggacaagcacugagugacauucucuguuccuauccacauguacagugcacagaaaagaagggguaguacagcuagagucucacucgcaaaccuacaacaccuagcaagggugagugauuaagaugcugccccaucuaccagcacauauaacccucuagagcuaccauggaacaaagccuggguuugcugcaggccaagcggaaucaccgucccacugaguucucuggaacucaucuguggaaaguuccuguaacuacccggagggcccaguccucugcuggggaaggcucagcaucacucucuacacacauaagcaguugccuucuuagaccucaagaccuaugugcaacagguaccauuccuccuagcccugguuccucugucuacagcuucuacuggucucaucuccaccuauaaucugacccaccuuuguuuccaguaaccagggcugugugauaacauacauauuugguguaacuggugcuuuauugguagacauuuauuaguagacaucggaucauaauucacauugcugcaugucuagggacaagccccacuacacauauuccucuuaugcuaauuucacuuauguuucuauaaauaagugaacuaaaguagcucuuauuguauuaaggugacuaucugaauugagaucaacagcaaacaccuacagagcagucugucaagcaaaggaaugaagggaucagguaagagcuuacuguagcuauuuccuacguuuucacuccauuuccuccaaaaaacgaacgaggaagcugugaaaaguaguuuguucagagcuuugggaaauaaaguuucaagcagauuaauuagugccuuauagcaagcaacaauguauaugggaauguuguuuuaguguggaaguauccuuucuggucuuuucauuagaagaaauaaguucagaaucuuugaauccccuggccaaucaccucucuccaacccuaucucaucgaaaguucagggugauagccucguuccucagcacuuaccuuuuuuaagacacuguccagagucucuggucuacugaugucaaagcaaaugagcacugcaucagaaucuggguaagagaguggacggacguugucauaguaaggagaaccuaagaaacaaaaacacacaggucucagacagaaauccccacugucuaagaggcacuaacucuacccuuugaaauaaaccucuuuccuguuaaaaugcaacaucccauugguccccccucuccagccuccuuccuguaaggaaaugcaaacacauccacaaaagacagguuaguaauacauucacuuuuacuaggagaucagagagcuccuaugcaugggaccucagcuccugggaaggucaggaaauuaaggugcaauugguagagcuuaagaauuagagucaaaaggguuuuagaugaacuggggaguauguggggccaggugaccuugaggacaaacccauucuccucacagggagagaagcccaagucuuaaaagugugugcuucugauucuucaaucaucaggggaacauggugacaaccuauauccacaggaucuaagcaaaccuagguagcagcuggaauuuaggaagagaugaauacauauuaacuagaaguauuguggcugguauggcuguggucaaaggucgaguggcauggcagcagccacuggaaagggagcugcuuccucggaaaaagauccaaacucaagauuagcccaauaguugcaugggggaggggucagugggggagggcaaguuuaauggugcacaggaagccagagcaaagcacaccggagugucacuccauccccaguuacaagacuggauaagccauugaccuuugugccugcuuacacuuaucccccagcucuguguaaguucacuuccugcuacaccaagaaugucauaaaugccauguuggaucauguugccuuucuacagagucccuccugcaaacaugacugcaggacauaauccaagggcccucgccugaguuaaacucaagguagucuaaaaguucaaauugacagucaaucaauggaaccacagaacuuucuggaaauuuaagauuauuuucucucucuuucucucucucucucuuucuuucucucuuucuuucuuucuuucuuucuuucuuucuuucuuucuuucuuucuuucuuucuuucuuucuuucuuucuuucuuucuuccuuuuuuuuuuaacaucuuuaugaguuccaaauguugggaauucauacaaggccaauaauuacaaaauagauugacuauaacacugaagauaacuugacaacugcuacuuuuaaagaacuauuucaucauauaguuauucacagacaccaggaagaucauuuauuaggcaaaugcaaauacgcuaaagauuuuuuugacuuuugauuuaguuuugacauaauuuugcauuucuggcaggaaaacacaacaugccuucccuaagucaaaacuuuggugguccaagucagacacacagagagaggugggggauggggggagcuauucaaagaaaugguuuuagucagguccaguagcaggguaaagaaggauugcaauuuugaggccuaccugagcuguagagagaaugcaagauuguuuaacucuccaugugaguacacuaguauuuccaugcuccuucuccauugagcaagagagacaaugucucaaagaaaaaguacaaagacaucuggccuucaggagucuguugucucuuccuagagguuauuguaguuagugugugugugugcuaggcucugggcacucaucgcugcaaucccuacccgcacuguguguaccucaguucugcuuuagagauggagagucugugugcugagcuaggaagaugcggauguccuaggaaccaggaaggaaugccucagcagugaagaaaggcuaagaagcucucagacaggucagcagccucccacuggccugugggaggcuggaagugagguaaaaaacccugaaugaaagguacucccagagagcuaaggccuuaguugaaaugaauaagaaaaauauguaauguguuucuaaaaaugacaagcaguggcuacccuuucagcaacuugaagaaauuagaggugagaguaacucuaagguggacacuuagaauucacccuaaguuuuucuugaaaggcaccagaaagggauggcuuuacccucuauggauacacugauauuuuacauuaguucugcagcucugacucucuccacuguaaccuuccuuguuugccuguccaaagucuaacuuuggcacagcugcugcugugagcauuagaauaucucuuuccuaauagccugccacaaaaaaucccagacuguacagagaagaaauucaaaggaggacagaggaggcucucuucuguucuucaaagcuagcuccaacgaccugacccgaccuacacugucagagucagccuacuguguaaagccaaacaggugucagaaagcucaugucuuaugcucuccagucuagaccuaugggacaugauuagaaucuggaggugccaggcuccuuuaggacgcugccugcacagaguggcagagcgcaguauuuacaggacaauggagaccaucuuuuccaaagguggcugaaggaagucaaaggggcaaaacuaauuuaauuaaacuugggacugcugggaaaaauccagaggcuggguugcaacauuccagucaccauguggcugcagagaacaccccgccuuuugugggcugcuuccccucccccacccaguuuaaggccacaaagggaucuggcuuugugcucagcccucugucacaggcuggagauugcuugccuccaaaaaaaaaaaaaaaaaaaaaaaaaaaaagauaaagaaaaaaaaaagaaagaaaggcagcuuuugugcucagugacuauaugcaaauaagagggaaauuuacucucuugauugacuuuaaaaagaaacaguucucuucgaguuaaacaagauuacaagauucucauggaggccuguuucugccuuuguuuuuauuugguuuaacaguuuggaugaaaauacauauguaguguaacgcuucaugagacaucagccaccaagcuuggagguaaagagguaacuccuaggcgcuuuaacaagaucuaauuaagagcaggacuuugaucugagcccaguccagcccccagcaguaaacaaugcagcuuuuugaucaacaagugcccaagggcgcuaauaaaacagauccucaaacucauaacuguaauucgaccaccaacgagaagaguaacuugccauagaagauaauuuauucauuauuuuuugaaagcuuaagguuaagauuuuuuuccuggauggggggagggggaacacccaaaacuauugucuccauuuuuuuucagaguaaggaaagugaacuuagaaaacuguucuaacaggaaagaucucacaguucauuggguaagagggacccuucucuucugugaucagcucugugaccugcacaaaggaagucggcaagcuaagggcugaucaccacaggcaugugugggaagaauccuaggaaugcccugucaacugaggagucccggagacgcaggagacuccaaacaguggagaguaagcccucaaagagagaacaaagccagccccggauuccugcugcaucccgcagcuggagaagucccucggcaccuugggaaggcaggcuuucagaaauacuaauuucuauugauucuaguuuaagguuggaaggugcuaacugaacguguuuuuacggugugcucaaacacaguggguccucgugugcucagccuacacuucaguaccuaagaauguaccagaguuaaaauccaauaaaucuaaggaugaagcuuugcuugucaaauaaaacuuccuuggcuuguagaaggggcuuccugcauagggacauuuccagggcagcaucguccuuaaagacacagcacugcacuuaaggccccccuuuaaauaaccuaccaaacucuccauuggcaaauugcagggaacuguuuuaguauaaagcuguaaccggacuauaugcaaagcaagugucucacuccgaccaaguccacccacuccagccccacuccagccccacucccgcagcugaaagguccacccauccccucucgaagcugaaaggcuuuauccaggcuuggauuagaauaagcaugcauuggggguucuuuguugcucgaguuuggcaaacaucagaaaaguucugacagacuuuugaaauugcaggucuaccccaucucugucuucaagaucauuaauuuggacugagaggaaaauuuccagcccaagaagagucacaaagugccucaccuagaaacuaauucuucaaacacauaccugccugcugaagucaccccgaugcagagauacagcauaccauauauguacaugauuaaacauauauggaccaagagccgugccuaaaagggagaccuuuggaccuguugcaaaaccagcucaaauacuaaaacuuuaccuuucuaaagucugcaaacugaaaaauccucuucacugaaucuuuuaaaaagugugauaccuuacacuuaaaaaaguaagucgaaaguuuuuccuauaaggaauugcuaccaagauaaggaaguuaggaauaguggauacuuugggcagaaauuacacaguaaaauuuguuacuuuaaguguucauuaaaagcacaggggaagcaagcagcacgagaggccauggcuggaaggggagcuguacaagagaagucggcucaggaaugugauucaagucuggacaagaccuugagacucuguuucaauauaaaccucaguuauuccucaacuacaccuacauugcaaacaucaggacccaguuagccaucaccacuugguccagcaguugucuuucauuuguaucaaacucuuauauauuaugaagagcucuuaugaaaagauaugggcagauagguguuucuagaaaaacucaguguucucuauuucugggggcagugcagaugcacagguggauauaaguucagguggcuagaacuaacauugcuauuuggugguucuaaauaaaauuuugguacaaguucucaaucuugggauacuucaaaacaauaacaucuuacagagaguggaaccauaaggaaccacagagcuugauuauauagauaccuuuuaaaaauccacauuaucauucacuccagacugaagcuauucuacuauacaucccaugcucugugagagccuguuaucugagcauggggucccuucaguaguuuccccugaccucauacgauaacacgaggcuugcguuucagucccaaugugcucaacaccuggccaaacuuuugaagcagcuugcauucuaugucagaaaagucugaauuuuugccaaaaggagcucugugaauguugccaauauguaauaaaccagaagacauuucaaggacaucaaaaaacaagagaggcccagcugauuccuuuggcacagcccaaccaugcaucaugagcuggguagacacacuggugucucuggcguccucuuuccauguaagagauuguauuacugauggaacaaacaccugguuacuuuaggagcauuagaaugaccaaucugguuaccuuccuccaauguacaacugaggaaaaaccaaauuggaggcaaaauuagcacuagauggauuuugaaaaaagcaggagaagggaaaagaagaaagucuagggaccgaugcuguuugucuaucccuagcccacacuucaguguaugaaggcucaguuuacucugggccugauuucgaaacccuaaguuccaggaaucauacugacuuugugaaacuucugguucuuuguaguuuauucuguuaugcagauaaaaacuguaaacucuuagcccaccucuaagaagcuuaggucagaaaucucaacuuugagaaccuguuuuuuuuuuuuucucuccccugauaaccauuaaauuuaagcaggugugaaauuaaaggggaguuuaagaacuuuggaagaugaacuuguagagaagcuuuggaauaauggagggcuuuaacggacaggaagaccugagcuggggacucggaguuagcacaggugcugaacccucuuuagucuuggugcugugggcgaauccauucccaccaaagcccaucuucuguuuccgggucccuguccaccucuggaguacucauaacagaugcccugggaaagauuccuugccuguucaagugcacaggcauuucuuccuagcugcacccuacacuuauucugggcuccucauuugguuucuuacuucacccuggagaaagaauggguauuuuaaauuuucacccauguucgcaacauuuuuguuugcuugguggcccuaacuagagugcaagcagcuugaggaccugagcuuuuccugcagagcucaguaccgcccaucccccaucagaguccaagcagcuuuugcagagguaaacucugcccuaauaguuuacaaucauaucuuccuggccugcccagauguguucauuuauauuuuaaaucacaaaaaagggaccgcuaaucuccuuuuaaauggcuuuccuugauuaauauguagaugagccuccacaacuguugaaccuuguccauuagggcacuggccuucaagcuugauuuuuuuuuaaagcugaaauauaugggaguaguuagauuuauauugauccugaagaccuuccuccaagaaaaguagcuugguuuuuucuuaucuguuguuuuaugcuaaaguguagagaauauauuguuuuuaguuaauaauaccacaaacagauacaggaagugcgaaguuuagcauucaggaccugaaagagguucauagcgcauuaagauucaaaaaaguuuucacugggcaauaccacaguuaucaacugggaaucagcaguugaauugaauguuuaaaacuaauaauaugccuuaaauaagaugugcauuaacuugcucaagcuaaaagcugccaaggacgacuauugcucccuaaaucauggaugcagaaauuacacugccaucaaguuccuaggaaaagauacccugaucuuuaaaugacuaacuuucuauuauuaguaggcauuuggcuuuauguuacaaauugcuucuacguuuggcaaguguugcagauuuugaagcacaagcuauuagaacuaacuacuuugguuucaguaucacuuuaagauagcaagacuauucccccacccccucccuguuucucaaaacucauugggaaaaucugaauauuuucccagcacauuucugcaaccauuagaucagcucauuuuauaaggaaaagaaacuauaccucagugagaggaagacauggccccaagacucccuuuagaaaccccucacuuuagaagauuuuccugacagguaugauaguucauuacuuuugaaguauuuuaagcagccaugagaguccauuggcacugugccacuguggcuguuguaauuggugaguacuuggggaaagacagaaagacugaaccuaaagacugcuuggagcucuacugggaaagccucaggaaagcacaugaagccaccagauagaagaagccauuacgguucaagaguaagugcacccuaggcuggcaguugccuagcccugauuccuaugcugucuaacagagggcuugcuuacaguagaugcagaagaaaggaagaggggcagaaaggaggaaauauuaacugccuggccucccagaagagaaacgaaugaauggcuuccuuuccucagauaagacuugcacuugcuacuuuuccccacauucaaauuggcggcuuuugcuuacacaugaugcuuacguaugacugcuucaggggaaagcagaccacuuaggagaugugguucgcacacacagaaaacccauaaagaauuguuuccuacaugugugcuccuccacuggaagcucaaacguaauagccaugcaaccaaagggcaaaguugguacucucucuccacccaguuuucccaaucuaaaucucuugcacacagucuugggagaggauaaaaaaaugacauuuagagauccauaaacuuggcuuggaucuucucuccugagauaagcugguagcaguuagggaaaaucaaauguauaaagaggcauaaaguauaugcaauuauuuucaggccucaaccaaacaaugucuuugugagcagagaaaaugucaaacaaugggggagaaagcucuaggaacuugucgggaaaaguguauaggaaagauaguauaaacuuccugcuggaggcacgcuaauucugacuggcaagccacuuucaguaggaacagccucuuucuagaauuuaagcaaugcuccaucacuguguuugauuaacuaacaucucacuccaccaccaacaugauaggaauuucaaauaauuccccaugccucuuuuuucauuuguaugaaucuaaauuuuaaguaagguuucauaacuggauaauuuugcagugcaauacuguugcaaucagcuuuuaacccuucuuaucuugcagaaauaggcauacagaaauaaauaaauaaaauuuauuucuuuuacuaaauaaaaauaugucauuauguugcuacuacugauuucauuucaagugauuaacuuuaauuugaugaaaagcaauauuuauaacguugcuaaucuuaaggcaaaggcaauucagugcuaauuaauaccaggaaccccauccccuuagcaacuaugcauaucauuauaauuugcucaggccuuagguuuuauugggugacuacuguaugcaagacauucugcuauaagugcagagacugaacuauauaguugcugaguaaggcuagaaaauaccugaagugauauucgcauuggcuucucacuauaaaccauucauacacauucguuuuauuuauuagcucuuggagagaaaaagaaagagguggcaaguuuggccuuugggcaccuaaucuaaaaaucucuguugguggucuuguggcuuugggagcuggagacacgggauguauaagccggcauuccuaggagcacacccaucccccuuccuuauccaaauagucucauuccuaaauccaccaggcagccuggcucagcccggaaucuggcuugguuugcaagcuguugagaaccucagcacgggaugccagagccacugagacuaggagcugaagccaaccaacagccugggacacacacacacacacacacacacacacacacacaaaucugccuguccaguacacuaaagccaagaagcauagcugggaagagaucuugcacauuaucuagcccagcgucugcccucuuuuuacagaugaugaaaaugagacccagggagguagaggauuugcacauagaaaucccugguaaccaggagcugagauggaaacagagcuuuguaucaaagacuguaucagacccacugcacugccccacuccacgccuaaauaauucuuaucgaguguaaguccaaacggggcuggggguuggggggacgggggggggacggggaugcuggugcuaauuguugguaccacaccagcuguccggcucacuaggcauaacaauuaccauaauaugucugagaacaggagccuaauaaaauacuaggcuauguaauaauucuuaugaucgaaaguaguaauaaaccccuagaauuccaucaacacuuucucuauaguuucaagauugcguaugcaaucuggacaacaaaaaccacaaaaacgcccuuggcgcagcucaaggaagaacuugacucuccggagggaaacuggauccauccuucucacugcagcagucugagcaucuggcaccgaccgugagaggcgccggugcaagacuucccucuagucuuucuucuagccuuugugcugaggguugccucuggagaucuugggacucuggccccuuccucccacagucuaauuccccaagucccucagagguuccagcccagggugugggaagcucgcugaagcuccacgaggccacucccaguugagcacggcuccaccucgggccaccccgccugacagcaacccugcguguuggcgcuugugcgcuccuccucgccaguuucgcccuaaucugucuggcagcccaguuccccaccagcaccggcuuuuccccucccagauugguaguuucugcuccucuggagaagguaugguuucuacuaacaguaggcguuucucccgacgagccucuggccagucuugauaccggggguguguggggguuggggggugcucaguccucacugucccuuccccgaacucagccggggcugccagccuuccugcccgcgaaaaucugcccuccccaccaccuugugccacguuggugggugggcgcaugggaaggcaacaacccggccuugaacccuagaccucuggacggaacccuccaaggcgccaauaauucaaguagacaggaaggucaaaggcgaucggugcugccugcggcucugcaggcaggcgaagccgaagcaaaaggguaggggagugguauguucggagagcuggcacagagugaucccugggcggccgcagaagccgcucugcaccgguggcacagaggcugcgggggcggaggccccgcgguggccgcugccggcaccaccagcgcauuccugacaguaggcgucacgggcgcuggcuccggccauucacccaucucccucagccuggaacaccccacgcaacccggaggcuuuggggaucuucucccagcucagccugcgccccugcccccaaaccagauggcuggugacacccaugaggggcuuccuccgcgagcgggagggcuuccacgcugcucuguaugcuccagcacugggccacccuggcggcccgcuccggcacggcuccaaggaaggacaacacaaggccaugcggccaccagaggcuccuccagcagggucacuccggacaccuagcguccuccuguccccaagaccacaaucacucccauugcugccccugcccagaaaggauaacauuuuccggcggcucgggaccgggaagucccucaaggagccacauuagcagacagggcaccagaucccgagcccccgggcgcaccgguucagaccgccacgcggugugccgagucuuaccugaagugucccacaggcucaacucuauucuuugugugucgauuucaaaacuggcaguguaauucucaaacaccguagggacguaauucuggacgaacgaaagggacagaagaggaagguggcaaagagauuauuaaaaacacgacccguagaucgaacacuugaaaaaccaccaagcccccaauuaaaaaaccaccaccaccaacaaccucacacuccuuacacaguaaacacgcagcccccucccgagagcccacccaggucuccccacccggccucccacacugaaaccagcaaguuucuggggccaagagcccagggugcuggcgggucccagccaagacccuuccaggacacuuucgcuucccggccguguggcggcagagacggcugggcaugagaaagauuuucaagaaaaucagugaagcaggagaaaggcgcaguccuccagaccggggaccccaccagccgcuccccucaagacgugcgggucacacucacuucugggaagcaguccuuggcgaagacguggagcagcgcgguuuucccacacuggcugucgcccacuacuacuaucuugcauuucacguucugauuaggauccaugauagauuuacuggauaauuucuggcuggcucuucucuccuucauugauguugccuuauuuucucuuggaacaggaauuuucucuuuagaagaaaaaauauauauauauauauacuucucucuauaaaaagcagauauaaaaauaaaucgcaaggccggcgggaaccccuuuaagcacagcggaguggaggaggagaggcagcggcucuuuacuccucuccuacaaguuuucugccugacuccgcgccucucuucccaaguccaauuccgaucggucugcuuuguuucacgcucuccgcgccgcuuuauacgcccagccuuccaauccgcuccgcuuucucaaug

SEQ ID NO: 814 - RNA, 18743 nt, Mus musculus
cauugagaaagcggagcggauuggaaggcugggcguauaaagcggcgcggagagcgugaaacaaagcagaccgaucggaauuggacuugggaagagaggcgcggagucaggcagaaaacuuguaggagaggaguaaagagccgcugccucuccuccuccacuccgcugugcuuaaagggguucccgccggccuugcgauuuauuuuuauaucugcuuuuuauagagagaaguauauauauauauauauuuuuucuucuaaagagaaaauuccuguuccaagagaaaauaaggcaacaucaaugaaggagagaagagccagccagaaauuauccaguaaaucuaucauggauccuaaucagaacgugaaaugcaagauaguaguagugggcgacagccagugugggaaaaccgcgcugcuccacgucuucgccaaggacugcuucccagaagugagugugacccgcacgucuugaggggagcggcuggugggguccccggucuggaggacugcgccuuucuccugcuucacugauuuucuugaaaaucuuucucaugcccagccgucucugccgccacacggccgggaagcgaaaguguccuggaagggucuuggcugggacccgccagcacccugggcucuuggccccagaaacuugcugguuucagugugggaggccggguggggagaccugggugggcucucgggagggggcugcguguuuacuguguaaggagugugagguuguuggugguggugguuuuuuaauugggggcuuggugguuuuucaaguguucgaucuacgggucguguuuuuaauaaucucuuugccaccuuccucuucugucccuuucguucguccagaauuacgucccuacgguguuugagaauuacacugccaguuuugaaaucgacacacaaagaauagaguugagccugugggacacuucagguaagacucggcacaccgcguggcggucugaaccggugcgcccgggggcucgggaucuggugcccugucugcuaauguggcuccuugagggacuucccggucccgagccgccggaaaauguuauccuuucugggcaggggcagcaaugggagugauuguggucuuggggacaggaggacgcuagguguccggagugacccugcuggaggagccucugguggccgcauggccuuguguuguccuuccuuggagccgugccggagcgggccgccaggguggcccagugcuggagcauacagagcagcguggaagcccucccgcucgcggaggaagccccucaugggugucaccagccaucugguuugggggcaggggcgcaggcugagcugggagaagauccccaaagccuccggguugcgugggguguuccaggcugagggagaugggugaauggccggagccagcgcccgugacgccuacugucaggaaugcgcugguggugccggcagcggccaccgcggggccuccgcccccgcagccucugugccaccggugcagagcggcuucugcggccgcccagggaucacucugugccagcucuccgaacauaccacuccccuacccuuuugcuucggcuucgccugccugcagagccgcaggcagcaccgaucgccuuugaccuuccugucuacuugaauuauuggcgccuuggaggguuccguccagaggucuaggguucaaggccggguuguugccuucccaugcgcccacccaccaacguggcacaaggugguggggagggcagauuuucgcgggcaggaaggcuggcagccccggcugaguucggggaagggacagugaggacugagcaccccccaacccccacacacccccgguaucaagacuggccagaggcucgucgggagaaacgccuacuguuaguagaaaccauaccuucuccagaggagcagaaacuaccaaucugggaggggaaaagccggugcugguggggaacugggcugccagacagauuagggcgaaacuggcgaggaggagcgcacaagcgccaacacgcaggguugcugucaggcgggguggcccgagguggagccgugcucaacugggaguggccucguggagcuucagcgagcuucccacacccugggcuggaaccucugagggacuuggggaauuagacugugggaggaaggggccagagucccaagaucuccagaggcaacccucagcacaaaggcuagaagaaagacuagagggaagucuugcaccggcgccucucacggucggugccagaugcucagacugcugcagugagaaggauggauccaguuucccuccggagagucaaguucuuccuugagcugcgccaagggcguuuuugugguuuuuguuguccagauugcauacgcaaucuugaaacuauagagaaaguguugauggaauucuagggguuuauuacuacuuucgaucauaagaauuauuacauagccuaguauuuuauuaggcuccuguucucagacauauuaugguaauuguuaugccuagugagccggacagcuggugugguaccaacaauuagcaccagcauccccgucccccccccguccccccaacccccagccccguuuggacuuacacucgauaagaauuauuuaggcguggaguggggcagugcagugggucugauacagucuuugauacaaagcucuguuuccaucucagcuccugguuaccagggauuucuaugugcaaauccucuaccucccugggucucauuuucaucaucuguaaaaagagggcagacgcugggcuagauaaugugcaagaucucuucccagcuaugcuucuuggcuuuaguguacuggacaggcagauuugugugugugugugugugugugugugugugugugucccaggcuguugguuggcuucagcuccuagucucaguggcucuggcaucccgugcugagguucucaacagcuugcaaaccaagccagauuccgggcugagccaggcugccugguggauuuaggaaugagacuauuuggauaaggaagggggaugggugugcuccuaggaaugccggcuuauacaucccgugucuccagcucccaaagccacaagaccaccaacagagauuuuuagauuaggugcccaaaggccaaacuugccaccucuuucuuuuucucuccaagagcuaauaaauaaaacgaauguguaugaaugguuuauagugagaagccaaugcgaauaucacuucagguauuuucuagccuuacucagcaacuauauaguucagucucugcacuuauagcagaaugucuugcauacaguagucacccaauaaaaccuaaggccugagcaaauuauaaugauaugcauaguugcuaaggggaugggguuccugguauuaauuagcacugaauugccuuugccuuaagauuagcaacguuauaaauauugcuuuucaucaaauuaaaguuaaucacuugaaaugaaaucaguaguagcaacauaaugacauauuuuuauuuaguaaaagaaauaaauuuuauuuauuuauuucuguaugccuauuucugcaagauaagaaggguuaaaagcugauugcaacaguauugcacugcaaaauuauccaguuaugaaaccuuacuuaaaauuuagauucauacaaaugaaaaaagaggcauggggaauuauuugaaauuccuaucauguuggugguggagugagauguuaguuaaucaaacacagugauggagcauugcuuaaauucuagaaagaggcuguuccuacugaaaguggcuugccagucagaauuagcgugccuccagcaggaaguuuauacuaucuuuccuauacacuuuucccgacaaguuccuagagcuuucucccccauuguuugacauuuucucugcucacaaagacauuguuugguugaggccugaaaauaauugcauauacuuuaugccucuuuauacauuugauuuucccuaacugcuaccagcuuaucucaggagagaagauccaagccaaguuuauggaucucuaaaugucauuuuuuuauccucucccaagacugugugcaagagauuuagauugggaaaacuggguggagagagaguaccaacuuugcccuuugguugcauggcuauuacguuugagcuuccaguggaggagcacacauguaggaaacaauucuuuauggguuuucugugugugcgaaccacaucuccuaaguggucugcuuuccccugaagcagucauacguaagcaucauguguaagcaaaagccgccaauuugaauguggggaaaaguagcaagugcaagucuuaucugaggaaaggaagccauucauucguuucucuucugggaggccaggcaguuaauauuuccuccuuucugccccucuuccuuucuucugcaucuacuguaagcaagcccucuguuagacagcauaggaaucagggcuaggcaacugccagccuagggugcacuuacucuugaaccguaauggcuucuucuaucugguggcuucaugugcuuuccugaggcuuucccaguagagcuccaagcagucuuuagguucagucuuucugucuuuccccaaguacucaccaauuacaacagccacaguggcacagugccaauggacucucauggcugcuuaaaauacuucaaaaguaaugaacuaucauaccugucaggaaaaucuucuaaagugagggguuucuaaagggagucuuggggccaugucuuccucucacugagguauaguuucuuuuccuuauaaaaugagcugaucuaaugguugcagaaaugugcugggaaaauauucagauuuucccaaugaguuuugagaaacagggagggggugggggaauagucuugcuaucuuaaagugauacugaaaccaaaguaguuaguucuaauagcuugugcuucaaaaucugcaacacuugccaaacguagaagcaauuuguaacauaaagccaaaugccuacuaauaauagaaaguuagucauuuaaagaucaggguaucuuuuccuaggaacuugauggcaguguaauuucugcauccaugauuuagggagcaauagucguccuuggcagcuuuuagcuugagcaaguuaaugcacaucuuauuuaaggcauauuauuaguuuuaaacauucaauucaacugcugauucccaguugauaacugugguauugcccagugaaaacuuuuuugaaucuuaaugcgcuaugaaccucuuucagguccugaaugcuaaacuucgcacuuccuguaucuguuugugguauuauuaacuaaaaacaauauauucucuacacuuuagcauaaaacaacagauaagaaaaaaccaagcuacuuuucuuggaggaaggucuucaggaucaauauaaaucuaacuacucccauauauuucagcuuuaaaaaaaaaucaagcuugaaggccagugcccuaauggacaagguucaacaguuguggaggcucaucuacauauuaaucaaggaaagccauuuaaaaggagauuagcggucccuuuuuugugauuuaaaauauaaaugaacacaucugggcaggccaggaagauaugauuguaaacuauuagggcagaguuuaccucugcaaaagcugcuuggacucugaugggggaugggcgguacugagcucugcaggaaaagcucagguccucaagcugcuugcacucuaguuagggccaccaagcaaacaaaaauguugcgaacaugggugaaaauuuaaaauacccauucuuucuccagggugaaguaagaaaccaaaugaggagcccagaauaaguguagggugcagcuaggaagaaaugccugugcacuugaacaggcaaggaaucuuucccagggcaucuguuaugaguacuccagagguggacagggacccggaaacagaagaugggcuuuggugggaauggauucgcccacagcaccaagacuaaagaggguucagcaccugugcuaacuccgaguccccagcucaggucuuccuguccguuaaagcccuccauuauuccaaagcuucucuacaaguucaucuuccaaaguucuuaaacuccccuuuaauuucacaccugcuuaaauuuaaugguuaucaggggagagaaaaaaaaaaaaacagguucucaaaguugagauuucugaccuaagcuucuuagaggugggcuaagaguuuacaguuuuuaucugcauaacagaauaaacuacaaagaaccagaaguuucacaaagucaguaugauuccuggaacuuaggguuucgaaaucaggcccagaguaaacugagccuucauacacugaagugugggcuagggauagacaaacagcaucggucccuagacuuucuucuuuucccuucuccugcuuuuuucaaaauccaucuagugcuaauuuugccuccaauuugguuuuuccucaguuguacauuggaggaagguaaccagauuggucauucuaaugcuccuaaaguaaccagguguuuguuccaucaguaauacaaucucuuacauggaaagaggacgccagagacaccagugugucuacccagcucaugaugcaugguugggcugugccaaaggaaucagcugggccucucuuguuuuuugauguccuugaaaugucuucugguuuauuacauauuggcaacauucacagagcuccuuuuggcaaaaauucagacuuuucugacauagaaugcaagcugcuucaaaaguuuggccagguguugagcacauugggacugaaacgcaagccucguguuaucguaugaggucaggggaaacuacugaagggaccccaugcucagauaacaggcucucacagagcaugggauguauaguagaauagcuucagucuggagugaaugauaauguggauuuuuaaaagguaucuauauaaucaagcucugugguuccuuaugguuccacucucuguaagauguuauuguuuugaaguaucccaagauugagaacuuguaccaaaauuuuauuuagaaccaccaaauagcaauguuaguucuagccaccugaacuuauauccaccugugcaucugcacugcccccagaaauagagaacacugaguuuuucuagaaacaccuaucugcccauaucuuuucauaagagcucuucauaauauauaagaguuugauacaaaugaaagacaacugcuggaccaaguggugauggcuaacuggguccugauguuugcaauguagguguaguugaggaauaacugagguuuauauugaaacagagucucaaggucuuguccagacuugaaucacauuccugagccgacuucucuuguacagcuccccuuccagccauggccucucgugcugcuugcuuccccugugcuuuuaaugaacacuuaaaguaacaaauuuuacuguguaauuucugcccaaaguauccacuauuccuaacuuccuuaucuugguagcaauuccuuauaggaaaaacuuucgacuuacuuuuuuaaguguaagguaucacacuuuuuaaaagauucagugaagaggauuuuucaguuugcagacuuuagaaagguaaaguuuuaguauuugagcugguuuugcaacagguccaaaggucucccuuuuaggcacggcucuugguccauauauguuuaaucauguacauauaugguaugcuguaucucugcaucggggugacuucagcaggcagguauguguuugaagaauuaguuucuaggugaggcacuuugugacucuucuugggcuggaaauuuuccucucaguccaaauuaaugaucuugaagacagagaugggguagaccugcaauuucaaaagucugucagaacuuuucugauguuugccaaacucgagcaacaaagaacccccaaugcaugcuuauucuaauccaagccuggauaaagccuuucagcuucgagaggggauggguggaccuuucagcugcgggaguggggcuggaguggggcuggaguggguggacuuggucggagugagacacuugcuuugcauauaguccgguuacagcuuuauacuaaaacaguucccugcaauuugccaauggagaguuugguagguuauuuaaaggggggccuuaagugcagugcugugucuuuaaggacgaugcugcccuggaaaugucccuaugcaggaagccccuucuacaagccaaggaaguuuuauuugacaagcaaagcuucauccuuagauuuauuggauuuuaacucugguacauucuuagguacugaaguguaggcugagcacacgaggacccacuguguuugagcacaccguaaaaacacguucaguuagcaccuuccaaccuuaaacuagaaucaauagaaauuaguauuucugaaagccugccuucccaaggugccgagggacuucuccagcugcgggaugcagcaggaauccggggcuggcuuuguucucucuuugagggcuuacucuccacuguuuggagucuccugcgucuccgggacuccucaguugacagggcauuccuaggauucuucccacacaugccuguggugaucagcccuuagcuugccgacuuccuuugugcaggucacagagcugaucacagaagagaagggucccucuuacccaaugaacugugagaucuuuccuguuagaacaguuuucuaaguucacuuuccuuacucugaaaaaaaauggagacaauaguuuuggguguucccccuccccccauccaggaaaaaaaucuuaaccuuaagcuuucaaaaaauaaugaauaaauuaucuucuauggcaaguuacucuucucguugguggucgaauuacaguuaugaguuugaggaucuguuuuauuagcgcccuugggcacuuguugaucaaaaagcugcauuguuuacugcugggggcuggacugggcucagaucaaaguccugcucuuaauuagaucuuguuaaagcgccuaggaguuaccucuuuaccuccaagcuugguggcugaugucucaugaagcguuacacuacauauguauuuucauccaaacuguuaaaccaaauaaaaacaaaggcagaaacaggccuccaugagaaucuuguaaucuuguuuaacucgaagagaacuguuucuuuuuaaagucaaucaagagaguaaauuucccucuuauuugcauauagucacugagcacaaaagcugccuuucuuucuuuuuuuuuucuuuaucuuuuuuuuuuuuuuuuuuuuuuuuuuuuuggaggcaagcaaucuccagccugugacagagggcugagcacaaagccagaucccuuuguggccuuaaacugggugggggaggggaagcagcccacaaaaggcgggguguucucugcagccacauggugacuggaauguugcaacccagccucuggauuuuucccagcagucccaaguuuaauuaaauuaguuuugccccuuugacuuccuucagccaccuuuggaaaagauggucuccauuguccuguaaauacugcgcucugccacucugugcaggcagcguccuaaaggagccuggcaccuccagauucuaaucaugucccauaggucuagacuggagagcauaagacaugagcuuucugacaccuguuuggcuuuacacaguaggcugacucugacaguguaggucgggucaggucguuggagcuagcuuugaagaacagaagagagccuccucuguccuccuuugaauuucuucucuguacagucugggauuuuuuguggcaggcuauuaggaaagagauauucuaaugcucacagcagcagcugugccaaaguuagacuuuggacaggcaaacaaggaagguuacaguggagagagucagagcugcagaacuaauguaaaauaucaguguauccauagaggguaaagccaucccuuucuggugccuuucaagaaaaacuuagggugaauucuaaguguccaccuuagaguuacucucaccucuaauuucuucaaguugcugaaaggguagccacugcuugucauuuuuagaaacacauuacauauuuuucuuauucauuucaacuaaggccuuagcucucugggaguaccuuucauucaggguuuuuuaccucacuuccagccucccacaggccagugggaggcugcugaccugucugagagcuucuuagccuuucuucacugcugaggcauuccuuccugguuccuaggacauccgcaucuuccuagcucagcacacagacucuccaucucuaaagcagaacugagguacacacagugcggguagggauugcagcgaugagugcccagagccuagcacacacacacacuaacuacaauaaccucuaggaagagacaacagacuccugaaggccagaugucuuuguacuuuuucuuugagacauugucucucuugcucaauggagaaggagcauggaaauacuaguguacucacauggagaguuaaacaaucuugcauucucucuacagcucagguaggccucaaaauugcaauccuucuuuacccugcuacuggaccugacuaaaaccauuucuuugaauagcuccccccaucccccaccucucucugugugucugacuuggaccaccaaaguuuugacuuagggaaggcauguuguguuuuccugccagaaaugcaaaauuaugucaaaacuaaaucaaaagucaaaaaaaucuuuagcguauuugcauuugccuaauaaaugaucuuccuggugucugugaauaacuauaugaugaaauaguucuuuaaaaguagcaguugucaaguuaucuucaguguuauagucaaucuauuuuguaauuauuggccuuguaugaauucccaacauuuggaacucauaaagauguuaaaaaaaaaaggaagaaagaaagaaagaaagaaagaaagaaagaaagaaagaaagaaagaaagaaagaaagaaagaaagaaagaaagaaagagagaaagaaagagagagagagagaaagagagagaaaauaaucuuaaauuuccagaaaguucugugguuccauugauugacugucaauuugaacuuuuagacuaccuugaguuuaacucaggcgagggcccuuggauuauguccugcagucauguuugcaggagggacucuguagaaaggcaacaugauccaacauggcauuuaugacauucuugguguagcaggaagugaacuuacacagagcugggggauaaguguaagcaggcacaaaggucaauggcuuauccagucuuguaacuggggauggagugacacuccggugugcuuugcucuggcuuccugugcaccauuaaacuugcccucccccacugaccccucccccaugcaacuauugggcuaaucuugaguuuggaucuuuuuccgaggaagcagcucccuuuccaguggcugcugccaugccacucgaccuuugaccacagccauaccagccacaauacuucuaguuaauauguauucaucucuuccuaaauuccagcugcuaccuagguuugcuuagauccuguggauauagguugucaccauguuccccugaugauugaagaaucagaagcacacacuuuuaagacuugggcuucucucccugugaggagaauggguuuguccucaaggucaccuggccccacauacuccccaguucaucuaaaacccuuuugacucuaauucuuaagcucuaccaauugcaccuuaauuuccugaccuucccaggagcugaggucccaugcauaggagcucucugaucuccuaguaaaagugaauguauuacuaaccugucuuuuguggauguguuugcauuuccuuacaggaaggaggcuggagaggggggaccaaugggauguugcauuuuaacaggaaagagguuuauuucaaaggguagaguuagugccucuuagacaguggggauuucugucugagaccuguguguuuuuguuucuuagguucuccuuacuaugacaacguccguccacucucuuacccagauucugaugcagugcucauuugcuuugacaucaguagaccagagacucuggacagugucuuaaaaaagguaagugcugaggaacgaggcuaucacccugaacuuucgaugagauaggguuggagagaggugauuggccaggggauucaaagauucugaacuuauuucuucuaaugaaaagaccagaaaggauacuuccacacuaaaacaacauucccauauacauuguugcuugcuauaaggcacuaauuaaucugcuugaaacuuuauuucccaaagcucugaacaaacuacuuuucacagcuuccucguucguuuuuuggaggaaauggagugaaaacguaggaaauagcuacaguaagcucuuaccugaucccuucauuccuuugcuugacagacugcucuguagguguuugcuguugaucucaauucagauagucaccuuaauacaauaagagcuacuuuaguucacuuauuuauagaaacauaagugaaauuagcauaagaggaauauguguaguggggcuugucccuagacaugcagcaaugugaauuaugauccgaugucuacuaauaaaugucuaccaauaaagcaccaguuacaccaaauauguauguuaucacacagcccugguuacuggaaacaaaggugggucagauuauagguggagaugagaccaguagaagcuguagacagaggaaccagggcuaggaggaaugguaccuguugcacauaggucuugaggucuaagaaggcaacugcuuauguguguagagagugaugcugagccuuccccagcagaggacugggcccuccggguaguuacaggaacuuuccacagaugaguuccagagaacucagugggacggugauuccgcuuggccugcagcaaacccaggcuuuguuccaugguagcucuagaggguuauaugugcugguagauggggcagcaucuuaaucacucacccuugcuagguguuguagguuugcgagugagacucuagcuguacuaccccuucuuuucugugcacuguacauguggauaggaacagagaaugucacucagugcuugucccuguguuccugucagcaugagggcagauagcauaaagggagaagugccccuguagauguccagguuugguccauuugggcugugugcuuuugguuucuacuuucagugacauuugcauuuuggguggguuuuuuauuuuauuuuuauuaguuuauuuuuccucaugguacuuaauugccugaguagacaaauuuagguuugagguauagccuuccuucaguuuuuugcuaaacauugauugcaagcaguucaaugaaauugaacucuugauagaucaagggguccuuuuaguuuguaacaccuuuucguucugaguaauguauaaaacagaggguuggcuuuuugucagauucugucaagaauacaaguuuccugucuucagggaauacaacuuucuuguccuccuguaaacagauagagagagacucgcaacaucacaagcugagaacaugucuggcuguguuugaagagaaaaggggccacuuauucacugguguuuguaccugauguaguaccagcuuauacauaauuuaugucagaaagcuuuucuccucuucuacuuugauuuuuauuuacuaagaucagauagugacauuggaccuguagauauuaguauguuuucuuugugugaggcuuaaaagcucaccauaacuuacuuaguucaucuguguuuugucuuaauugagucuuaaaguccauugagucaagaguuuaaaguaacuuaaaauagaaaaaguacaaaaaaacuaagucuuauucuguuuuuuaauucuuuagaagaacaugcuagauguuccuaaauaauuguaggagggaggaagaaaggaaaggcucaauggacagaucaggcacucgguguguuacugcccuccucaugcuggagcacuuuagaacuagaugucauuggcucagcuacacccugagaucuggagguagccucucgaggucucucuccuaagucacucuuucagaaugucccucuuaccuaguauuagacuuacaaaucuuuauugccucuucugcucugugaauuccugaaagucagagcuccaccaccauuacauucuuccuagagcaccaaaggcaucauaagugugggcagaagagucucaaccccucuaguugcucaucugaugauggaaaacacaaguuagaagaagcaaaaccaugaucagcuguuuagaugcuugaggcagcuggaaucccuuccagaaacuucucaaaguucuccugauucauguuaggacagaaaauaguuaaauuguagacuagacaguaauggcugacaguuaaaaauuaacucaaagucuuuaugggcuauaaacuaggugcuguccugggaugucaagagguaguucucugcuuaagcuguagucuguguccauccagccacuugaguggaagauccuugaagcaagacacuaugcuuuaguaaucauaggccagacacugaccuaccacgggaggccagcacacgaaagcaagcauguccuagucugucaugauggagugugugaaugcacauuuuugcuaguguggccuauuccuuaugcccacccuuccacuuacuauauauuaggcuggguaauaaggaacucaguauaucccaggauguaaaauccauuuggauugugacuauuaaggugcuuuuaccuuucaaauaccuccauaauuaagacauuguugaaguuaccuuguguugauacaaaauaaguucauugugggaggaaccacggagucacacagacuauaacaacagucucuaaaguuugguacccacuuacuaauuaauccaacauaaccuggcuucuucacuuaaaguugcacuucaaagucugucaggggagcuauuguuuuuauuguauauguaugugucaauacuucauuaauuuuucuuucccuccucccuaguggaaaggugaaauccaggaguuuugucccaauaccaagaugcuguuggugggcugcaagucugaucugcggacagaugucagcacauuaguggaacucucaaaucacaggcagacuccugugucauaugaccagguaaguguguugucacugugggaaagucuccuuccuuccuuccuuccuuccuucccuuucuccuuccuuucuuucuuuauuaggauauauuuauuuuuauuuuaugugcauugguguuuugccugaauguuuaucugugugaggguauugaguccccuggaucuagaauuagagacaguugugagcugccuuguggguucugggaauuaaaccugagucacucgcaagaguagccagggcucucuuaaccacggagccaucacuccaagcccugaaaagucaccuuucaauaaaaaugaaaggaaauauguagagaauuauuauuugugauaaaugagacgcagcgcuuuuucaagagaugaagcaggagucaacuggaauaggagcugucugacuuucuguagcaaaagucagcaagggguagggugcacaaacaauugauaggugcuaaccuuggaugcuucuacuacaccaguguuuuuaaagagagaaugugauuaaaauuaguucucuuaaaagagcuuauuguucucuugcccaauaauauccucaauuaagccauuguuaaaaaaaaaagaucacucugugaugccaucuuuugauuguuuuuugugauaugaguguucacucaaagaaaggagaaucuguugaggaaucuauucuccuaaaacucaccaccagauucuaaagaggguuccuguuaaaauagguauauguggcaugcaucauuuaaaguauucuauuguagggcuggggacauugaucagucauagagcucuugcccagcaugagaaaggcuuagggucccaucauccccagugugacaaaagugcagaguaaaagcauuauacucaucuuuaucuugcauuccucauuaacaaacucaauacaaucuuagaagcugauuuuuauuuaaauugguguucaguaacaucugucagcccuauguuuuguacaaccuguuggcugggguugaaggucauuaauagucucuacaagagaaaacgagagccuccugaaaugcuggcgaggacucugagggccaaagcaccuuggucagaucuauaggaaggauguuuaugguaucaggagacuuacuccaguagcaagagaccaugccucacaauggccccaaaugauaccuacacagcagguuacucacaaccugcuuaaagcaucacugagggucaacugcuaccuuugcaccugucucuucuuugcauccuccuagugagagcuggaugcuuggauucucuugcaagagcaaaucgccauacuagaagcuguggggagcuagagggguuucuacagaguaauauaauucagggccuucggacugggucuucagcaguugggaaguaguaacaaaguaacucauuuuaaaauaaaaucuguuuuuuauuuugaacaccacuugggaaguccauuuggcauauuagguauguuccaauucaagacaguuuugugguauuucaacacuuuccagugucucuccaaagucucgcugcugacggaaauucuuucuuuuacuucacagggggcaaauauggccaagcagaucggagcagccacuuacauagaaugcucagcuuuacagucagaaaacagcgucagagacauuuuucacgucgccaccuuggcguguguaaauaagacaaauaaaaacguuaagcggaacaaaucgcagagggccacaaagcggauuucgcacaugccuagcagaccagaacucucagcaguugcuacggacuuacgaaaggacaaagcgaagagcuguacugugaugugaggcuucgccgucuauaaggaggacgcgggaauaucugguguuuuaaaaaauuaauaauucaaauuaaaaaauguaaaaagcaggagcaaaccggaaagauggagucaaaugaagugcacagccaaagucacauagauacaggcuuaggaggcccuugaaaggauacccacuuuucggaauccuguccuuaguuucggcauguagaccgaguggugagaagcgaaugcauugaagaguuuugugugacaagaagugugacuugaaaaauccgccaaaaacaaagggagcuaugaacaggcgagcgcuagagaagugggggacgccaguaccuccaagaagaacauccacgcucugaauggugcuugaguauuuucgguuuuguguuugugguuuuguuacaaccuauucguggaucucuacuuuuugauuucguuuuucaauguuuuaaucccuuuuuccaaaaaauauauauuaguagaccguccucauuggggaacucgcacugugaccuuagcguuuaguuuucuagaggaugcgaucuaauuuccuccuagcucaucauuaaaauggaaauuguacugggacccgcugggauucgagaggaaaacuugaugcggcuuugaaaucuugacuuccugaaggucgcugcugagcaagaugguuugaaagcaagcuucagagcccuuacaagaugcauagaccagcacuacagagauugcguagaucaacuagaagagaguguugcuuuuuauucugucugaugguuuuguucauccuugugauuguccuuaacaagugguaaauuguuccguguaauauuuuuugugcgcuguuuagaagaguguguguggcuuuguuuuucuuuuugccaucguugaugaaaacgagaagucaaauaaaagaugugaucgucagaugugauagcgugauuaaagaagaggcaggugguugccgauuucaccaggagagaccuugaaugaaggaguaguaguagccgagagcacaguuggugaauggggcugucuggaacaaaauuauacgucaaauacacagagcaaaagcacucgugucuggggauggugccccuagacuagcaacagaaaguaagcugucgucuggugccacuuccuucaaagaaaugcuguucuggcaaaacccccauuugcucaugcuuuaguaaaccccaguuugcaaagaagccuauaaugucugcccugguaugagccuagggcguuucucaagugacugcuaaaccucacuuaaccauacauggccagggccagguugaaaauguugaucguugccagagugauaauaagcauuuaaaauaguuuacagguuucuccuuuugagcaguuccuuucagagaagaaaucauuuacgaucuuugagaguuggugcuuguuaaaaacaagcuuuuuuuuuuuuuuccccaaugaugacgcuucauuuuugaagcgcuggagcggugucucccuuaaaccgcggcagaaggggaggugaagguaacuacaacacccagcucugugucuucacaagcgcuuuguuuugucucugcaagaaaaugccaucucagucauuucccaugaaacucagacaucuuaccaacauaauacgcucugacugguacagcauuaugcuuugggcaguauuacaaaaucgcuggcaagugcuuucuguauuuaaauauuguaaaaagaaaauaaguuauaacuguuauaaagcagaacuuuuuguugcuuuuuuuuuuuuuaauguugaagucacuuuguauguuuguuuggucaguguuuccacaguauuuauuaaaacguauggguuuuuuuuuuucuucaaauaaaaaaguaaccaugucagucucu

SEQ ID NO: 815 - RNA, 825 nt, Mus musculus
uccauuucuguugcuuuauugucuucuauuaaaaugcuauguguauacaacuguaaccauuccauggggucacaugucucuaauuuauuauuucuacacaugcacacaaacacacauacacacacacaaauacacagagagagagagagagagagagagcauucuuuuuuaguuuguguuccucaugccauucuauuuuuuuuugugacucuaauuuauaaggccccagccacugaaccucauauguuauaggaaaacuuucucuauauauagaauaaaaagaaagcauugacgaaggcaaaucacuguggaggaauuaugagaauccaugcgcuggaccaccgcuuggaacuuucccuuguuguuuagauacugagaucaccaaggaggccaguggagagggcacuuuggauggugaccagcauuggaaagcaaaguuuagcuguuuagaucuagaggucagagaggaggguggaugggaaggucaccucugcccaccagaggcauuaagucacagaacagagccaagcgucuaugaacugaaacaagcgcguucuucuuugcagacacccaucuagcuugcacguauguauaaaugaaagccacucuucuuggcuaaauguaguggauaguaaagaaauaaaguacauucuuuuuuguuuugguuugguuuuuuuuuuuuguuuuaaacucguaguauguuauuuguucauaaaaauagguaauaaacuaggcuaacaggaugguucaguggauaaaggcacuucccauaguaggagucugacacacugagguaucauucaauccccacaggguauaaccgac

SEQ ID NO: 816 - RNA, 65850 nt, Mus musculus
guucauagcagccuuguuuauuauagccagaaccuggaaagaacccagaugucccucaacagaggaauggauacagaaaauacgguacauuuacacaauggaguacuacucagcuauuaaaaacaaugaauauaugaaauucuuaggcaaauggauggaucuggaggauauccuccugagugagguaacccaaacucaaaagaagucauuagauaugcacuuacugauaaguggauauuagcucagaaaccuagaauacccaagaaguggaugcucacagucaucaaauagauggaacacaggguccccaaugaaggagcuagagugcccaaggagcugaaggggucugcagcccuauaggaggaacaacaauaugaauuaaccaguacccccugagcugugucucuagcugcauacguagcagaagauggccuaguuggccaucaaugggaggagaggcccuuggucuugcgaagauucuaugccccaguauaggggaacgucagggccaggaagugggaguggguggguauaggggauuuucagagagagagcgcacgcacgagcuuugccagucucagccaggccuaaagcauuguagacaggcuuugcccuggaguccuugguaugaacaagucaugucacauucacauucacucagugaaugaaccagcacauacacauucacucaguacuugacucaaguagggcuuccucugaucccuacggauaggcucuuucccuuugcuuauuacauuuuaaagauuuuuauuuuauguguaugaauguguuuuuccuguacuuauguguacaucagaaguauaggucauaaaaggacacuggaauuggagugacuguuguaagccacuaggaacugaacccagauccucugaaagaacaggaagugcucuuaaugaacugagcccucuccagcaggaagaauaauucgauagcuugagagcuuggcuaaaaguaaaauaucuuuuccaggugacuguucacuuagauagcuccuuuggagaagucuuuuauucaaacccuuagcaucuuaaauaguuuugguguuagaggccuucauauauuccaaguauaaacuuaccagcaaaugacuuggaaauauuuuacaugugcuuuuguuguuuuguuuuagugguagcugcacacuguucuuuguaacuugaauuuauggaaaagguuauauacucuuaccaauauauggcauuuuccuuguuuucauucccaugaacagaaaaucuuccgugcuauauaugacuauauagcugcagaugcggaugaaguguccuuuaaggauggagaugcuauagugaaugcucaggcgauugaugaaggcuggauguauggcacugugcagagaacuggcaggaccgguaugcucccugccaacuauguggaagcuauuuaagcacuucaagaccuccaucagucugcaguaucugcaacucugcaggcaacauuucaguggagacuucaguacaccagggcuuucaagcucucucauguuuucaccuguagcaauaucauuucauguguuacaaucucuucuauagaaaccaugguuacucuccauguauaaacuuaccagcaaaugacuuacaaauauuuuacccaacaucaauucaucugcucaguucuuaaacuagauuuacagcuuaauuuuuuuccccuggauuuauacauggaacuguagacaguaaacauguaaaaauuuacuuuccaaauaagcuuuuacauuaugaacucuucaguuuuaaaguaaauucaaauucacaauagaauuguuaaaugcuucuguaguguuauguaaccaaaccaguccuucccaauuauaaaaacauuugacaucauucugaacauccaaacuuuguaaaagaaaacaagagaagcccuuucccuuguuuacuauguguuaaugcuugcguuucauuucuguaagaaugaacagucaauaucaaguguugagaaaguagaaacuaauaaaaucuauaguacugaaauaaacuguucaugggcaacacuuuaauagucugaguuuaaaaguuaccuaaauuugaaguuggaacugugaguuggugcucuuugugugauucccagcauccacauggcagcucacaaccauuuguaacuugagucccaaagaucacacacacaugguacacaugaauacacaggcaaaacaccuauaugcauaaacaauaaaaugaaacccaccccucccauuaaguuacuuaaguuuuuuuguuuuuugagacaggguuucucuguguagcccuggcuguccuggaacucacuuuguagaccaggcuggccucccaagugcugggauuaaaggcaugugccaccacugcccggccuaaguuuuuuuuuuuuuuuuuuuuuuuuuuuuaauguacugauaaaaaugaagaucagacauucucaaaaugauccauuuuacauauauuuuggauuuuguuuaauucuuucagcuaaccugugucucuugacuagagaacugaagcaauuccaacuuuuagguuggcauuaauccaucuuaguucagcaaacuuuccuuaagagcuuuggagagaccugugggaagcaaucuugagggauuccugccaccugaaugcaaugggcaaaaccuugugugaaggaacaggagguuuuuacucuuucaagacaaccagcaaugaaugccugaccauuuguuuaaaaacuauccuucucaaagaucuaaagacugucuccauaacaugauaacuacagcgauacugcuaaucuggagcaggucuuuuaguuguuauuuguuuggggcaaugcuggauaucaaaccgaggaucuugggcgugcuaggcaauguccccuuuuucuuaaguuucuuaauacaugauucucugagacuuaagggguugaguacucuagcaaaaaucaccuauuuguaaauagggagaaaacaucucuauaucaggcacugaacugcauaaugaaacucauugagaaaguugguguccucagagucccaaggcauacuuuauguauguugauuuuuuuucaauauuacaacaaaagcacuaaaguaacuuaauacuuccaaauucaacaguguugugaaaauuucaguccaauuaguccaguaagggaacacagaagaaugcuacugagugggcugcuccucauggcuuauucccccuaucaggaggcacaguacccauucugaccuagaucccccucccaccucagucgggaauugagaaaaugucccacaaaccguucuacaggcaaucuucccaggugagucaacuuaugcaaucaaggagucaaaagaacaagaaaaacacccuaaccagcacaaaggccuauguuuauucuuaaaugcacuuuggagaggguaaauaccugugcauacccaauuugcacaacauuuuaccccuucagcuguucugcuuauucacuaacaagucccauuaccuuuuggcaaggcagaaccaucauaagagcauaugacaaaagaggcuauuuugucggauagcuggaaauagaaaagaccaggguaacacagucuuuauggacaugguucgcaaugaccuaagccuucagcccgaucacccacgaaaagcaccacagagaccaagccuuaguaaaccuuagaaaacauucuagacccaaacccccacaaugucugaaucuuccaaugauucucucaccucagucuccaagcuucaucuccacucggugaaaaucccaguuaaaugaaacaucaaucgcauugugcaguguuccucuaggucgaccaugauaacaauauagacauuaccaugggcuaggaagcccuaacaaucaucugaaaacacagcaacaguuggaucuaugggcacagaagcagaauuacuaacauucuggaauaggaaaaagggaaaggucauaggaccucccugggauugccagaguugcaagagauuugggacaagaguauagagaagaggaagguuaacugaaagcaggccauaauguaguuuccaugaggcugucauaugugcuggaugguacuguacagugaugcagcucccuagacuccugucaccucucaccagcgcucuauaaacucaccgacucacuuacacuuagguacacuuguacucgcucuccggcuccuacuugggcugaacagauauugggaaaacuaaugcaauaugcagguaucuggcaauaccuaaaacaucugcugcacauucaguacaaugagcugagagaguuuuuauuaugacuccgucauauuuaucagcugcuaauauaaagcucuuaauucuagauuuuucuuaaagccucgacauugaaguagagaaucguccuauaucagauauccucaaaaauguuuaaucuugggcuggagaaauggcucagcaguuaggaacagugacuauucuucuagaggcccuuacuucaaaucucagcaaccacauaguggcuuacauccaucuguaaugggacccaaugcccucuucuggugugucugaagacagcuacaguguacuuccauauaauaaguaaguaaaucuuaaaaaaaaaaaaguuuaaucuugcuuuccagccaaccaguucacuccucccauaacuucacauaaaucuagcuagugagauuuaacuguaaaucccacaaagguuuccuaacauuaaccacauccuagaagcuggaaaucacuaauguccuaacuuucacccauccaccacaccuuugggccuccccuccccacaucugcuuguucuauuuuuaccagucuccugggagcaaccugagaaucuccacuacaaacaugacuaucaagcugcagaggccucaagaccaguuauuugcuuuaccuucuaacuguaacaaagagggaaaaauuaacacucaugccuaagcauguuuuggauuguaucaugccccacccugccccauucuuguuuagaugagauuagccaaauaaauaggucugcuguccuuucaagcaaaguaaaugugggcaaaaaggcacacaggaggagaugcuaaauacaaagacuggagugaugcuucuguaagccucuccccaccccuccucccaagcucugcucuucucccauguggccaggaaaccuggaaagaggcccagaacuuugucuucaacccaagcugacaucuuugaaacagacuccaaguagaguugcugggugcuauuacaauuugcuuucuacugugaucauuggcgugccucggcaacuugaagccaaggcaagaacccaaggcaggaagaagcaagaauuaagucaaaggcuaugguggaaugagccuuauuugguuugacucccauggcuuguuuggccuauuauacaccccgggagcaucugggcugguccgucccauaccaaucaucaaucaagaaaguaacuugggcuggagagacaucucagugguuuagagcagugacugcucuuccagaggucccaaguuaaacucccagcaaccacauggugguucacaaccauucauaaugggaucugaugcccucuucuggugugucugaagagauugacaguguacucacauacauacaaugaaucuuuggggaaaaaaacaaguauuucuuuuaaaaagaaaauaaaucaaauuugucuuauaggccaaucugacagaggcauuuuuaguugagguuugcucuuuccaaauagcucauuuguaacaagaaaaacuaaccagcccaacugaccccuugucaaucugacauaaaaaaaaucaucucuguuuaaccauaacauuucccuguacccaaaucucaacaucaacauccaaaucaauaauuuaagagaaaaaaaaaguauaacuuuacagucaacacuucaauauaaaagucugagcugucuuuaaaggcaacuacgcaugccugggaaaggagaguuaauuucuuauuaaaagagggaagaaucagggcauaguuccaaucaaagcaaaaccaaaaucucaguguaauucaaauaguucuugucuauuuucuagaacucaccauguucuggcuccaaagggcuuccuuaggaagauccucuucagcucugccacuugcaauacaagaagcucccuuuguagucucaggcuggcuccacuucacaccugccacaguccuggacucuccaguauagaaaugucucucucaguagcuucaaucuuguugcuuccaugaagccaagacuaguacuaugugggagacuuaacugacagcuugaaaugacuccuuggugccuucaggacaacuucugguugcugaacacaaggaauacuuaccagauuucaccucaauaaugcuggccuuuuucuuuagaguucucaaccccacuaaccaacaucaauuaccaguaaaaccaaaguuucacuucagugguccuggucucuggagcucuaaagcauuacagauucuucaaucuuagaugaucagaagccagauuuuuaauauaaaacaccacucaaaugaauauuauuugagggacucaaacuuccuucugaaaccucaccaaaaaaaaauuacuaugaccauuccuaucuuccaaguacccacagaaugcucaauacucaaaggcuuucccauucaauacuuccaaacauguccaggucugucacagcaauaucccaagcuucuguuagcaauuucuauacuagucagauucuuuuacuuaauacaggcuuuucucugugcagcucuaguuguccucaaguuuaagagauccuucugccucugccuccugagugcugggauuaaagguaucugccauacccccuggcuuuuuuugaggggugggguagacguuuauuguaacagucaaauuacaugcagugauaauuugaauacaacguuuccuaucccgagcuuuuguccccaccggcaagaacacacucaggacaacgggaaucuucugcggcaaagcuuuuauugcuuacuuaucaggaggaagacgcugaaucaggaaaauggcgcugcuuauagagcccgcagcgugauguuucagcaccugauguggcaugacaacuccugauucguugcucgcccaucaccccauuacuacgccgaagaugggcagugacucaagugcaaagugcaagaguucacucuugcacuugcgcauacggcuuguuuacuaguuaggcacaguggaagccagcgccaucuuauaauggcgacugcucacagcacacacgcgauugcucgcggcacggaucuccacaguuucccauaaagcuugugggcauuugaauacucugucgguuguuugguaggaauuaggaaguuuuuaauuaaagguauggcacuggaggagggaaggcuuaugguuucucaaagagcuucccucagucccaugauguuuauauaggucaggaugugaguucucagcugcugcuccaguaccaugccugcuugcaacaaguucccuccccaccuacuaugauuaacacuaaucccuauaaaacuguaagcuucaauuaagccuuuuuuuuaauuagguauuuuccucauuuacauuuccaaugcuaucccaaaaguccccaauacccacccccccaacuccccuaccccccccacucccacuuuuuggcccuggcauuccccuguacuggggcauauaaaguuugcagguccaaugggccucucuuuccagugauggccgacuaggccaucuuuugauacauaugcagcuagagucaagagcucagggguacugguuaguucauaauguuguuccaccuauagggcugcaaaucccuuuagcuccuuggguacuuucucuaguuccuccauuggggacccugugauccauccaauagcugacugugagcauccacuacuuuguuugcuacgccccagcauagucucacaagagagagcucuaucuggguccuuucagcaaaaucuugcuagugugugcaauggugucagcguuuggaagcugauuaugggauggaucccuggauaugguagucucuagauggcccauccuuucgucacagcuucaaacauugucucuguaacuccuuccauggguguuuuguucccaauucuaagaagggacaaaguguccacacuuuggucuucguucuucuugaguuucauguguuuagcaaauuguaucuuauaucuuggguauccugaauuucugggcuaauauccacuuauagugaguacauauugugugaguuccuuugugauuggguuaccucacucaggaugaugcccuccagguccauccauuugccuaggaauuucauaaacucauucuuuuuaauagcugaguaguacuccauuauguagauguaccacauuuucuguauccauuccucuguugaggggcaucuggguucuuuccagcuucuggcuauuauaaauaaggcugcuaugaacauaguggagcauguguccuucuuaccaguuggaacaucuucuggauauaugcccagaagagauauugcuggaucuuccgaucguacuuuguccaauugucugaggaacugccagacugacuuccagagugguuguacaaguuugcaaucccaccaacaauagaggaguguuccucuuucuccacauccucgccagcaucugcugucaccugaauuuuucaucuuagccauucugacuggugugagguggaaucucaggguuguuuugauuugcauuucccugaugauuaaggauguugaacauuuuuucaggugcuucucugccauucgguauuccucaggugagaauucuuuguucagcucugagccccauuuuuaaugggguuauuugauuuucuggagcccaccuccuugaguucuuuauaugcuuugugucccauagguuuggguauguuauggcuucauuuucauuacucuaaaaagucuuucuuuauuccuuccuugaccaagguaucauugagaagaguauuguuuaguuuccacgugaauguuggcuacuauuuauuuuguuauugaagaucagccuuaguccauggugaucugauagauacaugggacaauuucaauauuuuuguauguguugaggcuuguuuugugaccaauuauguggucaauuuuggagaagguaccgugaggugcugagaagaagguauauccuuuuguuuuaggauaaaauguucuguagauauccgucagauccauuuguuucauaacuucuguuaguuucacugugucccuguuuaguuucuguuuccaugaucuaguccauuggugaaagugguguguugaagucucccacuauuauugugugaggugcaaugugugcuuugagcuuuacuaaaguuucauuaaugaauguggcugcccuuguauuuggagcauagauauucagaauugauaguucaucuuggagguuuuuaccuuugaugaguaugaagugccccuccuugucuuuuuugaugacuuuggguuggaagucaauuuuauuagauauuaggauggccacuccagcuuguuucgucauaccaugugcuuggaaaauuguuuuccagccuuucauucugagguaaugucuuuuucucugaguuuccuguaagcagguaaauguuggguccuguuuguguagccagucuguuaguguaugucuuuuuauuggggaguugagcccauugauauuaagagauauuaagaaagguaauuguugcuuccuguuauucuuguuaaaguuggcguuuuguucuuguggcugucuuuuacguuuguugagggauuaccuucuugcuuuuucuaggaugugguuucaggccuuguauuaauuaguuuuuuucuguuauuauccuuugaagggcuggauucguggaaagauaauggaugaauuugguuuugucauggaauacuuugguuucuccaucuaugguaauugagaguuuggcuggguauaguagccuggacuggaauuuguguucucuuaguguccaggcucuucuggcuuucauagucacuggugaaaaaucugguguaauucuaauaggcuugccuuuauauguuacuugaccuuuuucccuuacugcuuuuaguauucuaucuuuauuuagugcauuuguuguucugauuauuaugugucgggaggaauuucuuuucugguccagucuauuuggaguucuguaggcuucuuguauguucaugggcaucucuuucuuucgguuugggaaguuuucuucuauaauuuuguugaagauauuggugguccuuugaguugaaaaucuucauucucaucuacuccuauuaucaguauguuuggucuucucacuguguccuggauuuccaaauguuuugaguuaggaucuuuuugcauuuucuuugauuguugugcccauguucuguauggcaucuucugcaccugagauucucucucccaucucuuguauucuguugcugaugcuggcaucuaugguuccagauuucuuuccuaggguuucuaucuccagcauugccucacuuuguguuuucuuuauugugucuacuucccuuuuuuuaggucuugguuuuauucaauuccaucaccuguuugguuguuuuccugcaauucuuuaagggauuuuugugcuuccucuuuaaugucuucuaccuguuuagcaguguucuccuguauuuaagugaguuauuaaauuccuucuuuauguccucuaccaucaucaugagauaugcuuuuaaauccgggucuagcuuuucggguguguuggggugcccuggacugggcgaagugggagugcuggguucugaugauggugaguggucuugguuucuguuaguaagauucuuacguuuaccuuuugccaucugguaaucucuggaguuaguuguuauaguugucuguuuagagauuguuccucuggugauucuguuacccucuaucagcagaccugggagacuagcucucuccucugaguuucaguggucagugcacucucugcaggcaagcucuccucuuauagggaagaugcacagauaucuggcguucggaccucccuucuggcagaagaugaaggcccaaaacagaaccuuucccagaagcuguguugcuuuggccugucacagaagcugucagcuucugugugcacacucuuaccugugcagacuacuuuucgguggagucccggaaccaagauggcuucugucguuccuaaggcaaaagccucccgggcuggccggggagguggucggaugucuggagcccaaaaagggcgcugccucagaagcucuguggcucccgccuguccuagaagcugucagcuucuguguauacacucucaccugugcagacuuuuuuuuucccaauuaagccuuuuuaaguugccuugguuauauuauuuuaucacaccaauugaaauauaauacauauugaucgaaguccaucacugaggaaaagcagggcacgaacucaagcagagcagaacuugggagacaggaauggagcagggaccauggagaaacucuacuuugauuugaucagccugucuuucauacaaucugggacuaccuguccaaggguggcaccauccacaguaggcuggccucucccaccucaaucauuaaccaagaaaaugcccccagagacuugucuacagacaauaaagguuaccacuuuccaaaugaccauaguuucaaaugacccuaguuugugcccacaaaaacuagcacauaaauaaaugccguauaacacuuucucucguauuuaauaacuaugaauuuagaaaccaacaaaacaaaauacaacacaccagaaacuuuccagagccacccagguaaaugcgggguaagaggguuacuauuuguugguauccaugaugcuuguaaauacuggcacucaaucaugucauccuuaguccccucaagucucaauuaauacaaaacagauuucaaaaucaaggaacaaaaauaaacaccagaaauaaguuauacuuuuauuuuaaauaaaaguacauuuaaaaauaaucagucucaaauggcaaaugacuacagccaacucccaauuacacaugagaaauuuuacucugaagcaaacguucucaacaaucaugugcccgacauacuaaggaagcugcuuguucccaagacuguuaauaauacaaccccuuagaauggugcccuuauuucucagguacuaguguuauuaauauaauuaacagauauuucuguuaaauuguaacuuaaaauuagagaaucucaucaaauauacuuucaguauaaacuaaacuuucaccaagggcagcaaaauauuaacaaaugacuaguucauauuuuguuaaggcuauuagcagaacaguguuuaaaauggacugaaagcaacuaacucaccaaaaauaaguaguuguuucauacuauauguguauuagaacaccaguaaagcaaucacaaccaugacuaucuuauaaaggcaaacuuuuauggcuaauaggaaaggcguucagaccagucuagcaguaacuaaauugaccacauaccaaacaugaauaaaauuauccuguuaaaaggacugacaaacuuuuaaauuaagagacaaauaaauacuugaggacgguaggcuaauuucagauuacuuaacugucaccaaauuaggaaagcagccaaacacagccugacugccacaauacaacuaauucuggauacuaagaauauagaacuauuucuuccuuugcuucaaaauacuuauaaaaaauucuucccaaugguuuaaaauaagagaaaguggggccggaguaacuaagagcacuggcugcccuucuagaggacccagguucaauuccuaccaccacaaccuucuggaacuguuaaguuccagaagauuccagaagauaugcccuuuuucugacgucugugggcacaucaugcacauggugcacacaggcaaaacaaacacacaaacacaaaaacacaaaagguaaggcaucguuugcauugugcuguagugacuaaguucuccuacuauacuuugguuucuauacucaauuccaguuuuuuugaaaagucuuauucuauaaaaacuaaaaugcuuuagacauuucuuauuaaacuauguacaaaauaguuuucccagccuugaacucuugcucucuaccccacaaggcuagaauuagauaaguugcuuaccacacaccugacuauauauuuuaaacuaaucauauuaauugggaaaagguaguguuauacaugacagagaagcauuccaagccaaccacuauuuucuaacuacaggauugcuuguucuuccaccaaaagguuuuaucaucaaauuuuuggcuaagggagugucauaugguaguacacacuguuaaugccuacauagggaaguuggaggcaaacagaucucugcaagaggucagccagccuaauuuguccuaaguuugaugacagcuggggguaaugugagauugccucaaaaucaaauucagcccaccugauucccccucacucuaucacuucccugugcacuaauaagcauauguguuuaauguuaaaaaguuaguucucuacccaauuacaaauuaacaaagacaacauccacucugcuauaacugaagcauaaaagcuacaugacagagguuguucuuuuuagcaucuuaggucaggucauuucuuuucauugaagaaagguuuuuauccucaggaagaaauguugugacaaaauuauaacaucaucuauucuaagaccucagugaaguuccauagcuaguaagagcacuguuaaaaggaauuacagaucuuaaacuuaaaggacauggacuuuaauggauacuaccaaagagcaauauauaaagccagggacaacaaaaacauaaccagaacuaaguuaucagacaccacaaaauuaagauaccuaugaaauguugaaaaaacauuugggaggcugaaacaagaggguuugagacugaguugcaggccagccugagcuagaguuuugguaauaaaaacaggcuucugccccagucaaaugucaccacaacaaugcccacaauuguucuacagcccguggaccugacaaacuaccuaugaaaucaacuacaaauaaucaaaugaaaccugacucuuaaucagucaagucuggaagcauguuaaauauuuccacugacuucagaaacaauacuuuaucauuuuaauauguguaucuuagaccaaauaaaacucuucagcuauuauuugcggaauagaacauuaacuuaaauguguuucuaagacccuauuuuccccccagauuaauuggguuuuaaacagguucuuuucuguagaccagguugaccucagcacaaagaugucauaugccucagccuucaauuaagauuuuaaauuauugacauucuagugacccuuaaauaugggaguuucuggcuaccuuuaaguuguacuaagaguccaagaacgucauucaacaaccaugcuuuuaaucuuuagauuuaaauucuauuuacaaacuguauuagcccuauuaauuagauccaucaccacuauuugaaaugcagcguuaagacccugcaguacucaguaguaguuuaacuugcugaaacagauggcaucuuuacuaaugaacucaguuugaacaugaaaaucaacuauauucaaagacauaaaaaauuauacacuuuacagagucuuuuaaaaaaggauuaagauugcucagcaauuaacaacacuugcuguucuuucagaaaacccaaguuugauucccagaaccuacaagguagcucaugcuuaucuauaacucugguuucuagggauuagguggcuucuucugacugucacaggcaccaggcuuguacaugguacauauccauacaugcaaaauaaucaugcacagaaaauaaaaaucuuaaaaauuuaaauuacauauuugugugugcauauacaugugcaccaaguacauacagaggucaaaggaccacuaucguuccaccaugugcauguaucaagaauggcacucaaagacauaaccaggaugggaggaaagcacugcauccacggggccaucuagccagcccuagauuuauugcuuaaauauauauaauagggcaucacagcugaaagccaauauuucaacguuuuuaaaaaauuaaccauuagaagccgggcguaguggugcacgccuaaaauccuaguacuugggaggcagaggcaggcggauuuuugaguuccaggccagccuggucuacaaagugaguuccaggagagccagggauacacagagaaacccuaucucaaaaaacaaacaaacaaaaaacaaacaaacaaacaaaaacaaacaaacaaaaaacaaaaaaaaaaaagaaagaaaaaacaaaacaacaacaacaaaaaguaaccauuagaaaagaacugaagggguuccauguaauaguaaaacaauucuuuggugucaacucagaaauauuaauguucuuuguuauuuuaggaauuaacagacagaagaaaaaaaagcaaagccaagaauacugaaaagaaggcgacucaaccuuaaaaauaacaaagauucaauaaacugaugguaaaacaccaucucacugagcuauggcuucacucagauauaugcuguuauuaaauucaggaauuuaagcaaaucauuuauuugccacccuuccugcugaacuuugaacucccuaagaacuuugcuaugccuacaagugaguaaaccagaguuaaaagaaugcaguuugugcaaugagccauccauccauccacauucuccuugcuaaucacucccauucacuauauucugagguguucacgcacaccucaguacuuaaauacaguggccugacaaugcaaaccaccauuaucaauuguuuuaaacacuaggcuuuuucuuguuuguuacggucuccuagguccuuggugcaacaaucccagauucuuuauggcccucuuuguaggugaacacacuuauuuccaaaauaucuguaaugauuuaugcuuaugcaaagugacaccaacuuuauuuacgaagggcgggggggggggucucugcuggaaaaagggagaccuuaaacuaaaaaauggcaccggcuuuauuuauuuuaaaauggcagugucuuucuaagcagagguuaaguuugaaacuaagcucacucacuaauuuuacucagaaaacaagcaaaauauacccuuggggagacauagccaagcauaguggcaaacaacggcaacuccagaucucugacagcagaggcaggaggaucacggaaguaaagcuagccugggcuacguacagagacuguaucucaagaacgaaaaacaaaacaaacaaaacccaugaaacaaauaugugaaggcaggcacuaacuacuuggugaaauuuacaaaugguuuaauuauauauccuaauuuuuuaacucaacaaaaacguacauauaaaaaaauggcaguuuccaauuucuuccacguuuagucuucaaaauaugugaaaaaccaauuaucucuacagacaguuuauaguacacuugcaaugaaaauauccaggguaacucuccauuaagaagaaauaugagggaggcacauuuucuaguggcugggauccucuuccaaaccauaagaaaaaaggcagugguauguaacauuugcugguuccaauaauuuuaauuauucuggacauuugagaaaauaaacucauguuuuaacuaaauacaaaacuaucuguugcuuuauuuguagauaaagacuccuacaaauauccacaguagguccaaugaaguacuuuuacuauccacauggauauuuugauauuaaauauauacaaauguuucuauuacacaaaacaauaguauucacaaaaagcugcagaaaaacccaugcgauuaaugaaggcugaacuuuauaaauuaaaaaacauugucuucuauacauaauauacagagucaugcauuuaagguugaacacuauaccuucauaagaacacauuuucacaaaggcugcugcacaaguauuugucaaugcaaaaugaacagaaucuuagugaauuaagcauuauuauuuuaacacacaaguugaaacuugauauuucaaagauuuucuacagcuguaaucuucaggaaauguucucauucuuuugcaucucaguacagguguuccaccaggcacaacaaauauaaauauuuugaaagaguauaaacaucucugucaacucaauaaaguguaaauaaaacuuuucuucuaucuuaauuaaaaucuuuuacaugagcuauaccaaaauaugcaugaauuaaagcaugaaaaaaaaaagguauguauaucucuuuugcuuucaaguuucaguaacauuuaaacuucuuaaaaaacuauguguacuggccaagaaaauacaguagggaagaucuaaugaacuuauaaaaaugaccuaguaauucauuaccuuucaggauuugauuauuuuaucaauuuuacaaaguguccucuuuaaauggugugaauauuucuaaaagccaaaaaauaaaaucugauggugaaaaaacuuuacauuucucuuaaaauacuaagaauuuucaugggcuggugaucuccaacgugacuguagauuucuuauuauagaguuugccaugguaccaaguuuuucaugcauuucaaauagcuggcuuccaguguaacuguagagaucuucugaguccaguugaagagcaagagcacuaauuugugccacaagauuuuuagacaaugggguaucuagggucacagguucaaucaaaucuauaagaggaaaaaaaaaaagccacacacacacacacacauauauauauauauauauauauauauuaaauccauaccaguuauaaaaacugaucuguaucuccaaucauacugagaggaaauaagcuaugagaaacuugaucaagaaaacacaaugcaaguaaaaucuaccauagcuuguuacucugcauaaaauaacugaacaaaauguuaccauacuuaucuaugccuugauggacuaaacacuaacacagagaaaaccaguuagacacacuuaaaauuaaauagguauuccccucauguacuugguggaggggagggaagcaggggaauauggugaauuaauaguuguggucaaauuaaaauuaaagcauuggccuggagaaauaucucaguacuuaaaagucuauccuuccaaaggaccaggauucauuuccaggcaaucacacggcaaaucacaacugcucuaauauuaguuccagaggaaccaaaguacacaaauacauacaaacaaaguguauauacuacaauaacauuuuuuaaaaagauguaaaaccauuaacaaaguuauguuuaccaagaacacuuauuccauaugaaacuaacgugcuuggcuagcauaccugaggcgaaccuuucuucauccguggagacaguccugcucuccacuccauuuacugccuucucagaaauaucaaaaauuggaauuucuucaaguccacgagauuucaucuugauuaugcauuuaaaacaguagcaaacagaauaaaacauauuuuaaacaggaauuacaugaaacaugaaaugccccauaauccauaaucaauucaguuaaugaugcuaaaaaauauuuacuaaaacuaguaucauggcaggugugguggagcaauucugcaaucccagcauucuggaaacaaccucugcuggacuuuuuuuuuuuuuuuugaguuuaaguacagcuuagucuuuaggggguucuaggccagccagagcuauacagugugacuucugccccaaguguuuccuaaaagaguuagaaauuuauuauuuuauaucauuucuuagaaaacauaguaucaaaggcuaguaaaauuccccaaguucaggaauguggaaaagauaguagaaaucaguggcuuuugcuuucaaagauacagauaccucacugguagagcgcugcuuacuaugcauuauguccuaaucaagagccaacagcacaagaaaacuacuauaagguaucccagguuuuauggacuacugcucaaagaaauugcucaaaguuuucaugacucaacaauccuauacaaaauggcucaaaugaaauaaaaauauggccacauaaaaaucuaaaagauuucuuauaaaaaccaaaggagaaaagcaaccccuaagcccgucaguugagggaugggaaaagaaaaugugguacauccaaagaacccuauuuggauauacagaaagucagauuaaccauaaaaccuguaaccaccaaccagacucuguguuauuccaauauuaaacaauguucagaguagguaagccuacagaaaaaaacaaaguaguggaugccuaggaauggggaguggaaauggagaguaagagacagugaguagagaccuaacucauuuuggagaauuuucuuaauuccaaaauuaaauaaaucauaggaaugguauauaucgaauauaauuacuuauuaacaauagacuauauggaucaauuucauuuauaugugaacuaaaucuuauuagagcuauucagaaaucuacacauaaacacaugguacacagacauacaugcaggcaaaugaccaacuuuuaccuguugcucaugguauacucugagggccuuuuuuacauuaaacaccuuuggagaacggauaggcagaguuuuuauuucagaugccguaagcguacucaaauccccaaugguuuuuauauucuuggcucugaugaguugcccaagaccucuugcccuuuugaaaaaaaagaaaaacauaauuaugcuuuuacagauaaaugaucuaucugugagcacuucuccacuuaaacucagucagaguuuauagaguccaccuaacccauauagugugauaagcaaauauguagugaaauacaauucuccucuagcuucuaacacuuuaauaacagcagcaaugaugugcucugcugugcuuauacaaagauauaaaagcacagcccagcacagcaggaauacgacacguuuucacaccagcuuucucucuguggaucagguccuucaucaacugugugcacuuuuggguuuuuuaaccuauccuguccuaggcccuuuuuaacuugacuuccuucuaucuucuauaugcaugacauagaacugacagaguucucuggagaaggaguuucuuacugaggaauuauguucugauugaucagucuaguaauuaaagaaguuaucuguuucccaaacauguaacaaaucccuugacauuuaguugucuagcugugugugguggugcacgccuuuaaucccagcacuuaggaggcagaagcaggcagauuucugaguucgaggccagccuggucuacaaagugaguuccaggacagccagggcuauacagagaaacccugucucgagaaaaaaaaaaaaaaaaaaaaaaaaaaaaacauuuaguugucugagaauggagggagauagcucaguggcuaagagcacuuauuucacuuccaggaacacauuucaacucuaguucuaugggaugcuaauaccuucuggccuccagguaucaaaaucagccucacaugguauauaaacauacaugcaggcaaaacacauacauauaaauuuaaauuuucuuuuuuuuuuuuuuuuuccuucugagacagguuuucucuguauagcccuggcuguccuggaacucacuuuguagaccaggcuggccucaaacucagaaauccgccugccucugccucccaagugcuaugauuaaaggcgugcgccaccaugcccggcgcuaauuacaucucuaacaagacuggaacaagauuaaauuaagcacaaacaaaagaccaucaaugaggucuaccuauucgaaacuacacggcaaccaaccuacucagcucugcaaauuuuguggaguaagccuacuaagcuuuuauuuuacaaugauauuuccauuccuaagagggucuacaguaggauaaaauaagauauauaccaaaauaugcaaacacuaagccuuuauucauaucaggauacacacguuuuacuuuugaaguaaaaaaugugugagagguugccaggaggugguagcacacgccuuuaaucccaguacucgggaggcagaggcaggcggauuucugaguuccaggccagccuggucuacaaagugaguuccaggacagccagggcuacacagagaagccccaucucaaaaaaaaaaaaaaaaaaaaaaaaaugugugagaggaauaaguaccaacuaauucaacacugagaaguuugaccguuaagacauuccccuaagccaugccuggcaauucaaucuuauaaucccaguguguauggagggaggaaaggauccaaaaucaagaacucuuugguacacagaacuuauguucuguaugaacaugguucauacaggugaaccucguuaaaaucuuuuauuuuuaugucccuucacauuguaagucuuagaaauuuaaaucaacaauccagugugacacugaucucaaacuggacaugucagaggaugccuuugagcugucccuagugccccugcaaaagcacuucuggcuuaugcaguacugaggggagaaauuuauacccucgucaauucuaaacaagcaucuaccaacugagcuucaguccuaggcucagauuacuucaucauuacuauaggaaauuacaacuacaucucaggcaggccaugaccuggcgauccuccuaccucagcuuccuuaguagcuaaacacccuccucaaacugccaaauuuuagcaauacuaugucucaaaauaaaggugaaaaacagacagacaccccaaacgccuacuccucuuaccacauauuugauguaaucugagguaaaaugaugucaacugaugcugcacaguucaccaaagcuggguaaacacuuucuguuggggacagcauggauucuugggccauuucuguaaucuuaaaauaaauuucaagagccauuaaguagagguuacaagaucgaacauggaaguauaaaguuacauaaaaacuaaagcacuucuuacuaaacacuucuuugggcucuuaaauuuagagcucugugauccuggggacagaaauccuuuggcugaagugguauuaugcuagacagaaguagagaaaaacaacacucagaaccccagacaacuauaauguuacaaguuaaauuguacaaguaaaaucgcccuuguaaaauguuaggaaaugaaaauggaauaggauaaaauauuaauuuaccugugauauuuagcugauugauuggccuuagccuucuccaugaaaaagcaguauauauccaaagcaaagaagacuguuucuugaucuccaaauacaacuuuaaauaaagacauaugcauauuuugaagaccacagcuuaccuuagagugugaaguaggugaaguuuuaacacuuuuuauuaugggagagcuauuugaagaaugagaucuaacaacagagcaacgccuaucaaugucaucugccaauccugcuugguauauuggaucugcaaacgagacacgucuaaucugaaaguacaagauaaauuuucauuaagaagacaacaccugucauuaauuggcacuuuuacaauugacuagugauuaaaaagauauuauucuuacuuuagacccuuacaaaugucuauguaaaucaaugaguuaaacauaaaacaacuuggauuaaauguauguacauaucccccaccccaaaagaugacaacaccuugaguuugugcaaaagcaaguauuuccaagcuuauuuuacuagaacccuccuguacaacuguuccaucuuucagauauugccuaauacugcagcucauccuaauuauauacuacacuacuucuucagugaucaaaacuuuaacucuuuaaauuagcaauguacaaugaauacaaaggauaugaugguguacaccuucaauccuaguacucaagaggcaaaguuugagaucagccuggucugcacgguauagauuuccaaguuccagaucagucagggcuacauagaaagacccugucuaaaaaacaaaugcaggaauggcaauguauaccugugaucccagcacaggagacaaaggcagaaaaucaccaaauugaggccagucuggaacuucauagugaaaccucagccucaaagaacaaaacaagggcucaaaagacagcuuagguguuaaaagcaccagcugcauaaugacagccagaguucaaauccuagcaccaacauuaacaagccaguucuacguaagucuguaacuccagcuccacgggaucugauacauucuucuggccucaccaggaucacugacuuuugcauauacaaacguacagaccaaaaaaaaauaaauuucuuuuaaaaauccuguauaauuugauuuaguuaaccaauaaacucuauuauacauacuauggaugguaguaacuggcuucugguauaucuuauuaaucaucgauguaaacuugugaaugcaugcauguggaagucagaggacaacucugaagggagugauugcucagguguuguacaacuaauuuugugagaugaugcuucucaauggccugaaauuccccaaguagacuaggcuuacuaagcagcagaccccagaauauggcugucugucuccccaagacagagauuauuaggacaugccacccagcccaggauucuuacuuuaagcguggguucuagaaacugaacucagguccucaugguugcuuugcaaacaugagaucccccacgcuaucuccugugcccugcccuaaacucucugaaggcaauacaaauauuguggccacagggcaacaauuuuuaucuaucuuaaccucacuguggcugaauuugcuucuuguaaaggacuacaauauguucacauugagcuauuugcuaaaauauauagcggauauuaguaucauuccauaucuucuaggauugauucuuaagaaugggcaaaguaucuaccacagaaauuaaaucuucccaaguauagccaggacuacauagcaagacccugucuucaacgagagacagagacagaaacagacacuaaaccuaaguuccuaucaagcaguaguacaauaguuauucuaguuaaguuguacaagccuucuaaagaauucagaauucugucaucuuguuacugccuuacuacccuuugcaguccacaaugaaccuguuuccuuuaaaaaaaaaaaaaaaaaaaaaaguauauagcuaccaaugugugaacaccaggccagccagaacugcauagugagggcccuuugucauaaaaacaaaacaaacaaacaaaaaaaaccaaaaguaaaauaaaauaaaaaucaagagcuguuacaucuuccuaaacaacuucaucucuaaagucucagaagccuuuuuaauguuauuuuuuccagauuguaaaacuaaaggaguucagaguucauacugcagcuggacaguuaugugcaugcucuccuggagauagaggcagaggcaggcuaaugaguuccaggccagccuggucuacagacaaguuacucaacagccaggacacagagaaaccuugucucaaagaaaccaaaaacagaaaaaagagcacacacugcacuucaaagguccuagcacccacacuacgcagcacuugaugucucuacuuucuauaggcaccugcacuacuauacugugcacauguccuaauauauucauacaaauaauuaaauguaguaaaaauuagucgaaaaagauauacuuauuagccaaaggugaugaaacagacuauaacccuagcugaggcgugaguggucagcauggaaaacaagagguucacacacacacacacacacacacacacacacacacacacacacacacacacacacacacaaacuccaaaaaaagauuuaaaaacauccgugcuuguaagggcaaaguucaaagcaccaucuuuauauauaccauacacauauguucaaauaaauauucuauaguaucagauaucaauuucaagauuaaguugaaaagaucagcauggcaucauuuaggacaugcuuuaugucaagcagagguuacauuuuucucauucauuuaaccuauguaaccuagauaaucccauuuuuuccugaagcuuuucauguguauaguuaagugcagaaaaaacagacauuaaggaaauaaauaguaaaugaacaccugggaaucucucagugaccgaguaugugccaugugccaaacauacucaacacugugcacuggauucccccaaccuugaaaaggaacaaaaacuggauaggggagaaucaauuugguggcaugcaccuaagucuaaaaaaaacuaaguccugggcaauguggugcaguaauagagcauauauaaacgggaccauggauuuaaucuccacaauggacaaaggaggauaaggacuacaggaaagaaauuaaaaaugagguaguuacaaaauauuuuaauugucuuagaauauuuuauauuaguuaaauccaaacacauauuaagugcugacacuuuugaucaacaauaaucagugcugcuuggcuucuuaaaucuggcuccaugaacuggauuguagaaaaggaagauccuaaaugagagcuacccauuaugucccauguguacaccuacaugaaguuuuugagugugaggugcaagaccaccugagacccuuccugaccuucccauggugaguggccaugaugcuaacacccuguccuuuacuagguuucacauagugaccacauauuccaagcaaacauuagauucauuagugucauuccuccuaccuuguuaacuggugagaucucaucuucuugggaucuuuuuaguccucucuuuaaaaugcuuguggauggagaagccaaaggugaccagacacaacgugccugcugcauaccacuaggacuuucauuuacugauccaaaagaauccagcucuaacuuuucgggagacguaguauugcuuucugcuccaaguucagaagccacuugaacuagcagacacugugguaauuucuccacuuucucugaaguaaagcaaacuuccugcagaguaucauuucccacuguagcuucauugccacuuaauuuugcuucaucuaauuuauuaaguucaauggaugucucaguuuugcaauuaacaguucuuucuccagaacucauuucaaugucacuaacaaagcucuggguguugacgucuagucuuccaaucagcgcuucuucagauuuagaggcacuggcaaguauguccgucuccuuuacccuggcacugucaauuucagugcucaucugggcuuugugacuucccauuucuuuguucauuuccucacaugagccugaaucagauucauugcucucccccucuauuuccccacuagcugcgugcucagucucaacauccuugcuuacagguaugggaguaucagaaagauccauaccugaauuaaaguccucaguggcuacuccuucaacauucacuucaguugugacugcuucacauucaucuuuuuuauuaucuuccucuguugccacaucuacagaaacauccauuuggguacucuuuucagagucagcagcuacaaaugcaucauuucuuacauuuaauuccauaguuucaacucccucuggacuggacccagcuaugacuuugcaugccuucccuacaucgcugaugucaagcucuccguucucugaaagcugcuucugugaaaugucuuugcacucacuuaagccuggguccucagcagggcugugguucucacuacauggcccuuggauuucagacacugcuucacuagcgucuguaucguaagucuucucuuucacaguuacuauuucagguggaagggaagcuucuugcaacucagccucagacuuaacugaaucaccaguaguacaauucucuucuuuaagacccacaugaaaauucacaagaggcucuucgccugccaacuuuguuucagcauggucacgagcuucacgaguuucaggggcagucucagguacuuguagaucugucuuuuuuuucuccacacucuuuauagcauaacuuucuguguucuuuaacccaauaaaugacuuuuccugggacugugauuuuucgccacagcagucacaacuuuuagaucuccugacucuccuacuucucuuguguuggcauucaacuugggugaauuuuucgggagacagagagcugucugauacccucacauuacuaucauuaucuuguuuauauaauaaucucuuacuggcauuccuaguccugagguuugacucuggcacagguagacuuacaaaugaacugucuacacauuuguuaaucuuacuuuucuccucgccuuuggguggagcuugcagugaaucugcaggcccagcagaauccuggaggaugacccuguuguuauuuguacuuuuuucacaaaccugagccgcugcauuuacaucaacaucaggaacugccuggccaucgagugucugauuugcaguuuucauaacuuccucuucagccuuuuuuucuucuuguucuucaaugucaacacugucacugcuucuauuuuuccauuucccugaucguuucuuucuagaaacuucuuccuuugccucagaacugucagauucugaguuuucaacagcagaaaucaaacccugcgaagcucuucuuguuugauaacguguccguccucuuaaagguuucucagacgacuugucuagauuguccaggguaccaccaccuccuucagaacuaacauucucaaggucugguuuucuucuauuuuggucaauuucagcauuaacacuggguuccccugaaguucucucagguaaaguauuucccuuuucaguuaaauuuuccuguauaggugacucaucaguuaguuuuugcgugggcaacuuaucaucuuugauacgcaacggacucuuggagauuauuuuuucuucuuccuuucgucuuuccuuuuuuugcugaccacucucucucucuuggcugucacugcaagaaucuacagcuucugaacgccgccucgaagaccgucggaguguuuuuggauuuggggcuagugcagcagccugacuaucuucauuuacuauuuguucuguucgugcuacaacugaggcuguacuuucuuuagauuccauauuaaugccuacauuuuucucuucuguuguuaagucuuccaaugaagcauuuucuacugcugguuuaggaucuccaucuuuaugcucuaggguagcuucagaaggaugaucaucauuuucugacacauguucuguugggcugagcagaucaggagaguuauuuucggaugagugcucuuccuguucagaugucagugauggcuuagacuuuuuaguaacugacugcucagcuuuacuccaucuccgacuugauuucuuaccugcauucgcuaaauuuucugaaucagauuuugaguucgucacuucucuuuuccuugcuuuugguggcaugucaguguuaguuguguuauccugguuauuucucacuguaacaguggaagauauguuauucaagggggauggacuaaaaggucuaguuucugagccaucaaauuucuccaaaguaauaaagguuugucuccgacuuguaggcuguggaggaguuccagaaaaaguggcauuagaaacugaacuacugcugaccaccgaaguuucuguacuagaugaacuuucagcagacaauaucuuugaugaaauuaauacuucuuuucuagcaucaaaaccagugaucaauguuucuggauugguuucagcaacagagccaccacaauuugguaaagaagcauucucagaauguucaucuauuccacaguucuccggggcaucuugauggaugaaaauaguacuuuccauuugcucuuccuaaauaaaagcacauagauuacauaaguaacaccacuuacuuggaaaauuuaaauauaaugcugugauaauuaaaauuuucuugggaaacuuaagaauaaacucugguacagguacuaacugugaaucuuccaaaaguaccaguaaagaacgguuaccauacuuuaaacugaugaugcaguuaaagccucacugaggccaaaaaugauggaagacgugggaggucacguuagcuaaggggaacuuuagcuccauaccagcgcaaagacauccugggcuaccucagacacugcuuuaaagcuucccagugcaaaaucuuauuuacaauguauuuuaaaugcauacuuauguacaauucugcuaguguaugguucagaguuaggagacucguacacauuuaaacaauuaaugaaauaaagaucuguauuuauaauuuacaaccuucuaauuuacacaaucuaauagaagaaugauuguaaagacccugaaguucaagcaccgcuuauaccuuaauuaucuuggcaucuucuuuugguuuuucaguuaaagugaggcuuucccuaagauaaauagacaaauuagauuauuuuuaaauuauauaauuagaaaauuagucauaaaagauuuauacuuacauugauucuucuugacuaaacugagcagaaaauaaaguguccugugaagcauccagauuauuauacaaggcaggaauaucacaccuaggaaaaacauuuauaaaaauucuaaaaaccugaugauauacauucccaccaucaaaauuauucuaucaaaguagauuuaaugaaucauauaaaagcauauagauuucccuaagaaucuacuuuccuuuccaauauucauauaacucacgaaaggcaauuuaaaaaagaccucagugggagaggaugugccuaauccugcagagacuugaugcauauggggggggggggggaugcuguggggguugaggaagggggggacugccucucagaggugaaggggaggggaggggaggggggcagcauuugggaugcauauaagcaauuugaaaaaauuagaaaguuuagaaacacuaggcauauuucuagauaagauuaaaauauuaugaaaucccauuauguauauaguccaccaucugccuuuaaauuuuaguugaauacucaggccagguguaacagcucagugguacagcacuugccuagcauaaccaauguccuaaguaagaucucuucaccaggcaccaaaaacaaaauugcaugcacacaugauacagaacauuaucuacagagagcucaaguuuaaaagaauaggucacaaaccguuuuguuuugaguacuucuuucugaugcucaguuagaacccuugccuuugucucuuuuccuucuggaggaaugaagacaaagucgguagacuuuuccucuuccaaaagcuuaccacucuuuauuuuuggagaugaagauucuaguuucagcuguggauuguuaaaaaauaaauguaugaguuugcaaauuauuuucuuauucuucuauguuuccuaacacuggcauuauuuuucaauagugauuagaagcaugaaaucaauaccuuucucauuugaagacaaggucucuuuaugcagugcagguuggacuaaacuuaugcuucuccugucucacccuaccaacucuguucgcaagcauguaaauaaaaccaauacaauauucacaauaaaacauucaauguccuuuucuuucuccuaacucuaauauucagaagauaaacagugagccucugaggaggcaaagauuauggaguuagagauacauguuuuaccuaagcagcacaucacccaaaaugauuaaacuguaugauaaaagcucuaaagaaaacaucuacauuauugucaugcacuauacugugcucuucagcaauccuuuccucucuauucaggacggcugcacagaauaacucuaucuacgagcgaccgugagccugagaucaugcagacuugccauuacuaacaagaaaucccucugggcuucuacaucuacaagcuaccauugccaacuuuaacuauuaucccaucacaauaccaaaaguuauuuugacuuuuauagcucuuuauuccaaagcuaauauuuaaaauucuaguaaguauacuucugaaaacauacuuuggccgacaguuucacuuuuuuuuuuuuauccuuuguaugugccaaaauggaaucucuuuuuccacuugauuuucuuuccaugccacuuaucuugacauuuaauugugaauucucugucuauugagauaaaaaaugaacacauuaaguaccuauauauuauucuguuucuucuggucagguugucaaaaaucagucuaaugacuacacaauuuaaaugguguaaauuucugagcagaagucuacugaaaacaaagacagacugugccgauacauauaucuacuuguguguguagucagcuuuuuagcuuuuacuuuugugaaucgaaaacaauacuuauuacuagacucaaauacgcacuugaaauuuaagaaaaaaacugaagcuuucaacauuccagaauaaagguugauaaaccauagguaggaagaacacaaauauaucuagcacauuuuucucuuauaccaggguguacaauuauaacacacaaaauuaugcugaacacacuaacaggcugaacuguuuucucuggugagaagucuuuuagacauaacaaaaaucuccacuguauuuuuuuccuucugaacugaaauauagguuccccuguuccugagcagaaagccuguuuucuaaaagaccccauuuccuguggguugaagacaaggugacaagguggugucacugaauucuuuccuguucaaguucugauuacugcugcaaacuacucaaauuuaaguuaaaaaacaaaaaacuuacugauucugaauacgguucacuggacucauccaucauuucaacauuuuccaaaccaggcagcagaagcaaaauuuucuguuuggcuugucuuaauauuggucuuuuaaaaaaguacauagauauagauaauucuuaagugaaaugcacuaguaauacuagcaauauuacuuuaauuaugaaagugauucucaugaaucucaggcuggccucaaaccuguaauuuacaccucugacuuugaacuuucuaaccuacacauauauuacaacacuggagagauuagacaauauuaggaucuuucucuguacuuuucacagcauucccaaacuuccucaacuuucaaaccaagacacuuccagcacucuggaagaugagagagaucaccacauguucaaggccaagcuauacuacaggugugaaacuuugucuuaagaacucaaaacuuaaaaaaaaaaagaaaauucaugagggguuagugauagcuuagugguuaaaagcugcaccuccaaagaagucagaugcacgccccaagacccacaguguggcuaacagccaugcauaaacccagucccagaggauccaaugcccucccugaccuccacaaacaacaggcaagcacauggcauagauauauguguaagcaaaauacucauguauauaaaguaauuuuguuuaaaaauaacacacacauuuucaaauauuagaaauaaguuggcuuagcaguuaugagcucuuccaaaagaaauggcagccacaguccaagagagaucuaauaccuucucuugccuccacaaagacaaggcacacaacacagguggugcacauauaggcauaagacccguucaugcaaaaaaaucuuuuucucaauuuguuuuaaagaaguaaaacaugcuggauguuguggcacaugccauugaucccagcucucaggagacagagacaagugaaucucugugaguugaaggcuaguccccacuacauaaggaguuccaguaguccccacuacauaaggaggggaggggaggggaggggaggggaggggaggggaggggaggggagaggagaggagaggagaggauaaagaaaauacaagacagaaacaaaaccaaaaguuaaauauuccuacccaugucuggcuuuauuaauaaccuucgauuuugugcccuuguuuauuuucaaggauuuucuauggcauauacuauuucccuaaaaucaguaagucuaacagcaauuaacccaaguuuaauggcuuccacauacucuaaugauagaauuaaauucucugugcauuuuauuuguacccaaauucaaauuuacaugaacaaauagaacaagcaguugcaggaaguugugaugcuaacuuacuuuaauuccucaggauaaaccagagcugucgcuuuagcaaauguggcauuccacaacagagcacucuguuuccgaaucuguuuauucuugugaagaaauauuacgcacaggaguggagaaagauguucaagaaguucacugucauaggcuccaagauagcugaacuguaggcaugcaacaauuucucccaauagcuuuucuaacuaggaaagaguggggaaaacauccggguacuguaaauaacaaaucuguagacuagguuacuauuuucauugaaaucugaaccaucuuuacaacaccauggucaucauaaauaugcacuccuguuuacacaugaacaaacuaucagguaaacuuacauuaaguacuagugcuguaauuugauucacagcuuucuuguuaacaggaaaaaggguuucuuauuaauugcaacaguaauuaauaauuaucuacacauaaaaaggggugagaucugagaaaacaugaauuuuaaaaaaacacagccacuuaagaaugcaccuauaccccauucuuuuauauccauuaggacagccagggcuacacagagaaacugugucuggggugggggugggggguggaaauggggcuagggagguuucuguggauagcaacacuugcaacuugcuuucagaagaccuuacuuaguucaguucucagcaccugcacugccugugacgauagcuccaugagaucugaaaccuucuucugaccucuauaggaguaaauuuauguacaacuauacacacaugcaauuugaaagaaaaguuuuuuaaaugauggcaaggaaggaagggccuuugcacuaaggcugacggcauuuccgcuccugggccuacaugacaggagacccagcuccugcacgaguccucugacacuaugacaugcaggcaugcauaugcacacacaggaaauacaagugugagacaguaauaauguaaccaccauaagaaucaauuauguauacaagauacuauugccuaagccauacccuguccccauugguaauuguauggacauuguccacuuaccuuguuguucagacuaguauacacuuuaggagccucauccagccugagaagaaagauguaagauaguuauauuguuaaauguuaucacuacacuacguaucaaacuaagucucaaagugaagcaauauagccacaaaaauaagguaaaauagucacacaguaguauaaaaugucccaagaauaagaugccaaauguuauacauugaguaaauauaaguaauaaacaacuaggaaauaaaauuaaauuccuagaacagacaccuaguggucaugguaacuacuugccuaucuccuaucguuucuuuauggaagguucaggaucugagggucugcugaguuacuauuuugccauaccuccuuauaauuuuuugauuuuuaaguguuccacacaacaaagaguauagaaaaacaaaguuacuauguuuaaauuacacccaucagggcccagcagagguacaguucacugcuggucauaagaacaugggggcaugagcguggaucugcagccccugcuucuagagccuggagcuggaacuggggagcuccaaguuagcaagaagccuguaucucaaaaaagcaagguagagccgguugguggcggcacccaucuuuucaaugcuggcacucaggaggcaaaggcagauucagaggccugaguuugaggccagccuggacaguuagagcuacagagaaaaacccuguuuugaaaaacaaacaaaaacaaaaaaacaaaaaggaagaagcaagguacaaaguuaauaaaagauagcagucugugacuccuacauguauaugcauauacgugaauauauuuauggacauauacacauauaaaacacauaaaaaaaaucgauguaguuaauucaacauuaaugagcugaaaauacuuacuuugaguuuucauacaguaaagccagaggucuuguaaaaguugcaaauauuucucggaucauagagggcaaggaaauauguccaaauacauuggaaagcaugcuaaugauagaguuaccaauagcaagcaguguaucagagaauguuuccuugaggcuuagaguguggaaaguaucgaugacuuucacaauuagcuuaaauaaagaagccaauuucccuagaggcuccuucuucuuucuggaccaaucugaagaucucugcggugcuaagacauaauuggguugauuaaaaacuuaaguacuuugauaugucacuauuacuuuuaugcuuugcauuuaaaugcuaaauauaucaaauauacauguucuugcugcuaacugaaacuucauauaaaccuucaaaugauacagcauuaaggaauaaauaucaauagaguauaaauaaaauccaaauucaauagaaaggagcuggcagaucucaauuaagaaaucaaaauaaauaagaauuucuuaaaaaauuauaaaauacaucucaauuucuucuauaccucagaauuucaauaacguguuuauaauuacgaaaauacaugaccaaaguaagaaauaaauguuuucauuagaaauguauauuccuagcucauacacaguuccuuaaucccugcaaauaaugagaaaaaaguucagaaaaacucuagugccucuuuucuagacuggacuauuuaucuuaaaaguacauauuuuccuuuauaguccccucuuagauaacuacucuccagacugcagguacaagacaaaagccacaauuucucuugcucugcaaagucauucuuguuuuaaaauuaccuguuucuguaaaacaaucaagacuugggagagcucagguuuaagggaauaguauagaacucauaccuuacuagccucaugaacugaaaucaaggaaagcugccacuaaaaauauguuaaucaucucaucuagaagcaguuucuucaaucuaaauauacauuuuaaaauaaaaagaauuucugcuacucagaaacccucauucuaaauguugagccuaagguaccaggauauggcuaagguaacaaggggaugucaggaaacugucacaaacacaaaaaguugucuaaccaaauuugaucgcucuaucaguaaguagguaaguagguagguagguagguagguagguagguagguagguagguaggaaggaagggagggagggagggagggagggagggagggagggagggagggagggaggguaagagcaacaaagcucuaaacuggguagacacaaaugcaagaaucugacuacaaccagaagcuuauccacaaaaacagguaacagagauaacauccaauccauguccucaguaaagggacccagaaacaauguaccuuaguagcaaugaacugcucuggguuuuuacauccuagucucagacaaaaaaagagaacuguuucuaggaagaauaauuccaaucuguaagaaaaguacaagauaaggcugaauagucugcaaaacucauaaauaggaguaaucugucaaaauauucuaagauaugucauucuauacuaaggugcauuuuggggggggggagaaguuucgagacaggguuucucuauguagcccuggcuauccuggaacucacucuauagaccaggcuggccuugaacucagaaaucuaccugccucugccucucugccccucugcgccucugccucccaagugcugggauuaaaggugugcgccaccacgcccggcuugcuaaggugcauucuuaacaaguaaaggcacuugguuguauacccuagugcaaacgaagaaagaauuuagaacagacuacuuacuauacaagcaugaagaccuaaaucuguauccucagcaucaaccaaagagcaaaacaaagaaacaaacaaauaaaggggggcagaagaggcugagcauguuauagaaucccaaugcugggggaaaaacaagacuaugagggugggguuccuggugccuagacuagccaaucaguggaaucaagaguuacugaaauccugucucaaaaaaaauuggcaguaagaaauagucauggagagauggcuuagcaguuaggagcacugacugcucuuccugagguccugaguucaauuaccaucaaccacauggugguucacagccaucuacaaugaauggguuuggugcccucuucuaguaugucugaagauaguuacaguacacccauaauacauaaacaaaucuuaaaaaaaaaaaagaaaagaaacaaagucauggcucacaaccuuccuaauguucugacucuucauacccccaaccauaaaaucaucuuuguuacuucagcauagcugucauuuugcuguuauggaauguaauguaaauauuuuuggagacagagguuugccaauggaaugguaucagaacccacagguugaaaaccacuguaauagaggaaggcaccagacauggaccuuucugugaagcccauacucgcauauacuacaaaucuccccacccccccaccccaccccacccccacacacaggaaaagauauaaaaauaaacagaaggauuuguauggaaaauaaaaaagaaagaaaauucaugaguugucacauuggaauuuauuuucuauaacucuaguagaaaaaauauaauucuacucaauaacuaugagauaaauuuugugagaaugacaacuuaaaacagaaauuuuauaauguaacugauaagaaaucaacugauuucuaauacagacuaauuuaauguaaucaaauaaaaacagugugaucacuucagaaaucagugaguggggccaugguagcucaugacuuuaaucucagaaggaccaccaacaaauuuuagaauuucacaagcucuaaaguuccaagauaugccuagucuaccaaguaagauccuaucucccaaaagacaguuuuaaauauaaaacaaauacucagugauuuaggaagcugcuuuaacaagagaugguaauuaaugagucaggcuuccugagaacaagguauuugaagcuaagguuauguagcucaauugguacagugcuugccugucaggcacuggguuguaucccuaggaacaaaaccaccaugccuguaaucucagcaauaagcagagacaggagaaugagaaguaaaggaccuccuggacuacacaauuagaagacuaugucucacauaaaagucaaaaauaaaugaauuccucuuuguggcaaguuauaggccagcgugggcuauuugucucuggggcaaggaaaaaaaaauacaaaaucaaaagugugggucaggggacauucacagucucucauggcagccacaauacaccauuuauuacuuaauagguaacuuuacaauggaaacuugacacaaaccaaccaacaguauagauuaaugccugaaaugaaugaaguaugaauuuaaaaagcaccacuacauuuguucugugguauuucuauuacaaauaaaaaacccaaaauacuaagaugaggaaauauggcaaguucaaaugaaagacuaaacaaacaaacaaacaaacaaacaaacaaacaaacaaaugcuggccaagugccucaucuguaaagaacuuaauacuaaggaaacauuccaagcaguuuaaacugaugucuguaucaugcuuucaaacagaaaacauaacacacacacacacacacacacacacacacacacacacacacacacacagacacacacacacacacagacacacacauacacacacacacacacacacacacacacauacacacacacacacacacauacauacacacacacacacacacacagacacacacauacacacacacacacacacacacacacagacacacacauacacacacacacacacacacacacagacacacacagacacacacauacacacacacacacagacacacacacacacauacacacacaaacacacacacacacacacacacauacacacacacacagacacacacauacacacacacacacacacaccuacacacacacacagacacacacauacacacacacacacacacacagacacacacacacacacacauacacacacacacacacacacacacacauacauacacacacacacacacacagacacacacauacacacacacacacacacacagacacacacauacacacacacacacacacagacacacacagacacacacauacacacacacacaaacacacacacacacacacacagacacacacagacacacacauacacacacacacaaacacacacacacacacacacacacacacacacacaaaagaaugaaagaaaaaaaaaaaaaaccuaugccuuggaaaauauacuaaaacaaaaacaagcuugggguuuugugccugugagauugaguccgguuauguagccaaccaagacugacccauuacucauucacuacccgauccuagcccuggaauggaggccaaccuccaagccaacugccagaauuuaggagugcgcccagccauaacugucauuggagaaucuaaccaaaagauguguagacaauucuaacaguauuucucuacauugaaaauuugcuuaauuagcaaaauaaucugguaaguuuauaaaguaaacuaagaaaagccagcuguaagaauuuucccugaaauuucagcuaugaaauaccauauuaacaaagguaaagacaauacuuacauuugauuuuuggcugguauuucuuauuauauggugaaaagucgauacaaucaaccauuacaauaauaauaugagagauccuguccaagaauagcaaauccuaggaagaaauuuaauauuauacuuagaaaacuuuacuacagccacaguacuacagucaagacacacaaauaauauuuuuacuguuuaugcuacaaauacauggucauaaguacuuccuaguuacacacucagcaaugugcuucucaacaacuggcaacuaggcugcaugaaagcugagcucuauguagcacaaggaagguacuguuaagaaaagcuuagacuaggauuagcauuaagagaaagaggcauuccaagguuauuaagacuugugcuuaucucauacagaagugucaauaaaccgucuaucuccaauuuuuaaaaaagguggggggggggcgacucacugaaaggacuucaucuuccaaacugcacauuauuuuagaagaaaguucuucacagcacagauucucuucugcuguugccaccaaagaagcacagcgaguaaaugcucuauacaauucugaccaaguuuuaaguaaagcuuucaugguacccuaauaagaaaaauaaauaaauuugacaauugacaccauaccaccuguauagcaggaugaacacaucucuuaagucuaugaaaagugacacacuucacuugucagagggaccuguuacaacaaucuacuauguucuauaugaagagcaccauuaauuaccaaagaucaaaagucaaagaaggccaaaacccaaauccucauuccagucuucucuuaucuaucuccaccccacaaacacaaauucaagaaaaaucaagguugguacuaaccauacacaauggcaguauuuccagaaaggcaaaaaccauuacacaaucauugcauauucuuaccgugggaaaugucugagcugaaaaaauaugguuuauugguaaagucaaugcaccauagauggcacuaaaauuauguucuaaggcaucgccuugauucacuucauuggucugaaacaaaaaaauauaaaguuaaacaaauuacuaauucugauccuacauaauaauauaacucauauauaacaaagcaguauucuacuagaacauauucuagacauugcacuucuagcccuagauaccagaaaugaaaauaaacaccuaugcaaaaucaagaugucauacucauacucaaguaugcugaucucgaacucaacauuuggcauucugacuaccaugggaagacagcuggaaaugguggugacacaacucaaggucauggauugcuggcuaccucuauuaucugagcagaaagcuccgaaauagaaaaacagacuucuagucuucggaauucugacaacauagauuccuauuuauuauuagagcuagaauuacaucccaguuauuaucuggagauguacuuaaugcugagugcuugacucuagcacuuaacauaaaacaauucauuuaaaaggggggaaaaacauaauucucagugaucacuggugacacaguacuuuaaucccagcauucaggagggagagacaagcagaucuccuaauucuaggccaaucugaccuacagaucagguuucaagacagccagagagggcuacaaagaaaaacccugucuugaaauacaaacaaaaacuucucuuguuuuuugccaacugguucaucuaaauuuuguucucagaacaaagcaagcaagagagauauaaauuccuaagauagaaguuaaagcuuacagcagcaauuacagcaucuggaaugcugaaguagggcugcuaagagucagaggccaaccugggcuacagugaguaccaggggaacaccacuauaaaggcaggcaucucaaaacacacagaaccgcaaauaauccugaaaacauuagucagaccaguagacucauaaaaggccucgaccaccauuuaaggugaggauucauuuguuuuuuuucagacaggguuucucuguguagcccugguugcucuauagaccaggcuggccucaaacucaaagguaugugccaccacagcagagcuaggguuaggauuauaggaaagugcuagcuaaagaagccgacuuuuauaaaacucaucuguggaguuuucaucccaugucaucaaccuaaagaauacccaaagaaaucugaacuaugucuguccgcaaagcaaucgaaauauaccaaaauaaaaccauugaaguuauuuuguguuccauaucuaccuauaaaccuacaaacacuuaaauguaaaaaacccucaacucuugacaggaaggauaaaugaagccccaugguuggacucugcauauauguaacaacagaucagaugugggaagcacacaagcuguugaagaccaacuuugggaagcuaggacaugaagccagcuuugcuacagauuaagacuguuucaaggggaaaacaaaacuguuuuuguuauacuggaacuguaccagguagggaacaacagaaguauucaaaugauucaaauacuggaaagaugggggaaaaaaaaaaaucacaggaaaugggagaccaguguaggcuacacaguaagauacugacagaccauuaucauauaaaggcagguauuauuggcacuauuaaaggguaaggaaguguuuggaacuaguuccuaucacuaugaaaaauggaauacacuaaucaaucauuaaguacauguaguuauuaaaaaaauaguaauuaauuauuaauuuuuauuuaaauucauacuuaugcucuuuccaaaauagggggggaauggggacuagaacuagcauagcacaagccuacuaccaccuagcacugagugagcagcagcaggacuguggcaaacagaagaccagccugagcuacauagcauccuuuauaaauaaauaguaguccagacuagggugaggggagucauggcagauguguccuaccuggugaaucacaucagucaguggacugacuaucauacuccacauucuccagagaugcuccuuguuuaccaacugcuuugcauucugauuaaucacaguuagaacagaaucacuaaaagccaguggugauguuggaccagaaaguacacagccuacaaguguuucuagauugagaaaaaaccuaaaauauaugaacagugugcaucagaauggccauuucauccuaugaauuauuaacaaaacucuaacagguguacacaagaaaugauaaauuuuuaagucaguuuuauuauuuaucccccagccucuaacacaugacuuaaaauuuauuacgacacaaugguuaagaagaggacuuguuuucccagaggaucuggguucaguuccuaggaccuacauugucaccaaccaugacucacagauccaaaggauuugauacccucucuucuggccuccacgcauccacaugggacagacauacaagcuggccaaacacucacgcacauaaacucuuuuaaaaaagaauauuagguggcacaggccuggugucaagcaccuguaaacccagcaccugggacucugacaaaaguucuagagugagacuggccugagcuucaaagccacaacacaaaacacaaaaugugcaauugaccuuuucaucuguaaucuagcacucugaagguagagacagaacugccacaaguuuaaggacagccuggguuguauacagugaaaacaucucuaaauaggaaaaaaaauuuuaaaacaaacuugugaaauacaauaaaaagaaucucauucgccagucagugguggcacaggccucuaaucccagcacuaacuagacagagaaggcagcagguaaaucucugaguucaaggccagccuggucuaaagucaguuccaggacagccagagcuacaaagaaaaccugucuucagggaaaaaagaaaaaagaaauaaucucauuggaugcaaucauuguucaugaaaaaguagagcgcacgugcguacaugcacacacaaucaggaauggaacugggauuagugacauaaacuuuaaucccagaaaaguaggcagaccucuuuguucaaggacaggcauggcuguacaccaagcuggucuacacagcaagguuagggauacagacaugguccaaauaaaaacaccaaaaaacaaacaaaaagggcauaguaacacacaucuguuaugcuagaaguuagaaaguggggagcagagaauaaauucuuauuagcuucuuuacauagcaaucccaggccauccugagacuuaagagaccaugacuggauuuaaaauaaagaacaagguacagacuuacuucucaucuucuacaccacauucuaaaagauuguuguugaaaauuaacuggauuaaaaacaaugcuggaguucccugcaaagggaaggaaacaaaguuauaauccugaacaaaaagaacuguuuucugcagucgcucaacgugauuuauuuuggcauagguuaucuuuuuuuagcauuauuuauaggguaugaugacaaguuuauuucuaaaaaccacacacaaugccaggcauaguggcacacacuuguaaucaaaacacccaguagguugagguagcaacagucuugaguucaagaccagcgugggcuagagacccgaucuuuaaaacaaacaaaacaagcaagauaugauagcacuuaggacgcugagacagggagauaugagaguuugagauuuuagaagcaaaccugaucuacagcacagaguuaggccaacuacaaauggucuuaaaauuuucuuuuaaaaaugguccaguggcuaagaguguucuguucuuauaaaggauggaccaggcuucaguucucauacccaaaguggcucacaaacuccuguuuaacucuagcuccaggagcaggagaguaugaugucuucuccuggucucugcaaguacugcauucauacacaagacacacuuaaaaguaaaaugaauaguaaauaaacauauuuuaaaaaaaucaaauauaucucuaugcucuggaucacaggccuucugugagaaaucacagguggugaggcuucagcuguuacaaacaaaacacaacuaacacacucaccuacaauuugucacgguaucaagcuaauauuguuaagcuuucaagcauuuuagcaguagccaguaauauuaugccauacaaacaaacaaaaaacuuucuuucuggaaucuacuauucaauccaggaaaaaaaaaaaaaaaacuccaucuaccuauuggcauagcacugccuuaaauuuugcauacaaauuuuuuaacuuaacaaccagauacaguuaaguauuuuuuaagaaaucuaaaagaauuuuuuuguuuugccaaucuuugucauaucacuacauuacauuuaagauacuugcauuaagaauauccauauuagcaaccugauaugcuggugaaccuaguacuuucggaggaaguccuuuaacuguaauuuccaugagaaccuaagaaauaaauauuuuacaguaguuagccauaaaaaccugaaaacuuguuacaccguaaaaaucuuacaaugucaucuauguuuuuggcaauuuucuagacguaaccauuacucauaguucacuacaguacauuuaaaauauauauauacacauauauacguauguauauauauacucacauuauuuuaaaaguucaaaaauacagaaaauagacuucuaccuuauuaccaguuuuguauuacuaugagaagaaagcucuaugggcacauauccauaauuuaaccauucuucuauaaaugaaucuugacacuuucuuuuacauuguuuugagaaauucuacaauuacguauuuacuauaacaggccuagaaacaaacauuucaauagcuuguuaacuacaaauuaacucucagguuacaaaugcagagaugcuugcaccuccuuuagcuguucuccaaacaacuucccccacuugcagugaugucaacuacacacuguguuaagugucauaauaguucuuaguaaaagcaaaccaguuguuuugaaaauacucugaaguugacagcauuuauuugagccuuguccagauugaacucuuuaaaacaacugcaauugucuuuauaacccacgaaccaagaaagcaaugaauccaccgaauccuccacagcccuggcugccaucuacugcacuacucagcaguguuguuuaaauggcagucugaaaaggcaaguaagacucagaaguuaaaauugucauuuguucacuauauuauaaaaaucacauacaauuucuuuuuuccauuccuacuacuuaaauagaaacuauuucauuuaauauaaagucaauaacagugugcuacuguuaccuugcacucuaauuggacauuagaauauguuuaauucaaguuggauuccauuuuuuggugaaaggcugaucccuuuaaccacacugcagugacuauaccugcugcugcugcuacaacuguuuacuauguagauuucaaaugacauuugaauggaacuaacaauaaacuguuaagucaaaaggccugugccaaaucucaucugaacaaguaucaauugaacuucaagacuuugaggugauuuacaaacauauuuaccaguguuuuugauacaggaaauacuucugacuucacuauguuuuccaaagauuuuaguagaagggucaaaacuucagaaccugauuuuucuuuucuguuuccuaucaaagaauaaaaggaaagaugauucuaaacauguuuuuuaggagacuauugucuacuaaagagcuauaaagauuguuuuacaaagcaacaacccccacuaagugaacccuuugcagccaagcacugaacuugugcugugugaaggucauggaccacugugacagugcuuaccugcuucaguaacugacuucaccaagcuaauuagcuccuuccagauagcacugacuacugcaucugucaaggaaauacacacaguguucaguuucuaguaccugauuuguaacuccaguuccaaugaacaugaugccuuccuaugacuuccuugaguacacauacauacaugcagacaauaaucauacacauaaaguaacucuuaaaaaucaacacuuuucuccaguuccucauacuaaagaaauaacaaccugaaagcuaauuuauuaauaaugaauauuauuuccuuaugcuauuuauaaagccaccauuucaauguuucuuuaaagaaauuaaaauuuuuaagaaggacgccggguagugguggcauacaccuuuaaucccagcacuugggagauuucuaaguucaaggccagccuggucuacagagugagguccaggauaaccagggcucacagagaaaccuugucucaaaaaaccaaaaaaggacuaaacguaccaugguaacagcaggccaaccauguaacaaagaauaaauguuucuacuuuucucacuuuucuuuuuuuccuucuguaggauuuuuuuaaacuuuuaauguuguauccacaccacuuuugcagaaagaaaagcaccauauccaugcuuggugauauuuauauccccugcacuuaaggggcaaggacaagaggacugcuggacauuccaugccagcagagcuacauagcccaagaugcuuucuccaaaggaugcaaguuucccccaaguccaccacuccccccacccauaccaacacccacaccuacccuuuuauuuacuacagaauaaaaagaaccaaggaaauggcuccucaggcacuuacugccaggucugauaaacagaguucaauccugagacccccacauaguagagagaacuaaguucuaaaaguuguccucuguccuccacaugucgcaugacaaugaauaaauggacacauacauguauauaauggaucaaacgguuucauuuuccaagcagcuaaguaacuuuuaucuacuuauuuuugaguggcaagcucuagaucuggauaucgugucagccucacaucacugccccaugccucaacgucugcagagcugggaugguuugcuaccuuacucgugucuauuugaaaacaaggucucauucugcuguccagggcugccucaauccuaucucacaaagguaagccaccauacaaggcuuuacauuucuuuuauugggcccugagcacaaacuugaaugcaaagacugaagauguaaauucuaggcuugagucaaaguucuacuagucacuuauaaaacuauguauuauuuaucucuuuauacaacuaacuucuuucuuuuccuaggcagcuuugaauaccuggaauaggcaucaauuaucagacauuggccugcuucugccucccgcaugcugucagccacuccacuccaaucucauuucuaaugguguaauacaaguuauaucaaaaaacaaaacaaaacaaacaaacaaaaaaacaacaacaaauuuuuuggugcacaaucuggccaaugagcuaauaccaaacaaauauuuacaauuugagcuuccuucaaagcccacuuuugguggcugauaagauggcucaauggguaaagguaccugcuuuuaauccugauagccuaaauucgauuggaagauguaccugguagagaacuugagucucaaaaagugguccucugacauauacauguaugaccacacacaugcacaagcaaacaagauaaauacuuaaaaaauaaacacuuuugaauucuaaaaauuccccagauuuaccugaggcauccuuuccaacugagacaaagcuaucaugaacagcagugauaaguguaugcgcauacuuggagaagaaagaagggcugcugauuagcggguguuccaguggcucuaaaauggaaaagcaaaugcggucagauuuauaaagcaaauuucacacacacacacacccacacccacacacacacacacacacacacacacacacacacacacacacacacacccacccacacccacacacacacccguucuuaaaugucuaaaaauauuuuucauuaaaagauugaaauucagccagucguaaugacucaugcacuuuaauccuuuaauuccaaaacuugggaggcagaggcagguggaucucuuuguguuuuaggcuagcaagggcuguuauacagaaaaacccuaucucaaggaaaaauuuaaaaaaacaaacaaacaacaaaaaggaaaaaaacggaguauuuacgcgcucauuugaaauacgagaccaucauuacuagugagccucagugaaacugcagccucucuuccauucaacaguuauguuuuggaauguuucaaacacaugaaauuauuucaaaaucaaauaccuaaacucaauacaaucuuguguugcuuggcaaaacucaaaacuucugggcccaacaaaaaaugaagcaucauuuccagucccaaaagcugaauagaagggauugcagccauuccaccuguauuugaacucagguucccacggggacuuccauaaggagaagcaccuuuaagagagaaagaccaaauuauucaaguuuuauuuccaaucaagauacuauacauuuaaaaacaugauguaaauuucucaagcauuaauacaaaccuugaaauuauuaacaagccacuaaaauaaaguaauggcaaauaauugcuuuccaaugcagagaugcaauuuauuuaaguggaaaacaucuuuaaagaccuauuuuuuuccauacaagcacaguaucaugaaaaaagcugggcuugguuguacccauuugcaaucccagcauuuagaggcaggauuccugucaguucaaggccaguguggucagccuaguggguucuaggcuaaccaggacuacauagugaaaccaugucucaaaaacaaagaguucaaauucaagucugggcuacacaguaaaccauugccacaaauaggaaaaaauuaaaaccuagcuggggcuacaugacaccuaaugacagagcaaggugaaaagcaaaaaaagagaaugaaaagaaaaaauguuucccaaccacccacaauaauguagucaaaaguuaucaguaacaaaggcaauauagauaagacuauauuagcgucguguccucugaucccaauacuugagaggcagaggguuaccaaaugaagauuaaccucaagcccuaacaaagcuagguuauaugggauccugucucaguaaaaaacuuuugcuuaaagaaucucaucuccagaggccugugaccacccuucaaagacuuuuccaaaaacaucucucaccuuuaugucccggagucaguggacuuaagccuggagaagcagacccucgagaugaauugccuugaggugaaggaauacuaucaacacuuauuguacucugaaucaguggcacgcacaccuaacagaugaaaaggcaaaacagcaaucauuucauugucaaguguguaaaagcuuuacaagauauguauucuuauucagaagcaacuucuccaggcacacagcaagccaacuuaaaauuuuaaguccugauaaguuuuuauuuuauguguauuaauuaaugugaggauguccccuggaacugggguuacagacaguuaugaacugccacgugggugcugguaauuaaacccagguccucuggaaaagcagccuguguucucucagccacugagcaaucucuccaccccuaagaucuacuugaaguuuuuuuuauccuaaacaugaccagucucacagaagagguagcaaaauaaaacuaccuuauacaacucuauauauaaaacaaauuuuauggugaaacguuaguccuauuccuuauauccaaauaucccaagaucccaagaucuggagauagaaaaaucuuagaaaaaaaaaggaacauuuguuauucuugcagauauggguucaauuccccgaacuuaugauagcucagccaucuaguuccaggagacucaaugaccucuccugaccuucaugagcaccagguaagagcauaggacauacugacauaauaugcagguacaacacuuauacucuuaaaauaauuaagucugaaaaaaauucuuuugaagaagaguccuaaauucuagaaaaauauaaaacacgacaguaaguguucaaccuguauuaaauuuuauugguuauuccaugcauuaaaaacuaaaaugaaagccuuguaaggauaggcauaugcuuuaaauacuagcauucaggaggcagaguuccuagacagccaagacuacacagcaagacuuggucucauaacaaacaaaaucaaaagcaaacaaaaaaccaaaagcaaauaaaugcuggauaaauuuucuacacuuacauuugcuugaauuauuuuuuuaaagauuuauuuauuauauguaaguacacuguagcuguuuucagacacaccagaagagggcaucagauuucauuauggaugguugugagcaaccaugugguuucugggaucagaacucuggaccuucagaagaacaguuaguguucuuaaccgcuuagccaccucuccagcccuugccugaguuguuaucuauguguugguuaguuuucaggcaaaaccguauacauuaguuuucgcaaauaaauucugaguuucacaugcuacuccugucuuuacuguacauuuucccccaacagguuuuucugcaacccaagcuguccuugaauucaacauauagccaaaaugacugagcauaauuauaauucuuuuuguuugguugguuguuugguuuuugguuuugucgagacaggguuucucuguguagcccuggcuguccuggaacucauucuguagaccaggcuggccuugaucucagaaauccaccugggugccgccagcacgcccggcuauuuuuuccucugcuucuccaguacuaggguuacacuccaguacauucccauuuuccugguucagaaguuugacucuaggcuaccaggcauguuaagcaaggauccagucaauuuagcugaauccccagcccuucuuuuguuugaggaugggguguaggggucucuguguaggccuggcucacagcuauccuggagcucaauuuguagaucaggcuggccucaaacucagagacccaccugccucugccucccaagugcuaguugugcacuaccaugccuagcugauuuaaguuuuuuaauucuucucugauguuacaaauuaagcccauggugaagaggcaauggcagaggcaagcaaucucugauuucaaggccagccaggcuauagaaccccaucuugaaaaugcaaacaauacaaaauacaacccacaucuacaccaaaaaauaaacucacagaggggcaccauuaagcauacucaccgcuaagcaauacauagcuuuugugaagucacauuagaacauaucaagacaguuuaaagccuacuucuaaaaucauccgcuaccagucucaucuauucacuaugcucucccaacuaauaaauuagacaacuagauuagacuuuuaagaucuuguggcagaaugaggauuucauuaugauuuauuuuauguccauuuucaauuauguuaugucaaacuuggaaggcuuccaucuaaaacauaggaacuaaguaaggccagugguaaaacucacugguagcucuccuaguuaguauacacaggguccuccagaacuuccaaacaagaauaguauggcugaggauguagcucaauugacaugugcauaaguucugguuuugauuccuguacaccuauaauccagcauuuaggagaugaaggcaggaggaucagaaggcuauucuuggcuacaaagcaaguccuagcccugaacaacaugaggcuaagucucaaaaaaaaaaaaaaaaaaaaaucaauauggugggacucauauaaugccaguaacucaagagagcgaugagaaaaacggccucaaguucaaggccaaccuguuuuaaauuguuggaaucugccucaaugaaagggcaucaauaguaaacaaagacucuaguacaaauacaccuuccaaaaaaagcaagucacuacagauauauaaguaaaaaucuaucuuuuaauguuuuuuuaauuagaaaccaacaaauugucaaacaaaauaggcuugaaucagauuaaauuuaguguuuagugucaguaaauauuuuaaaugacugcuuaacuaugucaccuagaaaaaggagaaaaucuuuauuuuauuuuaugguauagcacauuaauguuaguuaauuaacugacugcuaaacacuaacguucauuuuauaguguaucuggggagagaaagcucaggacucagagcacuggcuacuguuccaaagguccagggugugauucccaauggccacauagcaccucccaagcaucauuccagucccaggggucaacucuucuugacagcaauggcaggcacagaagcagugcacagacagacagacaugcacgcaaaauacccaaaaacauacaaaaugagauaaauuuuaaaauaaaaaauaaaugcucuaguagguauguuagcauaugaugauuacagguuuauaaaugauacccuauuuuauuaggccacuggaaaauacucugaaacauauucaaguucuuauaacauaaaaggccuucauaauacugauauauaaugaccaaaccagaaaaacugagauuagacugguaaggauucaaggacacaugccaggcauggugaugaauaccccuaauuucagcacucaggaagcagaggagguauauaugaauuugaggccagcagaauauccagagggaguuccaguccagguagagcuauauagugagacccuaucacaaauaaaaacaaacaaauagcaccauaaauauucaaguuaauagucaauaauucugauauuaccuguucaaaauuggcagggagcugagguccaagucucaucaguaaauaccaccagacuucuaguuuuguuaaugcuaaaguuucuguucucacauggauggaacucaaggguugcauuaacaacuucagucuuuuugcacuacaaaguauaucuuaaaagaaaauaugacacaaguuaaagacuacuguagcaaaaaagguaagaauaaacuucucacuuugacaaacuccaguauaacugggccaaaaccagaauagaaacugcaguauuagauacaguguaacauaaaaggguuacuauucccaccaagagugugaccaucuggcaauaucuacaauauuucaggcuguuacaacugaagggaugcuacucccauuuaguggauucaagccaaggauguuccaauuuccuaaaagaaauagaggcaaagaaccauaguggcucaugcccagcaggacauggggccuggcaagaggaucgauucaggaggccaacaacauggucaacguuaagauuuugccucaaaacaacaacaacaaaaagaggcauauuuuuacauuauaaaaacaaaggcuauuuuaaaaaucaacuaauggccaggcacuggugacccacaccuuuaaucugaggcagaagcaaguagaucucugaguuugagaccagccuggucuacagaguuccagaacagccaaagauacacaaauaaaaccugucccgaaaaacaaaccaacaaacauacaaacauacaugagcaccauuaccacuagugccaucuaauuuuuuuuuuagaaagcuacacucagccuuguucccuacguuaaugacuguuagacuucaacacaaaagugaaacucgauguuguauuugucuuguuuuguuuauuugcuaauucuggagauuugcuuucauuuuuauguguauguguguauguuugggaacccagaagagcuggaauuaugcaagcagcuguaagccucccaauaugggugugucuucuggaauagcaacaggcacucuuaaccacuagcccaucucucuccagccccucaaagccaauucuuuaaaaaaaaaaauauuuuuacuagauguguucuugacuuagguacagaaaacuaagauacaaucuuugcucacacaucguauacaucagcaaagacaguguuuaaugguguauguccccuuuauaaaugccauuaccacuucuauaggaagucuagauguuaugcaacaaagauacaaacacacacuaccaaucaaaccuaggauuaaacuaagcuaucuccuagcuagguuuguuuugucuguagauccuggagagcucacuauguagaucaguguagaucaggcuggccucaggauccagaaucuaccugauuccaccuccuaagaacagggauuagaggagugcgccuccucuaaucuauaauauucaaccuauaauauaaggcuuaacuucacuuagccuguuacauaucuauauuaauguuuuggcuauuuucauauauauacauauguauacauguauauauaugaauauauauauacacacauacacacacacacauauauauauacauauauacauacguacguguacacacacacacacacacacacacacacacacacacacacacgucaaauacuccaucugagcauuauuaugcugaggugaagacaagucuaaaggaauccaguuuggagcacauuucuagagcuaugaggagaaaacuaaguuauugaaauuuucauuccauggcuaucacuguuccuuuucaacuauuguuuguauugcuccugauaaaucagguuuuccaaaguagucauaaaaucagaccuacuguagugacuguaaagagacacauaugacauuuaacucagaguagauagauagccacaaauaaauagguuuucauuuuguucaacuucugaaauaacuuaggguaagucauauauuagcaauuuucaaugucucuuaaaccuauauguuuguucccuuaagguuaauaagaacguuucgauauaaagcccaaaaaaaaucagaacaguaaaugcuaaauuaaaaauuugauuaguuugggcuaccuacuuaguucaauaccagccucagcuacauucuuagaaccugccucaaaaaagggaaacaugaccacagcaagaugucucaggcuugcagauguuuaacucugaugauguuaagcuucauucccagaacccaugcaauaauggcaaaagacauggacuccacaaaguauccauuaucccucuuaucacggccagaugcucuuuccccucgucacacacaauacacccagcacacaaacacgauuaaacuuacaaaaauaaaugcugaaagaaaggacuauuuacauaccuggguuuaaagcaaaauuaucuauuaagcuuuuccaagcaaugaaagcgauuuuuuuaaucauggguguuccacuacggaagcccaguucuuccagcuguaacaaagaguugaugaaacucccacuucggugcaaggucuaagaaaggagaaaaggcaucagaaaguuauuuauucauuuacuauuauguucuuggaaauucaaaaucuaaccaguaaacaaaagccacacauuacuuacaaacaaaaaccuauagcaggaguaauaaagauauauuaagcaagauaaacaagcugagggucuaggaaaacagauaacuuguucaauaaaguacuugcuauucauuauuaaggacccaaguucaacaauccucagaaacuaguuaauuaaaaacauaagcaaguaagaguccgaggcagacaacuggccuucaaagucagucuggccuacauguaacucaugauuacauaguaaggcuaugucucaaaacaacaaacuaggcaaaagggccagugauauggcucgggacuacaaaagguuuugcuuagccauacaaaaagccuaaaacauggcugagcaguuacuguguaccacuuuaaucccagaacucaggaggcagaggcaaagacaggccugaucuacagagggaguuccaguauagccagggcuguuacagagaaacucuguacaaaauuaauuaaauaaauaaauaacaaaaaacaacacacacacacacacccaaaaaaagccugaaaaccugaguuugaucucuagugguauuugaaaaaacuucacaaaguugccaugaccucuguacacacaucuacauaccuaugugcaagugaauaagcagauaaguuuuuaaaaauaaacacacucauauauuuuuaagggcagaaauagaggcaagcacuugugaucgcagugcuaaaauggcaguaacggcugccuacucagugaacacaggacuguaaggacucuaccucaaaggucuaagcugggcagacaguggcagaugcuuuacucccagcacagacacugguggauccucaaccugggucaacugcagggaaccccacaguggaagagugaaccccacccccacaccaaggaguccugauggauaucacaucucacacauagucauacaaauaaauguaguaaagaaaugaaagggcagauggcaccuaaugagcaacaccugagguggccuccacaugcauguacauaugagcauguaagcaugcauaaacuaggccuagugguucacaucuacgaucccagaauuugguaggcagauacaggaggauugaugcaaauugcagggcugugcuugagcuaugugcugagugguaaguuccacagaaccuuacgcaggacacacuaaaaaguaaauauucuggcauguucaaauuaugaaaauaccaacuaauucacucuccuuuccaagauaauucaacaagguaagguaguaauucacuuaccuuuccaagaaguuugacaaacaaaggccauaguuuuaacacauaagucucauuuuuauucuuaaauaguuuuuggaguucugagauuaauuucugggaacaaaaguaaaacauuuaucaaauacuuuaaaaggcaaaacauccacucuccaagucuaagaccuuuucauacaugaaaaagaaagcacuuagcucuaccaguaaguuuaacgcucaacugaccauccagaugcccaucaagucaggucacauuuuucuuaccaguauacuuuccccuaaaaacuucaggcccaucauuaacuacaauucaaaugauaccauaacaaucuucucauacugauacucuuaacagcuucauaguaacagaugucuaaaagcucaagagccucugauauggcucagugccccugagggccuaucaacaaaagauacccagaccuacauuaacuacugacucucaauuugcccucuuacugggcacggugauaugugccuugaaucccaucacucaggaggcagaggcaggcugaucugauccaagucuggucuacacagugaguuccauauuaagacugucuccaaaaauaaaaguuguccucugaucccacaugcaugaaagcguguauaaccuggcauucacaaucacacauacaauaauaaauuuuaauaggaaauuaaaaaaaacauuuuagcuaauauauacauuggccuauguggagaaagcacauuaguauaaaaacugaccuauuugagaaaguaguggaggagucuaugaagagcaucuugcccuggcuaacuccaauuaugccucuaguaaacuuauuuuuagucccugaauauuuuuuaagaugaggucagcuauggaugaccuguuacuuauuaugaaagacaagcuggccuucaacucauggagaugcuucccaaguucugggauuacaugugugugcugucaucuaugagaugacauauuacucuaccauacacuccacuccuaacacaaugccgaggucaugacauaaaaugcauggaaccaaagugaccaaacuaaagcccaaaguaaucacguuuuuugacugcuguuuuuugugucuauguuuauucccugaaggaccacaucacagcaacaagaaacuaacauguggcuuaccauauaaaucacaucaccaauaauaacuucauggccaguaaagugcuaguuacgaaagcaugagaacuuaaauucgauucccagaacacaugucuaaaaaaaagucugacacaguugugaaaauuugaaaucccaaagcuggaaagguggagaaagcaagaaccuugggguggaucuucaaucuagaccagcuuggucuacagaguuccaggacagccagugacacagagagaaacucugggugucucacaaguuccagcaggccaaugaagcugucuuauuccucuuuuuuuuuuuuuuuuuuuuuuuuuuaaagguagugccugagaaauacaagacuguccucuggaacucacuacauuaaaccaggcuugguggcuugcaccuuuaaucccagacucaggaggcagaaaaaaucugaguucaaggccaaccuagucuauacaaugaacucuaggccauggaggagugcacagugagaucuuacucaaaacaaaagcuuacaguaguccucaagcccuauuccuauaugauagugcacuuuuucauuccuuucuacagaagaagagcugcccacggcacccccugaauacuaacugggucagaaacauacauaaaggggcccuuugcaaugaugacucucucccccaaaaugagcugacacuaguauuauuauucacacagccaguucuuacacuggcuuucaaucacugcuaaaagguucuaauuuuaacauuuauauguuacuauauaugccucauauauaaacuuggcaacuuuacacaguagccauagugcucuuagaacaauucacaugaaaacaacaaaaccaaacaacugauguccaguaaauauugccaagaauauaagcugguaaacuuaagaccugaaaccguagccagaaacugcauuacaugaguuuauaagcauuaaguguguaucugcugagauaaugaauucaacauaauucuuccuuuuucaaaauauaaccccucuuuauucacucauuagagaagggauaaaauaucuaaacuuuagcaaaaauguuucauuuguuauaugaguaauuugauuaaacuaacaauucuuuucugcauuuguuucuuguuuugugcccaaggcuuugugcaugcugaacuaacagucuaccacuccucagagaugaauuuaggcugaauuuuaugcucaagguagaaauuccugaauguagaacucagcaaacucuuacuguuggcuuagaggugauucuguuaggcuccucccgcagucuuagcaaccugcugccaucuccaggugguggcacauaaagaaaugacugacagugcucucgcucccuagcucccuggacccucccuccucccuccuugcccucccucucccucccucugacccuuccucuggucccagugcuccuggauggcccuucucucucccccuuucugcccuccuagcucucucuaauccuaucugucugccucuaccucuucuccagauccuggcucuccucucuucccucaaauaaaccucccuuauaccaggucuguugcagugugauuucucaggacaccuuaacaugagccagucaggcaccccccaccaacccacuguauuauuuauuucauaccacacacaaaagaaaagaaacacuuacaguagucauaaggugcucuguaaucaaggcuauuucuuguuguuucugaagcagcaauggcauccccaucucuagagcaguggcuccccgcaaauguacuuuuugugcugagugaacaacuaaugguaugaccaauuuggcccaccucacagacucuucucccauuugaacuggggcuuguucaauuagccuacaaugaagaaaccaaugacuaaauuaaacuuaaaagaugaggucaagcuaaacuaucaagaagcaagggcaggugaggcacaucuauaaauccaacuguucaagaggcuaagaucacaagguuuaaaggcuuauuuccaaccuuaggcaauuggaugagauucagucuccaauuuuuuuuuucuuuuucuuuuuuuugaagacauaugguuuggggcacagcuuagugguagaguauuuauuaccuauuaugcucaaaucucucacacuacaaaauaaauuaacaggaaaaugagcaucagauagaaauaugcauaacaugagccaauuauuugagaauguauacacgcauguguacagagaaauaagucagacacagcaucaaaguacaguuaaacaguuggacaacugcaagaaaccuuugaaaauuaaaacuaagcaaaacugugcugucagcaaguccgugaguaagguacaaagaugcuccuggcuaggcucacuuaggaguauguuuuauuuugaaagucuuaaccuacaguuuuuagaaccaacucagauaguguuccaucuuguuaccuuucucuugcuuaacuuggucuaaaggauaaucacaucuguuguuuuuuuuuuuauuuauuuauaugaguacacuguagcugucuucagacacaccagaagagggcaucagaucucauuauagaugguugugagccaccaugugguugcugggaauugaacucagguucaaaguucuuaacugcugagcccucacuucugguuuuuuaaauauuacuguuuuaaacauuuguguguguaugcaugcauaccagugugacuaucuacacacucaugguguuuaggucagagaacuagcaggaagugucuuuccuauucauacggacuuuaggaauucaacucagguugucaggcuuagaagcaaaugccagcccuguugcuuaacaucuaucucaucauuaaauacaugaaccccaaaguuccaaagcuugauuauucuaauguauacaagaaccaacugcauaccuuauaauaacauuuaaugcuucaaaaucaacaacagcagaauguaucucuccuuuacuuaguaucacuuccaaugaaucaauaauacuggauaccuaaaugacaaaaacgcauaccaaucaggugagccacaacugucuuuugggcauauaauucagaugucccaaaacuagacucaccauuuugcuaacaaguucagcaggaaacgucuguuuggauauuacccacagugcccugguacacacauuuuugucugaacucuuaaugauaccauucaagguuaaaagcaguucuugaauauuugccucugaaaaacaagcauuuuaauuucauuuauguaguauaguuaaaaucuuuaaaaugucaacuacaaaaguaaaauaaaaguaacaaagguagauggagcuguucagaacgugcagaugaucacaaaaccuacagagaugcugaucaauaucacuucuugcaaaaaguaaacaauccugaccgaaggggaaacaguugcaaacugcaaacccuuuuuuuaaucauacucaauuaacuauugucaucuuaggauauuauggagacuuuuauacaaaaaagaaaaaacugcaacucuacugagggaaggaaagaguaacaacuuuaugauauccccuuacuaccuaccccucaguuccucuaauagugaucuuguagguuucuuuuacaauugcaaacuacagaacaauaguacuaguuaacaguacuuaguagcacuacuauacuuuacuaccacuuccaaaauaacacuuauuaauaucauauaagaacucuucaucucaacaaugaguuccuuaggggguaugacugccacaucaaucauaaaucagacagacagacagagagauauuaacuuccaauuuacuguguucuacuaaaaagacugagccaguaaaggcccuugacaucuagccuaguaaguccaguccccagaacccacaugguagauaugacucuugcguucaauguagucacacaugucccaaauuaauaccuuaaggagggaaggcaacaauuuauccauagauaacaguacuuuaacuguuuuaaacuauaaagucaacagauauuaaucaguuucccuaccugacaauccugagguaauucugggauuauauaaacaaaaucccaaggcuugcaaagcagcacugcucaguucugaguucugacuggaaaugugagccuacaaaacaaaguacauugacagcagacaaauacaguuucuagaguuaaaagccuguugcaacccaaaaucauugcguuuuuauccaaucagccaaccuuuggggauuaauugaaaaaaagauagggaagcuucgcagaggaggaggaaacuagaaaaagaccaacugaaagggacuaguuaagauagcguuccucuugcagauuaucuacguuugguucccagugcacacaggacagcucacaaccugucuaccuccaauuucuacuguucugacacccucuucugguuucuguggucacugcacacaugugguacacagacagacaugcagguaaauacccauacacauaaaaaauaaaccaaaaaaaaaaaaaaaucaacugaaagaccauuuuuaagaaaagacaaaugacaucucccauauccaugcaaaaacaaagagaaggccaacagaugaaaaauguuaacauuauuagacaggaaacagaggcaacaugguucuucuauaaggaauaagcaaagucucaaaugcaaaacugacacccuaguuuuagaauggagugaugccuucuuccucuaagacuaggaaagggaagcaagcuguauacuauauauuaggcacuuucucuugggucuuaaaaaaugcucaggaaguuugggacugggguuguacuucgguggguacagugcuugucuagcaugcaugaagcccuggguucaauccccagcacggcauaaaugcaaagugguggcacgugccugugaucccagcacuugggaggcagaaggaucaggucagggucauccucagcuauauacaaguccaaggccagccugggcuagaggcccugucaaaaaaaauaguaacaauuucaauaaggcugggauauucacuucaaucuuuucauucuaaaaacaagaguauuaaaagguguugauagcagguucugacgucacuaaguggccagaugaggcuaagaauacacucaguccgauauuaacuauuacaauuaaacaaggaaaacaaguuaacuaauuuuuuaaaguguuccaaaaagcaaaauuagcaaaaauuaauguaaauaaaaauaaauaacacguacugugggguaugucagugccagccuauaaucccaauuggaaggcagagacaggauugucaccuagcuaagcuaccugguucccaaacuggaaaaaaucccucugccccaaacaaacaaacaaacaaaaaagcaugaauaugaauacugucuaucgaaagggaagacuaagauaguugccauuuuaggacaaauuacucagaccuuccaaaacacagaucuuauuguuuuaauaagacauaagcuuugaacugacaacccuagacacuuuagacuuuaggcaaaugaaccgauuuccuaaccugcaaaguggggcuuuaaagagcagacuuggucuauggauguagcuuagugguacauacaugaacugaagugagaggacacauaagguaacugagagcaccugaugaaccauauauaaucacuugagauaauaaucucaucaauauaacugaugauauuuuguauucagggcauuaacaaugcacuggauaaugaugcuccauccacagugaaaaaccauuuuaucagaaagcuagucagaguugcuccuggaaucccagauuuggaaggcuaagaaaagauuucaaagggcucagucuaguggguucagacugaggcagugcgaagucauuaagaaaggaacacagaccuuuaaaaccguguacagccgagaaagguuuuucucgauuucugcaaugacuucuuuuccuucuucuccagucauacgacuuuaaaggaaauagaacauaagcuuagucgaaagcauaaacaaacaaacaaaaaguuauugccaucacuuuaaggauuacuuucagggcuggagagaugauccaggguaagaacacagagaggcucuggcagaagacugguguucaaucccagcaccccuaucguggcucacaaccaccuguaacuccaguuccagagccauccaacaccuggagccgcaggcacucuaacucguaacuggcuuuuuguuuuaaguuuuuaaagacgacuuucaagcccuuggaauuaaccucuuucuuuaaaaaguuuaaagguauagagaaaaaauguuuuaaguuagaccacauauaagcgguaacuugccucaaagcuuuuuggccucgaaaacguauuuuuucuuuucuuuuuuuguaauuuuuacaugagaaaagaaagugggaaucccuuucccuaaucauguuuucuaacucagaaaauacgaaaguuuaacaaaauucagaaauuuuucuaaagccuuucaaauaagucaaaacgggguuccuggcucugcuuuuuuuuuuuuuuuuuuuaagccaauucuggggccgguuugcugacucgcgcaccuguaaucucaaccacuccggcagaaccacaaguucgaggccggggucgggggaugagcacuggagcgagccugagccaaagacccuaacuaaacccacuaacuccggaucgccaacuuucccacggcguccgagguucgcagggcaaagcccugcucuccaaacgccucucgacuccaaacuuuucuuuaaaggcuuucccgucugcgggccagacaaaaaaauacagaaccgcucguccccgaagaagcccucggacgccgccgcugcgccccgcaacgucacucggcaggcaauggcccggugcaccccgaacuacccgcguccgccggguccccacggcugccccggcucccgccccgggcucguccccccggcccgccucaccuggucagaguuagguaggcguccgucugcucucccggaggcaccgaggggucuucccaagucuccagaagcggcuccagggggcugcgaccuggggccgucaugucggccgccacccugcagcgaggccggaagacacccaguaaccgguggcacggcccgcgcggcgcccucaccugcacgccgggccgcgcgcucgcaggccggccucccgccugcccggcucccgccgccgcuucccaggcagcacggccgcgagggggcagaggcggcgccggccgggccgagccgagccucccgcuccucaccccccacgcgggaaguccgcuccgcagcucgccgccccggggcccgccguccgcucccggcucgcgcuuauuuacucacgcgugcagcccgcuccuccacgaccaagauggcggc

SEQ ID NO: 817 - RNA, 3171 nt, Mus musculus
ggccagaaagaggugacagccgugcgcauacugaacacacugaauuauucacuuuucccacuuguuugcuuuggaaacagaaacuacucuguauagcccaggcuagacuggaauacuauauaaugaauacuauauagcucaggccagccucaaccuuguaacucucccaccuuacccuccaagugcugagauuggaagcacuguggcuguacacaaugccuggcugaguuauuuucuuuaaaauggaaagugugggggucagugagaugguucaguagguaaagagguuugccaccacaaaccugacaaccuaaguuugguugacagaccccacgugauggaaagagagaagugacuccccuaaguuguccuuugagcucuacauguaaacugucacacgcacccccuacacaaauacaauuuaaaauguaguaaaaaauuaauuuuuuaaaaacggacuuauuuuuuuccaucuugugaauuuugccucaccaaaaauaacaguuugggaauuuacaaagugaauguaguuaauuaacacuuauggucuaauuagcauccuccuggaaggcagaaggcuuucagcaaacauuuuuuggggcauugaugaauaugacuagaauuccuuugcugagucucuuuucagagacgcaucggccagguauuuggaccucuccuucucggcuacucuucaccaucaucuugaccagauuuagagacagcguggaaguuggcuccugguuaugccugucagugaggcuauuucccagagcuguugaacagagaugggacgaaacacacuggucgugcacagcaccguucugugcauggauuccuucccugaguaagaagaaggaaaugagcugaccuaagcauuuucucugcucucggacugaaggagcaaugccgcuucacgcucuugccccucugccgcagcggauuguuuccuccuauggccagccagaguaaagcccaucuuaaauacauuuguuaggcauguugucacagauacaggaaauucccuuccagaaacaguggaaccaagaaaacagcauuaaaaucagaauuuaaaagaaugauuacauuauauuucuuuauggggcagugggggcgcuguggcgugcacggaggucaguaaguucucuucuuccuucaccacguggguccuaggauggaacucagguggcaggcaccugucuguacgugcugagccaucucaccagcucuaaaaucagaauuuagaaggggaagggaugcuagaugacaaauagucugauguccucauuuuacaaucacaaaugugaucggccuucuuuaaauagcgaugccggcgaaagucagcagccgaccaagcuccaggccccagccugcuugcgcuccuuuugcuauuccucgcuguuucagccuugaccccagucccuggaaggguggagacuguggaaggaggacuuggccagacaacagcuguacuuguguguagaacaggacucgggccauauuuggguguggaggaaacacagcugcacucagagaaggcaagcaaaguggguggucaauaacuuaucagaaguaugaagcacaggaucugacugcuggauacaguuccccuucccaggaggcaaauaucuacacuuacaccccguuucauaacagagguuaguuacccugaaaguagaaagccaaggaaaauagggacaugugcccuuuguauaaauuucuccaaaguauuugaaauuugauagaauuucagaaucaagguugauuucgggaaaaacuggccaacaguaguguuugcccuuacauuuuguaguaacucaguguguucggcucggugagauaguuuucuauccccuacaaagauuccuuuggaaugccaauuaaaaacuauuucauugugaggggacuuuuucuaucacaagggccaggagcaagacauuggagcuaccauugaaaggaacaguaaaggauuucauaucuuguuuuuaggguaguaaagggcaugggacucuuaaagugucugaguguguguguguguguguguguguguguguguguaagugugucuaguuaugguuucuauugcugugaagagacaccaugaccacagcaacuuuuauaaaggaaaauauuuaauuggggcuggcuuauaguucagagauuuaguccauuaucauccugguuagaagcuauuaggucucaaacucaggacaaauggcuaacugagguguguauuugacauaucaaaccugaccacugaguucucagcaacuaccuaucccaagaucauccuggcuggcacgccccaccccuacccuauacucuccagcccauugacuggguuggacccuuuccccugcuucuuuucccuggauaacccaaacauuuuuggcuaugcugguuucuuggucucuugcccuguuggccacugcucuuggauuccuggcucacucuucucuguuuggguccugguuccucucuugcucuucccaccucuucucucauggcccaggucagccuuccagaugccucuggcuguuuuuucccccugauaucuacaauaaaccuucucuucuaucauaccuaggugcaucauguccuuuucuuucucgucuaugucuaugucuaugucuaugucuaugucuaugucuaugucuaugucuaugucuaugucuagucugucuuucuuucuuucuuucuuucuuucuuucuuucuuucuuucucucuuucuuucuuucuuucuuaagcauggcagugugcaggcagacauggugcuagaaaaacgagaggagagaguuauauauaaaccccccucccccuaccugggcccagugacacaguuccuccaacaaggccacucaucuucuuuucaaauagugcuacuccuugugagcugaugagggccauuuucauucaaacugccucuguguguguauguguguguguguguguguguguguguguguguguaugugugugguguguuuuccacuucaguguggauggagacaugccaaggacugugauaguaagaagcggcucugagccaagugccagccuucaguuuggagaaggcgagcaggagccagauugcugucaguauuggugggaugcuguuugaaguuuugaggcauucagccuauuugaugcccuggagcagaaagaaacaguga

SEQ ID NO: 818 - RNA, 56583 nt, Mus musculus
cuuuacccuuuggccccggcgggcgccagccacucagaucgcuucuuguugguaugugcagcggcaguggccgccgacggagcagucugagcccgacgaugaggccggggacuggagccgagcguggaggccucauggugagugaaauggagagccaaccucccucgcggggucccggggacggggagcggagauuguccggcucaaaccugugcuccaguucuugggucucugcugacggcuuccugaggagacggcccucgguaagggaucggcgggguaggggaaagcggcacaaugaaaaaccgagucagagaaacaggaagcucucuccaaacggagaagagcauaucaggaagagagcugcagauggugggcuacgucccaagggggagagauggagggcgggaacacacaaagaaauaggugggaccuuggacuugccaguggucuuggccuagguagauagaugccuuaggaagaaggaaggugcugggccccgggcggacugugcaucugagagccccaggcuugacuuacaguagggacacuuaagucugugggacuuaaggagcggcugcugcggucuuauuucuccgggagugguggugauuugcagggcuugggggauucgguugggagaauuggcugcggauacuuaguuucaagccaggaacaauggaaguauuauauuuuaagcucccuaaaacggcaugaauuuguuagugucugggacaguuuaacucuauuaaaacauuugugaaguacucuuggguacccgcacucuguuuuaggucuuguccauaugaauguaauuuuaaguaguauaagcugguuauguguauaaaggugacggaaguuguguucaucguaauaauuuuuuaaguuggaauucaauacauagucaccaagucugaccagucauuuaacaguuuguuaagucauuggagagggguuguaauccgcuaauggguuuaacuuuuccauuauuuuguaaauuuucaggccccaucuaauaaucacuguaguguaauuaagauuaacuucaguauaugcuaauacuguaauuuaaucacagugauuuaauauugugccuuaauugauggguuuuaguuguuguuuuugaaaugacauuuuaaagaagcauuuaacugucucucacucucccuuuuuauuauuuuucagauggggcauccuggcaugcauuaugcaccaaugggcaugcacccuaugggucagagagcaaacaugccuccuguaccucauggaaugaugccacagaugaugcccccuaugggagggccuccaaugggacaaguaagaagacgcuuucccuuuggcuugcuuaguuuuguuugagugugucgagauguauuuaagauguaagucagugguguacuugcagcccuuuaaagguuaguuuauauccacguaaugucuucaaacaagacaaaacauuacauugcucaugucuguaaccaaauuuugaauguaguaagacuguaugagaaaaaauuaacugacuuccucaacaaaauuaagcuuuaaaaaaaauaagccggcugugguggcgcacgccuuugaucccagcacuugggaggcaguggcaguuagaucucugaguucaaggccagccuggaucuauagacugaguuccaagacagagaaacccuaucuggaaaaccaagcaaauaauuuaaagugagaguauacaucuaaucuauuuaacuuagugacuuuauuucaggcauuauaauuauuaauggucuaggaguaaauauauaucagaagauaaucguggugaauguguaaagccuagcaucagaaaaauaguaguuacuugggguuuucauguagaaugaauuuuauucuuggaguaucuuccucuuguuuggggugcggagggauuuucugcucuauuacuaauucuuuccuggacagugccaaauagguagcucauuuucuacuuaauuuuugaaugauaauugcuucuauacuccuacuugugcguugccccuugaaucucuagcacaaaucguaaauggacguuuuuucguaggagugauuggauuaaaagguuuuaagaugacucaggaacacggguagaauuucuagagaaguggucaagaaagacaagagcuugaggugcaucaacaguucuguccuaugcuagguucuauauaauacacugauucuuaggugggcuggguuauuccaguugaauaucuugauaagucaugaaauuuuugauuagcagaauauuuuagaaagccaguuguauauuuucuuuugcuaaugaguacuauugaguuugacgaugguuugagcaaugaaggcuaaaguuacuggugaaauuacagggggaaacaggaacuuguguuuuuuuguuuguuugcuuuuuuuauuuuaaagaguagaauggcucaguguuaagugguuuucuuuuauauuuggaauauagcccuuaauuuuggauaagaaaauuguauucaaaggcaccaaacugaaaagauucugccugcaggaguuccuuauagaaaagauucuuuugcucuguuacucucgaauaauaauacuuuaaaacucccuaggauaugcagagacaacucuugauucuuuuucuguaucuuuccaucucuaagcagcacaaaacccuucuuguuuucuugguagagcugcucuaacuagauaaugagcuuuaaaaaauauuuauucucuaaugcucugguucuuauuuaaaauuaguuucuuuccacagaaagauaaaauaaaacaauuugcuacugccagacgcuucucucuuuucuggggccuucuguguccauugggccaggcaagguaaguuugcaagggguuggccugcuuacccuugcugucccggugcuguugcacuagcaguccugagaugccagcuacucauuuuuaguacagugcagauuuuacuuuauuuuuuuaaguaauuggcauacacuggucacaguuuguuuuguggccccuucucuuuagcugugccagugaccauauuccuaauuaguuuacuuuauacuuacacacuucagauauuuugacuuuugcuucaugguuuucuacuauuauuaauuuuuuuuuuagucuaauauguucugugcaccugacuguuuaaauguuuagcauucuuccucugugaggauaaugaauacuuugggagaccagaucugaaagucucaagaaaauugcuguuauuuucucaaaauuaggucauuaucuagugcccacuuccuaccuaagaguauggguccuagcuuaugguaaagcuaagcugaauccuuaagggcuccaggauucuuucucaaagcucuguguaccuuuucuuaaugaugaacugauuguuuuccugcaucauuucuucucuuugcauaugcucuggauuauuaauaguaauuauaaugagaagauaauugagaagaagcaggguaccuguauaguuuugccauccaucuuuuuuaaaguuuguuaaaaacuuuuagauuuucgggacuaagggcuuuauaaucuucaaaaauaguugaucuuuuauaacugcagaauucuguggccauuauuucaucuaacaugggcuuauaguacaugaaaaauaaauuacaauuuccagaccacaagcagacuuuuugccuugucauagucacauuuaacacgugaaacaacuauauaguuacuuauagagauagcauguacauuguguuagguagcauccagagaugauuuaaauuauacaagauguccauauaugcacauauuauggcuuuuuuuuuuaaugcaagggaaaaaaaggugugaauuuugguauguaccaggauccuggaacagcucagccuccuguuaucugcugcacugcccacauuuaaguuacuuggcuuagaccagccaaagauaaagaaaaugcuagauuauuguggucuuugaaauguuacugaauaugacaagacauuguauagcuucuuuauaaaacaguaugcaaacuagacaguaaugaucuaggguuaaaaaaggguuugcaaaguuaaaaugcagccaguuacuucaagaagugauauguucgcgauuuucuacccuuaauguauaagauaaacuagagugccauuuucuccaguucaggcugaaucgauuagcaaauaccuagaaauaacaagcauaacuuaaccauaauugcuuucaggcuuaucucaauuaccuaucauauagguuaaauuauugccuccugaugcacauaucuuuggggaaaauuaugcuugucaguuacacaauuaaaagaauauacuacugaaaaggaccguacaaauaaaucagauaaaugagcuuuaaauaguaugugagagaaggaacuguuuuuggaggggucuuuuuuuauucuuaaauauuuacugaaaaaauuuuuuugcauaguaacaauauucaaaacauuccaguagaaauuucuguuaaaauaugauuguguauaaagcugucuuucuccauauccauucagaauaaaacauguuuugucuuuaaaguauuuucuuuuccauuuuccuuuucuuuuuguaugugcuuuuaaaucaccaagaacauaaaauuuuuuguacuuuuaaucagcuggcuuugcuuuugcccaacagagugccccuagcuggcucuguucuugauuguaacucuccucugauuuauagaaagaaugagaugaggucuugagcuccuuuccagaguuaauuaacacuucaugguucaauuuucugacuuuaucaaacuuucauggauugauuuggaagucaaaaucuuccuaaguaauuuccuguuuuggggguaauuuuuuuugauauuacauuagugaguaguuacaucuuagaaaugaauuuggcuuucuuaacuuuauuacugagaagacaaacucacaaaucuguagcacccagguuguccuaucccgugccuuggagacucaaacuguuuuugaucugguuuucuugcuucaaggcuaauucuaucaccuaucaaaaaauagaaaguaaauuguauuucuuugcuuaagaauucccaguauuguauaucugugaccuagugucuaaauuccacagcuuuaaguuugaaagaucuucuguaauacacaucaaagcaacauucaaugaugcauguuuuuauacucccuaauacaaguucguacuaaucuuuucauggugccuuaaaugguuauauuagcucuugacuuuaagcuucucugcuguccuugccuucuugcuuucaagaucgcuaucaccgugacaucuuugcuugcuuaaauuauuuucucgaacaguuugaacacucuuuaccuccuuucuaaauuauuuaacacauugauauguuuggaauuuuuacuguuuuauuuuggcacuuagugacauuuuccucuuuuauuuuucccuuaauguuuucugauuugcuauuuuccuaacaaguaauagauuauaaggucuuagcaagaacugaauuguucuuguuaagaauugucagugcugagcacaguucuuggugcauucugggugcucaguaauacuuguugaaugaaugaaaugaguaaguagauacuauuuccuacaauggacacuagaaaguaacugauacaugugugucuagagguuacuugugacuuuacauugucccugcuuuuaguaugggaaucguaugguuuucucauuuagcaaaaauagauaaaaugaaauaaaugagguuuuuuggggucuuguuuuguuuugguuaagaaaucuaagccaggcaguggugguacacaccuuuaaucccagcaccugggaggcagaggcaggcagauuucugaguucaaggccagccugguuuacagagugaguuccaggacagccagggcuacacagaaaaacccugucucgggaaaaaaaaaagagagagagggagggagaaaggaaggaaggaagaaaagaaaggaaaagagagagggaggaaggaaggaaggagggagggaagggaggaacgaaggaagaaaucuaaaugcuuccacuuacugauaugcacguguauuucuagcugugucaugucauugagaaugaaaucuugccauuuaugucuuuauaacauaaaaggcuuugcagagauagucaauccauugguauuuaaauuuaucucgugcucgcuuuggcagcacauauacuaaaauuaaauuuaaucucauuaaugagaugcuuuauuuuauuuuuaauauuagccggucauuaaaaggcacauaauaauuuuuagguuaucuacuugaaauccccaaaucuagguaguuucuuugcauuuacuucucaagcagauacuuuucuuuauaaagaacauuauccuggggcagauguuuucacuuuuauacugugguucgauuuugacuguuuugcucauaagacgacaaaugggcucauuucgguuacuauuuagaugguaacucguuuaaauauaaacucauucaaaacuugaaaugcagcaauauuuuuaaguacuuaauguuggaaugauccaagaagacuuuccucuuuugauagaauggacuuuaucucucucuuugagaugauugugagucucacaugaaaguuguaaaaguguugcuagauauuuuuccgucuugcccaccaccuugcaaggaacauuucagucaugcauacuaccaacacuuagugaacuuucuaauacagauguguacuaggagaccuucaccccacuuuuuccaguguuuaccuagaaaaauggaccuguuuugaagguuuguaaguaagaauggguagauuauguucucuuguugaaguuguuccuaguuuuucauuugguuaucuuauaucuucauauuuuguuagacaucuaugucucuuauuaauguucuuaguauaaauauggcaugugugucuugaucuuaaaagagcaugugugaauugauuggcauuacugagugucuuaauuaggguuuuacugcugugaacagauaccaugaccacggcaacucuuaauaaaaaaauuuaauuggggcuggcuuacagguucagagguucagucuauuacuaucaaggugggagcauggcagcauccaggcaggcauggugcaggaggaacugagaguucuaugucuucauccaaaggcugcuaguggaacacugaauuccaggcaacuagggugagggucuuaaagcccacacccacagugacacaccuacuccaaccaugucacaccuauuccaacaaggccacaccuccaaauggugccacucccugguccaagaauauacaaaccaugacacugagagugucagaauauuccuggacacuuagaaauguuguggacaugagucuugucaauuuaccauguguuuucuuucauuuacuuuaagguguggucaguuguaauuagcaguuaauaaagauaauacauuuguuuagugggcuuauaucuguuauuuuugaguaugcuuuaaauggguuugcugcuguuaggcaguauauugaaggaauguaaugcuagcaguugaggguugaaauacaguuugcuguacuguaccuaaggcucugauucuucaguuaaauaaaauuuuuguauggcuuaucuuaaacuuugauuuuuuuuucuaaugcaaauucuugcuacuguauacacagacgcacauucuagguccucaucuucagaaccuuccguugcuuuugaaaacauggauuuagaaucacauauuucauuguguagucugcugcuccuguaaaggagacuucaguaauguuuuagucaacuuaacagcugcguguaugcuaguagucugacaagaguacaguggagugaaaauuuuuaugauguauuuucuacuguauacuuucuauauuuagauauaaaaauacuuuguauuacaguguccuguaguauuuauauuuaguacaguaaugacccaaugacauagcagucuuguggucauagcacaaaauaaugcuuuuguguuucugauaauguauuacuuuaccagucauuuuaaagauuaucucauacaagucauucaugguguauaauacuugaaguuauuaaugguaccaauagacucuguugcugauuuauauacuuacacacuauuucugguuuauguguuuacuaugcuaugcuuuuuauugguuuggaauguacuuuauuuacaaaaacaaacucacuguaauaauuacauguuacaugaacaguagccucauacaucuuaauguucacuggaccucuugauaagugaaaagagacaugcagugauugacugacuugugucaucuaaguuucuguauuacacauugcguaauaacaaaaucauguuauauuuaucauugagcgugucugcuguuaagugaagcaugcuguauuuaauguuacagcguacccuuuuaguacuaaaaaaguauaaaggcuuagauagaaguaauauugaaucuaucuugaagaacauaaaagggggauuauaauggucuuguguccuaaagaaggcuuuagaugacaauuuuaguacaaaauuuaaagucuuuaauuuuuaaaacuuaagagccacuauuguuuauguuuuucuaguugaauuuagaacuuccuugcaauuaaaaaaagaagugguacucauuuucauuccacuacacuuuuauauuuauguugcauaaucuguuguauuuugucauguuuguauaagcuuugagaaauuuauauaccuuaccgaauuuaaucuucuugucugaaaacuguuggcccaguuuguccagguuauauuuaguaacuggauggucuagagagcuaagugaauuuuauacucacauuguagaaccagcauuaaauguggcacuuagucuggauuugacuucuuauuacauguauugauuuauuggagguguuaaguguaugcuguucgcuaguugggccuuuaaugaaaaaaaaauaacaaaguugagaaauagacaaagaauggcugaggaaaaggauuauuuagaaaguucucuuauuguaaaagguuaagaacagcaguaauauuguuaguuggucuuucauguuuucaggugcuacacuuagauuuagucaccaaugacaaaaguguuuagagaaagauuugugucuauacuaaauguguucagaaauuuuugcaauauaauaacuagauagcauuuaauauuuacuagauaauauaagaaaucuagaugugauuuaaaauuuaccaggggaaugcauggauuauauaccacuuuuuaugagaugaacauuuggagauuuuguuauccauucggugaugcuagaauuaugaguacugugagacaacuucaguagguccuagcuuaucuaguagcuuugauugagcauuauuuuaauugccuuacauucauuauuguaauugauuuccuacaauaaguccugucagguaauauguuuacuguuaaugaggaaucaagguccagagaggucaauaucauagcagcccaaggucccaaagcuguuaaguagucaagcuaggauaggaauucugcuugucugacaguaucugugcugagcucacuugaguucuauauacaaaauuguaaaauuaagccaggcaguccuaacacuugccuuuaaucucaguacuugggaggcagaggcaggcagaucucuuaaguuugaggacagccaaggcuauacagagaaaucuuucuuagaaaaaaaaaaaagaguuagauuauaucaguugagguaaccaccucagaaguuuucuuauuagcuauguauguuccaagauucccuguggauuccuaaaaccaaaccauauauacauguucacuguuguuuucaagaugcccuguuguguugccuuguaauucuagaguuuaucuauccuugggaauuuuaugcccugauaccuucuuugcaucauuccuauacuuaggguuuggggccauuguuaaguaaaaugaggguuacuugaacuuauacacacacauacugcaauacgucaaagguagaucuaguaugcaagacugguugguaggagcuacagcuguggcagguguacuaagaaaccacauaauuuuaaaacuuguggauuuuuuuuauugguuauuuuauuuauuuacauuuuuaaugucucccuuuccaguuuucuccugaguaaaccccuaucccaugcccccuccccacugcaucugugagggagcucccccacccaccuacuccagccucaccacccuagcaucccccuaugcuggggcaugaagccuccauaggaccaagggccucucuucccacugaugucagauaaggccauccucugcugcauaugcagcuguagcccuggguagcuccuuugguuggugguuuagucccugggagcucuaaggggucugguugguugauauuguuguuucuccugugggguuacaauccccuucagcuccuucagcauauccucaucuguauugaucagaucaggcucugacaauaaaggagccucucgggacaggcuccugucagcaagagcuucuuggcaucaaaacuuguggauuuguuuuuaaaguuuucacauauuuucagaccuaguuggccauagguuacugaaucuggaaugcaaagcuauuuuuacuuacuuuagaauuucuaaguuuauagguuauauuuaguaaacugacuuugaauaaugguugucuuacuaaauauuuucuauauauuaaauugaaagcauuguuuacucuguguguguguguguguguguguguguguauguguauauuuaacagaaaauauuuucacuuuauauuagucuguuuuauuuuguaauuauugcuauuuugagauggggauauccgauccccuuaugaagaguuacagaugacugugagccuccgaguagguacugagaacuuaaccagaguuuuggaagcaugguggucggugcucuuaaaugcugagccaucucuccagccuuuuguucagcuucuguagcauugaugcugcuuuuauugccuauuuuuauuuuuaaaguauauaaagugauaaagcacucaucuauauuuaacauuagaagcuuucugggaugcuaagagcaauagaauagguugugugguuggcauuccuuuuuauucauugauuauuguccucucucuugugcuucuucugucuaucuauuaucccuaucccuucacuacugcacacugaaugcagggccucaugcauacuagacaaguguucuacuucugaucauacaucugcaguccuauuuuuaucuuuaggcaagaucuugauugggaaauuguccaugcugauccuaaauggauuuuucuuccuuggccuuaaguguagcaagagauuuaugaugagggucauuuacaauaccuaccuugaguauauguuaaacuggcucuaaaacuccccagacuccagagcuggagagaugacucagugguuaagagcauugacuguuacucccaguuauacuuuucccgaaacaccguuucuggucuuaauaaauaacaguuguaauuuuuaaaauaauacuuuauauauuggccaaaguagaagaaauggaaauuuguuaaaaaaaaaaaaagccaaaaaaaccccagcauuuuuauuuuauaauguuauuucauauuaugcuauugugaauagccauuugugcuuagaaaaugauguguuucaugaaauugcuauggcaguauagugauuaagaauuuuuucuguacauuuacagccuggauucacuuucauuaacacugauuaaaacagcaaaaggaaugcauuacagagaauuucauuagucucaaauuggggguucugccaaguaacuaguauaacugaauccaauugcuuguaaagaacuuaacuucagagauagcaaaugaaaaaugucccuguguauuuuguguuuaggauaauaaaaauaggauuguaacauuuccuaaguagauaauaaauuguaacauuuccuaaguagauaauaggggcucagggaaauaggucauucuaccauguucaaaaugcugagaacuccagauaaaccaaauuuuuaauaguaguuuuguaugaaauacagaaucuugcauagcauaaagauguucuuuaguuucauauucauaccaucaguuucacuuuuagaauauuuacuuaguuacguaaaaguuucaaagcucacaaauaaguuuguaacuaagcuucgccugccaggacuuuaauggaaaaugcugaagaaaacggugccuuuguauuuucuaucacaucucauuuucuaaccauaacugaauucugcacuacugaacaauugugaaguguuuaagaauuugggaaaugggaaggacagugaaagagacaauuaugucaaagucuuuguguucuuuauuugguuuugaauauuuauuguuucuuugaucuggacuaaaacuugcaucacuauugcaguuuuguagcuuuuuuaaaaaugggauuuuugucuuuauguuaaagucaaaauauuucaacugaaguuguauuaguuuacucagacuauuguuacugcagguaauaauuaaugaaguuuuuugcuuuguuuuguuuuguuuuguuuauacuauacauuuuaaaauacuuuuuauuucacccuuaggagaaauuacuauuuuucuuuuagguuuuuaaaacuuccacuucugaaaucaaauuaggguucuaguuuggacucuuagauucccacuguggcuuucucacguuaccuguugaguucuuagauagaaggcuuugggagcaucugucuuuguuugcuauuucguuuuccuuaacauguauauuuuuuuuuaaucuuuaaauuuuggaggcgucugugcuuguuuucaaaucuuacucuuuuuauaaaguauuauuuugagcguauguuccaaguaaucuagcaaaaucucuaaccauauugcuacccaauaguuuaaguaauuuuuagcagauuuuuaauguuaaccccaugcuagucuacagguauucuagcccauuucacuuuguauuuucacaaguaauaaaacugaacaugcauauucuuacguauuuuccuauugaucaauguguuuauuuuucuguuccuguuuuguaacuuguucauuuaauuugaaauuugaguaaccacuuuccuuguccuagugugguaguuguugaaauuuuuaucaaccuacaaguuuccuuagauucuuuugauacucaauauauuacagucaaaauucuaauaugguccuauauuuuauguaacauaggugaauauuuugaucaaauccuuuagaaaguaaauuuucaugauuuuuauucauccuuaauuuaguccuuauucagauuuuaauaucuguccuuacagacuaacauaaauucucaaaacuaguaugaucagauauuuauguacuuuucuguauuuguaaguaaaaggcauuuauauaaauuucaagucaguguuuagauuuuaagcaccuuuggucuaugacuuugaaaaagaccagacuacuguaaaguuuauuuaguacagauuuaagaauaagaggugaaaaaacugaaacuuuuuugucuuauuauugucuuguuccaaaaaaggaagaaauuguuuaauuaagaauaaaaggaaaugaagucucaaguuugacuuagaauaauacaaagucuguucuucuaaauaaacuuguuuuguuuuuuuaccauacauaugauuugugauguaaguaucgggaacaggaucaucagaaacuacuucauucauucaacaagcacuuacuaagcauauuauucauauaguagcauaguuucaguggguucuaaucuuaaauuguaugauacuuacaguccgugaaaagaaaguguuuugaucuuacaugguaaccauuuuuuuaacuucuauuuuagaugccuggaaugaugucuucaguaaugucaggaaugaugaugucucauaugucucaggcuuccaugcaaccugccuuaccgguugguaaucuuauggaaauaauuauuuucuguguuuugauuacuuucauauauaaauaauaaugugcuauaggacaccccaaaauuaaauuguaauggagcauuacagugcaacauauauacauguccagugguaaaacuaguucuguaagaaauacggcuuguaaaccauuugugaggggaaaacauuuuaguaguuauauaauauuuucaaauaugacauuuaauuuauuaagugcuaguaaaaauuaacauucaacuuaaaaaugagaagauuuaauuuuuuugaaacgcccauuuugguaaaacuuguugcaaauuaacuuaggcuguucuugaauagagacucaacugucacacuuagguaguaauuuggugacauauaaauacugugaaaaaaaaaaaagcggggcaugguggcgcacaccuuuaaucccagcacucgggaggcagaggcagguguucugaguucgaggucagccuggucuauaaagugaguuccaggacagccaggccuacacagggaaacucugucucgaaaaaccaugaaugaaugaaugaaugaaugaaugaaugaauacugugaugcuugcuuaggccuguuuauuuccugagauccuauugguuuuaaugaauggguaugacauacuuauuuagauuauaaguuuuuaguguuuuucagagcuuuggagauuucaggauugggaugggaagguuguguuucugcauaaccauguaggcucuuaaaguaauuaagcgacuccaguguugaugagcucuugaaauacauagcaagccuaggaguugaaaccucuagaaauauuagucuuuuagugccuuacagauuacacaugaaacugauuuacauugcauuguuucuauaaaauguagcuuaaaugauuucgaauguuaguaauuuaauuucucuucuugcagccuggaguaaauaguauggauguagcagcagguaagucuacaacguaugguggacuucauuuggaaagaugcggucauauuaccacaaggaaugaaaguggugucuggggcugaagagauuguucaacagaagcacuugcuguuugguuugguuugguuugguuuuuuuccagaggaccuggccuuccauccucacucuuaaaugguuaacuaucacugguaauuccagguccaggggaucuaucugaugccuucuucuguccuugggcaccaggcaugcauguguaauacauacauaugugcuaauaagccacucaugcacguaaaauuaaauagcuuuuuaaacugaucuuuaugauuaguucuuaauauuuucucaguauaugacaauagauaguacucacaacugaauccuuaagucagauuuauugugcaaauucuuugguucucauuuuuuauauucugugauuauuacuaaauacuuaaaauuuauauuagaacauuugaucugaauuucaguguuuaacaaucucaccuaaauugcuuuucuuuauuguauaugcuacuaaauacaauaaugccucugucaacaaaaucagagucagaauauuuacacaauauuuguucuuuguauuuguucuccuuggacuucuguuuuacaaucuuugcuuucucuuuuacuuauuuuaaguugacugguugcuaaaguuagacauugugugcucuuuaucacuaacaccugaaaaucccuuaccucauaaagauauacacaugcaucaacauaaagauacguguguguguaucccacauaugauauauaugugugccauauauuuauacaauaguauaggacagcacuaacaaaacuuuuaugugaugguggaaauguucaauaaccuauacuaucaaguacaguugcuacuagcuacauguaacuaaguauuugaaaugugcucaguacaauucaggaaccacuauuuuaagaaaauuauuuaauuguaauuugaauuuuaagcaagaaugugugguaucuuauugcgcaugcauaggaucaaagugacugaguuuggcaggaauuagagaauagagcauuguuguacuucaguagcauauauaauaaagaaaggaguuuaggggagaucgacagccagaaagcauaaugaauguuucuuauuuggcagcugacaauuaacuuuggagauugaaagcucaaguucugaaaaugcuuuauacuauagauguuuuauuugcgggaugaaaagcaagcaaacagguaauauaggacagcuccuaagcuuuaguaagaaugaagaggaagaaacaaugauaaggauuggaacuguugaggagccuuucacuuaccagugaauauuuugucuuuuaggugcagcaucuggugcaguaaguacacuuccuuauauuucauuuacaugcugaauuuauccuugguuucuagagauuauuugcuaagccaucuuuaguuuucagugccaaauguugaaauuuuuuauuuaaaaaaaauaauuuugauggauguuaggagagauuguuuguauuuuauguggcuauuucaaaauaugaaggccaacuacuuuagagaaaacagguuuuugguguuccagucaccucuggcagacgaaucacugccaagauguagauuuuuguaaacaccccuuugggaaagaccaucacucuugaguugaacccuuaucugcuauagaaaauauaaaaucuaagaucaaguauaaggaaggaauuccucaucagcaaaggcugcucccugcuaguaagcaguuggaagaugccuuacuuuaucuagccucagcauucauagcauauccaccccucauccuguguugagacuucaugguggugcugagaaaagaagucuuucuuucccaagaagaauaacaggagaaaggcugaguuugcugugcugaaagguagauaaaaaaugcaaaauuaguugccuuugucgagagucuccuuccggugaugaaagugguacuggagauuucaugcucagucacuugacagacagcacuguggcgaaugguaucugacuuagugcuucaacaaaccaaagacaaggaggugugcaugaguuaauaaaaggacaagaauuagggugagagugggaagaaaaggagguuuuaggaucuggaaagauggcucugugguaaaagugcuuguuguacaagcaugagaaucuaauuucaaaugucugucucuauauugccuauaaccccagcacugggggccaggauuggugagucacaagagcucuggccagcuuagccaaacagaguagugaaugucuggauuauagaguaaggcagagagcaauagagacucuagagucuuucucugguauauaucugcauuuacagugaaacuccaccuucuacccaucaaaggcaagaaaagagacauguuucauacaguuuugaagcuuggaaaauccaagaucaggccacucuauuugucugggcuaugguuagagccuccuaguuacuuuaacagcaugaccaaagacguuacuuuggugugcgugcaaaaauaguaugcuguguguguguaacaaaucaucauggccaagaaauaggggaagccaaggaagguuggaauagaauuucuuacuuuuuuuagacagauauuauauaaucccuauaauguuuuagaggcucaaguacuucuagaauugccucauggaaacuguucauccaagucuuuguuagauuuugcaaaguaaacuuccauuugguuauacauggccugaguccuuuuaaggaauuuuauuucuuaagucucauaguuuuaauuuacuagaaagauuuguuuuuguguauuuauuaauagacauuaauguaauaguauuaguaacuauuuaacagcuugcuuuauaugugaagaaagcuuucuaguuguuaguauuuuauuuauauacgaguacuuuaagcucuuugucuuguaguaaaaaaaauaauuaaaaguuucccuuaguauuuuuauuuucauuaacauguaguauacagaauaauggguuucugcaauauuuucauauaugcauauaauuaacauugaguauauuuaucccccuuuuauuugucccuuuucucaaauaagugcucauuuuucuauuuuauaagucuaguuuucacauacgauagagcauaugauuuuuuuuaagguuuacuuauuuauauaauguauauaggugcuauguuugcguguaugcacaccaucauaucuaaugggacgauagacaauuguuaaccaucaugugggugcugggaauugaacuguggaccuuuggaagggcagccagugcuuuuaauuccugagccauuucuccagcccugagcauguaauauuuuuaucggugggacauauuuuuguuuaaauuaugaucuccaguuuguuuuguuuucuuacaaagaaaaaugacuuuucuuuaugaguuaauuuuauaaacacacauuuauauuaguuguccauuauuuauaggaaccgaggguaauuguacaaguugucugucucagagcuauccuguaaaaugugaaugugcaagucccccuuguguuuugacuugacuccuucaggagcguaacugagaaacaguacacaaaauguacuguagguguuuuuugaagaacaucauguuucugaaguggccguacuaauuuauauucccaacaguauauuagaguuccuauuucccauacaagcuugacaacauuuguaguuuuuuuuuucuuauugauucuaauuuugacugccaggaguuagagcuuugcacuucccucuuagcuaaacauauugaguaauucucucauacauuuaggagucuuuuuuacuuacgaguugucugcuuucuggguguggugguacaugaauuuaauuuaaaaguaugugggggccaaggcaugcacaucucucugguggaggccagcauaguauacaaagugagcauguuucaggacagccagggcuacacagagauacacugucuugaaaaacaacaacaaaaaaaaaaccuguuugcucaguucacuuguccauuuauugauuguacuauuauuuugguauuuaauuuugaguucuuauguauucuggauacuccucaucugugugaugaauaucuggcaaagacuuccuaccauucuguaauuugucauucuacacuguuguuucuuuugcuaagcauaaauuuuuaauuugauaagauccuguugucaguucuuauacuauuuccugaguuagaguaauugucuuuauccugaaauguuucuccuauuagucuuaauguuucagguauugcuuaaguucuuggauuuacacugaaaugauuuuuaugaaguuagaaaagacugaguuucauucuaaguggauauccauccaguuuuccaggcauaauuuauugaagcugucauauuuccacucuuuauuuuacaccuaguuuaaaucaaguggcuucauauaccugagguuuguaguagucugaaugaaaauagcuuccauagacucauugggaguguggccuuguugaaaaaugugugucacuggcauugggcuuugagauuuuagaaggucaagacuagccuaauggcuuauugucucuuccugcugccugcugauccagauguagaacucucagcucccucuccagcaccaugucugccugcaugucaucauacuuccuguaauaaguggaguaaaccacugagcuguaagccaacccaguuaaauaucuccuuuaucuuggucaaggugugucaucacggcaauagaaccguaacaagacaagggauuuuguuugauuuguuuuaucccccuguaaccucuuuccucaguugucaucucauugucagcugagcuuuauggagacucauguaggaagauuugugaggugaauuucugggugugucugugagaaauuuucagaguuuaaauuaaggagaaagacugaauuuguggagcacaaauuuauagacugaagguucugauggaaucuaagggagaaaaggagagggugcuuucuuucucuaucuugcugcacccacgguacugucucugcuaugguggacuuugacauuugaaccaaaauaaauucucuuuuuaaaauguucuaucaagaucuuguuacaacaaaaaaaaacuaacuaauacagauguaugucugguuuuuccuuuaugauuugcuguguuuuuuguuaauuuuuuauugugguuauuuagugaaauuuaaaguuagguguuggcauacuccuuuuuugauuguuccuuuguucuuuugagcaagggucuuucuauguuccccuaaaaguccuggaacccauuauauagaccaggcuggccucaaacucagagagauuucuugccucugauuccugaaucuugggauuagauagauagauagauagauagauagauagauagauagauagauagauagauagauauguuuuguuuguuuguuuuguuuuguuuuauguauucacuagugcucucuucagacacaccagaagagggcaucagaccccauugcagaugguugugauccaccaugugauugcugggaauugaacucaggaccucuagaagaacagucagugcucuuaaccacugagccaucucuccagcccaaguccuuggguuuuuuugaagaguacuuuggauauucauaugaauuuuagaauucuuugaagauugauuuuucagauuuugguguggguuguauucaagaucuucauugcuuuugauaauaguuauuuccuaauacaaaaucugcuaaacaaggaacauagaaggucuuuuugucagcuagugucuuugguuucuuuuuucaguguuaaugaaguuuccauuguggaauuuccuuaguuguauguguuccuagauauuuuauuauguuuugaggcuauuguauauaguauuguuuuauuucucaaguauguucaauauuuguauauauaaaaauugcuauauaauaauauauauaagcuacuaauuuugcauguugauuuuacacuuuacuacuuuacugaaaaugucaugucugaggguuuucuggggagucuuugguggucucuuagguauugauagagucauuugcaaguagauaauuuaaugguuccuuuuuguaucucuuaaucuuacucuacugcucagaauccaagcauuuuguugaauauagguagggagguaaagaguucauucccuugaggcuuuagaagugaugccuugagguuuucuccuuucguauaauacgggcuuuacugcgugagccauauauacacugguuuuuaaugcugaggcaugcuucuuucuuccacccuuccuugguguuuucuguuuguuuguuuguuuuguuuuugucuggaacucuguagcuuagauugcucuugaacuugugauuguccugacucuaccucccaagugcuaguauuauauggaaacaucaccauaccagguuauguggagcugagucugugcccuuuucaacugagcugcaaccccaguucgaaacauacugaguuuuaucgaggucauucucuuacauauaguaaugaacuuuguaguaucugucuuagaucauguuuaugugcuguuacuuuuauugauuuguauguuggacuauccuuguaucucuuggaugaaaccaguuugaucauaaugugugauaaucaagaaaaaauuuugcaguuucagaccaugaauuuuagaucaaaaugaaguuuguuuauucccauugcaggaaagucuuucgggauuuaacaaauucuuagaaugcauuuucuucaucucucugauuauagaaguguauucccugcaaaaaaaaaucugcagaccguuugaagacaugguuauaaagcaaucagauauuaauuccgaacuauauaauugaauacauuaaguuuugaaguguuguuacauugugugauuaagcauuuggggaagaauugaacacuuucuguugaucacugcuggcugcagucguuuaagguuuuuugugugcagcucaucaguuugcugaacauacuucucagaugcaguaggauucagagccauuucuuauguacugcgucauaauucuagcaagaaaugguuuuguguagaauaaggaaaugaagguucagaggguuuuguuuucuuuuugguuuuuaauuuuugguuaguucacgaagcaccccaccuauuuaucaagcuuucucaccuuuccaguuuucuuuaaaauaccaagugacugcugaaugauccaugcugaauucuuuggcugcuuucuguuuauuuaaaaugaucagcuuauuauuguucucaucugaucauuaucagcuuuggauggcacacccccuagcuccucuucuucaagucucucugcaaacuuuucaagucccacuguauuguauguuucuuugucagcaguuccuggaccuaaugcagcguuggugguuugaaguuucucugccgccuuaccaacauuuagaacucaauuaaaauuguuugaauuuguaucuugucugacauuuccauaguauuaaaauaaacagcaaguaauaauucauuaggaaaaauuugagaauugcaugcuuguauuugacacuaaucacuuguguuaaacagguauuugagaucuuugagacucaucauuacguuguuuguuuugauuuugguguuuuuggguuuuuuuuuuguuguuguuuuuuguuuuuguuaauaugaucacguauuguuauaaacugucagggcugccguggcucuguaucuaagagguucugcauggauguguauucauuaucauuucucugaauuuuguaauuuccucaagugucuuguaugauucaauacucguuugaaaauggauagucuagucucuaaguauuuuuguuuguuucuauaguuucucuuacugcugauuuauaguuuuauuccauuauggucugaaagaacaugaggaauuaucuaguauaugcacauaugugguauguugagacuuggucuauauucuaugacauaauugauuuuggagaagguuccaugugcugcugagaaaacuguuauuucucuaucucuugauuggaauauucaaucuguuaagcccaguuuagacauaauauauuuuagcucugagguuucauuaucuagucuuaguuuuaaagaccaaucuaaauauuagaguguauuauugaagauccccacuauugauugcuguuaugcucauuuauguauuuuguuguuuguucacuuuauaaaauuaggggacuucacucaguauuuggugcauagauauuuaauuauauuuugaccaauuacucccucuaguaagauguagugccccaugauagcaauucuuuguugucaacuguaucugaaauaaacuaaaaccuaagaagcgagguacacuuguaagagauuugccuuuuccuuaauuaaaucauuugaauuggaaagaacuacaggaagaaccaucguccagcuaagguaggaaaauccaucuuaaucugggacacacugucuggagggagccuauagaagggacauacaagaaggaacuuuuugccuacuugacccucuuaacucugacuaacaaguucacuucuucacugauaccagaacuuucuucuuaaugcuggcacauauugagagcccucugagacauccagccuccuacacugaacguguugauagauagcaguuguuggaguagcuggaccacagccuauaagccacacuaaguucuguuccugagaggacccugacuaauacaugcccuuuuuaucacuucuaacuaauuuuggcuuaaaguugauuuugucugauagaaggcuagcucugccugcauguuuauauuuuccauuuacaugguaguuuucuauccuuuaauauuaauuuuuauaucuuugcuagcuacaacaagcagcugagcagacacauuacagaaauaaaauaggaaaaaauuaaugaaauacagauuaaaagcacaauacacaaaauuuagcaggcauaacuacuguuuugaaaaguuacuaagauugauauaccuuuacccagucugacaaaaagaaguggcggggggugggggcaauguggugguauauacaucccaacauuuaggaggcaggaggaucugaguaugagaccagcauggucuacaugagcaagagcuccaagacucugacucaaaacagucaaccaaaaagagagagacagagagaaacagacaagaagacacauuuaaaaacaaagcacuauuauagauuacuguggaagucaauacucugaaaaucuggacaacacauaagaaaagaaacaguaacuucaagaucuguaucaccuacuaaaauuaaauucugaagauacaacuaacuuaaaccaagucauuacaaacaauguaauugaagcugaaauuaagacuccccuugaaggaaagccuaggaccacacugauucucugcugaauuuuaccaaacugucaaggaagaucucaguuguuauuauaucuuaauuguauaggaaguguacacuauauagaaauucauucuaugaagccaguauuauuuuaauauuaaaaccagguaaagaugacagcaacagcagaaaagaaagcuacagacccuuugagcagggauucaaaaaugccuaaauacuugcaaaauaaauucaggaacauacguuacaaauaugaaagcuucgucccuggaagguaagguugguuuaacauuuauaaguuaauaaauguaaaauaccauauaaguuuacucuaaagauagagaugauuguuacauuugacaccaaaaaggcauuuggccaaguuucaaccaaccaauagacaauguuguauuaaauagagacaaacugagagcauuuucuucaaaaucaagaacaagacaaggauguccacucuccccuggcuuauuugauacaguguuccaagucuuagcuaucucaauuauacuagaaagaaagaaagaaagaaagaaagaaagaaagaaagagagagagagagagagagagagagagagagagagagagagagagagaaagaaagaaagagagagagaggagaaagaaaggaaagggagaaagaaagaaagggagagagagagagaaagagaaagcgagagaaagaaagaaaggaaaaagaaagacagggauuaaaauaagaaaggaugaauucaacccuuaaaagauuccuuauaagaccccauagaaaaauguugaaccuaauaaacuaguuacaggcuccaguaacaguuugacagaauucagcagugacucugucugauuacagcuucagucucauugcuuauaauugguuggucuauaaauacagccuucauguauaacagcaauuuauucucaaauaaauggggaggaaucccauuaaaaauaacucuaaagaaauaauaggauauaguaaaaauuucaagauauuaaaaaaagggagugacagaacauguuaaauaaugaaaagauuccugaauuggcagaauuaauauuauacaaguggcuauacuuccaaaauuaaauaugugaugcaaugccuaacaaaauucugauguauuucacaggcucagggaaaaaaaaaaagaguauaaaaauauauaccuugcacagucagaauggcuguuguuaguggcaacucauguuggagaggguuuguaaagauagccuuccgacuaugguaacugugaaaacauagguagcucccagccaucuguaacuccaguucuagcugauccuauguccguuuuggucuuuaugaagacagguauacauguuagcacacagacuugaauacaggcagaacacucaaacacauaaaauauuaauauagaccaaccaaaugaacuugcguauugcuguucuacucacuguaguaaggaguggaggcaacuuagucguccaucaauagaugaaaggauaaugaaaaucugguacacacauaaaaugaauuaucguucagcuguaaagaaaauugaaaucauaaaaugcuaagaaaauagauggauuuagaauauaacauuaaaugagauuacaaaaucucagaacaaaaccacgugcucuuaaccucauccaauguagccaauaauuuacauacauauguauauauguaaacaaauguauaugugugcacagaauaucauaaaaagaagcaagaaagcaacuaagggacaaggaacaacugggugcaaguuacaaaaaacgacaaagugaauucuuuuuucuaauucugacaucuuggauuggggguggauaugugcauuaaaaauuugauauuaagucugcauuaaaaauuugauaccuaguaugcaucucaacauuuucagacugccuagucuuaacaguguaaaaguucauugaggugguuaauuuugauguccaaguucuucauuuuaaaacuuuuaaaaaaagaauauauucguuaucuuguggcaaauuucaacaaagcaaaagccauuucucuucaaccaaucuaauauuuggcuugaaucuaagcauuuugcauuuauguugaggguaaauugguauauucuuugauguuuugucuuuauauuauuuuggaauugaaacaauacuguuuuuaugagauaaauuuggaaauauuucuucccuuuguggcauaguuugagaagcauugguucuuuaaaggccugguagaauucagccaugagauccacucauucaucuggucauaggcuuuuuacuuacuguuuauauauuuagcuuaauugcaguuuugguuuauuuggauaaggucuuaugcauuuaaaauauauuaauuucuugaagauauuucaagguaauuugaauuuaauuuuuacaauauucccuaauguuccacuagauuuaaguauuauuuauuauaacauuuucauuuuacuccuaauuaaucuggguauucuucuguuauuguauuuucacucuucaaagauucggcuguuuacuucauugauauguuguguuguagcguugguucugaaguuuugccuccucuuuauuucuuuauguggauuacagguuugucuuauugguuuuccaauacccugagcuguagcaugagaucacaggguugcuuuuucuuucaugcauccacaguauagcuauuggcuuuacuucccuuauucugggucuccuguuacuuacggauuugcuuuuguaacauuucuuccuuucugcuuguuauuuucuuuguuuagaauguugguguuuuaacaguggcuuauuuucugauaauuucugaguccuaaauaauucuuguccuuguuuaucuuuuuuuuuuuuuuaccuaaauuaucugcuacaagguaauugaauaauuuucuaugucuuuaucuguaacuugguucagucuuuuauaugacagauugcuacuuuuggugucucaggucgugacuauuguaacaauuauccugauuuuuguuguugcuaguuuuuuggugucugugugcauuaguuuuuuaacuuaaucccugauagucuuuuuucauccugggguugcuuuccauugauuauuuuuuuuuccauuugauuuauaguucagcccagauuucaauuuugucuuuuuuuuuucuuucaaagaaucuuuuuaacauucucaugaguuaucaggugagguuuuuuuuuguuuuguuuuauuuucccuguuucuuuuaauucucuuuaaggucauuguuuaaucuuacuuuggauguaaccuccaauagccuagaccucacuauaagucugguaugaucccucuuccuugcccacauacuaggaugauacguauaaggaacuaugagguacauugaguauuuuaaaaauuaguauugaaucuuuguuuagcacuucaguuauuggauuaagguauugaagagucaaaaaauuugaggaaugucgcauugcauuauacuuuuguauuucuuggcugucauggaacuagcucuguugaugaggcuggccucaaacucugccucugccucaagagugcuggaauuaaaggcaugugucacuacuaacaugguaguucauguucuuucuuaaacaaaaaaauaagaaaaaaauuacacaucccccuccaaaaaaaaaaacccucuuccccaaaggguaguuauuauacaauacccaggacauaccauuuaagaaaacauauuuuucccuuuccuagcagauagcaauugcaaauagaguuuugguuggguguguugaagucuuuuucucauggcugagauuuaaucugguuugaucuugugcauccugucagucuauaaaaaguauguugcaaaaaaaaaaaaaaaaaaaaagaacaaaaucacaaagaaucagagauaguucuuccugcccauuaauacuggaagccuccaauucggagccgaggacaggacuugccuuacuaaaauugguauauaaggccaagggcuagacuugucaaguguaauguuaucaguggcaaggcuucguguguucuuaaaacuugccauuucagagcauuguacguggugggcuggcagaaucccacuuagcuacagaggcugcauucuuggugaugacccccaauugccucugaauggaagaaacauucagagccccguucguucccuugaaagcaugaauagagacaacuaggaauuuugccuguagagccuucccagcaguaaauuaacuaacugcguucucucuuugagagaaaggaagcgucuuuaacacugaucaguccacuagacuuagcagcagagcauaaacuugugucuucuaaggcccauaaauggguagauugugggcucuugcacuccgugguaacagauaggugaugaggcacacuucucccuuaacauuguccauuuuaucaccagugcuacugugcucuaguggaugauacuauaacugagcaacuaauauaacaaugucuuaucuaguguguaauuuuuaaugagcuaauacauacauaggccuagcauacauuuagaaucaucauccacuccucaaauaguuuuucacugaagugucuuuucacauguguucuuuucugcccagaguaacccaugcuaccuaccacccuggacuucacauaccuguuuuuucauacagcuagucauauuuaaauucaucuuuaucuuuguauauuuacaccuacauguaccgccaaaaucacauugcauccauguugcaugaacauacaugacuggcauaucauaacugcuucccguguguaaauggaaccucugaagguauauaauaugcaaguaugaguguuuauuuacaucuguacccaauauucucuuguuuguucuguaaaaugcuguguuagauacgugccuuugcauuuuguuuuugcagcuuaguauccaugguauuuguuucaacugaacuuuaaucccuuuuuucucugugucugcauacuaauauguaauguggucucugauacaaaacauuuaauugaauuacuaaccaaauuauuuuuauuuuuguucucaaguacaauauugcuaucaaaaacaugguauaugcaaccucauuuauucauaggaauuauauuccuauggaagguuacaguuggcaaaaagguauaacuaagauuauucuaguuuucucgggaggggaaaguagccuuacucuuagaaaauuuaaagaauauuacaauuacuuuguuuuccuuuuuaugcaagcacacagugauaauaaucaguccuaauagauuugucaauaaguguaaaauaaaaucuuaguguugaauaagcaagugauaacauuugcuuuuuuauuucuuauuguuauauauaguaaucuuauauuuuuaaaaguagaauguaaaucaucuuuguagccuucaucaaccaugguuaaauuuauuacuauaugaaaagcugauuacaagaaaagaccaacuugaaagucaaacaacauuagaaguaucauggcugaggcuuuuuuucaaguuuuaguagacuaaugaguuauucuguuauuagaucuuuguuuaggaguagauuuacauuuaguuucacaugaaaaucucauauuuugggcuugaaauauuuggauucagguuuuuuuuucccccuucucauguuaacuugcucaugguuuuugcaauaaaccuuuuuuaauuuuccaguuuuguuuaacuguucuuauaggggaccaauuuagaacuuuguccaaguaccuguagguugugugggggggggggggaggggucuuucaaauuagaccagauaaaugcauauuacaucuauauuuaguuuguauauuguauucacuggagaagaugcauauuucuggaggauuagcuugugcaaagggcaaaauguuacuguucuucugagagcagucauggcauuccaaagccguaauugaucucuucuaccuuuggguuaauuuuaaauguucucuuuuccaauuccuuuucuacuucuauugacaaauuauuacgugugacuugaacuguuaaaauagucauuuuauacuuauucuugguguuuugcaugcuugcuaccucauagauauucacugcugaauaauuuacauguuaauaauuuuucccuuuagaaaucaauguggacagaacauaaaucaccugauggaaggacuuauuauuacaauacugaaacaaaacagucuaccugggaaaagccagaugaucuuaaaacaccugcugagguaaauguuugaagacuaggaaucagaacuguuaaguagcuuggguauaauuuuauauuaagcuccaaagaacaguucuucugugucucuaauuauuuaggacauuggguggagagggcuaauguaguuagaauaauaagcaagaagaauaaaauuuguuuuccuauaugaacauacuuuguuuaguaucguccuauguucaaagguaucuucaagaauaaauugaagaguaagcaguuuucuucaguacaggaugaccuguaugguuuuaaaagacauguuaacaguuccaguuaaccauggaguuugauauauugaaauuaaauaaucuaaaaaauacugucuugacuuagaguggaauauuuucucuuugucaagaugccucugaaagcauauuauuuuguacuauacacuuuaacauccaaaaucuauaaauaugauaaaaauaaaauugaagcaauaaauuaagcaauauugccugucuuaauagucaugcucagaaagagaugaucuuuuucacugaagaaugguuuaccuagccagugguauuucauuuuuauuucccuuaccuaaagaugguaaaguguuuuccacacacuguaguacccuguagucuaauauguacauaguguuugagaaggaagggugauagguaacauuuauuucucauucagauauacacucucucagaguuacaacaaauuaauugacuaugaaacuaaagcauuaggauagaugaaucagguuucacuuuuccccaaacuuucuauuugucuuauuuguauuaaauaugaauacuccauucaguaauuauggcugaugguuuuuaauaugugaauguaagaggggauguacacacaguugaaauucaaguagaugccuaacuuuaaggaagcaucauugcacuuccuaaauauauuaucuuugacaaauuauuuucucuucaauaguuaaaucauauauucaguagucgacagcucucaugcuaugaauguauguagaguuucauagguagacaaugucugguaaaaacaagugcagauaaucagcagugcugaauauguuacuauuugcugaaagcuuuuucccuucuuuagcaacuauugucuaaaugcccauggaaagaguacaaaucugauuccgggaagccuuauuacuauaauucucaaacaaaggagucccgcugggccaaaccuaaggaacuugaagaucuugaagguaagaugggaaaacaauucuacugggaaguuguugugcauauaucagucaccuggaaacaguccucccugaauaggauuauucaaacuaaggccuuauucuuuuuuaaaaaauaauuaaaguuuaugcaaauuuuaaaugauguaacauuuuuugugggcucuuauuuucuuguugcucuagaucucaguucuauagauuuuaaauagauuuuuauuugauuugauuccauugaaacuaggauaccagaauaccauuguugcuggaggucuuauuacaaaaucaaaccugcauggugagcugcuuugauaauucauuuucuguuauauuuaacauuuagaguaugucacuaauuuucacuaaccaugaauggauagaucugcagugaaagacauuuaauucaaacaauuacuucuauauaagaguuauauuauaaaugagcuuaaagguuuuaaaauuggguuugauauuuuaaauagacaugaauauugaacaaggucacguacaaacuucuaguaucccucagaauauuggugcauacaugggacaugugauuaagcuuaaucaugauauuagguaguaguugaucuugagucaguuauuuuguccauauauuaucggauuucaguuaauacugauuuuguuuuaguaucaugaaaaaugguuucaauguuuuuuucugaaaguuaaguuaaaugaauauauaaauuauauauuuuauaggaggaaggcuuaguuacucaguaccaucaaaaguuuaggaaagauuguuaucuaacaauacucagcauaaaauaacacuuugugaugugauuacucuccuuaaaauauaauccuuuacuaaauugaucuagaucagcuagguaaaagguuaugaucauauaugaguaccucuuauguggauuuuuugcaucuuaaaauagauuuuucagaaauauucuccuuuaagaagugauaaauuuuaaaauacauucauagacuuaggcuuauaucauugucuacauggagcaccucauucucuagugauacaaaauuacagauacgugucucaccagcagauuuaaaauuuaccucagccuagaauaaugcaaagaaauauugaguauucaaaucuuuaaaguucuaucuaaauugucugagcaugagcuuauaauaauuuuaccaauagaaucccaaauuguucaucuacagaauaucugucaagcucauuucugauaugacuacaaaugguugguuugcauaguugcuuaucugcuuaucagugcuaguaggaaaaaugggccagaaaucucaugaguucaguaucaguuuaaauguaguaucuuuaaaaaguagucuccugccuggagacaguacuauuguaugcauuguauugugugagugugcuuguauggccaguagcuucuggagucaucagcauuggaggagacugcucagcaguuacaaucgcuguuguaaaguuucaauguugcauugaggcuuugaaacucaaguaaauacuugcacuuuaaagcgaguuuuaaauugucgggugauaaauuagauccgaugaaauuaugauacuuucaucuccuuuuagaguuuguuuucaaugguuauauuuaaaaacuaguagauaacuuuucuguuuucuuuacuagccaugaucaaagcugaagaaagcagguaagcaauuuugaaaaucaguaugguuuacaaauuuggccauuucuaucgcauucauguuuuagauguccacuuuuuaaaaaggauaugaaugcuguuuaauuggauuaggguaaugguuugaugucuuuggaagguuuuauggagguuguuaaaagggaaauauauuuacucaaguguauguuuugcuaaacaaguacuuuaauaugggaugcacuguuugugaauuaaguuucucauuuugggaaugagugauuauauaucucuguuauaaaacuaauuuuuuuugucauccugaggaauagaaccacagccuugcguauguuggcaaucaacuacugagcuauauaaaguuucccuuuacuugacuuccugagccuuacgaguuuugauauauaucaaauauguuauucaaaguaacagacugagguuuuauugaaguaauuggacauuaggaaauacaagcauuuauaucaaugccaauugcagguuacugugcagguuugaugaaagcaaaauagugguagaaguuggaagugguaacaaugcacagugggaagaauacaguacugccugaggcucauguaucugagcccaaccuacacaguaugacuagguauucucuaaaacaaacauauguuuaauauagucuuauucuguggucuuuuaggauggcuuucuaguuuacugucaaugauuuguuuagcccuuuguuccauuaguguugcaacuuuauaauuggcuuuauuuaccaguacuguauugaaaugaccaguucucguguucucucucuuucucucucuccucacucucucucucucucucucccccccucccucccuccuucccuuucccuccccuuuucuauuccuuuuauucccucccuuuccucucuuuuaauguauagcaagcaagaagaauguacuacagcaucaacagccccaguuccuacaacagaaauuccuaccacuaugagcaccauggcugcugcagaagcagcggcugcuguuguugcagcugcugcagcugcugcagcagcagcuaaugccaauacuuccaccacaccuacuaauacugugggaaguguuccaguugcuccugaaccugagguuacuuccauuguugcuacugcuguagauaaugaaaauacaguaacuguaucaacugaagagcaagcacagcuugcuaauaccacagcuauucaagaucucaguggugauauauccaguaacacuggagaggaaccagcuaaacaagaaacugucuccgaguaaguuuaguaacucagacuuuugcaaaucaaugccugacuuaaaauauaagaacuuguuaauuuagucaauaaucauuaaauguuuaaguaaaaacuuaaguuuuucuaauguugauccauuucaaaucguugaauuucaguggugucaugccaccaaacuuuugaaaguaaucuguuaaaguuaugaucuuacguugauuugcacugaguauaggguguggcacaaauuuaaaagaauacauucuauaucuaucaauguacuauaugaaaucaaaaucaaggcaaaaaggaaaaaauccgcaguuugcaaacuucgaguauuuuaaauaaaggcuugguauaaugcccugguugguuuauuuuugguaagggguuauuuauauguuuguuuuucccuuuuuguuuuaugugcucaguacagcacugccaagaaguacugaagauugcuguggaagaucagaaacucugccaaauagaguagaauuaaacuuguuuucauucuuuuuggcuuauugaugguguuugauuuuucagccuauuguaaauaaauugaaaaaugcaaacagcuuuuuucaaaaaugucucagaagagagaaggcacuuuauauaggaaucaaaauaaggaagucacuuauaacugcaaaacuuauaauugauuuuuuucuaccauaugaugcaagguauaaaugggagacuaaucuaaccaaaacuuauuauccaguuacuguuagucccacugccuccaucucuccacuccuuaguauaauguuucuucucucauguuaauuucacaaauaacuauauaguguuuuaauaucaagauauuuaaaaagaaaugagaugguauauuuggagacaauuaagauuaaaggucacauuuuccuuuuuuuugaccuuggcuauacaucuauuuagguauauaauucaagcguguguguguguguguguguguguguguguguguguguguguguguacauauccacacauguacauauaucauacauuuucuuuuauuauuuauuuuauguauauacguagcugucuucagacacaccaaaagaggccaucagaucccauuacaagugguugugagccacuauguaguuuuugggaauugaauucaggaccucuggaagagcagucagucacuaagccaucucuccagccccuauaucuuacauuuucugcauacauaaagguccuucaucaugucaaguguugaugacaugauaugagcuuuugaguuaucauucuccuacauauuaugcuugaacuuuuugaauacuaaaguacugagaugcucaaaauacuuuaugcaacuugacaugauaauugcauguaauuugugcauauccucauucauauauguauauuucuauuacuuuuaguacauaauacaauguaauuuacaugauaucauuacuuuaggaauaauaagaaauuccuguauucuucacaguuauguuuuauuuaucuuuuuaucuugcugcugcauucauuuauguggauguagaauuuauuuuucauaauuuuaacaacuauucuuucuugguagcuuuucaguauucaugaauccuaauuucuuuuuuuuuuuuuuuuuuuuuuuuuaaggauuuauuuuuauuuauuauauguaaguacacuguagcugucuucagacacuccagaagagggcgucagaucuuguuacagaugguugugagccaccaugugguugcugggauuugaacucuggaccuucggaagagcagucgggugcucuuacccacugagccaucucaccagcccgaauccuaauuucuuaauaauuuuaauuaacuuguauguaaggacacauaaagaaugauaaauuuccauauaucacauucuuauaucaguagcuauugcagcaucaaguccaucauagugacuuuauagugaacuaaaguuuuuaaauuuaguguggaaucccaaacaaggaguugauaauuuuguauuaaauuaauucuuuuugaauuauuuuucacaauauuccaaauaauauuuguuuggaguucuggguuacagaguuacuuggcacuugugugacaguauauuaucagccaaaaacaacauaagaauaaauuagcauuguuguauucuauuaauucuguguuugcaaaauuaaauaagcugaauuuugcuaauugauccucuuauguugcucucuucacugguuguagguuuuauuaucacauacaaaauuaucagggauuaaaugugaaaugugaauaaguaugaugggcuauuuauuaacaugcagacuagugauguacaucagcuuagugcaguuccauguuauguucuggccuuuacaaagggucugauaacugaugcuacaaaaauucuuuaacuuuauguccuuggccucagacaguuguauuuauaggguuaauguaagaaacuuucuuuugaauuugucaaguuuuagaucagcuucaaacagcuaaaugauaaggagauuuuacucaguagaaaacagugauugaaauuaugaauagcguguuuaaauuucugucucucuaguuuuacuccuaaaaaagaagaggaagagagccaaccagcaaaaaaaacauauacuuggaauacaaaggaggaggcaaagcaagcauuuaaagaauuauugaaagaaaagguauucuagauuuuuuuaaguaucguaauaauuuccuaauaaauguucacuuugaugccuuuauuuaaaauacuaaucucuagaacuguuguaacugacagcaaacuaaauuuguuguguuuuaauugaacgcuuuugugaaacuuaaaaagguauuaauuucacaagcauauuuuugccuugauguuuaagauuuuuuucaaaaaacuuaaaucauccuuuuauugauggacuaauacagaaaaauacuguuucaauuucagugugaauuuguuuucacaaaauugcuucauuaaaaauggcuuuagacuuuaaaaaaaucuacaaaaggaggugcuugguauuugcagugagcauuauacuugccuucccaugacacuguuacucucuguguucuuguauucaauacucauuuuuccuuuaaaucauuuucagcgggugcccuccaaugcuucaugggagcaggcuaugaaaaugaucauaaaugauccucgguacagguaauaugacgguuuauaaauuuacuuuuuacguuaaucuuaggguacuuaaaguuguauaaaauaguauaacuccauaaagaguuauuguucauagcuuuguaguuggcauaaauagagguauuuuaugugugcuacagccaaaaacccaaaagacuuguccuacaaucugagcaccaugcuacacaugaaauuggcuuuuuagaagcguuuuacaucuucaauaaauuauacaaauauucuuaauauauguaugaaacuuuuuuccaaagccuuuacauuugcuucuccagcguuuauucuuauucuuguaugauuauuauuuuauuauuauuauucagugcuuuagcaaagcugagugagaaaaagcaggccuuuaaugccuauaaaguccagacggagaaagaggaaaaagaagaagcaagaucaaaauacaaagaagcuaaggaaucuuuucagcguuuucuugaaaaucaugagaaaaugacuuccacaaccagauacaaguaagguuucuaacgauguggaaagugauugucuguuguuuguguccgacguauugccagcucguccagaauaguugggagugagcauagcuguggaaaugaggauguggcaguucuguaaggcacugcaaguuuacauagaagccaacuuuuaagcuauuaaugagggaauaaacguaccacauuagcuguuaucuguuuuacagucugcagaaggugccuuaauguaagagaaagaauaggcuuugcucuucuguugagauuuuauugucugucauagaauuuuccuaaguagugauuuuuaaacugaacaguggagaguguucauuaacuaccuaugaaaaaugaucuaaaauuaguacuaaugcauuaaggaaguaacauuugauuucauaaucacuagaaaagcugagcaaauguuuggggagauggaaguuuggaaugcaauuucagagcgugaucgucuagaaaucuaugaagauguuuuguucuuccuuucaaagaaagaaaagguacuuuuaaaauuaucaguauuucaacauucugaagaauauuuuacuuuaaaugauaugacaauuucuuuacuuaauuuguauaguguauguuauauaucauauuuauucauuggaagcuaugauaaagauaaaaugaguuaacucaaucuuuuuucccucuuuucaaagauaguaauuauugucuaaaucauagugaguacugauuuaucggaauauuuaucacuguuaaauuguuuugccuccauucuuaaaggaaacauggaugauaguucaaauauuacuaaaacuuuaaacauaguugaaugacauugaagacuuugguauuuuacaugcaaugacugcuuucaguagcccucauuauaaaauguaucuguacugcauacugguaagguuauggaauaaggacacaaaaacaaauaguuuuugggcucugacuucaaagacagauggaaaaacuagagguaagacucugucacaaacaacacuaacaaaaggugguguuacuaaaggcuuauguauuauauuugaaauaucagaauauaaaggaaucuuaaguaauugcaauucagaugccuuguuugaauguuaaaagguauucaaacauucauuguaggaacaagcaaagcagcuacgaaagagaaauugggaagccuuaaaaaacauacuugacaauauggcuaacguuacauacucuaccacuuggucugaagcccagcaguaucugauggauaauccaacguucgcagaggaugaagaguuacagaguaagaacaaugccaaguagugcccuccagucacaaaguuauugucaacuuuuguaugaaaucaaaauuacucugacuuuuuauuuggucacuaacucaauuuuacacaaugauuugucugucuugggggugggaaaagcuuuauuuacaaaugaguuccuucuaauugaguuuuaaauuuagauuuaggggaaaaaauacuuuaagagagauucccuauuuuaaaaguuaucuuuuacagcuaauuccugaaauauguaagaagucgaccguuugcagaucauuggugucuucugaacccaaugaggcgccugcauguaaaacucacagugacucacagcaugcgcaaugcuuagucccagcaugcaaaugggcauugaccguggaaucucacccuucgcuacagaaauauuaacagcugauagcugcuggagaggggcaggguguucucucuaacuccuaauaacuugaccauaauccguggaagaccucauaucuaagaauauuuagucaugacaguuggucuugauggauuuaaaguaaggaagaaaaaguggugacaacaaaguuagauagacgaguagaggggacaucugugaagaguugugggggugaugaauaugaucaaaugcauauaggaagagcucuugaacuaagcauuugaaguguaacguagugcccuuugggaggguaagcaugauugcuucuguuagcuaguccagugccgugugcacguccuccauucacucucuguaggauuugaagucuuaacuugugucauucuaaaauuauguuugaauucaaauacaagugguuuuuuaauacugaauuggaaauuuguagaguuuaaugcaaauaaacugcuuuucuguuaauauuuuaauuuuuuauuggaaacauacuauagacauggauaaagaagaugcauuaauaugcuuugaggaacacauccgggcuuuagaaaaggaagaagaagaagaaaaacagaagacuuuguugagagaaaggaggaggcagcguaaaaauagggaaucuuuucagguaauagaaagaugccuauucugccuuaggucuguauuauagucauaggaugucaagaagaaucaaagcacuucugagauacuuguuucuaguucauuaccuaggcuuuguggaugcccaguauguugaacucuuuaauuuuuauaauuuagguuuuguucuuggacauuugaggcgaaggaauauagcaaggugaagcaaacauuauuuaacuugagcauaaggcuuuagcugaacaacauagcauaagggcuagguggaaacaagacaagugaugggugcuuuguagcaguugauauuugguuccuaaagaaugugcuguacagcuuagacauggaacauaguuaaucccuuuacgugggaguuuaaaguauguucuguaaucaguagcuuuuucacuucuagugguggucuucccauuacaaagaaaugaauuuuugcuguuuaaauuuuuauggguuuucuuugagauaggguccuaggugagccaggcuguccucagacuugcuguguagcccagaccacuuuuguacucuugaucuuuuuguuuccaccuuucaagggcagggauuacagacaagugccacaaugccugccuaagguauuuuaccuguauaaccuguguuuugaagcuguucuuaguauaucauguuuguugaauauauucagguaaauaaagaaacggacuuggugagauacuacuaaguauagagcuagaauuuaaaacuauacagucuugguuacaaacagucuuuagucuuauauuaaacucuguauuaggguaccagcaagguugcaguggcuuauauaagcuuguuaccuggcauuaauagucuguuugaucuauuguuaucauuuagggugguaguucuuaaaauuucacuuguguuagauucauguaaaagacuuuuuaaaaaacaguuuaccaugucaagugguuacuaucuauugcaaucacagccguuuaaacacuaauuuaccuuuguucuaugaaacucgcuacucugguaaguuacuuuuuuaguucuauguaggauuauucaugugacuacuaagaacacagauuauuaagucucuccuuaagauuucauccaguagauacaggguagguuuuaauauguacuaauauugaugcacucauaugaauaccagugacuucuaaaguuguuucugauugccuacuuagugggauauaucauuccuuugaccucauuuagcauggaaaugauuucaaagaccagucuuacuacuaaagccuauguucuguuuaccuauuuucauauucaguuuuugagaauucaaucuaauuuucauagcuagcuauaaaauaggcuaucccuaguuuuaagauagucaacuaugugacaagaaagaaaggcuuuuaggagagccauuagacuucugcagcuuguaugcuucaaggccuuuuuaagauuuugaguuuacaauaguuuaaauuugaacuagacauaaaacuagaaaucugggucauagaaacuacgacaauaugauacagaguaccaaaugcuauuacugcaggccacgagauucuaauuaaaggccauguaggccuuuagcuaaguguaaaauaggcuuuaaaucagauugauaugcauauagcauguuuguguuuaagguuaaaauaagugguuauuaaaucacuauguugguacuccuuaagauauauauguaauucaguaauuuuuuuaguccuauuuuaccuuucaaauuuucaaagaauuauuuagaacuguaguaaaaugaauuaagugaaacugucauuuccaaaauuaaucaugaguggaaagaaccuauucaguaaugugguuuggugauuacagucuuuuucuuuugauuugauuugaucugucaguuaauacuuacauaauuaaguuuguuacaucuuugcuaggaaccuggugaauuguuuguuuguuuuuuuuaaagucuuaagucccauguuuaauuugugucagcuguaauagaaagguuugagacaagucuuuaaauugaacaaaggaaaaaugugucacagaggggaaaauguuguaagacaaaaguagugguccucugagaaugagcccuagauacagaguuaccauuaccugagaaguuacaaaaugcaaauuacuaaacccuaaaacaaacuuacuaacuaagauucugguguggagucuaaugcuauguugauuuuauccuucagaugauugacaaauccuaagggacaggaaaaucuacaaaauaacaaauaguuaaaguuuuuauaguguggagacuuaaagauacuguuuaguguguuacuuaagauacuuaguaaucacuagcauaguaaagagaguuaaaagauugacaaauaguugaacauuacaauuagacuugagauauuuugguaaggaaaaccucaggacuucuguguuuuaugcuuugggauggaugcagugguugcacacacuuuuaauccuugcacgcuguugacagaagcagguggaucucuaagugcucacagccagccuggucuguccccuuucaagauccaggacagccaaggguacaugaugagaucaugucuuaaaaagaaaaaaaggaaaagaguguuuuauggauaagagaaaaauagucaagggagaaaaugaaggaacaauuuaaagaugagggcuaucucucaaaaucuaugaacguucauaauucaaacacagauauaaauaguaacauaaagaacaguauuggaggggaaaaacgggaacaaguaagaaaagauaauacugaauuaaaucugagguagagaucuucaaccaaggaaaaugcuguuggugaucacuauucaagggaaaguaacacugguaauuagugaauaccagcuuuaaagaaguuaucaacccuccugugacaauuuuucaacuggaaauccacuauuaggaugagacucaaaaaucagugacuugagugagauauuaacaaaaauauaugauagaaaggaguacauuuaaaaacuccaggaaggaguuuuuaaacacuuuaagacugaaaagcuuuaaaaccaccuucgccgcuuuuguugaaagagggaaguagcaguaggauguagguacauguuacucuauaacauugcugcccaguguauccuguauaugcaacuuaaacauaaccaguuucacauuuagcaaucuaguuaaaccaauauuuaaaggcauucucuaaacaagcaguaauagauauuuuuaaaaauuuuuaaauugaguaaauuuaaaaauuuacucuguaaaccagucuggacuugaacucacauagauugucuucccucugacuuucaagugcugggauuaaaagcaugcauugccaccaucuggcagaagaucauacuuuauacuagccgcaauguucagaaacugccuuuuauugauggcuuuuuaaauuuucauuguaauuuuuuauaucauguauauguauguuuugcaugcauguuuauauacauacuauaagggcaucauaacuccuagaacuggaguuuuagacugguaagcugucauucaggaacugaaccuggguccucuguagaagcagugugagucuaaacugcugagucaucuguugcuccccaggcccaguagcuccuauugaacaguggagcccuaggaauuacagaacuaaggacuggaagaagaccaauagacacugauaguacugaagccccagugugcaguccugacugucagccacaggaaaggaaaugggugguauagaauagacaauuuuuuuuuaaagacagaauaaaguuacaauaagccuucuguuuaaggaagggaaaugguugggagaucacauagugauuuaaauccuaacuuucccagaagcuuugaggagaguaguacauaacuauauuugauuuauuuuuuaaagauuuguuuuauguauaugaguauucuacuaauuuguauauaccauucacuugccugauguccacaucaccugaaacugaaguuacaggugaucaugagucaccuuauggauguugggaacagaacgugggucccaucugccccaaaccaagagccaucucuucaggccauuguuuaaaauuaaccuaaauaaaaauaucuaaaugaugcuauuaaaaaaaaaaaguuuuauacaggacaugcacauacucuuuagccucaucauuugagaauagauaaucccagucauuuuaguaucuuugguuuuugguuauauacauacacaauauuuuauggaucuuguuguuuuuaacuggaaguggcuuucugucuuaagggauagguaacugaagacuagaaggauaguauagucuuuugaaagaucucuuucuuuggauggcuuguguauauuauuuauuuguggucuagaaguauuuuugcuggcacuuuuuaccauguuuuucuuguauuuuacauguguuugucgcccgcagaucuuucuggacgaguugcacgagcaugggcagcugcacucuauguccucuuggauggagcuguaucccaccaucagcucugacauucgcuucacuaacaugcugggucagccgggugagauuccuuucuuuccaagcauaccuuaggaguugggauggauguggguugggguugggaacagccguugggggaggagaggugugugcuuuauuuuauguuuguuuuacaaacaaaaaguaauugcagcucuugguuagagcuagcuuuuugacuucuuuaguuuuuucauuaggaucaacugcacuugaucuuuucaaguuuuauguugaagaucuuaaagcacgauaucaugaugaaaagaagauaauaaaagacauucugaagguaagugaacuuguucuuaacuauuugaaaacauugauucauuccuugcaguuacauguuauuuauaacaagauuucuggcuuuuaggauaaaggauuuguaguugaaguaaacacuacuuuugaagauuuuguggcaauaaucaguucaaccaaaagaucaacuacuuuggaugcuggaaauaucaaguuggcuuucaauaguguaaguuaaauuauuucagauaccuaccuaauuguucaucuaagaauuacuucaaguuguaggcuagugggauaagguacuguaaaagggauaagguauaagguaaagaaaguaaaacaaacuguguaaaaauguuucauuguuagagguuaaauuaaacuuuuauaagugauguuauaauacuuuuaagaacaaugucuuguuugaaacaggacucaucauaauuuaauagauuugauuuuuugauaguuacuagaaaaggcagaagcccgugaacgugagagagaaaaagaagaggcucggaaaaugaaacggaaagagucugccuuuaagaguauguugaaacaggcuaccccuccaauagaacuggaugcugucugggaagauguauguauacuugugcuucaaaguugaaaauaacacuaauuuguuucuaggggacacagauaagcuaaacuauucacaaaauauucuauauaugucaaaagcuaguugugacuugaauuucggaauaguuugucuaaaugguuugaauacagcaccagcaggggacagggcuuagaucuauguacuugauucugcuucccagcaugcacugccacacccugcuagaacuauugaaggagaaaagaguccacuuuuaagugaaucucagguuucuccaugggucauacugcuuuuagauaugaugauaagauuuucuuaucuucauauauuuauuccauaucguugcuuuccagauccgggaaagauuuguaaaggaaccagcguuugaggauauaacucuagaaucugaaagaaaaagaauauuuaaagauuucaugcaugugcuugagguaauuuuuaguuuguugugacauauaaaggugaaaguuugagaugaaaauaaucaagaauguuuuguucuguagaauuuuuucacaugacaaauaggugugcaggggcuauuaaagauagugucagaaauuugcuuuuuguuccuaggugcaggaauucagucauuugucggccucauaaaucagccaguaauuaagccugggaauauccuaaaguuuucuuggacagcagauuuuuaaaaacugacugaacaaaaaacacauuaaaaaaauguugguuucagauauuauacuauauuagguaugccaaaaaucuauaguuucugaauuacaaugggaaaaauaggaaguuuugcuuaaaauaacagugggaaauuaucaaguaagucuauaguagaaauauuuucacuuguuucaagacaggcucuuguaaauuauccugaauugaccaaugacuauuaaguacauuguuauagacugugugagcuaauccauuuaucauucauagagcuuacauguaugaacuaaauccuuacaggaaguuauguuauguuacaaauaagcaaacuaacaacaugaaguaaguuuuguaggcaauggcgucuagccgauauauauuauuugacuauuuaucagugcuuucaaaaaguuuaacaugagcuaaggaaaugauugaaugggcaaaauccuuggucugcaauuguaaggacugauguucauaugcucuagcauacauaaaugcagggaggauaugguaggcuacauauaauccuagcacucagggagguuagaaauaugaucugugaagagugguaaggcuagcuacaauaacaguuuuucuggguuccaguaagauaaacucuaccucacuauaacguggagaguauaaacuuauggauuccacaaacauguacaaaguacaaaauggaggauaucauccugaaugagguaacucaaucacaaaagaagucacuugauauacacucacugauaaguggguguuagcccagaaacuuagaauacccaagauacaauuugcaaaacacaagaaaaucaagaagaaggaaaaccaccauguggauacuucauuccuucuuagaauagggaacaaaauaccuauggaaggaguuacagagacaaaguuuggagcuaagaagaaagaaugaaccauccagagacugccuagccagaauaggaaaagaugggccuaauucuacugcagcuugaugugccugauaacuaugggaggccuccccuuuucugaggagagagggaggacaggaagagaaugggggaguaagagcgagggaguaggggaggagggaguggaagguuugauuaagauguaaauuuaaaacaaacaaacaaacaaacaagcuugguuauacccauauuccaaagcauuugaauguauuuggaacuuugagaugcuguauccuaaggaauguaugagcuaccuuuuuguaaucaagaauccccaagcaaugaagagaugguucauugaguaaagagcgcuuuugugcaagcauaaaagacagucugaguacccaccaggcagggguggauacggggaaaucuucuaugcuuaacagccagccaucuuagccaacacaaggaauuucuaauagagugagccugugucucagggagaaagguugagaagcuagagaagauagcuuauuucuucaucuggccuuugcaugggugcacaucacacucuucauucacacaccacuuagacacacauacagagacuagccagcuuuguacuuuugguaauuugagcuagagguaauguagugaagugguagaugaaucuaaagaugauucuauaggaaaagagugagcaagucagauugugaaaccugauuaauaaggucuugaggcaccguucauugaggcagaaaggacuucauucuuagccagguuuuccauuucuacuuuuuagaccaaauguguguuaucugagccagggauauaaacauuagaacaaggagcauuuccugcagcacuucucccuuccaaguagccuuaugaauauuuuacaguuguguguacaucuguguaagucacaauucauauggaagucagaagauaaauccaggagguuuuucucucucugccuuaugauugccagggguagagcuugggucuuuacguacucuuucauaacuguucccauacuccaccagcaccacccacccacaaugaauuguuuacuaaguguuaagggcacaaccuguaguuaaauaaguguucccugugugaauucggaggaaaugcuucuugggacaaaauaaaaaggaauagaucuuguguaucccaguugaaagaugccuguuagguuuuuuaucucagugcuuggccuagcuuacuaaccaaaccuagucagauuagaugacaaaauuaugccugaauaauuuuuuuaauaauuauugaaaguuacaccuuuuaagacuuuucccuaccaaugcucuugucauuuugauaaaaacuacuucauuaauauuuuguaaaaauuuuucagauacauaaaugaauuaaaauuuuuucagauacauaaaugaauauauaauauaugaauaccuaauaagaauaaaaauagugauuucucauguaaucacuggacaucuuauucuaauguaucuugcuuaggacuuuuugaagaucucacaugguaagcuuguaccauuuucuuguucuugccuauacaaagcaagugcaguucuuaaaguuugucuuuuacuacucuagcaugaaugucagcaucaucauucaaagaacaagaaacauucuaagaaaucuaaaaagcaccauaggaaacgcucccgcucucgaucgguaagaaguguguuggcuggcacaguagaccaaaacauuugugaacaugcuugugaaugucuguauguguauuguuuagggaucagagucagaugaugacgacagccauucaaagaaaaaaaggcagcgaucagagucucauucugcuucagagcguucguccagugcugagucuggugagcacuucucucuucuugagucaaccuugacacuuugauuucuucagauuuugacauuuucuuuuucuuucuaugcuccacagagagaaguuacaagaagucaaaaaagcauaagaagaaaagcaaaaagaggaggcauaaaucuguaagaaaguuucuaguuuuuaacaguuccaaggcuuugcuuuggaaaggauucuucggccuucucauaaucuaaaucugugcucauuuaccuugggaauaaaaccagaaccuuuaagugugcuuccccuuagucuuccauugugaucacucggaacuucaaauaggaacauucacaaguacuaggguuccuaaccuggucuuuuaaauuuuaaaagagacagaaaaaauaaaaaugcuugaucaguuucucuuccaaugcuguagaugcauauuagguuggcauagggguuuuucaucaguggugucugaguuuuagcacagaugcccugaacuagaucgguugucuugguuucuaugcugcuuccuaggaguuuuagcuaucuaacccagaacuacuuauuuaagcacuaacauuuuaaauaacuuguuuucucugugauuuuucaaccuuguuccauggauuaaaugaacagcuuagucagcaguauccuuauacagaucuaaguaaaccagagauaugcuugaugaaaaaugugcaggaacuaaggcucuauauagcucauuaaggguguguguuuagcauguauguggggcccuggguucuaaauaaguaaguaauaucgcucuauacuuacacaauagauauaaccuggugcugaggcucuuaauaguguuuuaacauauccagauguuguucuuccugcguugaacacuggagaaacucuaguuuuggggaucagagugggggaugauggcgcacaccuuuagucucagcauuugugaggcagagacaggcagaucucugaguuugaggccaggcugcuuucagagcaagcuccacagcagucagaaaugcacagagaaacccugucucagcaucuuaacaacaacaauuccuggggucaacucacuacauucuuacaccuaaccuauaagugugauauuauuaaacaucugcauaaauaaucuguaaaagaaugguaugcuuaucaaaauucugauauguucgguguuuuguacauaggacucuccagaaucagauacugaacgagaaaaggauaaaaaagaaaaagaucgggacagugaaaaagacagaaguagacagagaucagaaucaaaacacaaaucaccuaagaaaaagacuggaaaggauucuguaaguacugaaaaguguuucuuuccugaauucccaaaaaacaacaguucauucccucauuaaaucuuugaugguguuuauaggauuuuuuuuucuugaucugcuaacauugaagaaaagaauaaauucucuucacugcuuaucacaaaauagcuuucugguaccauucauuuccuuaccugauuuaggaggaaaugcuucuugggaugaaauaaaaagaaaugucugagccgggcgugguggcucacgucuuuaaucccagcacuugggaggcagaggcagguggauuucugaguucgaggccagccuggucuacaaagugagcuccaggacagucagagcuauaaagagaaacugucucgaaaaaccaaaaaaaaaaaaaaagaaagaaaugucugguaccacuucauaaaugacuauccgguugauucucuuacauuuauauuccuuaaaaaauuuuaacagcaaauuaacaguacaaaauaguugucauuuaacuuggaaugaaaagauaauguuugaauuuuacaguaccacugagaaguacauugggcacugacaccuugauuuucaaauuauugggguuuuguucugguuuugagacagguuuucucugauucacgaccuccaugaagagugagucccucucuaugcuugucuccucuguagcagugguuuaaacaaaacaccucagaggaccacuccacuucgugagguuguuucucauagacuuuaagucuugucuguguucaugagcauaggucagagaccauuuagagucuaaguuaagucuaaaacuuaacauugcuuuacaggauuaccuaaaauuuauaaaauuagcaaaaaccauacugcuuuggaaguggauguguggcuuucauuaagugggaacuauuaauauuuaauugugugaaacaaaaggaauuaguauguaucauuuuccuuguuuacauauuuaauaugaacugaaguagcucuauauaagaaucccuaucuuagcauuuuuuuuuccucuaauaacauccaaggaauguuuaauaaccaacgguugggcuuuggagcaaaguaucaguuuuaaaaccucgugagauguuuuugugugacugaauuccacaucuacuuuagaaucuuuuuacagugucaguuuucaggauuaacuuuaauuguaauuguguugaaugucuuugcaggguaacugggauacuucuggcagugaacugagugaaggggaauuggaaaagcgcagaagaacccuuuuggagcaacuggaugaugaucaauaaauuauaccaaauauauguuuauaguaugauuuaaagucuaauucagaccagggauuauuuuaaguccaauuuacauaacacuggguuuuaauugugucacaggaaaaagugcauuuauguauuguuauuguggacuuuauaaaagcaaaggaauugaaaauaacuugauucuguaucaagaaucauauuuuccuaugguaauaacugucuuucugugacccuuucacagggcacuacaggauggauuaaaaguggcaauuucaugauagcugcagacgucucuacuuuguucuaagucaugaggugauuugauuuccuuuauagaaguuggauuuugaagauacaaugaaaauuuuugauaauguaguacaaaaaaagcaccagcaaccuaugagaagacugcuuuuuugugcacuacugaacugguuaaagccaaugugaucuucuguggugagcucuuaagaaacagguguuuuugauggagccuugguagaccuuuaacagcaguggugcuaacgagcacugcuguaaaaaagccaccauuauuuuuuaugaaacaucugaacauuuuaaaaaggcuuaugagggcauuauuuugagcaucuauuuugaggugauguuuuaaaauagcuaacaucaagucaaauuguaaauuaguugaaauauauugccuuaaggaccuacuaaagaaugugccaccaaacuuuugaguaauaguugaaauauccuugucaggggugggaaaucaauguugacuuaaacauuuucuuuuaauuuuuaauccaaccuuucucuuacacuuuuuuuuuaauuccacugaggagguuguaaauuaccuuccuuacugagaaguauugacuucaugguacacauucuaaagcauuucugauuucaauauuuuuguacauuuuuaucuauuauuaaacuucucuuguagugugcacuagucuuuauuucuacauaagcugcucagcucuaaggaaauuguaugaucauuuucaagauaauaaaucccugaaauuuuguuucaucguacccaugguagcuacaguacuuuuuuuuaauauuuaugaacaucguaaaucagugcauuugagguucuuaaauguguuuucaccuauaaauuuccuauggaauauuuuagaaaggcaaugacuauuuuagaaaggcaguggcuuaaaguuacaauucucuuuaccugcuaacucuugaagguuaguaaugugauuuauacaauuuccuucagugcaggagauuuuguuuguuaauucuuauguaaagauuagcaguuguucuuuaguauucucuuuguucuuauaauuuggacaugcugagauuaucucuuucaaguugagauuuaaauagaauauaaauuauuucauugcccuuuaaaugaguuaggacagaucaguacagcccuuuuuccauccugcccagguuuuugauuaaauacuggccaggguuuuaaaaccucacaagggagguacuuuauuucuaaccuucucaucgccauguccauuuucuguugagauauaagacauacuuuguggaaaagagcauucucuuagagaaaacguuauaugaucaaauugcuugcuugagauuaguuccuccuccccucccccacuccccccccccaguuguauguuauucaaaauaccuaacaacuugcaacagaaucuccuugaguuuaauuuucagggguccucauuuagcaauagucaagauugcuaaugagucccaguacuugacacggaggucagagauagucuuuaaaucaugcuuauuuuuggaaacaaaccaguaguauuucauaagagaaauuagaaucuguaaaauauguuuuaauuccaugaauaaugauuuuuaaaguacaacauuaaauuuuugauauauuugaauaaaaagcuauugauguuuuagcauguccucaaaauagauuucugugcuucuuauaauuucuucacaucuucagagucuuauaaaacaugaucaauuaaacuaucccugcaaugaaccuaugcaaaucagacacagcaaaagacauaaagugauucucuugacuaaaacaguuuuuuuguuguuguuuugguuuugguuuuuuggagauagggcuuuuguguagcagcagcugucuuggaacucuguaggccaacaggccccaaacucagagaucccccugccucugccucuuuucuuguaaauguuacugugaacagaucaauaucauaacagaaccaaauugauuuaaauagaaguuuuauaucaguguguugaauuuugacuuuagguaccuggaaauguaauauccuugcuauaaaacauguaaauccagucuacucuauugucuuguuuugauuauaccaucagacacauuguaguugcuagacguaguaugaaggcacaggugauggggcaguccuaaauuucugacucuuaaauccaguagaucauguuucuacaucuucaguuugacaaaggcagauguaucuuugaaugcuuguucuucuagaguuacuucuggaguuacucaaauagccaagcaguuaauauaaguuuauauauuucacuuaagacuaggagucuaaugcugauacuguguuguccucagcaucacuaauacugaucaaacuugcuaauauauucauaucaagcaaaaucaugaccucagauacuugacguucuuauuuucucuuaucacuaccauguugggaaaauuuguaagggaaguuaguauggccaauuuagcauguggauuaucugucagcuucacaaaugaauuuaaugugacagaagcauagauuuuucauuucagcuuguaaaacuucgucuuuuggauuuuucuuaagugggccugguguauagcuauaaaugaaaguauguaccugguauaaggcaguucauauagaucaguaaucgcaacuaaaaagucuaugcauuuuccuguaaacccuguguaguuugaggcuauagugcacuguuuucauucauuuauaugcuuaacuaagcauuugcugaaugcuacuuacugguuuuacuccaguguuuaaaguugacuaaguguucaguagacauuuugcauccagaagagaaaaauuagauuuauguauucugaucagauaauaccuagggaagaguuaugaagaaugcuuucauuugugcucauagaauuuuaacauaaaaugauguaaacuuaaauauaaacuuguaaaguuuuugaaacaagaaaacaaacuagauuaaguuaaauagauuuuccuuugggaaaauuuuuaauuuaacccaccuuucuccucuagguuaaauacacuuacuauauuuacaaaaagggaaaagaaaaaugaugcgcggugggagguuuuuuguuguuguuuuguuuuucauggaacuacaagggguuuauguuuucauuuuauguuucugcuaauaacauuugccacucuuaacaauucucuuuaucauccuguguguuuuaaguccucuguuuauucugaugacacauuuuguagucuugcaaaaucuucgggugggauuuaucuguuucauucacuagugugagagugugugugugugugugugguauauacauacauacaugucuugauuaggacucugacugcacuuaacagauauaaaaugucaauugacauauguagucauauauaucccaucauccauacaagagagcuuaaaagaggcaucauggcaauuaaagcaucccacugagaacugaugcuucauccauaaaguccacuuacaggaaagucuaguuacuguaacuuaggacaugccaaaaagcuuaaaaaggaaauucauaccugugagauaaaaaauauaaagggaugagucaugguaacacuguugcacuccaugucuuggggcuccuuucaauguaagaaugaaagauaacauacacuuuguugagcuguccuccauuuuagacccgacccccccccccccccguuuaaguuccuuaauaagaugcuauuccuaaaccugcuguaugugcucaacagcugcauuugagaaugaguggauucaguucaaggucaucgguggaaccagucuuugacagugaugacccuaguauaauuaauguuuacauuucaaagaaacaggcuaguccauaacgcugcucuucaaucugggcuauggagcagaucacauucaagcuaagccauuuuuugauacuaugcugugacuguuacuagaguaucuccugguuacugaaaucuuugguuuuugguccugacuacuaacauauuuggguagguguuaguguagucaucuugccuuccucuacaacuaaacaggauuuguucagaaagguaauuggcaaaagguuuaucuuuucuaugcaaucaccagauuuuuauuuguuuuuauauuugugugauguauggaaccucauagauacaacggaccuuuuguaaauagagcaauggcauauuuauuaaauaaguuggauuuguguc

SEQ ID NO: 819 - RNA, 27796 nt, Mus musculus
ggggaggggggacggaggaaguuucugcgucgagugcucugccggggaaacucuaccaacuucccccaggaaaggggacacggcggggacccagauucccggguucgggccaccgcaccccgucgggggguggggcaguggcguccagccccucgcccuaguuacguucgccccacaaaccugaggccaccaggggugggguggggguggggcgggggaagcggcacccggcguuagcggccuagugcgcgcgcgcgcgguugcccuggggagggggucgugccuuugggggugggggggagaaacucgagagcugcgcgcgcgcccggcauagugaagggcggaggcgcgaacuguaucuggcggggagcgguaaagacagagaucucucgcccgagggaggaagcgacuggcgguuaggaaggcgcggaacugcggucauggggcucgagaggugcgugcccacaggacccgaaaggguggaauaaaugagaguguugucgcggcgggccaugggcgcgcgcucccacggcgccuccggaagcggaguccccggguaacccgcucuugcacuccccuacgguucugcgcgcggugguuggguccgccgacggccgucucugauuggcuguagccggggcggggcguggcggugguggacagccgaccuucgcgggacucucagucuuucccgccaugucguucguggagaguuggagguuugcgggcgcgcggaggcgccgucagguuaccccaggcccugcgacucggcccggguauuccgacuacacucagggggacagcuggggugagggcgaaggcgacgaagacgagggaugcgaccaaguggcccgcgacuugcgggcagaguucucagccagggcgucgucggagaccaagagggccccgcuacucccccgggucggggacgggucuccgguccugccggauaagcgcaacggcaucuucccggccacugcggccaagcgaacccaggcucggcgguggcccauccaagcccuuuccauucucuguucgcugcuguucgccguccuccuugcuuuccuucucgccaucgccuacaugaucguuaaagguauugaagcccaggccuugaaaggcuguccagcguaaagugcagccaguacaucacacgcccccauucacacucuccucccaaagcguucccucgagacugcuaucgucccuuuugucuucucucccuagauggacguccuugcuccgucaugagacccauuuagaaaagaucuuuggcuaaaucuacagucuuuaaugccguaaaggcauugaacacuuugaguugaaacagcagagccccuuacuuuuaaaaggaucaaaaaaguacguguaagaaaguacugcuguacguccuaaggcugauguuaagagacaugcuggguuugcacuguucucugaaccuaggacaaggauccccacccccaccccaucccaaguuucuacuuuucucucucucucucucuuucuuucuuuuuuucuuuuuugagacaggguuucucuguauagaccuggcuguccuggaacucacuuuguagaccaaacuggcuggcuuucuuucuuucuuuuuuuuuuuuaauauucuuuuuuaaaaauuuuuauuagauauuuucuucauuuacauuuuaaaugcuauccugaaagcccccuauacuccccccccccccgcccucucgcccugccccccuacccacccacucccacuacuuggcccuggcauuccccuguacugggguauauaaaguuuacaagacuaaggggccucucuugccaaugauggccgacuaggccaucuuuugauacauaugcagcuagagucaagaacuccggggugcugguuaguucauauugcuguuccaccuauaggguugcaguucccauuagcuccuuggguacuuucucuagcuccuccauugggagcccugugauccauccaauagcugacugugagcauccacuacuguauuugccauggccuugauuucugaguucagaaacccgccugcuucugccucccaagugcugggauuaaagacacaucaccacggcuuggcuaaguuucuacuuuuauaggcaaaaaugguuuuucuauuuuucccuuguaaucagguagaguuauuucaggacaagccuauucuacugugucagaaauugacauauuguccaaauagcaaugcucagaaagacccucuucccccauuugaauuuguuguaugauuuaguauuuauuguaguagaaagagauuuuaauucaguuagugcugacuuugccaauucuugagaaauagaaacaugaaaacuauuuuguauuaaaaggauucaacacucauucuuguguugccuuuacuaauuaaaauuaaaucuccaguucaguuuugcuuuauuuccucccauucccuaaugggaugcagguggcccuucaacaguuuuuuuucccacuucagccaugauagauuuguuauucacguaguuuauuuuucuuuuguaacauaaagguauauacccaugaguagacguucauugcagaggacaguggcauuuuggagaauggagugaggaacugaagucaaauucuguuaugcccugaaguuucuuuuguacaaauuuucuucaacacauccaggagauaaacacuagucucguguuuauugcacuugacucuuguagagcuauuugcaugaagguaguaaaucagaaauuuaaccuagcucugacuuuaggguccuuuugacauugaacagugucuucaaaaugccuuuggauauucaugucaugaaggaacacuaacuacucuucuaccuaaaccucuuuguauuuacagaauugcaugcagaaaacuugaaaaaugaagaugauauacauacugggcuguuagguaugaacugaucauuuuauucauccaaucgcuuauuuuaguuuucccaaauuaagcuuaaguuauagaggcuuugggauaaauauuuuacauaugucauguguagcugguucuguaguguuauuuauauguuugugguaaauguuacuagauuuccuuuuuagguauacauuuagauaauuuucauaauuuuauaaugggccacuaaugcauguauacaguauucaacguaacuuugcaugacauugguccacuaguuccuugaaguaguuucuaauuguguuuuggaagaagcuccuuauacuacuucaggaauuuaaaacuagaaacuugcucacaaacuuagccaauauaaauaguauccgaaacagacuucagaagaauguccacauguauuuguacgcaguuugucuugagauacaaauuuuaaaauaagaauuauuugccauuaaugucuaguugagucaguuaaguuuccauuguccaaaauaucauacauuauguaguuuauagcuacugaagaggauuauugauggugucugucucucucguagauaauuuugaagaguuuagaauuuuaucuagugauauauuuuacuauuaaaauucagaaugaggaaaacagcuauuuuuacaacagaacuaacugccaagacagaacccucuaugagccucuaaucuaguggagaauaaaugcugucaguaucacuuagagacagcaugaccaugacagcuuuuauguaggaaaacauugaauugggggcaggcuuacaauucagaggauuuuuuaguucuuuaucaucacggcgggaagcauggcggcauacaggaaaauguggugcugagaguucuacaucugggucagcaggcagcuggaacagugaggcacuggccuggcuauagcaucugaaccucaaacccacuccuagugacacauuuccucuaacaaggacacaccuccuaauagugccacuaccuaugaggggagguggugggggggagcacuuucuuuuaaaccaccacauauacccuuuuucugugauaauguuuuaucauuuuguauuauuuacuagacaauuuauuacuagucuuuuggcauaaugcuauuagaucuguuacauuaauauuucaaugagauacauuuaaaguuuaucauaaaacugccucaauauuuugauaguagguugauuuuauuuuguagaaaaaaauaacaagagcacagaaaguacucaaccauaaaaaggguucucuuucuauagacauaaaaauuuugaccccugcaaauauuuuugaauacugauguagggcugggguaagucucaguaagguaggaauguagcuacguuaacauuucucauuuugacguggguaauuaucagucuggugacuugcuuuuauuuuguuuaagugcuuuuaaauuacgauucagcccaagguuggguccaaggauauuugcuuuuaugaguaguucuuaugcagguacucaaaggaccguggguugaaaaccacuuuuaaauacuugaacuaggugcuguguccgucauccaaaccaacacacacacacacacacacacacacacacacacacacacagacacacacacuuuucuuucuuucugagcucaguuuuuucagaaauguauucaaggucaggugugauuaaaacgccugggaaguaaggacuggaauguucagugguuaaaaagcacuggcugcucuugcacaggaccuggauuugguucccagcacccacaugguggcuuacaaccuuccguaacucuguuccagggcaccgaccacucuuuuccuuccaagggcacuaggcaugcacauggcuuauaauguguauucagauaaacaguaaaguaaaauaaaccugaaaaaaaauugaaagguaaauuguaacagguuaaaaagcaguguaagcucuaauacuuguuagaaaaucuuacuugaaaguugcuaaguuggcuuagucauucaucuuuguuuccaugaaaaaaauucuuaaugggaagccuguuuuuguuguuauuguuuccaguuugaguuuuguuguuguuguuggugguggugguaguuuuucuuuuuuuuuuuugguuuuucgagacaggguuucucuguguagcccuggcuguccuggaacucacuuuguagaccagacuggccuccaacucagaaauccgccugccucugccuccggaaugcugggauuuaaggcgugcgccaccacguccggcuuugucuuuguuuuuuaaagaaagguuuguuaugaagcguuggaagaucuuuugggggaguuguuuuguuuuguuuuuggaacaggguuucucuguucccuggccuuccuggaaugcucucuguagaccaggcugacuucaaacucagagaucagccugccucugucucccuagugcugagauuaaaggugaguguuugggagagauaauugaucugguuugaaucacgccuuuaaucccagaacucgggaggcaaaggcaggcggauuucugagagucagccuggucuacaaagugaguuucaggacagccagggcuacacagagaaacccugucucgaaacaccaaaaaaaaaaaaaaaaaaaaaaagacuaguacagaggucaucaggcaaagugauuguuacuaucuuugaaugguauuaaucgcgccgcagguuuuacagauguugggcucuucucucuuuuuuuuuuaaagauuuauuuauuauuauacauaaauacacuguaucugucuucacacacgucagaagagggcaucagaucucauuaugggugguugugagccaccauguaguugcuuggaguugaacucagcaccuucaaaagagcagucagugcucuuaccugcugagucaccucgccagcucaggcucuuuuaaaauucuugcaaaucaucccuuacuuugaacuuauuuuuccagggaaguuaauagaauuacuuauuaauaacacguuucacucauuccucuuuuaagauuguucugaggccagauugaucgugcuaagcacacaacauugaauuacuuaguuuugcacaauggcuuuugcauugguuguaguuuuccaaguucucucacauuugacaacucaguguugcaguaugcuuucggucuuuaguauuucccaggguauagaauaagccuuucguuuuagguaaaccugggaaaauacuuagagacguacauaaaaucaccuuuagcagaaaauacuucaucuaaaauauguagagcuaguauuuuauaugugugucacaguuuauacugauggaaagcuuuuagugacuuaggaagcuucuaguuugggucugauuuauauuccuuagacucagcuacuuggaaaggugaugguuucuuugagucuaggugcucgaggccagcaugugcaacauagaaagacuccuaguucagaauaaaauaaaucaacugaccuauguguguauguauauagacauauacauacacacaugcacacacacacuuacaaacacagcuuauaaacaugauugcgcaugugccagucauuccuuaacauuugguauuuaaauuccuuauaugggaaagaccagauuugguuuauuuuucagcaacaaguuguucuuauuuuugagcuacucauauaguuuguauaccuaacaagcuucuacgacuucgccuauguucagggaagaaauaaccgacaaauauugaguucagucuucagaaaugaaaucauugaaaauuuaaacuuucuuuuucagaggaauaaugauguuccuguccucaugacuuuauccuacaaaauuuuagaaauaccguuaaaaguuucaaagagaagccaaaguucuggaagugacccauagugaaauagauguuaagaaaagcucacuaaauucuuccuuaaguucaaaaauuauaaacucagaauuugguuuaaaguaugauuuuucugauuaaacccacagacuauuaaggaaaagcacaguuauuugaauuugugcuggguaaugcaaauauuuuaccaaaacacucacuaaaaauuugcuacccucugcuguaguaccaucuuugaaagauugaauagccucguuaaaaaguaaguagagaaaagagaaaacaaaagucaguagacuggaagaauguaacaaaaaugaguuuaucagggcuuugauuaugaauuguuuaauauuuguaucaaaugcaacaggaaugucaggaagaacaauacuuucagaagaacaaacuuuagccagacuccauaauacauacugggaggcagagacaggagacucagaaguucaaggcuauccuugaagcaguacgaaggccaacguggucuguaagacccuuucucaaaaaguaguuauaagaggaagaaaaagcacaauuuuaaauugacuuaaaauuauauguuccacaguauacuuuuuuaaaaaaaagucuuacauuaauauacuuaguaugccaaaaauauuaauacuuuuuaaaccauucauguccaucaguauauuaguucagaaaaugcauaaugacaccguuugcucugguauagugaaaaagcaggugcagagaacagagucagcagaguuggucauuaguaaguugagugauauaugcauaagaauucaucacacuucuuucucaacuuuuuaaugggaaaaguuuacagaaauacaauuccagauauugaucugaagaguaacugaaucuucaaacuaauuuauuuugaaagaugcacuaacaaugaauuugaguaggaaaucuacacucugcuugucuuugcauuagucguaaacacugaguuuacaacuaaugcaaagacaacuaaaccaguaaguuucacuucaugaauaagaugaaguuucaucauuguaucaacuaauaaauugaguucaagagaagauagauguauguauuuaguucaaaguucaaggucuguacuuuugaaaguaguucacacugaaaaucugaaacauaugucuguguaaugugcuguuugcgauguuauauuugcaauuuuuuuuuuuuuuuuuuuuguaauagugaaaaggcugaaaacuauguggugaggcuguuguaacuguguacugauaagaaaagcuuuccacauacacuacugcucugugaaagcaguaaaguaagaauuuuauuucugggugguacagagaacacuucaccugaguacucuguauguugcauuuccaggaucuguuggcuuuuagaaagaugcuagcaagcuuugaguuaacuagcuaugggcaugcauaaaucgcaggggaaaagaagacuuuauuuuaugugccuccaguuuuuuaucuuaauuaaauacuaaguuacaugaauucauaaauaguauuaaaauguuaccuaaggauucauuuuggagcuaucaugacaaaauuguuggaguuagguucuauggcuuuuagaugaguuuuguauuuacagaugugcuccggaagcucugagauggaagauccuggcugguuuuaggugaucggauauugaguuuuagauguuauuucccucuuuaccauuuuuagguaucuggaaauuuuaucauuucacuguaggugguaaucuugaaauuuuuuucuugauuagcauauuuauuuuagagacuauauaaauuacacuaaucuuggaguaaacuuacuaugcuuaccucuuuuuggagaugcucacuuaaacaacaaauaauacauauuugccaauacaaacguuuucaaauuauaguucacaaaauuuuguaauuucugcuguguucuuacuagguaacaugaagguugcauuucagccuuuaugauuguuggucccaggcuaggcuaagauccuagagccuggcacugccagaguuuugaaacugaggugcauuuugaggacauuugccgaagugaguuacuguugcaucuguuuuauauguccuuuuagauguaguacuuaaaccacaggaccauaugcuauuucuguacccuacuuagagguaucugcagaaugauccuugggccaucugccaagaugugcaaaaccacauuccugucuaguguaucucuucuucuggauggccuugucaagaagcccaauggugcucuuucauuuuaucacaaguucagugcaaacacaacaugcauuuauuccaaguagggacaucauucucuuguauuccacguaaacacuuccucuguaucccaaacagagcacuauuuuuucucuucuagaagcuuuaugauuucuauaccugauuaaaucuauguacuagcuuuguaauuuuacgaaauagaaccagagaaaaaguauuucuucugcuuugccacacacuuguguuguaaugaaaaaaggggugugguucaggaaaaaggagaacuaucgggucagucuuucaaaacacuuguacauuuucuuguuuaauuacuuugcuuuuuacaugucaccauuguugucucugcuacuaagcuccacaagauuuacaaacaaugcaaugcaguuucuuacuugucuugaccugcucugguucugaccugggcugguucaccccuucuuaggcaaccugguggucccugcuccugggaggucaccauauugauacuaaauuagugcggacaucugacucaacauaguacacuacagcucagaacuccuggacacaaacgaucauucuaucucagccucccuaguagcuaggaccagaggcauacacugccucacccaggccuuacugcauuuuuggguagcaagaaaauugcuaauucuucucauucuuuggugguuugucuuuccuucuggaauucugaaacaucucaugugaacuuuuuaguaagaguauauauugcuuauuaagaagcaaucagaauaugaugauacauacauuauaguacaacuuaccucaaccucuucugucaaaaaagaacuguuuuacuagagaaaucguuuuggaaccugcuuuuacuuucauauagcucucuggcccugaauucccaguaucuggaagaaugggccugaacuucggauacuucugcuuucaccucccuaaugcuagcuaggauuacuggcauccccaucacuguggaaggacccagugccuuguacaugcuacacaggcagucuuccaaauaaaccauauucccagcuguguuucuucccuuauuuuuugaauagauuauuaaauaaucacaugggccagguuggguggugcauagggaaacagagacagguggaugucugaguuuggagccaugaguuccaggauagccagagcuacaugguaagacccuguucaacccccucccccaauucacauggguaaacauuuuaaauucuucuuaauaggcuucuccuguuuaccauuucuucuuccuacagaggauuagugguaaauucucaaucuucucugggauuuuuuuaucagcauccuaaguaaauauacuuuuacccauauauagcacauauacauauaucucuguauuggauuauaauuguaagcaaguuccuauguaagucacgugaaggcugacuucagguuccugaucuuacuuucucggucuccaaaguccugacauuaccagucuauaucaccaggccauuuuguaacuuguucauugauuuuuuuuuuuuuuuuuuuuuuaaacagugagauuagccgggugguggcacacgccuuuaaucccagcauuugggaggcagaggcagguggauuucugaguucaaggccaucuuggucuacaaaguggcaguucagaugaucugagacccucuucugaccuuuccaggcacccagcacacauaugguagacauaaauauaugucgguaaaaguuucauacacgugaaauuaaagaaaauaaguuguaagaaauaaaacuacuccuacuaaagagaauuagauuaccagcaguucacuaucccuuuaacagagugaguugaguggugucuaaaaaucuucagauuagacauaaaauuguuuaccuuuaaaaauaaacccuucagauccguuuauuccuguguccugucacuguaucuuucuucugcuucaacuugaauucacuguaauaccaugacuuugauuugauuccugugagaaaaaauguuauaaauuaaccaauuuauauucccaagaccuugguaggcuggaguucaacuuuaguuuauauacugagcaagaauauuuuaauaggaaaauuauaaagaagaaauacuccacaauugguugauauaccaaaaguguuuguuuuggaauggaagaaagcauuggguaccaagcaguagcaaaugccagcuauugcucaugaaauaacugcaaacuagaagcaugcuaaugcugagaguaaauuguuuugacuauuuucauuguaggugaauguuauagaaucaaauuucuuauauuuuuagguagaauuugucuuuguuuacacacaauaauuuuguuaaaauauuuaaugauaccaccucuaacuguguucuaguaauuuguacauuaaauggguuaacauguauuaagcucaaaucuuuuaggaaauuuacgucagcaucuggacaugaagauccugguuuaaauuauuuuaauaauuuuucccuuuuuucccuuaaaggcuucuggucucugcugauaauaucucuaacugcuggauuguccuguugcagcuuuucuuggacagugacuuacuuugauucauuugaaccaggaauguuuccacccacuccucuuucaccugcuagguucaaguaaguguuucuagguuuauuuuguuuguuugagguguguguguguguguguguguguguguguguguguguuguguaugugugcacauuauuguacauuaaugucaguucuguuaaagacacuaaaguuaugagaagcauaacugggauauguugaagcucuagauuucaguauauaagacaaaccaacacaagauuuuuuucaagugucuaggccucaaccuucaaguaauuggagaaugauauuuccuaucuuguuuccuaucuuguuaauguaauuuuuaaaaauugaaaaucacauaucaaagaagaaaauuucaugacuucuuuuuagguguaagaguuuacaaagucaaaaugcaaaguuugaaaaguuuuugucagguguguggccagauucaacaacaauuauuucucaaauuagacuuuuuucaggauuugaaccucauguuuuaauuaacuugcauauuuggugcccaguguagcgauccagacuagaguugauguguuuuuguaguggaauuucuuugcacuguauuuucuuguguuucgaagaguaucagaaacucaguagccaauggucuagugcuugagagacuucugacuuaaauaguauuugcaaaaaacuucagagauuucuaguuuucuacaaauggaauugggagggagaaugaagaugugaaaauuaauuucaguuaaauuuaugugaguuaugacaguuguuacuauuguuauuaccaacucuaccucuuaagcaaaaugucuguuucuaccucuuaagcaaaaugucuguuucagggccucuguaaaggggaagccauaauagugauaacuaucaguauuacuauaauacuaacauaguuguuguuauuacuuucauuauuaguaaacuucauauauuuuccucccucaaaauaugugcuuaaaaauuuuguuuuuacuugaaacaaaaugugaaaauacauauuuuauaaaaaaaaguauuuaccuugucgcauguuuuaaauguuucacaaauacucguguguaucugaaauguaaauucuaugccuauggaucuguguuugaaguugauaaauacuuaauucacaauuaaauauaagaaaaguuauacuggaauaccauacuauauggauaacuuggguagcauucauucagaaaguuuauuuggcaaagacauaacagaguucuaauuuauacuguuuugcuaccuauuaacacccaguaccuuuaauagagauuguaaaucuuaugugauauacuuaauuuucuauuauuuuuauuugacaucgucccugaaugcuagcuguucaggcaacuagaguuuugaagguuaaagaauuuuaguguucuccuaaagaucgguuaacuaauuguacuaaguuuuaauaaauuaaucuuuuuauuaaauuguaaguagaaauaaagaaccucuauugucagauguuuaguagccauuaaaaucagauagugcugcaucacauacucugugugcuuggucaucuagucuuuagaagucuuaaagcacuuauaaaauauauuuuaguauacuguguuuguguuaauuuuuacaaguaaauauaaaauaccaaauuauuuuauguuuauucauacggaauuuaaguauacacauaaacacacagugauauucaguuugaaaaugcaaacauugcccucuaguguucaugaaaauaaacaauuacuucauaaagaucuuacgaauauuuucucuguguagccaguagagugaguccuugcacaggaaaauagacuuuuucuugugaaaauguuauaaucuuuagacuauuuacuuagaaaucagauagaaauguaauguuuuaauaaaaauaacuuuauaauauaucauguuaucuuacuaccuaaaauuagguuaauauaagcauguuucuugauuguuuaaaaauauuucugauucuuuguuaagguguccuugcaauguagcucaguugcuggagugcuugguucauaugcauguggcccuggguuuccucccuggcacuguacagugugcaguuaguuguccguguguugugucauccuugcuaguucaaggccauccuuggacugcauagcaagcuugaagccagucugggauauaugaggccuugucucaaaaagagaaaaauaggacuguggcauguguguguguguuuuuuaagacaguggaaauaacaaaucgggaaagcuacugccaacauuuuaauguauguuuuuuccauucuuuuguucuuuaugauuguuuuagaaauaggaguugggaucaccauguguauacuauuuuucaugauagccaguuuauaaauguaauugguuuauuuaaacagucuuguuagucuauagacuaaaacauggguuuuaauaaaagaauaauuucaagggaagaaaaucaaagcuauuaucuuuuuaaauuauuauuuauuuuuuuacuuauucacuuuaugaaucacauuuuacugaaacaaaauucucaaugaaauuaaaaaguaacauuucuugcuauuuaguaaauaugagguaaaccauuuagugaaauuagcuaauaacuaguguauugaauaacuaguuuagauugauacuaaaaaugaaaugcuuuucuuguuacuuauuuauauuuaacaaauuuuuauuacauuuuauucaucuguauuuaugugcugcuauugcugcauguacauaugccauagcacaaccugucaaggucaguugaaggagucaguucucaccuuccacuauguggguucaauccaccauuugggauugaagucaguuuuuccaagcuuacccauuaaacugagauagcuucagaucacauacuuuguuuacuugcugagcaaucuugccuuccaccgguguaucauuuuaauuuaguuaaguuuauaagugcacggaaccgucuuccugucaaaguucauuuaguaccuuuuugaaaauguaccuuucuuuguuuuuauucccaaagucuuauguaaaagugaaaacuuuccuuuauuagauuuauaaaauaauuauauggagaacuuugucuuagcuacuuggaauuugcauuguuaaauuacaaagcagaaguuuagauuuugagaaguauccauagcauuccauaguuguuauuagguuauaauuuaguauaacaaucuuguauaauuuacuguuuucccccacaaugucacaugaucaucuccaacuuguuucccucauucauugggucuuaggagugaguuccaaacaagcacauaaauugcauguauagucauuacuuaauauugcggcaucuaucuauauauaaaauuacuguauacaaggaaaacccagacuguuaaguuaucuugcggcuuguuccaggauaggcuaguggcagaaccagauaucuuauuuaaaucuuugugauugaagaaguuagguagaauaucuaccuugacguugaauucuuccuaaaaguacaauuuuuaaacuaguacuuuaauacuagagaugucuuagagacuccaaauaaaguucauagggaaaagagccaagucucuaagccaccuguaauguuauuauuaguguuguuccauuuuauaacaugaagaaaacaagccccaagaacugaagcaacuuguacauucagauguaacaugcaucaucuauuuuuccuuugcuucauuaacucacugacuucuauauuauaaaauaaaguaauaguuuuacuaauuguuuuucuguugacaucuaacuuuaagcuuuuauaauaaugucaguuuuaccucugcaguguugcuaaauaagaguaacaacuuuguuuuuaacaucuguucucauauucauuguuuucuccaaaucagugacacuuuuuccuuaaacccaacauauuuuacauuaccuuuguauaggcaccaucuagugguaaauggucuaacuguaagcuugcaguuacucuaugugcuagauauaaaaccauuuaacuuugaaaauccuaucuauaauaaaaauauuacuugagacuuauaauaaauuuaguagaaaauugaaaaccuuguuacuaacuugaagaaaauguccauuguuuaggucagaagucaaauuuaacaguuuauuccccuuacauacuuuguagaauuauaaaaccaaaauaacguaggcauuucugguuuauugguuauacauauuacaccuaauacuugcauuuaaaguuaauuuauauaaucuaaacauuacaaaaugucaagcacucuuacauaggacugguggacuucuuaauuagcucaagcucagaucauugugaagggaguuacaaguucugcuaagcaaucuuucuuaacuuuucugccaggcauugagccucaggccuuucacugcaguugagcuauauuccuagcccucaggaaguauucucugucagaaagauagacuguucuuuuauauagugaauguacauccagacuuauuuccaaggagaaaaaaguuugcuuauaauuacaagaaugggugaacucuuuuauggaauucaaguguacuagacauuucugaauuucagguuuuaagcugauaaaaggguaugugaagagaaguacaucuuucaguagaaaggugacucagcagguaaagguguuuccugccagccugguggccugagauugauccucuggaaggagaaaaucccucacaggcuguccucuaccuugacuuuuauaccaugucaugcauuucuucccccaaguaaauguaacuuuaaaauuuuacgauuuugauauaucauauauuugaaucuaaagcuuagauuguugaauaacuuacuaagaaauugauuuuauaugaaauauuuccuaaguaauacuaaagaagugacaugcugugguguggagacuacuucagcucuuggaaauaaaucuuuagccaccuucucuaguaacagcucagcaugaaucucacaacgaaaaaugagccuauuugacaaugcuuacuugcuuuaugaagaauuauuuaggguucacaagacuaaggcaggaguccugccaucguucaaagcuaguuuggguuacauaacaaauuugaagggagccuggaacuagagauccuaauaucucuuccuugugcaguuuaauagccuuaacucuuuguuugcaauaugaaaauuuauuaaaaggcagagacuucaaauguuccuagguuacuuuuuuaaguccgugcuuaugucauccuucaaaucuugaagccauuugaaguuacucagccaagaaaagguauuguaacuugacucagaguauuuaugccucagaugcaucuuaaauuuauuucccagaaugaggcaaaucggaacacauacacucacuuuauagaaaucagcauaaauccaggccuauauuuuuagaaauuuggugcuuuucagguguauuacugguugcuuuauugcuuauuuuugguaugacauuaauagucaaaacaaaccuuacaguuaucagauuaacaauuucuaaaacugauaagguuagagaaugauaugaucuucccacaaaccuguuuuaaagaacagucuacagaauuagauggccaaucuguaguauuucaguuuugagauacaaacgagugaguagaauagcugcugauuuucuaacauuguugccuuuguucuuuuuucuuucuuucuuucuuuuuuuggucuaaauaauuggguuauucaccuuucuguugcacugucaaccacagauauuugauacauaccuuaguuucagaaaguacauuuuaaauuuuauuaaaguuagcauuaugcaugccucauacuuuuaaaugcaccacauuaggugccauuuagaaucugcauaaguuucaaaacaacaagguuuuuaaaaauugcuuuauuaacuuauuuugauaagucuuuuugucuuaggguuuuacugcugugaacagacaccaugaccaaggcaagucuuauaaaaaaaacaacauuuaauuggggcuggcuuacagguucagagguucaguccauuaucaugauggugggagcguggcaguauccaggcaggcauggcgcaggaggagcugagaguucuaugucuucauccaaaggcugcuagugaaagacugacuuccaggcaacuagggugaggaucuuaugcccacacccacagugacacacccauuccaaccaggucacaccuauuccaacaaagccacaccuccagauggugccacucccagguccaaggauauacaaaccaucacacuuuuauuaaaaugugccacuuuuacaugcuuuacuucuucuggaaagcauucuauguauaaguagaugcugaggcaguuagauuuccaugggauuuuugggugcauguuguuuuaacuauuguuauugggagcaacagaaagcguagaauauugaauauaaauuuucuagagaauuguagauuuuaggguuggcauacuaugcuagaguacuuuuuuauauacccuugaggcuuuguuuugaauguguuacuaggguuauucuguagcuucucagugcucuucacauuguaguuaagaaagucauaaugaguaaugaaacauuauaggaaaacguuguggguuaucuuaggcaguaauauaaacguuguagauuaacaaaaguggaugauuuaguauuuaaauuagaaauuucucuuccaagcacacuagauguaacauugaucacaaugaauuaacucuaccuucuuucauacaacugcuagaaagcugcuuccuuguugaaucagacuuguuauuaucaugaacuaauggaacagauggcuaauugcaguaggagaaaaaaaaccuacuaacaaaagaaauagaucauggacuuagcuuugauaucugaaugucaugaaguuucauuaacuugggacuguuuggagccgucacuugcaaugcauauauuaacaacuauauuggugguagcauaauguggcuucuggaagaggcacaugcauuuauuaugaaauauauucuauuacucuugcauggagauauguguagaugaaauaaaauccuuuaagaaauuauguuaacauuuauuuuuagcuuccuuguuucauaacauaaucuagcugauugauuugcacuugugugcuguuguacuuggugugcuguuaauauguuacuugugaguuuuaaaaagccugggcagcacugagaauacugaaccacuuuuuauguguuaaguaacugccuuaguuaggguuucuauugcuaugaagagacaccaugaccacugcaacucuagaaagaaaagcauuuaauuggggcugguguacaguuucagagauaguucauuaucuuccuggugugaagcagugaagcauacaguagacauggugcuggagagguagcugagaguuacacaucuagauccuuuggcaacagaaagugacaccgggccuuguugggauguuugaaacaucaaagcucacugccacuacuaacaaggccacaccuacuccuccaacaaggccacuccuucaauaaugucuaugagaaccauuuuuauuuacauuaccacaauguuuauaaauuauaggaaacaaccuauuauauuagaaaguguuuugaagucaaggaggugcuuuuaaauccagcuuaugcuauauacucuagaugaauucuugaucaacucagucagcaauuaauauaaguuacugguuaaaucaacaguugagggcuaaggagauugcccagcauugaagacugcuugcugcuuuuucaaaggaucagggguccauucccagcacucagaucugguagcucacaacuaccuguaacuccagcuccaggggaugccauugugucuagcaaauuauauagucuuaaggauaaggcagauuucuuuaaauuacauauuaacaagcaauaauugacacuuugugguauagcuguuaacaccugaauauuugugcuuuaaugacuagagcacuaggaggucagcuaagggcuauauagacuagaagaagcaggaaaacuuagaauagguuuagaacuguguuacacacauguuuuuacauacuuuucuccuuuuuagauuguaauacuauaaagguuuccuuccucgccaaucugggaaauauuuuucaggcuaaguuacagaguaggggauauauaaguuaguggugaggaaaauaaugggaauuuaagaaucagaaaggcaaaggaaaugcacccagguuugccauaacuguuaugacugauaagaaaaaucauaauccuucuaucaagucucugugaacaaaaagaagguaugugaagugcccguccuauaaaauuacaaagcuuuagaucgggcaaaagaaauguauugcuagaaauuaccuucaauauaaaauccaggugggaauaauaugcucauaguauauucuacauguuucauuugugugugaccacacauaccaugguauguaauuguagguucagagacaacuuggaggaauccauuuucuuccuucuucauguaggacugugaauugaauucaaauugucacguuugguggcaauccguaucauuagcucuccuagugaauuuuaaugagaacagugaucucgaauaagugagauaagaaaaauacaaaguaaaaucacauauguuuuauagccagugaugguauuguagucugccuccuagguuuauuuguaaauuuuauagaugacuugguuuaagauaucguguuugcuuaaaaggaagaaagaaguguagaguggcaaauaagcuuucuuuuucaugcucuuacacgcguucacgaccggccaggaagaacgcagcaaaccggaaucuucugaggcaaaacuuuauugcuuacaucuucaggagccagagagcaagagcaagagcucuauugcuuacaucuuuaggagccagagcgcaagagagcaagagcucuauugcuuacaucuuuagaagccagagcgcaauagagcaagagagcuagagugcaagagugagaauggcgaaaccccgucccuuuuaaggagaauuauccuccgccuaggacgugucacucccuuauuggcugcagcccaucggccgaguugucgucauggggaaggcagagcacaugggguggagaacuacccuuggcacaugcgcagauuauuuguuuaccacuuagaacacaggaugucagcgccaucuuguaacggcuaaugugagggcggcuccccacauucaugcuguauagcuaacauuuauuugcugugcaauagauauguaguacucacagcaacuuuuuaagggugaauuuguugucaguuuuauagaggaauuugaaggccaaagagaucagacaauuuaucuuuauaccucuguaagagguacucaaacccaugucugacucuagaguuugacucaaaccacuggugagaaccacaugagcacuucauugugugugucuguauuguugcaaaggauuucuuuggcacuaaacuaagguaguuucuuuuguacaacaucuucuaacauggaaguuguccuguuauaaucauccuuucuuuguaacuguuuucagucauuuuauucucauugaacagcauuucccauuuuuuuuccaucuuauuucagaaauguagugggaaauauauuuaagccugauagaauccacauuuaggguucuaagucgagaaaccauuugcuucugcccauaaaugauaucugucuauuuagucuuauuauaugauuaaaugaacaaucaaaguuuuuaaacuaguaaauuaacuuacucauuaauuuuuauuuuauuauuggauuuccuggauuggcucuuugggaauaaaauauguguuuaaaucccuauaacauuguucuacuuuaaguauagauaauauuguuaaguaaccuuuuaagugguagaaaaaacccuaugcacaaguauguaauuucuuucaaguauuuucuuauucuuucugcuugaaauaguauuagaauuuuacaauuacaaaggauccuaaauuaauacccugccuucuguuuguuaacuagucuuauuaaaacacuuucuucuuuuuuuuuuuuuuuuuucccgagacaggguuucucuauauagcccuggcuguccuggaacucacuuuguagaccaggcuggccucaaacucagaaauccaccugccucugccucccgagugcugguuaaggcaugcaccaccacgcccggcauuaaaacacuuucuaauaaauuuuuuucauugaucuuuuccuuucuccucuugaaacaaauuccuuauccuccccuguucccugccacccaaauuuauagcacccuuucuaaagaaaaaaacgcaauaaaaaaaguacaggcaaaguccauuuguguuggccucacuacggggucuguccuguugugugguuguuacacccacugucuuaguuacuuuucuacugcugugaugaaacaccaugaccaagucugaaguuaacuaaguccaagaugguggguucacauuuaaguuucuuuucuuagaucacuugaagugggaagugccacuuguaauaugggccauaccuucuucugguauaaaggaaagacacuugcucccuuuucgcuuguuagcucuugcucuccccugcaaauuauuucuucacuaguauuagagcuuccuucuuugggauuauagcauauacugaagacuagcugagacaugcaugcuuguggacucaacaacuacuggauuuuuggaccuguucuuggcagauagucauuguuggacuagcuggaccacaaucuaaaccauguuaagaaauccucuguguguguguguguguguguuauaauaauauguauauauucauucuauauguucuguuucucuagagaacccuaacuaauacaagaguaaaggaggguuuuuugcuuacauauugugaaucacaaucacagucuguggagggaagccaaggcaggacucagcaggaacuggaagcagaagcagauauaaaggccaugaaagagugcuacuuacuagcuugcuccucugggcuaccuuauagaacccaggaccaccaguguagggguggcaccacccacgucaaccacuaauuaaaaaaugcccuacaggcuuacauauagccugaucuuaugaaggcauuuccaucaucucaggugacucugccuugugucaaguucacauaaaacuagccaguacacauacccaguaacaguauuggagaaaacugauuuuccuuugccagcaguaucaguuuaucuuuuuaguuaaggguuguccacuuucccuucuuagcagugagauuuugugugguuugaacuugugcaguucuguguguacuuucagucucuuugaguucauguuuaucaguccuguugugucuauaugaaagauguuguuuccguagaguuauccaucaccucucgcuauuaaaaacuuucugccuucucuuccauguagaucucugagcuuugaggguuuugauaaagacaacccacucaaggauguguacucaagucucauucucugcacaucguuuaguugugagugucucuguuaguucccagcuauuacaaguagagacuucucugaugaugguugagggauacucugaucuauggguauugcaguauauuuucaggagucauuuuauuguuaagauccuuuaacagaauaauaguaguagguuuucccuaggcucaugacuuacuauucucagauucuuggccacuuuggcaguauagagugagguuuuacaggccuguggagucacaaagaccaggagacagucuagaaagaaagucuacaaagggauaaaaugaaaucuugagaguucuacuucugguucuguacauacaccauacugcuucuuuuuuauuguaaaccuugccgugucucuuaaauuuaagaaaucaaaacuuguauuggggcuggagagauggcucagugguuaaaaagcaccaacugcucuucugaagguccugaguucaaaucucagcaaccacaugguggcucacaaccaucuguaagagaucugacacccucuucuggugcaucugaagacagcuacaguguacuuagauauaauaauaaauaaaccuuuuauuaaaaaaaaaacuuguauuguuaaggaaaccugacauuauucacaauauuucuuuuuugguuuuucgagauaggguuucucuguauagccauggcuguccuggaacucacucuguagaccaggcuggccuugaacucagaaaucugccugccucugccucccaagugcugggauuaaaggugugagccaccacgcccaccugcucuuuuucuuuuaauuuucuauuugguacucaagcaguuuuagagguagggauauagcuuaguucuuguagugauugcuuaccauuuauggggccuugaguuugaauaccagcacugacugcauaaauuggguguggugguacacucuggagguagagauagaagaaucagaaguuuauguuucuacaguaggcuagaacucagguaggagagugucauccucuuuccugucuucuuuugcaaucucuucagacuuaacauuaguccugcugcauccugccuggaccccuccuccccaagccuaucuccacuccuuugcuacucacaucuuagugaaaauccaggauccuccuaguuuaguucccucugguagccccuuucagccucuccuuguagccugccuccauuccuuuguaacuuacuccagaccuguagcucuguaccaggaagccacagccagcugccacacuuggccuucuggcaauauuugaggacaaccuucauuucuuuuucuuuuuacauuuauuguuuguuugcuuauaugcuaguuuggcuaucaggucagggaacaacuuggauucugugaaucaaacucuguucaucaaacuucaugacaggcacuuuuaccugucacauguguggcagucagaauguaccuuuugugagucuccugccauggguuccaaguauuaaacucagauguuagacauauauacugcugagcuaucuugccguccccuuuuuaagaauaugccauucugcuacaauaagcaaaaaacuuaucauuacaauguaguuaauggaauacuuagaaaaguacaagcaaaaaacucuuuugguuuuucgagacaggguuucucuguguagcccuggcuguccuagaacucacucuguagaccaggcuggccuggaacucagaaauccaccugccucugccucccaagugcugggauuaaaggcaugcgccaccacugcccagccugcaaaaaacuuauaagaagcaagugucaggaaaaauuacauguacauaaauuuugugaaguaguugaaacucaguaaucauaaauuagagauguuucuuugcugucauuuagaaacuuguuggaagcuacuacaguuaaauagucauauuaagaugaaagcugacauuuguguucaaguuuaacucguucacauaagcucaaaggaauagcuucuuucuauaaccgaaaaaaaaaauuauaugaccaggauaaauacuggagaaacaucuauuuaagcuagcgcuaaauaagaaugagggcagggaagugcuauuaguagaagacuugcuuguaauguaacaaauuugcugaugcuacacacacaaucgacuuuguacuaauaaaauuaaaaauacauuuuuauccaggaaaucaggacuuucuuguuagcuuauuuuuaagauuguaauguguguuuguguaugugcuguguuugccauuugugccuuuguucagaugccuauggauguccuggagcugguauuauaggcaauaaugagccacccaguuugggugcugggcaguccacuggaggagcaggaagcucuuuuaaccacugacccaccuuuucagucccuacgaagacuuuuaaaagagaauuuaagauggauaauccuguacaaauccugcaaguguccaguauuuuuuaacuuauacacuaauguauaaaacaggacaacuagccaggcaaugguggugcacaccuuuagucccagcacuugggaggcagaggcagguggauuucuguuugaggccagccuggucuacccaggacagccagggcuacacagagaaacacugucuggggggggugggggggggaggugggggggggauaugacaacucauugugauaucuuaaguauuuuaguauuuacuaguuuuauuuuagaucuuacucguuuucucauaccaaauuacauguucuuuuuuucccuuuucuuaauuugugcucuuucccuuuuucacuaggaaacugacuggacauucuuuccacaugggcuacagcauggcaauuuugaaugguauugucgcugcucucacuguggcauggugccucauguaaaccuacacuagagcaacguuguuggugaaagucaugaugguuuuugaaguagcagaaacgaaauugcugacucagaagacuuugaaaugugaucagauacuuacuaucaucauuauggaagaccuuauagagggcacuucuucaauguauaagauguuuacuucaucuuuuuacuuuuguuuauguaguuuaucaguuacagaaaauauuugaauugaaaucaaacuuggaaacuugaauacaugacauugccuaccuuucuauguauauuccauuuuuuacuaacagauacugauauuugugguugagguagaaauauuuauauacuauauuaggaaaacaguacugaggccaaguguguuagcaagaccuucaagcccagcauuuuggagacagaagcagguucuguggguuugaggcuagccuguagcugcacaaugagaucauuucauaaaaaagaaaacaauuccuauucuuugacauuuuguagaagcuacauaaaucagaguuuuugauaaucaguagaaugcauaugugcauuuauauuuuuguggaguguaccugggugucuuauagauuuuuauaauacugcauuuguguuuuaaaugauuacauuuauaccuauauggcuguaaauuuuauuucuuagcugguguagaccuguccuuuaguauuuugucucuucaaaaagaauuaaaguacauugacuugaguuuaagauuaaguaaauauauuuuuuaacaaaaacauacuacaaauucaggguaaacuauuuguuguuauaauguuaagaaauuugagacuuuuagccauuucuauuuucuacaauugaaaguauuuauuuugauguauauauuaggguagcaaacuuguacuauuucauuuuuaguaaaugaaaaccuaaaaauuuuguauguagaaauguuugaacuuguuuauuuuuaaucucgaguauuuaguugccaaaguagaaaagguauuuugauacucuguauguguacauauaauuuaacuguaauauguauguuguaauauauuauagauacuguacuugucauaucaaggguucuuguuguuauuaauuaagcuuuaaauguuucucugucuugcuugcuauuuaaguauguagaaagucaccucaaucuuagaaaguugugugguuuacacagcuguuuguccuggcuguaggaaaauuuagauuaggaaaacauuguguagucaguguguauucuagcuaaguggcaagugaguguguguguguguguguguguguguguguuacaucugcaguccuacuguuguuacuacacaaggguucuaaaagucucaacauuuucucuauauucuccaaaaaaggucauuuccauuuaauuggaaauggcuaauaauguuccaauuaaagugagugaugaagagggacauagauagauagauucuuacuaaaugccagucucaugacuuaauagcccuacuaauuaugcuuuuuaaaaugauuguucuuguuguuuauuggauuuuucauacaauauauuuugacuuuauucuuuuuacacgauucccuacccccaacucuuucuauaucaucuccuuucccuccaccucccacccauccaacuucauguucuaucuuucagggggaaaaagaaaucuguguauuugaauuaguguuuuuuuuuuaauucucaggcaucuuacauucuuucuucuaccuuucccuuaaaggacucuuuauuacaaagauauguucaaauuauaaaauuauuuuaucuccucucuaccuguguaaagccccauucccauuaucaccccaauuaaaauggcuccuuccacuucu

SEQ ID NO: 820 - RNA, 2517 nt, Mus musculus
guuuuuuuuuuuuuuuuuuuucaauauuaaaauaauuuauuuuuaauuuucaauaaauucuugcaacauagucauauccccaaugauaaaucaacuguucagaguuagcaagaaauuagguuuauaaaauuuuuauaagaaaaaauguauccauuaugcagcacuuaagaauaaagcugucuaaagagcucaaaugugacacaccuguggcaaguuuuaaaagaacaucaaucaaaacacaguaucaauauaugccuauucuauaaccucaaaaucuuaauauaugccuauucugggacaucagucuagucacuguauguuuccucagcccuacuccuucccacuuccaccucuaaaauaagcccugaucauagaacagcgagcccguuacgggacucuugauuaucacccauucaaauucugguuguugcuggccaugugguacacuccuuuaaucccaguaccugggagucagaggaagguggaucucuggguuuugaggcuagccuagucuacaaauugaguucuagaauagccagagcuacacagagaaagaaacacgcccccacucuucccuagauuuucuuuuguuguuguugucuuaaaaaggggugcuaaugcuacuaaauuaucuaacucaagccagacccccuacaacaagaggauccagggccagccaugguagagucaaagguuuucucaacuuuuuaaaguagaacucacucacacauuaugacuaaccaucuuuuucacuaggacuauaaacagauuuugcugaauagcuaaucaguuaccauuacuaccaaaaguaacaguuaccuuuaaguaguaaaauaauaauuucaggaugguuaaagcacaaaaucaagugagaaugacaaaaauuaguauacagaacuggccuuuuaaaucugugggccaaacauccaagggcucaagcaacugucuauuaauauuugaucugugccgcacaugcagacgucuccuuaucauaaagcauaguacaacuaucauuuacaggagcauuuacgcuggguugagugucauggccacgccagagacgaggugaaguguagucaguaauaugcaaauacgauaccuucuaucgacuugagcauccaguauugguuauacaggguuccugagauuaaucauccugucugaagaccgagagagagagagagagagagagagagagagagagagagagagagagagagagagagcgccauauacuucccucugaaccugcucugccuguugcugcuguuguuacaauuaucuuuaggguuagggacucaacaacccaugacaucaugccugcaaggcaaucaugguacacugagcugucuccugagcccugcccauuuaaccucuuagugcuguuucaaagcagcugcucaauuuucugauguaugauaaaaaucuaaagauauaaacaacacuugacaauuagcaaagaguucugaaagugucuaucaaauguaaacuaugaguucuaguuacuuccucaaucuugucauagccagguauuuggacaggcuaaauuaaguuuuacuuauggcauaauuuugcaauaaccucaccuaaauaucuuuuacagacaucagugcauauauaugggauauaugauauaaaacuguaagcuaguugaguuuuucuuuucucaaaacaaauucugguuguaaaauaccuauguaucauauaagagggcccaauuuaaaaccaaaccaaaccauucuuaccagguagaaaauuuuucaaaucauuuacacauucacaaucuauguauuuucucauggucaacaaauggacucaaaugguuuaaguuaucccaccauuugaagaggaaaguaucugcaauuaucuuaaaccacggaguuaacuuaauuucaccacuggcugccuucuucaaaauuucucugacuucuuccuuugauacauagcaauagcuuuuaaucucguugggaucuggauucaagguuacauucuuccucagaaacagaauguaaucaacuucauguucaccccagauaccaucagauugggccuuguaguaaauucuuguuagauaauccauuucauuuagaucaaccucuuccaaggguauucccaacucggcuuucaagcgccgcuuugcugcucgcuucacaccaauggcguuguucucuuccagcucgccuggguuacuuaauggaugacuacagcaacuauuggugaaacaaccuggaaagguaauuuuagcaucugaucucugcuguaacaggagcuuauuuucaguauuaaacaagaagacacuaaaagcucgauguaauaauccuuugucgauguuuucauuaaggugacaguuuuucuuggugucagccccaauuuuauugucauuuucaucaauaagaauacacaucuccgcuagaagcugaaccuguuuuucaucaagauggcugguauuuauuucaggcauugugacagaaugucugaucugaccuagaacacagagauuccggcugcaggugcucg

SEQ ID NO: 821 - RNA, 2517 nt, Mus musculus
cgagcaccugcagccggaaucucuguguucuaggucagaucagacauucugucacaaugccugaaauaaauaccagccaucuugaugaaaaacagguucagcuucuagcggagauguguauucuuauugaugaaaaugacaauaaaauuggggcugacaccaagaaaaacugucaccuuaaugaaaacaucgacaaaggauuauuacaucgagcuuuuagugucuucuuguuuaauacugaaaauaagcuccuguuacagcagagaucagaugcuaaaauuaccuuuccagguuguuucaccaauaguugcuguagucauccauuaaguaacccaggcgagcuggaagagaacaacgccauuggugugaagcgagcagcaaagcggcgcuugaaagccgaguugggaauacccuuggaagagguugaucuaaaugaaauggauuaucuaacaagaauuuacuacaaggcccaaucugaugguaucuggggugaacaugaaguugauuacauucuguuucugaggaagaauguaaccuugaauccagaucccaacgagauuaaaagcuauugcuauguaucaaaggaagaagucagagaaauuuugaagaaggcagccaguggugaaauuaaguuaacuccgugguuuaagauaauugcagauacuuuccucuucaaauggugggauaacuuaaaccauuugaguccauuuguugaccaugagaaaauacauagauugugaauguguaaaugauuugaaaaauuuucuaccugguaagaaugguuugguuugguuuuaaauugggcccucuuauaugauacauagguauuuuacaaccagaauuuguuuugagaaaagaaaaacucaacuagcuuacaguuuuauaucauauaucccauauauaugcacugaugucuguaaaagauauuuaggugagguuauugcaaaauuaugccauaaguaaaacuuaauuuagccuguccaaauaccuggcuaugacaagauugaggaaguaacuagaacucauaguuuacauuugauagacacuuucagaacucuuugcuaauugucaaguguuguuuauaucuuuagauuuuuaucauacaucagaaaauugagcagcugcuuugaaacagcacuaagagguuaaaugggcagggcucaggagacagcucaguguaccaugauugccuugcaggcaugaugucauggguuguugagucccuaacccuaaagauaauuguaacaacagcagcaacaggcagagcagguucagagggaaguauauggcgcucucucucucucucucucucucucucucucucucucucucucucucucucucucucggucuucagacaggaugauuaaucucaggaacccuguauaaccaauacuggaugcucaagucgauagaagguaucguauuugcauauuacugacuacacuucaccucgucucuggcguggccaugacacucaacccagcguaaaugcuccuguaaaugauaguuguacuaugcuuuaugauaaggagacgucugcaugugcggcacagaucaaauauuaauagacaguugcuugagcccuuggauguuuggcccacagauuuaaaaggccaguucuguauacuaauuuuugucauucucacuugauuuugugcuuuaaccauccugaaauuauuauuuuacuacuuaaagguaacuguuacuuuugguaguaaugguaacugauuagcuauucagcaaaaucuguuuauaguccuagugaaaaagaugguuagucauaaugugugagugaguucuacuuuaaaaaguugagaaaaccuuugacucuaccauggcuggcccuggauccucuuguuguagggggucuggcuugaguuagauaauuuaguagcauuagcaccccuuuuuaagacaacaacaacaaaagaaaaucuagggaagagugggggcguguuucuuucucuguguagcucuggcuauucuagaacucaauuuguagacuaggcuagccucaaaacccagagauccaccuuccucugacucccagguacugggauuaaaggaguguaccacauggccagcaacaaccagaauuugaaugggugauaaucaagagucccguaacgggcucgcuguucuaugaucagggcuuauuuuagagguggaagugggaaggaguagggcugaggaaacauacagugacuagacugaugucccagaauaggcauauauuaagauuuugagguuauagaauaggcauauauugauacuguguuuugauugauguucuuuuaaaacuugccacaggugugucacauuugagcucuuuagacagcuuuauucuuaagugcugcauaauggauacauuuuuucuuauaaaaauuuuauaaaccuaauuucuugcuaacucugaacaguugauuuaucauuggggauaugacuauguugcaagaauuuauugaaaauuaaaaauaaauuauuuuaauauugaaaaaaaaaaaaaaaaaaaac

SEQ ID NO: 822 - RNA, 146269 nt, Mus musculus
agaggagaauagccaagguggaaagacucugaaugugggcugguagccugcucagacuaaacaggaaaaaaggaaccaauuggagcggggaaccucucuguucuucaugaaccugggcacuuacggcugguguuacugucaguguacagcggacuccagcuuugucaguccuucaacauggacucccaggugauucuaaugugacucucuaaggagcaucaggacccugugccucagauugaggguucauuguugguuuccuuguucuaaggcuuuagucuuagacucagcuguuccuggugucucugaauauccagaguggccuuuguuggacuguccauccauccacucuaauaaaucucuguaaguauaugugucuagguauguauguaucuuacacguagacauuuuuuccuucugucuaaauuuuaggaauuacuagaaaauuccuugagcaaagcauuauagaacuaacuagaaacauuuaaauuacacgauaauguucaaaaccuugucuaguuuuuuucacauguuagagggaucaacaaccuaaaauagaguggaugaggcaucgcaaaucuuacaaaacuuuaguguugcuuggauauuucacggaguagaacauucagacccuuuacacgguuguaaguugcucugcacccugaauggaaaacacccuacaugcauguuucuaggaugcucggaaagcuuuggcuauagaaggauuggugccaaaggcaaauaaacagcgaagguggcacuaguuuccugugggagcuauaaucaauagccacaaaguuagagguuuaaacaauaggaauuuauuacacaguucugaaggccagauguccaaaauaaguaucaguggccugaaaucagaggguugucaggguuacacugccucagaaggcacauggagagccgugguuuggguuucuuuuuguuugcuuggcugacaucacuucuuggcuuauuuccaucuuugcacacaugcuuauacuaucuucuacucccugguuguguacagucucauuaccuuucucuuugaagaaaggauguagcccagcacggugguacauaccuucaaucccugcaguagggaggcagagggaggcagauaguuugggaucagugaaagacuacauagugaggccuuuucuaaaucagauaagauaaaaacaaaccaaggaaaagaaaacaagggccgggcaguggugcugcaugccuuuaaucccagcacuugggaggcagagacagacggauuucugaguuccaggccagccuggucuacaaagugaguuccaggacagccaagacuauacagagaaacccugucuugaaaaaccaaaaaaaaaaaaaaaaaaaaaaagaaaaaaaagaaaaaaagaaagacaaaaauaagcaaacaagcaaauaaacgaaaaaucauucgaagacugcugagacaaucagucagccuaguccugaugacccaauucaguccuuggggcacacaugaagguagaaggcaggaaucuaccccacagugcuguugucuggcccccaugaguggaugguggcaugagaguguagcacacacugaggcacacacacaaacacaagcaauaaauacaacagaguuaaggaaagcacacgugcuuuauaauuagggcugacacugguaacaacuucucugugucucaaguacuuaaccaaguuugcaaaguucuuuucccuaccgagaccaaucaacagguuucagagauuaggacagagucugagagaucacguauucucucuaguaguacgcaggagcucuuuuuucuuuccuuuccuuuccuuuccuuuccuuuccuuuccuuuccuuuccuuuccuuuccuuuccuuuccuuuucuuucuuucuuuuuuuuuuuucuuuuuucuuuuuugguuuuucgagacaggguuuuucuguguagcccuggcuguucuggaacucacucaguagagcagacuggcuacagaaauccaccugcuucugccuuccaagugcugggauuaaaagcaugugcuaccacuacccggccacaggagcucuuaaaucauuuauuuauuuauuuaggacuucaucuucuagccagguugaccuugaacucaacagaucccucuggguuuuggcuuauaggugugucugccaccacacucagcuaagagcuugccuucgccucucacuagucugaagacgaagcuuuucaccugacacaagagcaggagcagccaggcauggcagcacaguguguagucucagcaccgagaaaggugaccuggagggugguugugaguuuaaggcuagccuaggcuacagaggaaaacccaguguuaaaacacuguaucuguauggagcacagggguggaaaaguggacuguggagugauguauacauauguugcacacauacguaggcuguuacgccgcuacaaagacaaauuagaaguugugcuuugcaggaagauugaaggaauggaugaucgccauaugaaacaacauaaaccagucucaaaaacuuccauguuucuucucauauauaaauaaaaacccccaaaaggcacaaaagcagaaguggcagaaauuuagucuccaguaacccaaaauccaaacaagcaaaccaaacagccauccauuaaacugcgguuucuccuugauggcuguuacaggguguucuucugucuuacugucuuguacacucugcacagaguuccuugaaaacuuugcuucuggauagagggugauggggaguggcgcacaccuuuaaacccagcauuaggaggcagaggcagguggaucucuggguuugaggucagacugguuuaaagaucaaacuguaggauagucagggcugcacagagaaucucugucucaaaaaaaaaaaaaaaaagcaggggaagggagggcgagaaacaaagagaggaaggaagaaaggaaggaaggaagagagagagaagcuucaauuuguaauucccagauaacagaagcaaggcucucuaccuuugggccuuccaugugagccucugauaaugaugaugauuuugcugauagaggaggaaugaggaagagguuuggaagcuaauguguuugcugaggacacagcaccugcuagccucuggcaugugcucccugugugcagaaugcuuucaucuuggcuugguugaaauuaggucagagccugccuguuucaaagcuccuaaacucagugaucuucucuccucccccacccccuggugugugugugugugugugugugcgugcacacucgcgcauugggacagguucucacuauauugcccuggaacuauggcacuauguagaucaagcuugccuaauagaaaucugccccccaaacagucuuuuucucuuucuuucuuucuuucuuucuuucuuucuuucuuucuuucuuucuuucuuucuuucuuucuuucuuucuuucuuuaaaauuuuuuauuagauauuuucuuuaauuacauuucaaauguuaucuacuuuccuaguuuucccucuuaaaauccccuguccccucccuccucccccugcuccccgacccacucacucccauuccuggcccuggcauucccuuauacuggggcaaagagccuucacaggaccaagggccucuccucccauugauggccgacuaggccauccucugcuacacauacagcuagagccacaaguuccaccaugugcuuucuuugauuggugguauaguuccaaggagcucuagagguacugguuaguucauauugauguuccuuccauggggcuucagcccccuucagcucccuggguauuucucuggcuccuucauuggggaccuugugcuccauccaauggaugacugugagcauccacuucuguauuugccaggcacuggcagagccucacaggagacaccuauaucaggcuccugucagcaggcucugcuggcaucugccuagugccuggguuuggcgguuguuuaugggguggauccccaaguggggcagucucuggguggucauuccuucaggcucugcuccgaacuuugucucuguaacuccuuccauggguauuuuguuucccauucuaagaaggaaugaaguauccacacuuuggucuucuuucuucuugaguuucauguguuuugcaaguuguaucuuggguauucuaaguuucugagcuaauaucaacuuaucagugagugaauaucauguguguucuuuugugauuggguuaccucacuaaggauaucuuccagauacaaccauuugcuuaagaauuucauaaauucauuguuucuaauagcugaguaguacaccauuguguaaauguaccacauuuucuguauccauucuucuuuugagagauaucuggguuguuuccaacuucuggcucuuauaaauaaggcugagaucuaaauaacuuuaaaagucccacagucuuuacauauucuuaaaauuucaaucucuuaaaauucuaagucuuuuuacaauuaaaagucucuuuaauugugggcuccacuaaaacaguuacuuccuucaagagggaaaauaucagggcacagucacaaucaaaagcaaaagucaaucuccaaccguccaaugucugggacacaguggagcauguguccuuauuaccaguuggaacaucuucuggguauauucccaggagagguauugcuggaucuuccaguaguacuauauccaauuuucugaggaaccaccaaacugauuuccagaguguuuguaccagcuugcaaucccaccagcaauggaggaguguuccucuuucuccacauccucgcgagcaucugcugcgaccugauuuuuuuuuuuuccccuucuggacaggguuucucuguguagaccaggcuggccucgaacucagaaauccaccugccucugccucccaaggcaggugggauucaaggcgugagccaccacugcccggcagaauuuuugaucuuagccauucugacuggugugagguguaaucucaggguuuuuuugauuugucuauuucaacagucuauuuuuuuuuuaaagacuuauuuauuuauuauauguaaguacauuguagcugucuucagacacuccagaagagggagucagaucucguuauggaugguugugagccaccaugugguugcugggauuugaacucugaaccuuuggaagagcagucgggugcucuuacccacugagccaucucgccagccccagucuauuuuuuuaagguaaucauacaaagagaucacucuugcuuguuucuaauuuaugcuugcuaucaggaucaaucaaucaaucagucaagcaagcaagcauggaauuacauuuuucuuggcacuggucuucugcuaugccugcagucuagcacugaguguguagacuccaggcucucauuuuacaguggggugaucagguuuauguuaaaccuauuacuacugaguuuuaaaugaucuccaggugacuuaaggucuuccaaugcagaacugcaggaaucuccaguuuccagggcagcuugccccaggcucaguuaccggauucgaagggauggcaacugacuuugcuuagagaccaauucuccauuucagugacugcuucacccagcucucuguaugaauuuccuggggcauuucugcuuacucaccagcuuccuggagcuauuaaaguugaaggcuguguuccagagaaaacaagaugcaggguagcucauuggcauuugaaaaggcuuguuuucagugcugcucugagaaagagaaaccgggcuuggaccuguccaggagaggagaacacaguuucuuccccuccccacaccccaagaccuccaaauugaagcaaauuucuugguaccauguuauauugaugcuuuaaacuuuuauuuuaagaacacuuucccagauuccuauaaagugggcauaaaaccgcaaguacccgucuuaaaauauauuuaguauuuuauuucaucuuuucaaggaucauauauuuucauuucauucuugauccuaacucugugaggcauugacauggggagaucuucuguuggauauucuagaugucuauaaccccacuguuaagaauccagguaacagguaggugggaacuugcuaacugagcucuuugaaucuuggggucuccaagacugucccccauccugcugaaggaguuaacauuucccugcuagccauucagcaauacuuuaucauuuuugcauuugugaguaguaaacuugucuuuauuuaguuuuuaguuagcuucuugguguuuucaauuacuacacauaaugggcaagguuauaaguauauaugaguuaaaauacacuaagcaaggcauggaagucagaggugaacauacagagggagccucaggacagaggguuuugaccggaugcucaaccaaguaucagaaugagggcuaggaaaauggaucaggccagaaaggucguuguuucacagcuuucacacuggaauugguugcccagaacuuaccuaaagguggaagacacacugcucuacaaagauguccucugauaccacacaauccuaugauguacacuuuccaccauucacacgggcacacacacacacacacacacacacacacacacacacacgcacgcacgcacacaagcacacaccgauaccacuaccaaaaccagcaauaaugggggggggggggggggaagaaucagaaugacuguagguuaguauugggaauucugagucacacacacacaaaaaaaggcccacaaauuuuuucuggcuuuucuaguguuuuacagacauuaucacacucaaucuugucuuggucauuugcucuuuggguuguguuggcauguugucuacaguuuacucauuuauuacaaccaaagcaaacuaaacaaacaaacaaacaaaauccacaaaguuaacguaagauuuaaagauuauuugcuggguguaaugguacacacuuuuaucccaguauuggaaaggcagagguauacauacuucugugaauucaaagccacuuuggucuucaaagaguuccugguuaaucagggcuacaucgugagaacuugacucagaaaguguagaggaauuuuaauccagcaacauggcugcucuugcaagggaucauauccaaagaccuucuacgucugugugauccagcuggaaugcagacacaccuuggaauacugugcguucuggcuggaauaaugcagacucacgacacaccuuuaaucucucuggcuggaaugcagacacacccuuaguauacaccuuuaagguaaaauuaguuuguaaaaggaagcagccauauuggaaagugacaucuaauugaggggcagaugugacgaaucaaagaaagauuugacagaugagucagagauauaggauauauccaacucauuugagaacaggagaggaugagaggcuacaaaagagcagagacagagacagaaagagaaagguggaggugugggugguauaugugcauagcaguuuuaccaggacagauuuacagagacagguuauagagagagcauagacacagaugaagacagaacuagccagaaaaugagaaggaacaagaaaaugaaaacaggcugggcagugguggcacacgccuuuaaucccagcacucgagaggcagaggcagguggauuucugaguucgaggccagcuuugucuacaaagugaguuccaggacagccagggcuacucagagaaagccugucucgaaaaaccaaaggggggaaaaaagagaacaaacagauaaaaacaacaacagaaaucuaucuguaaagcuagggcuacagcucacaggagaagcacuuggggcaaaccauaaugcucuagguuccaucacuaguacugccaguacuguaucguuauaauaauaauaauaacaacaacaauaauaauaauaauaauggcaaugauauuaaagaaauaaacgaaaguaaagagugugugcauuuugcugaagaguaguguucgguauaaguaaaucacaugacugggccuuauuagcaucgcucccugaugaggacaccagagcucuggcagguacagaacuagaucaugggugaagacuuugcaugaaagugcgucagagauuaugucguuuccccauuuuucucuuauuucuuuguuuagcuaacuacgcgaccuuaaggaaguuauuuaaguuuaacugugggcuuucaguuucucauuuguaaaacaaaaguuggaagagcaauagcauucguggcucuuccuauuuauauuucuuucuccuuaauauuucauaaguuguaugaacauguguaguaaggggagaauuugguucucaagaaauguacaggaucuaaugcaguuguccacagccaaugcaguggaugucuuggguucuguucccugcacugugacaaacaaacaaacaaaccaaccaaccaaccaaaccaaagcaaacagacagaaugcaugaaagaaucuucuagaaaacuuagagggaaucugagugacugacagcuuuguuugcuuuugguuaauguaaaaagaaaaggcaguuucuggggguugcacagcugucccuacauuaacaugacuguagauagcaugaugggccgugaugccagugguuguccguguuaugguacagggauugcaaagcggcuuuuguugagaucacuagcucuuucuucacuccccugugaaggcuucgaguggaggacugaaugugcuagacacuuuucuguuacgguggcaaaauauuugacaacaguaacuucaggauggaagaaggguguucuggcucacagguugagcauaguccgucggggguggggugggguggggaggcacagcagugugagccccucuggcugagacagcaggagcugggcugcugucccagcaggaagcugacagcaaugcuggugcucagcucacuuuccuccuccauucugcagacggacgcuucuuccuacagcaggggugguuuuccugccucacuuaagccucugucuuuuuaaaauuaauuaauuaaauuuguuuuauuacuuaccuauuuauucuuuacuuauucacuuuauguccugauuacuggccccucccuaacacccccucccacaacucuucucccauccccuccccccucuccucugagcaggugggggggggggcaggggcuccccugguuacuccccaacucugguacaucgagucugugauaaaccucugucuuaauuagaguuuacaguucagagauuuaauccauugucauuaggacaggaagcgugguggcaugcagguaaacauggugcuggaaaaggagccaagaguccuacgucuggauuggcaugcuggaagagagaaugacacuggacuuggcuugaacuucugaaaccucaaagcccacccccagugauuuaaucccuccaacaaggccacaccuccuauuagugccacucccuaugauccugugagggucauuuucauucaaaacaccccaguguuauaaacaucuucacaaauaugcucagaaguuggccuuguugacuguaaauccugucauguuaaaaauuaagacuauuuauuacaaaggucccacccccccccuuuuuuuuccuauggacagggucucaugucucauuauggagcccacagagaugacaggcaggcacuacuaugccuguugcuaguggcuuagagcuuuuucuaagagcuccaaaauccucagauaguauuaauauugccauugucuguaacacugucccauuaagggccaucaucauguucaauuauacaagcauggcccuggucacuuaaccucugcagaccauugccccccacccccacauuacacuuugcuuuuucaccccauccauuucucuaagccuuauguccucaguguauuaaguuugagacuuggaucucaccccccacacuuggcuaccuuguaacuaaacuuuuuuucugcuuuguaaaagaguguuguuuuaugauuaguguacuguguaguaggacaaagccagaguugguucauuaauagcaguaaugacccccguuuccccaucuuggaaaagcaucucucaucucagaaacuggauuucagaucauaguagaaguugcacaucccugauuugggaaugagauuuguuccaaggggaugcauagccaguggcauaaacugacugaugugauauaaaugcagagaaaauggcaggugaacuggacuuugguaaaaugcaggcgcauagaggaaagccuuccagaguuggacagacaaaugugggugaaaaucuaugacgguuuugagcugacuucucuccucccuuuucuuccuucggaacagugcugggaaccaaacccagggucgcccaguaugcuaagcacgugggcugugggcagaugcucugcugcugagcuauaguguuguuuuuaaaacauugugacuuagucuggcuaagccauccagccuggccuuuuacucccuuuguaguucaggcaggccuugaacuugugcuucuccuucuccacucuuccaaguagcuggaauuacuguuugugacucuuuucuuaggaguguaagcaaaguuagguggcaccaaaguuguuugacaccaaggauguauaaggcaggaaccacggcaguuucaugaaugcuuugucaugcuuaugauggcaaggggaagcccuuugcacuuugccuucccaggguaugggccuaagaucgccucugcugaaauaacugcuggcuguuuucaaauauggcaaccaccuuccuucucaaucccuauugugucucagaucuaaacuugcuuuguuuuguuugaauuccaugacuaaagaacaacaauagcaaaaagaaaaguguuuuuauuaguaccaguacuuacauauaguugugugugugugaguguguguguguauguagguaugugcacuugagugugggcccucagaggccagagauguugaauuccuuggagcugggguugcugagggcugcgagcuaccauguggaugcugggaauugaaccaugguccucuggaaaaguagcaaguauucuuaaucacugagccauauuuccagccucuuauuuuuuuuuuuaaaugaaaauguuguucguagauuccaaagagcaguuccuaaacuaaugaguauccucucacccgcgaugaaguuauuuuuguuaugguaagaauuuguuuaagcaauugggaagcuguauucaguuuaauuauuucaguccucaaacaaauucuuucaguggaguuuuuaguauaauaaaaucgagacaccuggacagagauaagaagguugaacagaggccaaaucaggcacucguaaacagcagucuuaaaaacagcucaaagcuuuacacauuagacuaggaggggauauggcuucaucuauuuucugccccuugauggagccagguguggggguggcacaugccuuuccucucagugcaccagaggcagaggccaguaagaucucugugaguucaaggccagcccggucuaaaggguuaguucuaggucuacagagugaguuuagagacccagucucuaaaaacaaaccagacaugaauggaguaggugaagagauuuuauaagucucugugauauuuuaaaguacuuaccuuaaaccuuuacauuuuaaaauuaucuguuguucacugaaaaaaugagucugucccccccaccugcuucagauaggccucacuguagcucuggcuguccuggaauuugcuaugugggccacacugaugucaaguucauggccauucucuaucuccaagcagcugggauuaaagaugugcuguuuuauuuuauuuuuuaaaacaaacaaacaaacaaacauguucuaaguuaguugugaucugagcaguuggaagcaagcaguaguuuuaauucaugaauauaucugcuguagagcauuuuccucucuaauuuugcuccuuuuauucagcagugguggggaugaaaugugauauacacaggaacaaugccaaaaugcagugguuuugacagagaggacucaaaagaaacacauggauuguuuggggcugcuuccuggcucuuuacccuuuucccacauugucgcaucuuuuuccuuuagggcucuucaugaauccuauuggaugcuuccuguucugaucuuuuuuguuuguuuugaggcccauauuugucaagugcaaugcugcccagggcuuccgauuuuucuccucugucgucuaaguuaugccgaggucugaugggugcucauggguuucugaugagagcugaauccuucauggguggaguacuuagugaagaaagacuugacauaguugggccagaaacacacuguucacuuaagcauccacuuaaagccaacgaacauuuaaacaucuuuuauaggcacuaggaugcgaaagucaauggcggaaugguuucauuuccaggaacugcagucuuuuaggugaauuagugggaagucagcauggacccugauuucgaccuacuucuuugcagagaaacgcauugaacuucuaaguaaauauuugagaucugaaaaacaggaaaaccgaaagucaguggcuuacuucuagggcucucaaacuagaauccuuuaggaccgagcuauugaacaucagcucucaacccuuagugugaaucuggaccucuguaaugcuugguuaggucuggagcuggaacucggauguuugggacucagguagccacuagcucagauuguuugcauuucugccaaguucucaggugaugcuguaccaggcaccauagcuguacugugaaaggcacauuuuaaacgcuaaagauucccuggcuuauuuccaaacccuuucagugguacagcgacagaagcuuaguucguaaauuuagcguguccaaggccaggaacaaguucuuuugccuuuacagaggguuuguuugccauaaguuacugugaguuugugaccccaaacuauaggcauuucuacaggguuuaagaauacuauguaugugacuuagcaauugauuacuaaacacugcuacaauuuccuucaaacuaauuuggcacgaggagcuuuucggaucagucccugccuacuuuucaacaccauaaucucaggauuuaaaguggggucuuucggaacccgaacugagcccuccuuggguacccuugguuuugcuuaacccuuuuaguugcaacaagugagcugggcaugcucagugggcagggucggguugggagggggugcaagugggaagccuguggcuccgcagccaggguucuccgccuccccccaccuguacgaggcccggcccgcugggccagcgcucagcaucccacccuugcugauuuggcuuguucuucucagcgggucccggugcuaacauucaggcccgggguccacaggccuggagcgcccacagaacacgcugggguaucugggccgagagcugcaggccgagucccuagagucccccgacuccuagacgccuuucuaggcccagggaagccuggcggcugggaggcgcggaggaggggacgccggaucuaagggcgcgcgacgggugaucagguaaggcaaccccgguaggcagcaggcgggggaaacguccucccccuagggcagauggcaggaguggcccgcguggggagggacagaaacccaacaccacagcggcuuccccggccuagcucagcccucucuucuuuccuccagcuagcaaggaguggcaggguauggagucgugcuccgccggggcucagggcaggaucgauaaccucgggcauggccagcccacgucccugcgagacccagagcgccgggucugcagccgcccuuucccaccggcugcacuuccgcauuucccugccgggcagagucgcccgggccgcggugucgcggcgaaggcgguggcugaguugccggaucaucccccggggaggcggaggcgcacgaggggaggaggaaguggccgggaggggcgucggcgggcgggucggguuacgguggccccgccugacccggugacaucccggcgcgcucgccgcgagcucagggccacucugguucucggugaggccgacuccguucuggcuggaggauccugacucccuugcucgccgaccccuugcgcgugacgaccgaucucaggugugugcguccuggcgaccugguccucugccucggcuucuaggaggaaguggucccucucugacuugugugacucggugggacugcgguguggcggagguggagguggugguggcgggaaacuggggcgagacugugaauuuguucccaccaacggaggaggagcacaauucucauucaggguuaggcgagacuggaauacguuugagauacgcuuuaccuagcuggaggcagggcguucccacaucaaugaaacuuuaugcaaaguuuuaacuugugaaaguggcuugucugaugcggaggcuugcuguuuccuucugaggugaggcggggaagacccuucugcaagggggaggaggcuuucuuugagaaacucaguugccggggugugacuggcccaggaggaaaugcaaaguguacaccggcaacagccuccucucuccgcaaagcaacugugucuugccaaagaaaguuugcugagugcugcagcuuuaggaaggcuuuuagcaggugauggucccuagaccguccuuuaucccuuaggaagauauacguacuccugaaacagccuuccucaagcaacacaaguucuuacaaaaguucaaugacaggggcaucuaaguguuacaagaaguaaauaucccagggguugcuacagaaacagccaaaaguuacauuugucaauuugugugaguaggugagagaaggaaguugcccuguuugcuuaaaacaaaacuuuguaucuugcauguauuucaaaguuugagagucuuggaauuucucuuuuugaacguggaaagugcuggugauggccucucugggaccauggggcuucuugggagcuguugguuagcauauggggccuggaugccauugcccaguggauagcaugugcugucucuggggccuuaaugaugaguguugaaaccucccccuguuucucauagagacauuagucaaacgaccacacuuccuucauuuuagcaaccuaacccuucaccucagugaacaaugggaaagaauuugggaugagagacaaaacuguuagaacucugcuuucugagagcauuagucacauagucaccuuauaaauaagucauucuaggaaccaugggaaggcaguugcaugccucacuguuaaugaaaagggcacagaguuagcaguucucaguggaugucacaccccacugcugagucuuauaacuaaugcuucuuauagacagucaaaaaagaguugauugucacuguggaugaaugagaugaaugauguugacauacugauagaauucuuacauuauccuguccauagucaggauguaaguuuuuuuuuuuuuuuuaagauuuauuuuauguauaugaguacacuguacuuguacagaugcuugugagccaucaugugguuguuaggaauugaacuugggaccucugcuugcucuggccccacuugcuccggcccaaagauuuauuuguuguuauaucuaaguacacuguagcugucuucaggcacaccggaagagggugucagaucucauuacugaugguugugagccauccugugcuugcugggauuugaacucaggacuuucagaagggccgccagugcucuuaaccccugagccaucucuccaggccaggauguacguuuuuacugggguugggugugucuuacacacuuucagaucucuagcaccaggagugguggcuugguuugcaauagucuuccacaaaugcuuucuccggcagugacuaaccugaaacaauguaucugagucuaagaaacagaaaguuuuggccuuagagaacauguucaaauuuacuaagucucauagacaaaauauggguaaugguauauguauauguacacacacacacacacacacacacacacacacacacacacacacauauacguauacacacacacacauauauauaccaggucuacaaucacuaguaauauguccuagaggcaagaaacucuaaauguuaguguccuuccucuuauuuuucuuuugcauuggaaaagcaaauuuugggaaaaagcauacagcuagacaggugauuuagguuugggguuuuuuuuuuuuuuuguuuuguuuuguuuuguuuuuguuuuuguuuuuguuuuuguuuuuuuuuuuuuuuuugguuuuucgagacaggguuucucuguauagcucuggcuguccuggaacucagaaauccaccugccucugccucccgaguacugggauuacaccacgcccggcagugauuuaguuuuuauaugucaugccagaggaaggcaagaggcagcugugguuauuagaagagggaacaauuuccagaccauuaucuaauuucuuuucuucauuuuuggaacauggugauguuuucugaaacuugauucauucugcucaaugccuggacuccgaaggcuagcucaagugcagaaacauacugcagaaagcacuggacauggcacaaaugcuacauuugacuuuuugaaagauguuuuacacagucgugugcaccauuacacaguaauaaguaauagauaaaggaaaaaucacuguuagcuuagaucaauauauggcguguuuguuuagugaaauaaaacaugaauuuuggugcgacauaacaucacuuuaauugacuacauauguagcugguccuaguugcguagagagguggaagccaucuuaguuuguauacauucugugauguuucucagaaugagagaccaccuaaugagucauuucucagaaguuauuucugaccuuacagaugacuguugcuggcugaacuuguugggaacaaguugauguugaagagacuaccacugacaaagacuaaaaaaaaaaaucaucauuuuaggaguccauaucgguccagacuuuggcucuaggcuagucuugaagucauagaaauccuccugccucagccuuucaaauaccaggauuauaagcaugugcuguaucaugcuuuguuuugaaguaggcuuuaaaugccugcgaaagcaucuggauaauuccacuacauuuuauuauuuugagagaagaagaaaaaauacaaguguuuguuauaggaagaggcgcuguuacugcucugggucguauaggaugugcuucauugugcuuacugugccgccuugcuuuugaauuguuggcaugauggauaaaauaaguaugauugacaggugauuacauucagcuucugugaagaaagaaaagagccaagguggaaaugucuaacgacuuuaggguagacacuuucuuauagucuaaagccagagauauaucucagaguccccaaagagaaagaaagcaagagcugcugauauauauagcaggguauagugauacuugccuuuaauccuaggacuugagacaggaacucaauauauagcucuggauggccugaaacuagcaauauagaccagguuggucuagaacucagagaucuaucacacccagccuuaucuaucuauauauauacacuuccccuuuuucuguuaagaauuuugauucuuccaacaucagauaugcuuugugcagcaaagcgugauuuguaauuuuuauuggugaagccugggcuagcucauuaaaauugaagagaagaauuagcuaguaaauuuuagcucuucuuaauuaaccguuuauuuauuuugaauaauaggagcugggcacagugaaaaaccacauauaaggucaguucucgagaccaacccuccuaacaaacuuaagaagugccuguucucugucucugacccuggaaggucucaguuucuugggauuucuggguugagcauacuuuuguacauucaugagauugcugauggguugguagauagcuucugggauaagagcugagugcccgaggcuuugcugcugaaaucagaguugaaacuuccgcugcgccuuugacuucugggaagagaaagagguuagagacuaucaugaacugugguggucugaugauccugcguccauaauggagcucuuacaaaccucuaaaucauggguuuggaaaaccugaguuucagaauauuugaagggugggaggagagagaggaggaaacuccuuggcacuguuuccuuagugaaccauacaguucuuuauuucauguuuaccuauauuauuuauaauauuuauuugaaaugagucucacuauuguauccuuggguggccuagaacuuauauagugaucucuggcuuggaagcguggaccuuucagagaucugccugucucugcugggaucaaaggcagacaacaccaugcccagcuuguuuucauuauuuauacuaucuuuacaauaggcuuauaaagacauuucccugagucagagauuuauuauagccgguuacuaaauuaaaggguuggggacucuagguugggagguugggagacaguuggaggaaggguagguaaccugggaagccaauuguaugcccacugucugaagugccuuuguguguguguguguguguguauguguguguguguguguguggucaggucaguuuguggaacuaaacucuuaaaugagcuuugugcuaauacaggcaguaaaucuggauuugaguuaaaauuauuggauucuuucuuuuuuuuuugugguuuuucgagacaggguuucucuauagccuggcuguccuggaacucacuuuguagaccaggcuguccuggaacucagaaauccaccugccucugccucccaagugcugggauuaaagguaugcgccaccacacccggcaaauuauuggauucuugaaaaaauugggcagugguuucacacaccuuuaaucacagcacuugggaggcaaaggcagguggaucucugaguucaaggccaaccuggucuacagaguaaguuccaagauagccaaggcuacacagaaaaccugucucuaaaaaguaaaaacuaaccaaccaaccaacuaaccaaccaaccaacaaaccaaccaaccaaccaaccaaaaaacccaagacacaacaacagaagauuucagaacucuucacuugguauucucguggaacuggaagaaugguguaaaaaaccuacacauuuggugucaggagugaugugaauacaaggacaguguucuuguccaucuguaguaacacaguuuagaacaucuuuuaguuauucagggaaacuugaauacuaauguaguucucaacacugagauacucuaauagucuggguacauccugggcaaugacuuuagaugggauucuuuucuggggacccuuaucuuugacugcccauguauauaugauuguaugacugguuuuaauugguagggaaaggagaccucaaaacuguaacagaagccaguuguauaagauuuauggaagcugaugcugucagacaagagugagucugaugaggcuuugugacaguggagagaaagaccugugauuuauaacgggaaucauucccuugagugugugugcaggugguugcuagggugaugugggcguuuucuuuucuuuuuuuucuuuuuuuuagcugcuucuguaccugugaggagggaaaguugugcucaauguaaagagcuccggaaacauuugguuaagauaaugugcuauuguaugucaguauaacccaaugggcuucugaauguauuucaaagggacgaaaacaaugguuuagaauacugaguucucagugguccuuuuccuuucaacugaauaaguaaaggauguugugucgcauuguaaucaagccagaagugccuuugaucaagcuccuguuugcuccgcccuuccugggguucuccuguucuguggcaucaagucuauuugucuuggaguucagggcaccuccaguuuugcuucuggauucuuucuuucucaucggguucugucuagguuggaguaaguagaauucuuuaaaccuacuucaauucuauagcugccucuugcuugucagucagugcucuccuguuuuacuuuugaagguucuuggcacgagcuuccaaucucacgaaucuuuccuccuucccucucauagugagaaguguugcuuuauuucuuucauuuaaaauuaaauuaaaauuuuauuuuuguauauguauguaugaauguaugauuguaugcaugcauguacuuauuuauguaauguauguauguauguauguaugguguauauguaugugugugugugguagaaacuauuuaauucuggccugagguuuccacccugccuuugaccauuuaguuccccgauaaaagacacauaccauaaauauaaauaguuuuauaauuauaauaagccgucaauagcacaagagcaagugcucuuaacugcugagccuucuuuccagccuccaagugccuagaauuuuaagggaagagaaacucggugaccauuuauguaggugagguggaagaugauccaggagaagaggucaaagcugacagaagagaugaggucaaaauugaccaaggagaagcuuuuacuuucgagcgagccugagguugcagaaguggggcaucggcacucuccuccucucuacagugagguagcuaggcuucagggauuugaagcccacagaaaacacaaagugcuuauuacucuuggccugucucuguggaagccgcuggucuugcucaugguucuguuuaccuccaggcccuagccuaacauuuccucuuacugcccauuuggagagucuuucucuagcuuuccuggauggggauuuucuugccggggaaagcuguaugccuuacaccucccuauauauccgugcucauauaagcccauuuucaccaaccaccaugagacccuuccucaacccucggcccccauuaagagguuuuuauugggcaacugcugguuuccaggcacugugcugagcucccucucucauguuucuuagaucagcagggaauccugcuguaugagggaucaguggagaucagagaaauucagcuacccauucaaagccacacagucuuugguuugguagagacuucuggaaauccuugugaaaaaaugaagagauaauucuacuucuucugcuagccucaccccucauccccccauuuuaaaauuuuuauuuaauuauuuuuacuuucugcuuuuugagauagaaaugugauccagguuggccuucaucuguuuguggcccaagauaaacuugaacucuuggcucuguucucugucucccgagugcugagacuacaggcaugccuaugccagauucuccaacccccucuaucccccuguugacuccauaguuuccuuuggacuugacuuuaggaaccagugacauuguuacaaacuucuugagguuugacacauguguaaacaaccggcaccuuagaaucaacugcuuuccacucuugugucugggugccugccagugagcacagucauguauaccaugagaacauaccauuuguuugccugcuuuaaccaggaaccugcuucucccacuugacuuucacaccacagcacgccuuucuccauuucuuuauuguccuaagacacagucucucucuaugacuagugcugggcuggaauuuaaccauugcuugcuacaguuuucccuuucggcaucaucuuccuuucaacccaguguauuuccuaauuguuagugguuagagcagacuaaacuguuguaaccggagaucugaguauagacccaggcucaaggacaaguucauuucuuucuccuguggaguuucgguuggcauauaugguuuucuucucuuggugcagacugcauggauccuucuguuuacaauguaguuccucuagcuuuguuuucagccccguucagcgaauggaaagcgaagagaagaagcauuuccaccuucucaacaccaacucuuuuuuuuuuuuucugagacaggguuuuucugcauaguucuggcuguccuggaacucacuuuguagaccagguuggccucgaacccagaaauccgccugccucugccucugccucccaagugcugggauuaaaggcgugcaccaccacgcccagcuaacaucaacucuuguagugaaugugccaccacagcucacauuggcuuggcuggaaaucugaugcagagucucucuugccuucaaggaagauugccaaugacuucuagcuaggagccgaggaucaugggacuauaggucuugaaaugauaacuuuuucauagggucuuucaucuuagaccaggaagacagagguagcaugucaguugucagauaacucugucaacucccaacucugagucaccacaaguucguacuuucuuucccuacuacuuaauuuauuauuuuucuucugagacaugguucucccuauguagacuaggaugaccuugaacucacagauuuccuugccucugccucuggaaugcuuggauuaaaggcauguguucccuuuaguuacucugugaaaauuagccuugcucacacuuaauuuuuauugcucuuuuuaaaaauauugggaguagcagugcauguguugaauccaggagggagagacagucaggucuauggaaguuugaggcuagccuggccuacauagugaguuugaaaacagccagggcuacacagugagacccugucucuaauaaaacaacaaaaaauugauuuuauuaccuuuugguaagacagggauuugcugaguaucucgggucaguuuuaacacaaauuguacugcccuggcuucuaaaggccaacuaugcaggacaucuaauuugcauuuaaaauauuuacaagaaggcuccaacuucccaacacaaacaguaccaaacucaaacugugcugucagcccacauucaccucuagcugcgggcucacuuccugccuuucuccugagcuuugugaaagcuuaacuuuauguuggccuuuacuuccuugcuuccuuguucaaauuuuuggagcauccaaaauucuggguucaauuucagaugaagcuauuuccaucauuauuuauugaggcccugacuggcaagccaaugaguuuaauuuuuuaauuuuuaauuuuuaauuuuuaauuuuugaaauuucuauuuugcucacucuuuucccuuaugaaauugaacucaccgaguugcugugacagcuugcuuuccuuuggaguccucccuacagcugucugcagguuccuucuugggcuuucuucauagcucacuggcuuuucucuucaguugcccacaucaccugauuuuucccuauacuggauuugagugauauucuaauuagcaucucgaggcacaucucuggggaccugggaguugacaccaguggcuacucccucauugauguaugcucugcaguucauggcaggaccaucuuuuuuuugucucugagcugcuucuguucacuaaggagcaucagggcauuucuuucccuuaccaccuauagggucuguucaucaaaucgaucagccuaaugcaugcuggacauuucccugcaauuaggacuauaguggucuacagaucccucuccacuucuauagaauuuacauuuuuaguggaggagaaaggcaugauuaguauuaaauggugaacaggcauuugagaugacaagaaguauaugauuauuggagguuugucugacucgggagaguaugucucagaaucugacauuuuccuugggucaugaaggcccagaaggagcuaucugugcaaagaugaauauuagagccuuccaggcagagggggcagguggcaucaugugugguggccucaggucuuuaaucccaguacuaaggaggaagaggcaguucauugucauccugguuaaaaagcaaauuccagaccagacagaacuacacaaugagaucaugucccaaacaagcaaacaagcaaacaagccaagguguguucuauuauacccagcucauagaacuggagcuggagagauaucucagugguuaagaacacugauugcucuuucagaggaccugaguucaauucccagcacccacaugguggcccacaaccaucuguaacuagauuaggaugugaacauauucagggugucuguauggaauuuuuuuuauaacauucaagagaaacuuugugaagcccucaaggcuacguucuguacggcuuuauaauccaagguacaaugcuucgguuucauucuaggguggauucugugcaggucauuaaaaugauguggaauagugucuguuucucagaugggcaugauggcucgcguugucagucucagcuuggcagccgaagcagaugacugcccugaguuugaggccaguuugggcugcauagugagcuccaggccaggcugaaaaccagaggaaccuuguuucacaacaucaacaaaaagacaaaagguccaguuuguuucuuaaaagcccaaguuagaacuaucuagacgcuuaguguucguugauaagaagguacuucuuacauauuaggaaauuaagcuuuguuggauaggcuugagcugcuucagagggucauggaguuuuacaauauauaagaauuuucuacuugccaagaaccaauugugguuaauagugauucgguugagacuguauacgaucagucuguucuggcugcugaaaggaaacagggauaugggaaguauggggcgacacugaaaagagaacuuagguuaaaauuauagaauuuaguuguucaacugaggaauuaucaugugggcaaccauugcgcuaaagauggaaagaaguggacagauuuaggagauguuugugaaauagguuggugacuaaauuugauaguagauuaaaaagaaucaaaggguucauuuuuuuacuugagcacguaggccaaauuacugagaaaaugagaauuuggagagaaucaggguugauggaagaagacugaaagcacucugguuugguugcaccgaguuugaguugcgucuuagacaucauguacaaccgggcaaacagaauuucgagagacugaaaggcauuuacgcugaguagacaaauuggggauuuuuuuucuuugcacguuguuuauauuuaauacugcaugggauuuccuauagagaaugucaagaaagauaagggacgagugaucagugguuacauagacuugcuucuugggaacuaggagaaugugaucucucugaagacaagcccagagugguuuguuuuuauuauuaaagagaugguuuugcaucaauuacagagauugcauuuggugaaauuguucauguuugauuuugacugauaaguggagaaggcgggacaaaagcuuaauggguugagcuguagagguggaagcuggaagccagacuuuucagaaaacucaagaaaugugaagaagaaggagauggcgaugauguuugcgcacacggugcuuugaagaagaaccauaauacuuaaaacagacacuaugacagucagagcccaugcugagauggagucaaagaaccacucagcagagguugggaccucgaggguuggagccuccagguaaauacauacagagcugaguuugggaaggaaccaagugcuaaggucaucaaugaaugagcagaagauggauggugacugcagaggaggaauaauaggaggguuuuuuuuuuuaauuuuuaaauuuuuuaaaauuguaugcuaugccuguuucuaagaacaauaggacugaaaacaacaacaaccaaguuacauguuuuguuugaugggcacauuggccuuuuuuuuuccuuuuucuuuuugagauuguaauguaaguacaacauuucuucuccccgacccgcuccaacccucccauguacugacuagaauagccuucauggcacaguauggaguuaaccaaugagucacuggccauaauuugucuaugggacaaaguccaaauuccuuugaauucgcaggaaucauaugagauauuuaauaacuaccccaccuugcuuauuuuuuucucaucuccuucuggguuaugauugcuuugauggccacccugaacuucugccucauucuaaucuugcuaaccuuugagggagggcuacuacccagccagaaguccuucagguaggcuaaccaaacuugacuagaacuaagacggcugcuagagacagcagucuccagcuuuauuauauauaauaucaccugcauuguaagugacacauucuccaguagcggacagucaccacugucacgguggcccacuggauguagcauaaaaagaguaaaaauagaugccuauauuaggaacuuucuacccauccuuagugagauauuaggucuucccuuuaguagccuauuccccuccucugccuugcccaccauaacaaagaacacugccccugcaaggucgagggcuugcuuggcaucucugucucacagcuguccuugaccaacaauacaaguuuccaguuguuauucagucuuguuacugguucuacaguucccagagagaaacaggacccaugcugugggcaguaucuaguaaugucgcuggccucugcuuuugcaccacagggacacucauucccucagaaagcaccguguucacuuggcaucguuucucauagucauuuggacaccgaaccuucaacagcagaguuacuacugcuuucccuacagcuaccccucggaucuuccuugccccuucucccucagggauaaguaguccuuuagcuuuuuaucuaaaccuuauccauacacuuuuuuuuauuguugauuaauuaauuuuuugacaaaggguccccaucauguaaccauggcuguccuggaacuuguucuguagaccaggcuggccuugaacucacagagaucugcuugcuucugccucccgagugcugggauuaaagguguguguucccgugccugguuucuauuuguuuuagaaucuccuuuucugaacuaugauguccuucaaggcagauccacaaauuagucacucacagguuuaaccgaugaaaacguagugcuuacuaacuuuacaaauugccuuucuuuucugagguguaagucauguugugcauacuuuuggguuaucuuuucuuuuauauuuuuucauagaguaucucauaguccaggcuagcuuugaauucacuuucuagccaagguuuucuugaacuauugaguuuauugucuuuauuuccuaaguguguacguacauuuuucagauuuugcaucagacuccuguuuuuagcgcgaccccccucccgccuuacuggugaaggagaaucuguugaaagcaaagaugggugcaggaaacacuugcuaucugugugaccaaggcgauugagauggaaagccagcaaucuggguuacgccucguucgccguugucguugcuuugggcugagcuguaaucauuaacuucauuauuuauauagccuaaugaaggcaaauguggugguuuucuggugugcuuaaguaugauuggguggccuuuuuccacuguccaccugaguaugccgaugggauguagaacuuucugaagacuugugucaaaguucaguuccuuuaaggucccuucagaugucaguuuccucgucucacaugaacuaauaauuacuucuguguuaccaagauuugagauaauguaaaucagaugccagcaguaugaacauugugagucaccaugauguguaagaacaccagggagugagucacuccguagcaccuguggaugggaguggugggaaagggagcauggugggggcuggcugguuugggaguuuaggaugaauaacaggguugcagugauggguaaaguggcuagugggaccgcuuaugggaugccugguguuagcauguucccagugagugaacaaggaagaccuguuuugacacuuggggucauagauuguuuucagguaauuccugcaagaacaaucaguugugguuugugacuucauguccugagaccaguguaucauucuuaaugcccugcauuuuuaagaaauacccugauaucuuuagaaagauuaacuuacaaaguuagcuggucugauagccuuuugguuuuauauuaguaauccccccuccccccccaaagagauggaguccagagcugugauggagccaaaagcaacuuccuaguuucucugaaauaaguacccaaaaaagugcuauucuauuccaaagagaggacaaaauuccacgcuuguccuggcacaguuuucccgguggauuaaccccagaggguuaauucaggacacaaaccuuugaucaggauucuuacggagaacgcuuucaguucauguccacacuaacaguguuggagguccagcuacuggacuucacgugauugcagccugaccugagggaaagucaguucccucccuuugacuucugcaaccaccaaccuguggcccagauccacaguagguccugggcuuuguacagauuuguaagaggccacuccacaaauaacaguaucucuucuguuugagacaguguuuauuuuggaaggugauguuagagaaaagcuagaggaggccuuacugaguguuuuaccggggaauugacaggauuuauuuaugagugauaagaguaccuggguuagagcaggugcuguguaggccccaaagcaggguugcaucucuacaaaggcaggcucuacuuauauaggcuugcauaguggccacaucugcauugugggcgugccggauguuagugagagcuuauaguauaggccuuagauaucaccguggcaguuggcaggcacauuccacacugcaucuuuagguguaggugagacuuuauagaggagcuaacuaaacccauugucacacagcuugugucuggguugagccgaagggcugcuggugucuuuggugugguacagguucucccacuguggauguuguacugaacuugacaguggugucaguugaauaugcuauacgagccugacugugccuggucaagugugacugugcuaaggacagcaccugcgacuagcaggaaucuggauguacccugaggaagggcuguguccugcaaacaaguagucaauuguuaguggcaggggaggaaagcaagguugagcucaucauaggagcuuucucugugggcuuccuuuaaggccuaguacaguucaagggccccugugugaguggcucaccucauuuugguagccuggagucuacagcaaaguagcagaaagaaggcaagagccaaucccugaagguuguccucuaaccuuggaguguaugcuguugcuaugugguuauacucaugcgcacaucucucugucucugucucucugucucucugucucucuuuuacacacagacaugcacacacaugcauacauacagaaugaaaaaugcugagguaguuuugauucaaguuaacugaaugaaaaagaaaagaaaaaggaaugggaaggccaugacugcuccuagguaugguggaggagaaagugugucauagauauguaggagagcauagccagaggcagggaccucugggagagacuagaguggucaugacccugaacuauguagggacagagaguggaggaggagaagaagggagagaggggaaccacuauagcagccaggaagucgaaaaagggcagagagaggagguaacgaaaaugucuggacuauauugggaagagccucuggguaagggcagcccugccccugagcuagaaagugaaggaugcugggagaaccuggaggucaggucugcuuugauauguuuaauaggcaccucaacugcuuguccugaguuugaaacuuaguauuauauuagcugguuuaaauaguuacugaaucagaugcuuaaggggaaaucaucuuaggguuggaugcuccauguuccucagagaaagguagauaccucuguaguguuuucuaggucuugcuccaagacuccuaauaaacugcagaggcaaagccuauuucuccuuucucuguguggcucuuuacccaucuuuauuaaagauaagagugguuguauaacaggaaaaucacccgaguaauggucagaugacaagggauuuggucagaugccagcaguccauuugcaggguucucuuagagaacuuuccuuauuacaggaauaacacacaaucauacagauauuaaaaugaugcauucaacgacucaacccuacuaguuucaaauuugggggcggggguuacuccuugagucuuccuguuagcguuugcacauaugcucacacagaaguuugcaugcacauacacuuuuaaauuuuuugagucaaggucuuggaaaguagccaugacuacccugguaucuauuauauagacuagauuggccuaguauuugcagcauucuuccuggauuauaggugugucccagcucuguugagucgggucacugcuuuauauacuuuucuacauucucaucacggugucucuaucccuaaugcuaacaauuuauaagaaaucuaaacaccgacuggcuugauaccuggccaggaaggggauccaucaucuucuucucucacuagcaugagaguuacacacaacccccaguaugcccagcuuuuacaugugugcgaggguccaaacuccauguggcuuuuuuguuuguuuuuguuuuuccaggcaggguuucucuauguauccccagcuguccuugggcucacucuguagaccaggcugacaucaaacucggagauaugucucccucugccuccucagugcuggaacuaaagauaugcaccgggccggacaccugguuauuguuuuuaauacguagguacauuauuccacuuccggucuugagguccagagaagccagguaucuauuuuuuaaaggcugaggcuguccuaggcuggguugaacacgucaggucacagucucuguggaagcacucagcugccucagaacauaacguuguuggcagcugcugagguaaugguuucgggaguaggcagaagugcacugggugaggucgguccugaaggucaccucauugauauuggaaccuggaguuuugacaagaguccuauuagaaauaccauuuuacaagucacuugcuuccugccugugucuuggugagcuuugggcucaagcucugugcuaaaucuuucggcuuugauuccuucagcauuaucuuaagaguuccuggcugaggagaggcuguugagucugaauugcuaacgugcucugccgaguuccauccacccugugauuugacugacaacaguguuagccuaguccacuggggucuggagaauugcaacugcucagucaagaguguuuucugagcuggaauugaaaugcagggcccuuuagcuucuagugugacaacaauguuccggcaauugacuuucacucuucagucuccaauaggggggaaauuaugaaauaaaaugggaugguggugguggugguggggaagagggccaagcauccucgucaagauucaaacccauaaaaaugaguaacuguaauuaaccauauacagucucucuucccuauuacaugugcauuuaacugggucacucugcuucacacagcagguuagcagaugguagauaugacccgagauccuuuugcaacacauguccaaaaucaguuccaguuaugaggacuguguguguauaugggaagguaauuggcaaacaaccccagccccagggggauuagaugugaagacaccuaccucuguggguauuggagaggcuguucuuuguaucagccugucacagugaaugagagggagggagcagucucucaaguauguguccaauagguuuuuguacuugagaugauuccggaaguguggguuuuccuacuguagauacuauucuuugauugcaguuuguguguuuuucuuucuuucucagggagguucuuuauucuuucucucucuagucccuucugccuccuuuucauacauuucauauauugauaagcauggcuguguucuguaaaaaaaaaaaaaaaaacaaaccaaaccaaaaaaaaccaaccaaauugguuuuauacacucuacccacucugaucucccuccaucucuggguuucaaauaaaagaccucuccugguaggcaaaugcucuaccgcgaucugauccgcagaccacucuggagucuuucuuuugaaacacaaauuucaucugagugcuguagcuuaaagcccuccacugacuuccugucucccgcauugucagaaugaaagccuugcuaggaggaggucgugugugacuuggcaccugucucuccuucugaccucagcugggaccaacugcagaggccacuugaugcagccacaguggccuuuuggcauaccagagauguggcgccuguacaggcugagaguaucuuugucugcuggccucuugcaaaagccuuucccucaugaacuauaugcugaccucuucucaagagaccuccccacagcacacucaugaacacuauccaaauucaaugcugucacuacucccuaccccccccccacacccaguuacucuaaauuguuacucauuuuauuuacuguuucauagcacuugucauuuaaaaauaucuuaagaggaucuuauguuuauaaaacacccccaauccaugacaacagagggauccuccucagagcugugcuggguaucuagcaggcugcacacuuucagacucaguggcccucuaccugccuucuucacuuggcaagauggcuaagggauauuuuucugaauauuucaaauucuugcuuugguuauauucuaagagcuuuugauuuuuguuuuccuguguuaaugugugugugguguguauuugaguucuaaaauauagcaauaacaaaaauauagcucacauuuugaaauuggacuuaauuacuuuaucuuagaggcacuuguauguacugaaaaagacuugaaagugucaacauacgauacugacaauaguuuaguuauaaauuauguugaacauacacuguuuacauaugauauauaacccuguguuauaaagagguaucaauuauacauaauccuauuuuaaugaugcagaguauaaauguagguauauucgugccauuuggcaaaaauguugucuagaacuagggugacucuacuuugccauacaaaugaauauauugauuccaauuagcugaggugauaugcauaugugugguuagaagacaaagagcuuugcauuuucuauccacaccaguuaaaaaauaacuuuuuaaaaucuguuuugaguauagaaagacacuccaauuguuuguagagcaggagagguuuacuguauuaauuuuugagguaagugugggucuauguaggugaggguauaaaagcugaguugugugcaugcauauguguguguaugugugcgcuuugaaauaaucuugugugagagugguuaggggcacuauugcuguaauaaaacaccaugaccaaaagcaucuugaggaggaaaggguuuauuuggcuuacacuuccacaucacaguccaucccugaggaagucagagcagugagauggaggcaggagcugaugcagaggccauggagaggugcugcuuacuggcuugcuuggccugcauucauauagaacccagggccaagaucucacugguggcaccacccacaaugggcugagcccuuccccaucaaucacuaauuggaaaaagaaugcucuaugggcuugccuaugauacaaucuuagggaggcauuuuauuaauugaggauccugccucuccgaugagaggaucucaaguagucaucaaauuaaccagcauguguguugugugcauguuuguuuguauauuuguguguguguacgauguacauggccagagucugaagucugucgucuuccucaauugagccccaccuacuguaucgagacagagcucuuacuugaacccagagcuugcuggacugauuagacuggcuauccagcuugagcucccacgucuccucuuuucggguguuggcauuccggaugggcugccaugcuugccuggcauuuacagggugcugggaacccaaacugauccucacacuugcaugcuaaucacuuucuucacagagcccucugcuggggcccacacuuuuauuuuguauuuucugagaugauuuauguagcucaaacucauaauccuucugucuccuccuguauagggcugucacucaucagugagguauuuccuuuuauuuuuauguauguuuagccagagucucacuauguaacuauagauggccuggaacucacuauacauauagggcugaccuugaauuuacaaagaucuccauuccucugccuccacacaaaugcugggaucaaaagugugggucaccacaugcuacccagauuuuagauguuugagacagagucucucagccaggaggauuugcagcucuguguggaauggccuugaguuagaauccucagguuuuugcuucccuagugacagguauuccccauuaugccuaacuuggaauucuuuguguuuguaagaacuguggguuauuugcuauguccauauuucuuacaucaagaugcacacauuaucuaaccuacaagaugagaagagacagggagaaaugaaaugcccaccaguguuaaagccagaggaggaaaguccaagugcuaagaugcugcuuuguggccucuuuucaauguuuggagcaauuuauuuguuuuuggaacacaguuuuagauaauuuggcucucaguuucuaaccauggugauaaguuggaaguacauagagagcuuaaaguuuguacaaauuaucaccagcccgauaguuuggaagaaauagaaaaaaccuuuauaaugcagguaaaggaaaaauugagaugggacggacacuuggacuaaggaagaaaugaaggcauugauaguauuguguuuagugauuuauugugauaguccugggugcuggagauugaacccagguccucugcaagaagacuugugcuuacuguguguguguaugugugugugcacucgcacacacaggucagaggucggcuugcaggaguugguucucuccuuacaccuuguggggcuuggagaugaaaaucagauucucagucuaagaggcaagugccuuuacccacugagccaucguaaaugaaaaagacagcuuuugaauauugagcacaaugcuuuuuauucucuguuucugggaugcaagcuuugacugcggcuguuguuagcugugccguguugguaccaaugaauauuucagccccugguuauucauucauucauucauuuauuuauuuuugagacauugccuuuuagcucaggcuagccuugggccuauugccaucccucuuguucagcauguuuacuaguaugauuucaggcaugaggacuacaccuggcuguaaguaggauggcugagaucaagcaaaaauaucgcucacaauuuuugcuuaggugaaaggaaguugaauauuuuuggggcaagggugaagggacuggacaaugcucuacuguugcacauacccuugaauaggaucauugugagcggacaucuuauuucaacaucucuuguuuccuugagggucagacauguuuagggaaucugaucacuuuaccaaaaacagcacaguccgagauuauugugacuaguguguuuuagguuuucugacacagucacuguaugugcagcuuaaacauccacguguacacauauggauuguuggauguguggaggagugaauuuaaacguagaauucagcaagcuggggaugaaaaggugguaaacucugcucucugggauucccaccccggcacacuuccuggccacagaauuauuaauuccuaauucuguucuucuccagaacuucuucuccggaaguauuuauaguagugguggaguagaucuguauuuaaacaguuuagcuuucuacaguauaaaguugauuugaaaauauugugcuauuacaaauuacuauacaaacucagguauggucuuuuacuuuaguuuguucuaguuuuggagacaggcugucacauagacucggugaccugaacgaauuauacagugacaguugacuaugaacuccugauuauucuuccucucccuuugccaagugcuaggauuacuguacccccgccacaccucccugguuugguucuuuugagacagagucucacuguguaauccuggcuugccuaaaacuauguauguaggucuguuuggccucaaaccagugcuuaccuuccuucucagccucagccuagaauuugaucuccgggaacccaaagaugcaucguuuucucaguuuucuccucggaucuuuucucuuguguaaccaggaggaugcuucgcuuacuaauucugaaagccuccagguuaauuguucccugcuguauaaacacacacacacacauucaagggugacuggaggauaggaaucuguccucagaacgcgauugguuuaggucuuucuguuagagucauguuguagaaagaacauuuccaaccagucucguuugugcuuugguuaccacuugauugugucagcccuugucaguguguucugugucugaaccaaaacacacuucuuugugggcauuuggaauaagaaagaguuugcuuuguuacaaccugccucaaccugaguuugcugauguuuccuuauauauaaccuccucacuggggaggcagaggcaagagaccagaaguuuaaggcuaacuugugcuacuggagacugccccagaaaacgucaaacaguaauaaaacccaaacaaaaaaauacgaaacaaacaaacaaacaaccucacuaguucaaagaacucagacauccuuguaguuuuaacuugaguuuuagugugagugaguggaagggaaagugaguucacuuucucuucuuccagugugcuguggauugcugucagccucuaaauccuggacauacugggcaggauuuccucugagcaagugcugcauuuuuaauuuuauaaaguucacauaccuuucuuuuaaaagaaaggauuaauauggauuaauaugugguuggacauguggguugggccccagaguugugccucucaugggugugacagcaugaugugacucagugggaaguggggguggcuuucugugcucagcugcaaauggagagcaaaguaugggugggggcuuuguguaacuuuuggagcggcuuguauguuuaguuuguaaaugguuaguaagauagcaugugcuaacucuaaguuaugccucagggaucauguuuuguaugugaaaugccuugugcaucugggcuuucgauguagguaaucagaagcguguggaacacuucacuagcuuguuguagagccugguccccaaaacugcaaagcuggugguugaauuccucuuccuagacaagagcuccaccacugagcuccauccucagcccucugccguucaagacaggucuugcucuucaucucaggcuggccuccuuccuggccuugggaugacggacaugcaccgccacacccaacugagcaugcucuuugaccuguacuuuuccucacacugaucacacguguaacagaugcucauucuuagccuggcauaccagucaacaucuugagcaguucccacuuuucugcaguuaauggagaacucggagauuaaauguucauugcaggucauugggauugcuuauaagaggccagaaagauagggaaauuugucuauagguccgagguuucucucacacugagagaugguuaugaaugcaugagaucuuaaguuaccuuuacauauauuuuaaaaaagauuuauuuauuuauuauauguaaguacacuguaccugucuucagacacccccaagaaggcaucagaucucauuacagaugguugugagccaccauaucguugcuggaauuugaacucaggaccguuggaagagcagucagugcucuuaaccaccgagcguucucuccagccuuaucuuuacaucuugaugagugcuaagagagauuagcuguagucuagaguggacaauaaaguaaguuauuuagguagagaauucaggggguggaaauauucuuuccagcauaagcauacuucugacuguccauauuuuuuucuuaaaauugguuuuauuauuguguucccaugccucuugugcucccagacagagcauggcaaagguguggagacgagagggcaguuucuccaccuugggaucugggagacugagcucagguggucaggcuugugugaagccuuuucuucacugacucuucuugcuggcuuuuuuauguuuuucacuugaugguuguuucuugcuucuuuuuugguuuuucgagacaggguuucucugcauagcccuggcuguccuggaacucaccuuguagaccaggcuagccuggaacucagaaauccgccugccucugccucccgaaugcugggauuaaagacaugagccaccuggcuuguuucuugcuuuuaaagggagaugucugacuaaguuauucaaauauaugauuuagcugggaggguggccuuggcccugagugggaggagacagguagggaacgcucuggggcuggguuugagaugaauguugaucugaguugcuaucuauagugggaguccuugagggacagccaaggguucagguaagcucaggcagucccugcagacuuugagaaguggcagcuguccuuggugucugugggcacucaaggagcagaugcaauggucacuucuaggcugauguuuccuaagccuauacuuugaagaccuuuuuuguuuuuuguuuuguuuuguuuuguuuauaaguuugagauggauuuaggcuacucucuuguuuucuuuaaauaaguauuguacaaagacuuggaauuuucucaauuccaaacuagucuccuuccugccuucauuuaguuugucugucuggaucagaacauugcaucaguggggccaacccccagcuccuaugaucccucacuuuaccauguugguucucugcccacuuccuccugucaucuuuugucaguacccuuuggucaccuuucccaagguugacugaagccaagcucauucagcccacauggggaccacuucauugucaucuaguuggccucuuuuuccucauaaccuucugcacaaaauucuacuguaaagggcgacauacauccugagcagauguguguguaagugagggccauuuuguuuaggcuuggccagcugagcuagacuucuuggaagaauuggagucagggugugucagccugggagccaguccugaaucacugugcaugugauuuaacuaagaguccagaaagcauggacauugagcugugugauaagcuagauaauucugugguuguaucacuuucuuuuccuuccuuccuuccuuccuuccuuccuuccuuccuuccuuccuuccuuccucccucccucccucccucccucucucucucucucucucucccucucucucucauuuuauuuauuuuuuagagaguaccuccucugcucaggugaggcagaauccuagagcagggucuuugagaugggccccuugggugugaaaggauuucagaacaauucagagugaaacacaauuaccuuagucauaggguauaaugucaaguuuagaaauuuaaaguaaauuuaaaauuuugaaaacgugagcuaauuuaccuuuaaaauuuuuucuucaaaaaugaaagagaaauauuuuuauuuuaaguguaugagugcuuugucugcauggacauaugggcaucauacacaugucugguaccuacagaggccagaugagaucaccugaaacuggaguuacagacaacugugauccuccgagucugaacuuguuggggaaccaagaacuaugcaagagccccaaagucucuugacuguugagucaucucugcagacccuagaggaauuuucauuuguaaacaaaguauugagguggguuuaugaggugccugauuuagauuccugaugaaagagugguaauaaguugaucucccggccacaaacauccugacccaggguugucgugcuuauugcuguuaaugucuuaagaacaaacacuguuuguuauaacuuugauuuuuuuuuuuaagguugggucaagguuucuaauaaggcaguuccuggggugggcggcuucuuucuauuccugcauccccuucaucuuuccuaauuuccucacauuauuugcuaucuuguuugcagcuuuuauuacuuaaaaaucuaacuuuauguguauuucuguauaccacuugagugccuacuacaaaggccuuuggaucccuucucuuggaacaggaguucaagaagguuauaagccaccagauuggcaccgagaaaaucccucccuggcugaaccaccucuuuugccucuuuuuauuauuauuauuauuauuauuauuauuauuauuauuauuauuauuauuaguuguuguuguuuuucgagauggggcuucuauguauagcccuggcuguccuggaacucacuuuguagaccaggcuguccucaaacucagaaauccgccugccucugcauccugagugcugggauuaaaggcgugugccaccaugcccggcgaaagccacgcuuuuggaagaaucagcccuacacuuauuuggcugaauggaccaacaccuagggcugagacauucucauugacuucuguguaccaccccaguuguccuugacgauguaugguuuccuuugugaggucaugaaugacauuaucagcaagacaagcagugcuaccagcccaggucaaaccauccacggcagucacauccaauggaccaccaggcuucugucuauaaggguaggcacgcccauuguuuagguaaauaaaacugggacucuaaucucugucuuguugaucaaaguaacugucugauagcaggcugucucaggguccccaggaguucucuuguugagacagucaccccuaugaacaguuagugucucaggaccuuaaacaacguaagcugugugacaaaugggugccugcauuggugugguuuugacuuuuaaagaagauaaaguuuagccuaaggguaacugaauauuugacuuccuuaaccaggaaacacaguuugagcaaaaguggaugguuauguagggaaagugucaaugguggcagaugaagacccagcucugcaucacugcucggagcagcccgggaaguucucucaugccuuuagagauccugacucagggucagguuggcguagguuucauggcuuugaccagagaaguauuuuagucuaagucuguuggaauuuauuaaaaauagaaaagugcuauuagaaagaacuaggagcagggaugugcuugucucaaucaagacuuaguuuacaaaaagacauucuucauggauuucucagaggacaagggagagaagcacagacaauggacaagaaccauccaaguauaggaucuuuaaggaugaggugcacagugucucuugccaguagcuguuuguacuauuuuggugccucucaacuucacucucaaaggauugcuaagaaaccuguuucuucuccucucccacuucucucuguguccuucuccuucuccuuuaccucucugauaaaccagauuguagacuggcucuagagguuccuugcacaggauuagagcuuacagugaaacccaagggaccgugcaaggaagucaggacaggcccuucuacugugaguguguuuggguugagauuucuagaaaacugcagauuuaccgcuagagaaggaugcucuuaagcaaauauuggucaggaaucuugguaaucugaaugcugaagagcuucgucagcccuucuuagggaagggcuccuuucccuucugucccuugguuuuuccuauucuuguaacaacaaagauaguaaaggagagcccuccaauaucaggguaguuauggaaaauaguuucuuggguaagaauguuaauaauaauaauaauaauaaugaugaugaugaugaugauaaugcaaccccauguuggaguuuuggaguuugaagaagaucagaaaggaaaaauaaaagaaaugccagcuucuauuaguguauaauuuauaauauuccaaaaugaguucuguauagaaucuaguuaccaacucuacugcaauucuuuaauuuaggagaguagaacugauauuuuacaucuaauauggaacccaacgggggcuggagagauggcucagagguuaagagcauugucuacucuuccagagguccugaguucaaaccccagcaaccacaugguggcucacaaccaucugugauggguccugauccaccuucugguguggcugacaguguccucacauaaaaaaauaaaucauaaaauaaaucuuuaaaaaauauggaacccaacaugcaacuauaauuuauauugauaauuuuuuuuuuguauucuaaguuagaagugccuuuaaacuuagcaagcucuuaaguuccguauuagucaggcacaagugacguguucugacaggucugaucgcuacccauucuugaaaauagaguaauagcuccuuucuaagagguuggguguguuagcagcuuuugugaauggaaggagaaagguuuaggcaguucaaauuauuugcucuuaaguuaaaaaaaaauguucacauaauguuaucguuuuauguuugacagaauaaagguagaccagagaauuuugaugggauucuuaugccuugcaagggcuuuggcuucuaaagaagucagaaaauauuuuuaaaucccuaugaacagaacuugaaaaaaaaguccaaucaauccaguaguagaaaagaggggagaagaaagcaagcccucacacaauacagcacuuuauuuagcaauacccugugagcacaaaggagcuuucuccuugccucugcuggccugucacuggcuacaggaaaaccuccccccuuuucuuguccccucuucucccccucuaaacuccacuaacaaaaggaguuacagcagguuaaguuaucauucugcuagaggaccagggccuggcaucuguucccuuccuaucuguaaaguguccacuguuuuagcgaaggaaaucuuagugucucagcguucggcuucugugagaguuacaucaagaagggagaacuucagaaaguuguccccgaguuugaauugaaccuaaggcccaaggaccugaaguaggccucugguuuauuguccuguucaaugacccaggacucccaccggcuucccuuguggagaggauuagcuggggaacaaauucgcaaguacagcuuguaguuuugucaaaucuacaacgacauuucuuuucacagcucucuugacuuuauacuguuuaaauacccccaguugucucuuaauuugcauuucuuucuuuaauuccugucagcucugaauguaacguuuacauaaucaauuuccugucuuuuuuuuuuuuuuuuuugaguuaaugcucuuggauuaugguauacccauugucaugucaggaaucuucuuauuuuauguuuccuugucuacuuuaagauauuuucauaagcugugcaguguuuuaugauuaagauuguuaagcaauuaaauuaacuuuuucuuuucuuuuuuccuuugcaggcugagcaauggcguuucaaaaggcagugaaggggacuauucuuguggguggaggagcucuggccacuguuuugggacucucuccguuugcucauuacagaaggaagcaagugaguaguaacugcgacgaagcagggaugcugucucugugugcucauggcugugcacgaacuacucuuaaaauuccuguuagguugagagauccucagaaugaugcaguaugauacccacgaacuuugaguaccucguguuuuagagugagaaugucuucucaaaagacuccauuuggcuccuugauuuuuaaagacugccucauuuauuugugccaggguuuguucauuuagaccuuacuuuguccaguccauugagaugcccgggugcuuuuuucacacuugccaaguuuguccucuuagaaggcaggagucugggaaagaaagugaaaaagcaaaggcccaauuuugcugucugguuauauuuuuucccuuccuuccuuccuuccuuccuuccuuccuuccuuccuuccuuccuuccucccucccucccuuccuucccucccuuccuuccuucugccuaucuccaucucucuuucucucucucucucucucucucugccuuucuuuguccccuugucuucauccuuuccuuccuuccucuguucguucuuuccuucuuucucucugaaucccucuuccuucuucugacagguucucaguuuuggcugacccagaacucaguauguugaucaggcuguccuugaacucacagagauccaccuccgccuuugccuuugagauggaauuaaggcacguaucacuaggccuuuauauguccuaaggguuugguuacuuaugcagcaaguacauuaucucagguaaggaggaugauucagugaggggcaccaccacaccggugggauugauaugaacauucugagaacaguguuuaguuuccuuuuaguucucccuguguaccacaaccauggguugaggucaggaaaugaucucauggcaagacuuuguacucuuuggccuugagaugccauaguuagcuuuggucuccuguuucuuuccuccuaggcugucugggcaguucaguucugcuuccagaggagaguggaggagguccggugaugaagcaacaguucuucaccauuucuguggcugccuuuuaagccacagguuucccugcacuaguucuuccugugucuuuguguuagaagaugguagaaucaggcguauugcuuggaaguuucuacccuaauugagaaauugccuuauacuuagagugaauaagagccuccgauugauuuauuuauuuauuuauuuauuuauuuauuuauuugagacagacuggguuuuuacucuguaagccugacuggcuuggaacucagacagaucauuguuaacuugauuuuuuucugugcacagaaaucucaacaaacgcaggcgaguggaucucuugaguucaagaccagucugaucuauaauagugaguuccaggacagccaggccuaaauagugagugagucagggggaaggaguaaaaggggaaaggggaaggaaggaagggagaaauaaagagaagaaaaggaagcagaauauaaucagacagggauuauaggccuggccacuauaccugguccagacccggaggcucauuuuuuguuuuuauuuccuaaauagagguacugagcgucacccuuucuuuauucugaaccgugggcaccggaccccagggcuucccaggguguguguguguguguguguguguguggcccacguuuacugucuagcuauugacucccuucucaucuguucauuguauuugaugcacuuucuugucaaaagaugugucggauucuugagagcaaaugugagagaagcugcuucugcugaggcuguuucacggguucggggcgugagcguuagggauaagauuccuucuccucucuccccagcucugugauaucucaacugaaacugggaaaugccagugccaaaggucaugauaucuaauagguguugcuaaauucguauguggcuuauaucuuuuaaccauaguaagcauguuuuacuaugaaguuuauggcuuaauuuuauacuuaaguauuaaugguuucaucuuucgaaaaucugauuuuuuuuuuuaaacaacugaucucacagaguaaacuugauagugcuuuggagcagcugaguuagggcuggagaaaaucaaaacacaguaaggaccgccugauuucuagagcauuugucacuucaucucaaguuaggcacuacccuaauagcacggugaaauagauaccagcagcuuggagucauuuauaaaaagaaacugacagguucucggcaugggggugggggugggggaccaccauggucauauuccagucagugaguugcauaggaaauccaacugcauuuuuacucacucgugucccuuuaagacacuacuuuaagcuuauauuugagagaggguagcuaagugugcuguagccagaaggguuaagcaaaaaaaaaaaaaaaaagacaaccuccacagagagaaggaacauaaaaucuccccccugaaauacaguucucuucccccacacaguaugcacccguuagagccacggguuguguagggaugauggugacugaguuccaguuuguuuguuuuuuuuaaugagacucgugaauggcccacgguuuugaaaggaccuugaacaugcuccauuuuucugcugauggcuuguggugaaaaguuuugccuuguuauucagguguggucaucugcuguucccccugcucgggccugauuuuuuaagaugguucauacuggaaguuugcugucuucuaggcauaaaucagaaggcugggugcgauggagcacaugugaggcucuaagccuagcacacgugaggcugaggcaggaggaucucugugaguucgaggccagcacgaucuauauaaccacuuccagggcaaccagaacuagaauuaguuacguaaugagacaccccccccccccaaucucaggaaaggaagggagggaggggagggagggagggagggagggaggaaggaaggaaggaaggaaggaaggaaggaagaagguagagaggaagaaguguagagggcacuuuuauccccugacgucauuguaguccagaggcuuucugcuuaucuucucuaggcccagaguguuuccauccagccucugagacuuagugcucaguaagcuccucguuuccaguucuuucugagcucuggcuggcugguucaacauaguuaucauggcucgaauuccucuccgagccgucugauggacuguagcgucucucaguaucuuccugaauugcucugcuuggucucauucuaacuuuugccaucuguuugguucuucugacuccuccuuguuaucuggauuguucuguccuuaccagugucuaacuuguucucucuccaaccugucucucugagacaaucccggcaaaacugccucuuucuucccucccuuugcucugccucgcuuaaguagccucuucucucuuccuguaagaguugggcagauccuguugugucaaaucuuucucugauucaucacuuugccucucauuuagacaucacuuucaaacauggugcuucuacaaacuaccuuuaccucauuguuugggauuaaaggggugcacuaauggcucugugugugcgccuguaugcgugugugcaugugugcgugcgugcuugcauguguguguguacacaucacaacuagaaacuuuuuuuccaguaaauaacacaaucucaggguucacugugugaucaaauauccugcaguaaaguagaauaaguugguguugaagaaccuucacguagugguauccucagccuccacauagugguguccuagggaacugugcauauauuguaucuuccucuccugcugguaguauucaccugguuaagcucuacuuaaaauuuaucuuucuucuuucuuuaaauuuuuuucugucugguauuuuaucacaauuaguacaaauacaaauuuagcaaugcauuucaaaaacucaguuuaaauuugguuacugugguugaaugaccuuucacaaaguauuuuuucucuuguggugcuaaggagugcauccagggccuuguacauuaggcaagugcacccugaaaucccccagaacauauuuguugaaauaaaugccguaggcagcugaccauagcuccacaguaggguucuaaagucaguuccaccauuaaauaccucagucaauuaaugaaaugucauuggaacaucacacauauauuuauuaaaaacauauuaggaacaaagucaauguaaaaauauaaauuuauauagacuauguuuucugauuaugcuucuuuaacuauaacuaguaaagugaagcagcuaacauuauacuuuaaaaacacaauaaacaaucuaaugaagaucaccuguaucauacuuaggcaugcagauaacuucagaccuaccauaaaguuguacacaugcauggcuacagcaguaacacaagcauaacugcucaggacuugggacugcuauuccucuucugcuaugucagucucagaacagagggcacagugcugcauuagggcagcaaacaaaggcauccccucccgacucagacaacugcuccagggaagccacagaaggguccuggucguuuaacauggcuggcgguuguaaagucuugucuugaaugcgugaaugucucccugguggcagguacuuuagcucuuuaaauggggacuuuuuaucauguugcgucuuuuucauacuuuguaaccgugauggagaagauacauuguaucgaauugggcaaccugcuucaguuuuugagucagggguuguuaaauaguuggcugggucuuuuguugucuugauccucuuuauaaaccucaacuuuuccaugauguucauccuccucuucugguuuuccugacccuagauuagcuuccacauuuacuucuugaagauguuccuuggcuacacgagccuccucaauauuuucuccuaaacugacuuuuucuuguuguuagaaugucuaugauuauaugucgcauguuuucaauaggcugagccccugacagaauggccuucucauagacugagauaauauuuucaauaggacuugugauugguucaauacauacaagacauauccaauauuuaacaaguguuuuuuuuuuuuuuuuuuuuuuuugcaucuggaauauuaugaaucaggucauucaauguagcuaaauuuucuucuuuugggcaccccuuauuaaugagguucaggcauucagaaauaguuuauuuuuucaguaaauaaucucuguucaucuucuucugccaugguaggccaaaaggacccagcuggguuuucauuuugcgccguuggcucggccugggugacuacugaaaugaggaggucgcuuuggccccuuuccuuuugccaguucuccucugggucaucugagcuugccucucugcuguggugucuuugagcugagcugaucgaugaacaguugcuccugcaaucguguaucugugcugguguccugacuuuaccaucagccugguauugacagaucagcccugguugcgucuuuccguguugugcuucuugaugggccuugucucuuuuucguguccugagaggaacugguuuucacaacagacacaacugguucugaucgacgugauuccuucucuuucuuuucuuuuuuuucuuuuucaauuuuuauuagauauuuucuucauuuacauuucaaaugcuauccugaaaguccccuauacccgcccccuaguguuccccaguacuggggcauauaaaguuugcaauaccaaggggccucucuucccauugauggccaacgaggccaucuucuuuuuuuuuuuuuuuuuuuuuuuaaagagagaguuuuuuuuuuaagauuuauuuauuuauuuauuauguaaguacacuguagcuguccucagacacuccagucagaucucguuacagaugguugugagucaccaugugguugcugggauuugaacuccugaccuucggaagagcaguugggugcucuuacccacugagccaucucaccagcccccgaggccaucuucugcuacauauucagcuagagucaagagcuccggggguacugguuaguucauauuguuguuccaccuauaggguugcaguucccuuuagcucuuuggggacuuucucuagcuccuccauugggagcccugugauccauccaauagcugacugugagcauccacuucuguguuugccaggcacuggcauagccucaccagagacagcuauaucaggguccuuucagcaaaaucuugcuggcauauucacuagugccugcguuugggggcugguugugggauggauccccagguggggcagucucuggaugguccauccuuucgucuuaguuccaaacuuugucucugcagcuccuuccauggguauuuuauucccuauucuagggaggaaugaaguauccucggauuggucuuucuucuucuugauuuucuuguguuuugcaaauuguaucuuggguauucuaaguuucugggcuaauauccgcuuaucagugagugcauaucauguguguucuuuucugauugagaggauaucaggaugauauccuccagaugcauccauuuuccuaagaauuucaugaauucauuguuuuuaauugcugaguaguacuccauuguguaaaugcaccacauugucuguauccauuccucuguugagggacaucuggguucuuuccagcuucuggcuauuauaaauaaggcgcaagugacccuuuuuugacuguaacauuggcaaggggcccgcugaggcccuguuugaagugcuguggguacuacuguggaggcuucggguagguggucguacaaguguguucuuggacacagugcucacagauguaaugucugcagacuugguggcacccggugcauuugaggguuuuacacugauguucucaggcucaaacugagccuuccuggcuuuagacacaguagugggagguuucuugauuguugcaagacucucgccuuugacacugggaagcuuucuaaaugaauuaaucuuagacugaacaaucuggccaugauaauagccaagcacucauguuuuuagacauguucgugucuuguuuaggcugcucugcagucauuuguaucuuauugucuuuauagugacaugccugguauguuacagucugaccugggaaaucaucucucauuaauaauaacugcacagcuuaaauauuauccuucaaguuauguauuucugagcugguuacuucuccagcuuuuaauggaaugcaguaguuuucaacuguacuuccaauauuuucuucaucagccacuucugcuuugaguuucacaacuuuuuucccuucuugggccugauccucagaagucaucauuuucugaucucuggagagcugauuuucugguuuguauggaaacacuguuuuucguguuaacagauauuccuugaggucuuguuuucuuuguuagaauuagguugggugagaaaguuuuccauauucuugcugcagaccuuucaacuccaguuuucuuagacauccaggacaucaugcaaacagccccagccucaccucugaaggcuggcuggucuugcuuggucgggggaaagcugaagauccuggugcaccugcaagguauuuauuccucacagcccugccaaggccucuuuuuaaaauuuaauuauuguuccuguuguacugggaauuaaucccagagucucacacacugcagacaagcauucuaccacugcaucauuccaucaguguguaauuuuuuagggauagguuaauugugauuuuuuuuuuuaauuuuuuaauuuuuuuaguacagguguguguguguggggggggugggcuuaaugauaaauuuuuagcugaaaaggcguuaaaugacaucguacccagccuaacacuggagagaaagaggcaccuucuuuugggaggcucuccuucaucugauuccaggcugcucauaaguggagugagagaaauggguaguugagagagggagccggggagcacuuccagaguaagguuaugaaagcagaauuggcgagaggggagcaauuuccugguagcucuaggaagaacagguggccauggagaauggaaaggcugagauaugacaaguuagccagcgacuacucuagucucuucucauguuaggacaaaagcaauuuuuuuguugguuuaaagaaaaauaauuaacuuaucauucacaccauuaagguaugaacuggaaaaacugaugugaugguguggucuucucucuaaccgaccugugguugauuuaacagaucuguuuagcugcgaggggccccucuugggugacaugcuauguuuguucuuuccauuacucacucuggaguugcagugggcuuugugaacucacccagaggugaaauagacuggacccuccccuccccaccccuccccucuccuccccuucccuucccucucuuccucuucucuccuuccuuuccccccuuuuuucuuuccuucuuucuuuccuucccucccuuccuccucuuccuccuccuccuccuccuucucucucucucucucucucucucucucucucucucucucccuccaacccccauccuuugcaucaaacaaaucaaggagugggcuuuggaaauaggggucuguuuagugugaggaguggucuuauaaggagauggggaacauggagauucugcugaugaaucugucuuccccagaugaguguaugcgaaguaaucccugcagccucauucagcuugcccgccuccaguacugcugucuugacagauuagcgauuguagacagcuuuccugagucuuaaccuuguucuucuuccugaaacaaugaauguagcagugguauaauucuuacaugacugaaaagcaaaggcauguacggguaauugaaguccacaaggauguucagagcacuguuuuaacuuguauuucagacuuucccuuccagugagcuauuuguaaaguugcgaaaaagcagugccuucuuauugguagaauggaaacaaaggguuacucccccuuuuuuucuuuugucaguagcaaaagacaaaauuggagaagugcaaaaagauaggaugaucaacacuacucaaaauaagucuuuuauuuuguucuuuuccuuuugaaacugggucucauucuguagcccagucuggucuggaauccuugugcccuggcucgcucagcacugcauucaaaggccagagcgacccagacucugguagcagcuuaccuaucaagugcaacugggggguggggccacuuguugcugugcacaagguaugaacaucuugagacuuggaucuuucuuucuucccucccucccucccucccucccucccucccucccucccucccucccuuccucccuucucucucucucucucucucucucugucucuuucuuucuuucuuucuuucuuucuuucuuucuuucuuucuuucuuucuuucuuucuuucuuucuuucuuucuuucuuucuuucuuucuuucuuucuuucuuucuuucuucagacucaccagaagggagggucagaucucauuacggaugguugugagccaccaugugguugcuggaauuugaacucaguaccuucggaagagcagucagugcuucuaacugcugagccaucucuccagcccccuggauuuuuucaauauaagaaggauaaggacuuuuugucucagucuuuccccuucuaagcucuuaguccaaccaaaaagaccagcgaucuggcaggcaguagguucuuagcuggucugaacagaccaguaaucuggcacacuaaugugguccuuagauucacaugcacccccuuuccucuucucaacauuggagccuugcauuuggaacacaccuggguuuuuuaggcauaagaagauggaacaccaaacuuaaaaauaauugacugguuuauguauuuuugccuauguuaauaacugaagugagagaagacagguacauuagauagguuucuggcaacauuuaaauuaaaaaguuguaccuacuugccuugcuguuuuacggcaagcaucucugaauaucacucugccucucaagcacucucaacaucaugaagagcugaacugcagugggugaagcucuccaaucugagaguacuuggggucuagagucaaccaaaauguucacucguguguuaccucuguuugccauauggccuugaacuugugaccacaccuguccccuaagguaaauagucccccacuuacagaggcauuuuacauaguuugcaagcagccuuucucuuuaaaagucugacuauaaacaguaaaaacaaaauuuccuagguggggguaauagguagaggcacaaagaucagaaguucaaggucaaccuugaauguagaauuccuucagcaauaccucucuguguuauaguucaggguccuauuggccacuauuguuucauuauuuuagauuccacauaugaguucauguaggcucauguucucuagguaggccuagcuuaucaccuuaucauaacagguuaauugaggcugucaaucauagugcuuucuuuucuuuucuuccuuucuuucuuucuuucuuucuuucuuucuuucuuucuuucuuucuuucuuucuuucuucuuucucuuuuuaaggacuuauuuauuuuacuuauaugaguacauuguagcugucuucagacacaccagaagagggcgucagaucccauuauagaugguugugagccaccaugugguugcugggaauugaacucaggaccucuggaagagcagucauugcucuuaaccucugagccaucucuccagcccucuucuucuuucuuaauuuaauuuuauuuuuuuacagucuaguuguuauccccucccgguccgcccucccacaguucuacaucccaugccuccucccccugucuccgagaggaugugcuccccaaacccugucaggucuccccacucccugggaccucaaaguucuggggggguuaagugcuucuucccucagcgaggccagaccacacagcccucuccuguauaugugucgagguccucaccagcuauuguaugcugucugguugaugcuuuccuuuuuuuuuuaaaguagaauauuucauaguauauguaacuuguguuuuucuacaaaggugagguaucacacacuagggaaaguuucagaaugauauacuguauaugaaguagguaaguugaauuuuugucugccaaacaggguuuuuguuuuguuuuguuuuuuucuuuuuuuggcuuuuuugagacaggguuccucuguauagcccuggcuguccuggaauucacucuguagaccaggcuggccuugaccucagaaaucugccugccucugccucccaagugccgggauuaaaggcgugcgccaccacugccuagcaugccaaaacagguuuuaaaguuguauuuuaaaaauauuuuauggguaugagugcuuccucuguacuacacacaugccugagaugcacagaggcuagaagagggagcuggaguuuccagaauuggaguuauagaugguuugaaauguacacaugggugcugggaaccgaauccagguucuuugcaagagcaaaaggugcucuuagcugcugaaucaucucuucuccagcccccuuaacaguugaaugucaaccccauaggugaauugcugggauauggaagccagucacucuaacaagcaagcgacaaacucagggcuuacagcgaggguuucuuacugcccuuagcaaucagcauggggaggcgagggacccauuucuucuaugguucaggggcuuguuaccuguaaggcuuuccugccugcagccccauuucucuggaagaagagaaucauguuaagcauccagccauuacauguguccugaaugucauuuuuuaucuggcugacuaaugagcuguuucuuauaaugagaguuuuauuguuagggcuuauaccaaaaacauucaucauucauuggguucuccuauuuagaacccuuugcauagauuccuggaaagacugguuuguuuuuuuuuuuuuuuuuuuuuuuuuuguccuccuagaaauacaacuaaguguguugggaaugugccugguaucgaaagcuagaugaggauucgaaauacuuuguauuuuagauaaggccaguugaaacuauucuuaaccacucucuaugguuaaacugugucuuaugagacacacuccaucaaagcucugaaauuaugcaggcagagcugggaaugaauguccucugaagagcauccuaucagcuucucucuaauuuugguuuuuauuuaacacuuagcccucgaaaguggggccacggcggcaacucgaaguucuaacucacacugggccuucgaggaguuugggaugcuauuuuguggcuggcauacagaaucagugagguuaacuguacuuguguaggucacccccgugagucaacggcugagcuaggauuagcgcagacagcuggugagcugcuaggcuguugcuaacugagcgccacugacauucacucugauuugacuuugcauuucauuucaacuauuuauucauuuuaaggccuuuuaaagaaacuuuuuagggauauugugggacggaggaaacuuucuauaaaugcccugggagagcccucuugcuucuguucuuuuuuuuuuuuuuucccccucccagccugauagcuacauauuuguguuuggaaagcuuucucuagguaucucccaccucccaguuuaggauaaaagauacuuuuacguuagguagacccaaucuuacccuaaucuuguuaccugagauuuuucaacaaaaacuuuccaaggucuaauuguacaauagcaugagugaaucuuacuuguauuucaugaagucuccgaagagauggagacugcaucucaugauugagcaugagguauuuugaacagaagauucaaguguagugggcuggucccuugacucagugggucaguaugauacucaucugaaagggagagggggcuagugaacaguuucagugccaggucaaugccuuagggggagcauuagggacaggugcugcuucauuugggugcucucuguggcugcccagcaugccugguugcaggcuagaaggaugugccaggauuucugaacuucacuaacugcauuggaaguucugccuuguacaaggucuuugguggugcacaccuuuaaucccaguacuugggaggcauaggcaagcauauguaugggaguucgaguccagccugaucaacauagucaauuucaggacagccagagccauucaauagagagaccguguuucaaaacaaaagcaaacaaucaacaauaacaacaaaacccaaacaaacaaacaaacaaacaaauccucauuccuuuugacaaagauguuggcugauaaggggguaauguagcagagcugacauucaauuuggaaucaaaaugaaucagguucuaaauuucaaauauaugcugaaggaauaaauaaauagauucuuuucaggucaaagaauaacuccuaggaccugggguauauuucugugguuagagagcuuuuuaauuuuauuauuacuauuacuacuauuauuauuaguuuauuuacuuauucacuuuacauccuacucacuguuccccuccuggucaccuccuccuacaauuccuccccuguccucccucuccucugagcggguggggucucccuggguaucucgacacccuggcacaucaagucucugcggcuaggcacauccuucaagagcuuuucuuacaggcuuaaaagcccugaguucaauguccuggaccacacuuuauuguuguuguuguuguuguuguuguuaguuugucuuuuuuuuuuuuuuuucuuuuugucugggcuucucugauagccuuggcuguccuggauucacuuuguagcccaggcuggauucaacagacaucucagaacucacaggaacaugcuugucucaguguccccacccaccaccccagugcugggauuaaaggcuugugccaccacucugguuuagauuuaagaaaagaaaaagaaaaauaaacaaaacaaaacagaagggaaaaaggaaaagaaaagaaauacacaaaaggauaccucuucuccucugaggggagugggagggacuuguggaucuggaggagauggguggugggagggagagacuggauagagaggaggggaaaccgcggccuggauguaauauaugaagauaauaauauuaauaauaauaguaauaauaauaauaaugccucuauguauuaaugugaugcuguugagagguggggugggcuaauagcugcuggacaggcaagaguugcaucuuuuuucccuuaccucuuuguccccucagccuuggguuuccucucuagaccuccgcuuucuuuccuuaaaacaaacacacaaucaaacaaacauuuauuuuaugugccuauaugagcgcuugcauguauguauguguuccuugugcauuccuggcacagggggaggccagggcagggguucagauccuuggaacuggaguuacaggcaguguugagcagccgugggaguccccggaaucuggguccucugcaagagcaaguggccuucacuacugaacuaucucuucaacuugcagauauucugaucccaugcaagauauuagauuugggcggcaaugucggucugaggcauccgaaccuuuacugcauuauauauuuaaagauaacuauuugaggauaguggaugacacgguagguaaaugaccuugccaugaauuccgaugaccuugggucaaucucuggaacccauauagggagagaauggacucaaaguugucuucuugucuccacuuacaugcuauguuagguacacaugugugcgugugcacgcgggcacacacacacacacacacacacacacacacacacacacacacgauaguaauacauucaauuaaaaagaagaaauuugauuauuuauugaaaacccauagguagcaucuucaaagccucugguuguuuagucacguaaguuaaugguguuaauuuauuugaauaguucagacagagccgacccuuuuucauuuuccaguaacuccccuugaaucuaacaguccaucgauggaauugcgaacuauggcggaaagugacaguuucguggaaacugggucugcaugaccuucugcucgacuacccccaaguuugguaaucgauugcagagggcucuguggcgcgucugaaaggaaucacagccccggaugggcucuacggcgccuucagggugcgcaggguccagucucagugccugggaagagcgugugcuuaucacuuuucaugcugccuacuugacagaggagacuuagggaggaggaauucacuuugacugacaguugauuaugaugagaaagaggugguucagcugccagcuccugacuccugguggugguagcuaacugagaacugcgucuggucagcgaagccaccuccggaacccacagaaccaaaacaguaccaccugcucguauccauguguccaaacacauuagccuguggggacaccacacguuuauuauguagcaacaaacuugucugguuuucuguggaaaugaguuacccuguauuagcuccugcagaguaagcaagaagcccugguagucugcuuacacugaaacgcguuguuuaacuugucauguaaauccaagaaagggcaucaauuucgcuacaagaggaucccagaagugaagagcauuccgacuucugaagauaaaccauuugaagaugcuugucacuuuuugccucuaggaacacacagauaugguuagugacagcaaaacaggaagcaauuucucuccagucuaacugauuccauugauugaauggcauaauaugggcgagcgagcgagagugauuguugccgccugaagugauuugcaugaaaccuacuuuauacuccaauuauuacuguacaugauuacaggacagccuggcuguuaauugccuguggucuuuaaauaugcacuucuuucagaaauagacacuaauuauuagaucuuguuuucggucucacccgaaguugcaaaugucuaggaauuuuuuuuuuaauuugcaagucuaauggugcuuagacauaguaaaacugaucucacuggggauccuguucaggggaaaugcuuucuuggcaacuacagauuaugaacuuggcuuccaauucuagguagacgcaagugucugucuuuuuaaaaggugauauuucauuuuuuauuuugugcccacauuugacuauccacacauacaugcaaaugcccucugaaaccagaguccgauagauucaccuccagcuggaaauaccuggagauuugagccgccuaauguuugugcugggauccaaacuugggucuucugcaagaucaguauguacgcuuacccacugaggucucuccaaacccuguggaugucucucauaauacuggagggauuucuuuuauuuuuccucgugguacugggcauuggaucuaggguguucacaugucagucaagaccucaaccacugaguuacagcccaaagcucacuuuuaagacaggaucugaacaaguugcccaugguggccuugaacuuucuauccugccuccccaguaggcaggacuauagacccuugguuucaguggugagguuaagccugauuugaauaguguacugacaggaaagagcagacuuggguauauucuagacuuaguacaugcgguacccgcuuccuuuccuagugucuuccagcugauguccacuacucuugauuuagcuggccuuccucuggccuuccuagggaagcuuggccaggauuuaugagauaccuuccgggacugccuuuccucccuuccucccuuccuuccuuccuuccuuccuuccuuccuuccuuccuuccuuccuuccuuccuuccuuccuuccucuauaacuaugcuguuccugaacucucuauagcuggcuauggccuuggacuacugauucucuugccuccauuaaaugaguguugggauugcaggcaugugcuacucuaccuguuucauguaguauuggggauugaacgccauccccaggugagcacugcucugacuugaucacacacacacacacacacacacaaacacacacacacacacacacacaguccccugugacuuuuagccccuucucugccuuaaauacccugcaaguaauauuauaauugccaccuuauccuuuugucuccuacucuauggaaugcuugggggacuucucaauauagugauuuguugagugaguggugcugagcccagcaucugcagaucccaugagcauuaggacauuuuagaugcauccauccgcaaagcucaccucccacauuccugucuaauuacacuguccgcuuggaaaaggagacccaggaaaggacagauccgacaggaguggcgcacaaagacccuuucuuaaagacugccauuacuuaccaauaaugcuuuauuaucucuaauuccuccccccuccuuuauuucccugaaaucaacauauucuagagaagguagagugcagauguauuuuuguaacucaaagccauaugaaagccaaaaugagucuuucuccugucauaauucuaaguagggccuuaggcuguguuuacugccucuaaaauaagcaugggugcuuugcuucucaguugcaacacuuuccagcuuuuucgaaagaaauaaacaaaaauaaaacguuauuuuaaaauaccgucagaaauuaaauaaauuacccucaauaguacuguguguguauauaaguauauauuucuaaguuggaggagcuccucaguacaacuucugcaacaauuggcacccccaccuccauauuaaaaguuuucugcaucuugucagugguauuaccucguucuguuguaacuagguagucugcuuugguauuuauuuccuuaagauucucugcacagucagcuacaguagagaagugugggacuuggucucuguucccaggcugugucgcuacaauuucaguucugcugugagcuggucacacaguuuugggauaacuuccuccucugucucaguccuggcuuccuaagaggagagcaagacacaccuggcucagguuugcucugaagauucaaugaacagaaaaaaaaaaaaagcaaacacccuauaaaaccacuuagaaccuaagugcucuaaccacaguucguuauuauuuuuaagucacuuuuauugaggugcaauuuggguaacagcuucaauguaguugagaucaagucuuuauaacacucccaguuauguaauuauaaccgcaguuaaauuacagaacguucuuucacccucaagguguuucuugugcccucuguagacaguguucucccaaggccugaaaucaccgaucuguuuuuuaaugccauacuuuguuuuuuuuuuuuuuuaacuuaacauuguuuauauagaacgaucacaaccauguaguacagagaugcccgagucuggcugcuuuugcucagcacagagauugguugguuuuucuguguguggcaagucauuguuuucaggccuguaggucacagagucacuuggugaccacacuguauucaugggcacucaugcauguauugcuuagguuugccugugcucugguagaaugugagcucacacuuuaaucugaauucgagguucauggcucuucaucacuagcucuuuguaaaaucacucacugaucauuauuccauuucagacgcauaccacaguuuagacacucaccuggcaugguggugguuaaucucaguuuucaguuagucgagaauuagaaucccucagagaugggccucugcgcaugccagugggggauuaucuugcuuagguuaauagaggacgggccacuaaaaggcaugucagccacucauagcaguugaguguuauccaaaggaaaagaggaaagagguucaaaaagcaggagaaagguuucuuggauacugagcugaguggacagucagguaugugaucacacauuggugguauugugggagccgggugccuugugaugaagcaggugauggugugguguguauguaaaaauuuagauacucaugagcuuagugggucaaugcucaagcuggauaauucagaggcuuggugaaucuuuaaaggguuuuuaggauggauguuggaaacacgagauguuggaaaccuauauuccacauauggaaacaugguuguuguuuuggaugaggucuugaggucuugcccuauaguccaggcuggccuugaguuucucauccuccuucuuccaugccucuuggggcugagaucagaggcaugcaucuaccauacuaagacgagagaaguguuuuuaauauagagagaagacaggcugagacuauucccacaaaaagucaggacccgcguagucacugcaaaugacucugcccucccaccccccacccccuacuaaaguagaagcugaguuaguucaggcuucccggugagaccagaagagggaguuugaagaauuaacacguucuaaugaacuagaccauaauauggucuuuaaacuuauuucucaacuauuucuagaaaacuuacaaggcagaaaaugucagcaauucuguugacgugugaaaacgcucuggcgguuuagucacuugucagucccauguccaaauccuucccaucugucauaguguaguucuccccuccccacagugaucauagucugccccuaccccccaccccccauguuggcauuugcuuuuucuacaaaugugguauguauguauguauguauguauguauguauguauguauguauguauacauccagacuaccucucuguguguucuauuucccuucuuguuagcugaggaagacuaaagcuauagcuagaagaguccaguccuucacagagucuagcagguguuuuuguuuuuguuuuuuuuuaauuuggcuuguuacaggaagaaacaguuauuaauacacaaauaggaagagucauaugcagaaugggauuuuuaaaaaaguuuuagcacuugaauuaauaauuuaaaaguuaacaaaucaugugaauaugaaggucaaagggcaguuuguuggagucuguucuccucuccugcauggguccuggggauugaacucagcuugucagacuuccaagacagggaggggguuuggagacucaggcuggaucccuguggcccaagacaggguuuccccaacuuccucuagacuuuuggcuuuuuuuuuuuuuuaaauauaagaaauacaacugauuugaugauaauucgaugauaggaaauaguuuuuaacugaauugaaaaaaaaucuuuaucuugaauaagaggaguaguucucauguaagagcaaugaccacagugggauaugcugauaaacacuuguaagccccagcucuuaggucaguguggugccagucuggacugcauaaacuauuccaagccaucuaagauccauucuuagaagaccugagagcuccucuucuugagcaaacuugccccugcucauucagagcuucauaggugacucauggcagagcgggagaagaaccuucauugugcugaccuugugaggccauagagaaacagaauuuguggucuuuggauaucuaauggagacacaugggccaauccucuugugauaaaugaacuuauacuacaguaagaaaaaaaaaauccagcaacucauuuuucuguauguuugugguuguggcacugugauacauacacacacacacauaucuaucacacacacacauauauaauauaacguguauguaauacauauaagauuuuuuuaaacauguuaucuucuguguaaugcaggcuggcucuaggacucaccuuugacucuagaaugccuuccugccuuuccuuuccuuuccuuuguguuggaauuguagauguuggccagcagagcggcccaauuccuuuugcuugugguuguccuggguauggaucaaagagucuuauaaauacguguaguggguugaucugaugcucucuacaacaaauacuaggcaagcacuguaaaggaaaaaaaaagcacaagcauuuuugauuugggcuguugaugaguuauguugcuaaagagccaagaaauuuaauggaauuauaccuagcuuuauuauuaaguuuucagcagucuaaauaaugugcuguaaacacaggaaaucuuuaucuuacauuuauauacuugauggggaaaaccucuuauuaaaaucuuugaaaaguauaauuuccauugagcuuaguagauuaaucuaaugaagaugcuaacuuaugcuaagcagauuucacugauuuuaaguugacaaaucaaaauuaggaucauaucuuuugucaugagaauugaacaagacauauauucuuuuaaagaaaauacacaaugguuguaauguauuauuuuccccuuucacaugguaucuauauguuaaaaucuuauccaaaugguuugaugcuacuggguaaaauacuuccuucugauuccccaaauugguuuacguagaaaguucggaguugcuacacaguggcagaaauaauuaaacuuugcuauauauaaaacucacacagcugagauacuggauuuacaaccagguguucuguggauaaaaaaacugagacccacauaaagaaaucuugcgacugcauguggguggugggcuuguauugguaaucuucaucuccauuaggaauuucuucacgggacacugugugcuuugcuaaauugccauugauguugcgugaccccagccugcgugcuuucccucaggugagccuggcauauguggaagcagcaggauaccucacggagccugugaacagggaaccucccuccagagaagcucagcucaugacuuugaagaacacacccgaauuugacauccuuguuaucggaggcggagccacaggguguggcugugcacuagaugccgucaccagaggugaguccuuagaaacauugcgucuucuccccauugugaaugccgucaguguuugacucgugagcucacaucuaucuugguguuccuuaauuuuccauccuuccugaaacauucuugcaauuuucaaaaucuaggcccuuacaacaguuuuaaaaugaaaauaaccauaaauacacacuuaaucuccacagauuuauuugaaaauaaaacucuauauuccugaaaauuuauucauguacaccauguagccuaaguauuuuuucuguuuaccccgaaucacgauaaauuuaacacauagacacaccagagucuacuguuguuaacacauugacuccuguuuucauagaguuucgugccuccaaccgcgguguauaauuugagggaacuuauacgcuaacaugcuaaagcagguggggagagcggguuagaaucaucacaaggcaacuugagcuuagcuuucuggccaguguggacaggagaguagagagauggcuaucuuuaugggaggcuaugcuugugaugggcugcucuacucaaaggaauuauacaggugaggaucugugcugaagagaguucuuuguauagcaggagucagucaggaaacuccaccccgccuccccuucaguuacuuucuugauuuauacaaaaacauauaaucauucuuuuaauuucaguuuugcaaaugcuaacugcauguauagucauguggaaggcccaagagaauacacaacuaucuauagucauagcuuuugggagcuuuugugcacagcucacauggcagagagcaaguaccuuucaaucaggcaugauagacagauaaguaggcauggguauuuuuuuuuucccuuuguggcacuuugagacagggucucucuguguaacagcguugguggccaucguggaacucauuuugucgacuaguuugucccugaacucaaagaaauucaccugucucugccuccugagcucugagauuaaaggugugcgccaccacccccaccacugcugggcaagguaugcauauucuuauugacagagugaucaggagcagaaaaacuacuggcacguguaacagcuugauagagaccuggcuugaagaaauacgcuggagagagugcauguggggaugggggaagcggaaucuuuaacuugggccaccaaggccagcaagaaagauuaugaggaaagaguugagaggcaggagguugccagcugacagucuugauuuuccugaguaggccucuugauguccuggagauaaagagagcguugguaauuuagaaggaacagagaggggcacggagaggagacauggagaccaaugccuuggugaagugggaucuagaaguccaucauuauggggugggaguuuaaacugcagguuaagaagagaggaugcggugcuguccuggggaagaugcggagagggcuguguaucacaggugugccuuaguuugcacaggaagaugcaacucauuucccagagccagaaacgggcaaagguuguugagcagaagaacagaagaaagggacccugcacguagaacugaucuagaacagacagaagcagugugcggugcucaucguacgugcgggguaccgggagggaaggaggguugggggggggggcauaugaaugucugugugcacaccuaguugucaagaagcagaggagguaguagacuagaauccagaacuggaaacuggccaguuguugauaguaaacagagaaaaugagaaaggguucuccaggagcagagacaggucuggagcugagggagggcagggaagcggauggagaugcaggaaagccagggugcuuagaggaucaugaggggguugggaugaaagucaccaagggcuucuuauuucuguucuccuuuggggaaaguguuacauguuguucuuuguguccuuucuccaugucuaugaaaaacauaggcaagaacaauuacgcuuucucuucuauaguguguuuuuucccccccaaaagcagucuauuuaguuucuccauguguuuugcauucauucuuugucacuggaaaacggugcuugauuuauuuucacuaaguggggaugaagcuuucucucucucucucucucucucucucucucuuucugucugugugugugugugcgugcucguguuguacacaugcacgcaugugaauuucuguguaugcguguacauacaaggugcagaaguugagguugaugacaagugucuuucuuagccuuuccaccuacuuguuuaugaaacaugucuggcuaggucacccagccuggccucaaacuuuagauccuccugacuuagccuccucccaaaugcuuggauuucagacaugugacagcagucuggcuauuuuuguguuuuugugugugugugugcuggauacuaaauccggagccucgggccugcuaaguucaucacuacugaacuauacccccggccuuauuuuuuuuuccccuuauuuaaaacacuaccagaaugaauugaguaccauuaugagcaagcuccgagcauacagacauaguagauauggacugcugcauuuuguuguuguuguuguuaagcaaugaaguaggcauucaguagugauuggagccauguggguagugauacugauggugaugaugucgaugauuagaguuuccaugaguuuuauaguugauaucuaauaaaaugaugcacauuuaauauuuugugacauauugauacccaucuuagaauuacuaguugaaugucggucguuucuagguuugugacuuaucguggggaugggaauaauguuuaugauuaaaacauacaaggaggugcugaggguagucuguauuuacucucaccguguuuucugauuauaucaguggcccucugaagugugaaauaaccaugggccuuugguuaaugaauugcgcauuguuaccguucauucauggaauuugcucuuuuauuauauuugaugcuucacuuaacaacaaauuuugcuuucucuguguuugauauguuuuuaccaaauuauuccugauugucuccauuaaucuuuagucacauuugacaaaaauaaauuacugugaucuuuuaaaguuaccacuaauaauuagauuuuuuuuuccagggcaucaaaguuuugggggaaaaccacgagauguggaagggcuuuuacagaaauguuugcacaagcuuugagagaaaauccugggcugauaacggauagacgaaggcuguggaggaggagugguggggucucucuucauaaugcucauauuacguucucauccucugucguuucucggggaucaauucucauuugcuucauuugggaauauuauuucauaaacauaacaggcacagucuugacucacauucuccugcaggucuaggaucaauacuaauggcuucacuggucaacacaucuggggcuaguuccuggguugaaguacgggccccaggcuccuuggugagagcuuugcucccaaggaagcagaaaugaggagaccgguugguucaugcagucuccccucaggugauucccuggcuccucucuuuuccuuuuaagugacuuuaccugugugcaucuggaaccacccaggacauuauaaucuguuuaaaaucuaacuuacaaaauuuggcuuuaugcuuguguguaaauugcagaaagaacuuucuuguuggagaaguguucacacagcugucuuuguuugaaaauguuuauuagauccaggguuguuugggcaugacuggugccaaaagggucaguaguucaauguuuucagaccaugcuugaaaagucuaaaagccagcagcuggagagauggggauacagcucaaugucaggagcacucacugcucuuuuaaaagucccggguucuagagcaccuggguucgguucccuguacaugaaugaauuguggcuccaaagauucugauguccuccccacuuuucauguggguguguaugaacucacaaaggcauacacauaaaaauuaucuuuaaagaaacccuaaaaauaaaacagugcacagguauuucuaguucauaggaggugcaggguggccucucuugggcucacuguguuucuuacaagucugggcuguggagaugguaaagacacaggcuauggauguggaaugaauugggcucaaauuuuagucuuauugcuuauuuagccucaauuuucaacaagugucauaacuuuacagagaaauguccagaucuucaggaauaauuggaggguaauagugauguuguuuccauaaacaaagguuuaugcguuguuauuaaaaaaaaauucgaaagagugagaaccuugaacauggcucauccuggggauuguagaccuauauuacaugccuuaguaucccuccccucuguuucugagaguggguugugugguugguuuuugucaauuuggcuuaaaucaucaccugggaagagggaaccucaaucaaggaauugccuccagcagacuggucuaugaacuuguauguggagggcccaguacacuauggguggucccaucccuuagguaggugggucucugcuguauaaaaaagguggccgagcaaaccagucuucugcugcgguggcuucugcucugaguucucuccuuaguauaaaaugaaauaaaccccuugcuccuguaaguugguuuuggucaaguuuuuucuuucuuucuuucuuucuuucuuucuuucuuucuuucuuucuuucuuucuuuuuaauuacagcaauagaaauuaaauuggaagagugggggaagcugcauuucaaggugugaaacugcagaaagcuagcucacugcuugcuagacuuuggaaauggugugaugcugcaaaucucugaccauuuuggaaaucuaacuuucaguuguuuuuguuccccucccucccucccucccucccucccucccucccucccucccucccucccucccucccccucucucucccucccuuuccuuucucuguacuccagacuguccuaggacucugccuccuucugucuucugagugcugggauuaaaggugugagacccuaaaccugcccuuuuacacauuuuuuuuuaaauuuuuuuauacauuuuuuuuaaaagauuuauuuauuauauauaaguacacuguagcugucuucagacacuccagaagauggcaucagaucuuguuacagaugguugugagccaccaugugguugcugggauuugaacucuggaccuuuggaagagcagucgggugcucuuacccacugagccaucucaccagcccccuuuuacacauuuuaauggagcaauuucuuuugucaggggucaggcaggcaaaacuucaaauuguugguguuagggguucauauaguccagacugacugcgaguuagcuagguagcagaauuucugauccuccugccuccacuuccugcaucuggaauuagaggcaugcacagccacgucuaguuuaaauuucagauauuuucaaaauuugcuuugucucucauaaacaguuaucuauuuaacuagguucuaccuauuuauuuacuuaaccuuuagacauuuuauauaccaaugguuuauucuauguguauggguauuuuuccugcaaaggucagaagaggguggaauuagauacuaguuaguugccgugugggugcugggaaucgaaccuggguccccuagaacagcaguaagugcccuuaacuguagaaccaucacucuggcuucauuucaccuuuccauucugcuuaucuucccgaccccccuucuguccaucauauuagguugacuuuguuuuuuuuuuuuuuuuuuuuaaacuauuaacaaauuuaguucucugacaacuuaauacauguguauagugcaguaugguugcuguuuccucuugucugcucuugucucuuaccauuaucaaccuuucuuccuccugacucauccauucuuugccaguuucauaguuuuuguuuuauggcccauuuuauuuaaucaggacuucuugugugaccauugggcaggacuauccacuggagcuggugggguccccaaagggcucauagcuaucgcaaaugauuucuccuuuccucugaaucuaucaggaaauucugaguuuucuguuuugaucugugucuagauugaguugcuacugucuuuaagauccaucugggacuuugccuaucaccgucuucugccuugugcugaucuugagcaucuguggagccagcugaagccuuggcucugaugguguggucuggacuguauuuaucuggugguguggucugaguguccggcugugacccagcagauaauccccagcccuacacaguggucaggaguagcuugccaauuuccuguacaaaguagagacccuuucuuccgucucagcucucaaaggcugaguucuuuguuuuacccacaguggauagggauaguccgcacccuucagaaacagucccagcuucugagcccaccgagauagauacauuuaaacagucugcugcauuacugguccaugaguguuuaucuuaauuuugaaucaaccacaucuuuuuaaaauaauuuuguuugaauaaagaaaggaguuguuuacagguggcugugcagugucacaucaacuaaauuuuuguuauuuauaagcauguauguguguauguaugugugcauucgugucucuguguguacgugugugugaauguguggccguaguacgaaggcugaggcuacaaguuuuuaucaucacauuuagcuuuuuauguggauucuagggaucaaccuuggguuguaugauuuauacuuuuacuuccuaacauacuuuccugacucccagaauuuuauuuauagcaguaaccugauaacaaaauaucaggauauauauguauauauauauguacaaauauuuacagacuauagacucuuaagcacugcaagaauauggcaacacauacaaaacauucuauauaauuaaccucagguuccauugacuaucguguuguuucuguuguuuugucuacugauaacccccucacccccacuugacacuggcuauuuuuauaguaacgaggugaaaggagggaaugauagcagcaccucucauuucuugaaacuaugguauuaacuuuuaaagaccauuuuauagccuuaauauuguauuguauguauaucuaacauaaauguguuaaugauacacacacacacacacacacacacacacacacacacauacacacacacucuacaguuauauauuuguuauauauuauccauuuccuaauaugaggauagacagaggcauuaaaauaaccaguauguaauauuuuacaugccaaaacaaagcuaacauucccugucagacagugccaggcaaaguguuggauccucaccuuggcucgucuuggcugcugggcagcaucacaugggucuuguccuggagaguucuucaugagaacacugggccuugguguagucuucuuuauuaguaauggcaguaguucuuggaaacccaaacaagugcccgcggguuucuaaugaacgagggucccaucuuuguguacaguuucaucuuuucucaugcagcauucacauugagugcuugugcuuauuacaguacuaaggcacaagggaccuuaacuuuuugacuugugugucauggucuuggugucucugauuauuucauagcaaugacuucugcuuuccauuuagcaaaccuuagcaauuguauuucuaaaaaucuauccuagugacaugauugcagauacagggaauuuagaggaaaguacaaucuugcagcucaaucuguaagagugaaaaaagaaacuaagccagauguucaaaauaaggaacugaauaaauaagucguagcaaacguuuaauguaauacuuucaaaugcuuuuaaaauaaaauuauauaccauauuuauugauguacaaaauguuuacaauaagcaguguuaaaucgaaucuuugcaaaccuguacaugugcacacauacagguuguagacgggcauggaaaaaugugaacguuuaaacacccagaugucaauggcgguuaucucugagugcuguaauuacaggcggguauuauuuuguucucuuugcaucucugcauuuauuauauggagcuuauuuucgugcauaguaagauaaucgguagaagguauuaaaauauacuucuguucuauuccauguugugagaguuaaaugucauaccauuucucccuuaaguuuguaaguauucccuugugugcauccagcugucuugguccaugaguugauuuaguuggagauagcuagacagcaucacuuaguccagaggagcuggguuucgugcucgcccucacccugccuggaagguaugcuuucgcucagugugcugaccgaugggugaggaugaauggaagguagauuuuugcauugaccagauucuuuacaaaucaccuuucugccugagacuucacucaaaauuguaucgcugcuguggaauuccugaaaccacccuuaaacauuuauaauacuacuaauaaaaccccucagauagaaagaugcuagcaguuggucuuguuuugauucucaacagugguaggguuuauugcuuugcguuauuaaauacaugaauaaauagccuaacaaaaaguaagggggggggggaagcgagagaacuaaacaccuucuuaaaaaaccuugaacuggggacuggagagaaggcucaguggccaagagcacuggccguucuucaagaggacccgaguuuuauucuuggaacccgcauggcagcucccaaccaccugugacuucccggaaucugacaguaucuccuccuccuccauggcauccagcacacauauguuguauauacacacaugcaggcaaaaugcucauacacauaaaauaaauaaauaaauauaaaaauaaaauccuugaaccuaauuacuggucuaggauguggagauucgucuuucuucucugaaggacagucauucguucccagccuucucagcucucggcaucucaaacgcaugcuuuugauuucaucauaccugucuuauguaagaaugcaaagcgcaaggguugaaugccgcaucaaaaaugccacuuaguuauuccauuaagauaaagaggucccgcucucaccucuccuaacuuauccuuaagugagaagucgaagcuuuuaauuuaaaaucucugauaagggaaacauuagacuuaaaaacaaacaaacaaacaaacaaacaaacaaccagaaaauaaaugaaaaagcaaguuggaguccaguguugagaacacauaauacccagccuuggaggccgguucagggaguguuuccugcuacacagagggccacacaggacuaguuacagagaagccuaacauacauagugaggucuuaccccuacaaaucaacacacaagcacacccgcacacacucaugcauacacccgcacacccacgcaggaccacucccacacaggcaugcaccccgcauacacgcaccauaaacauuuuaguuaaguaaucaaugaaugucacacaaucagcuguggcuucuggucaugcuuugacuuuguguuacuucuuuucuuuauucccauccugcaaaauugagaauuucagaacacuagauacgugggagucaagguucugauuuuuuucuuucuuaaguaguuuaaacaacuuuuaguugacauguugguuuuaauauacugacuuaguagucauuuuggagacuacguuuguugucugcuuugggaaaaguaaucacaucucuuuuucagaaauucgacaagauaacaguagcagaggagggcuugguguagcugaguggcuuauuuuaaauuccauuguuacuuacaaugguuuuucauguaaauacauacaaauaacuuguuaaaaaaagucauggccggauaaaagcggcguaaagagcuugaccuagcugggcgugggccuuuaaucccagcacucaggaggcagaggcagggggaucucugaguucaaggccagccuggucuacaaagugaguuccaggacagccagggcuacacagagaaacccugucucaaaaaaccaaaaaaaaaaaaaaaaaaaaaaaaaaaagagccuuaaauauauccuagaauacccgccugccguggcuugcugauucuuguaacagcacacagaguuagggaaagaaacaucuacccugacagcaagggucccugagaccccugcuagagcugccuccugaggccagguuccucauugccuuggcaacacugugagccucaggucugcuaguagcaauccccuagcuccaucccucugccuucccucagagaaaacuuuauagaaccuucaucagcuuugucagcuuaaacacuucagugauacccuugucaggagacauaagcagugucucuccaaacaaucucucagaacuucuaaggaaaaaauaagauuaaaaauugcuuuaaaaaaaguugcccaggcaagcccugguuccuggaaaugggcacccaggacaggaucgaggaggacuggacuugcaggccucaugcuuauuaauguaacgaagcagcuucacugaaacuggucuuagaugugaacuguguucuuaggggcauucccuuuugaggcuauccugugauugcugcuguggccaacgguggccuucagaacacgauucaaaaaccccagugugggugaaaaaaaagcuccuggucacuuccucgcaggacaaucacacauacccugcuuucucuccagccccucagugacaagcagccugcgacaaggcuggaaacuuccaauccuuugccagccacccacccucccuccauccuuccuuucuuccccuccccuucaucuuucuccuucucucucaucuucuauggcuccacagucuugggauaguguggaaaugaacaguuccccagccucugcacccuagcacccuagcacccuagcacccuagcacccuagcacccuagcacccuagcacccuagcacccuagcauccuagcauccuaggacugggauuacaggugagguuaguaaguucagcuugucuccuuaagcuugccuaagcuuaccuaccuccucagccauuccucuugagcaagacucuaugaacucagcuuuugcugaaggcugcuucuccagaagugauuaaaaacuaaaucgggcugccaaagagauggcccagcaguuaagaaugcagacugcucagguucuguucuuggcacccacaucaugguucacgaccacccauaacuacagggguauuuuggauguuuuaugcauauuuguguguguuucuggguguauguaugaccgcuucuguuauugcgcauauuuguguguguuucugggugcauguaugacuucuuuuguuauugcacacauguggugcacauacauacacccagggacacacacaaauacacauaaaauaaaguaaguaaaauauggaaaagaccugccugcccccuccccccacaauggucuucacuguucuucacacaggaauuuuuguuaccaauaacaccccucccaguuuuaagugguuaaacaaaaauacccauaagaaucccuucaucucauuugggauauuuaggaggcacggugagugagccuucuugggucuguggcucuguguguacacuggcaguguuucuuugugacucacguggugcuggcaggggcaguuucccuagcuguuggacuaaggccugaugaccugucacuuggggccucuugguuucuacagagaccacaugauaguuugcuucacuggagcaagugcuugcaugggggggggggggacugaggugaggggaggcaugggcuuacugaguuacucugcucuccugcuggggauggggcacugcacacaguacacccucagugagggcugucugggaggucugagaucacagccucgagggcuuuugggguuacccaaauaggaagcugagggucuuguccucucagcuucacuuuccuuccuuuccugcuacaggcaaccugaugcaguaacugugaugcuaggguuuaaagagaggcauauuuuaaauaauguggcuccuaaauaccaucugaaagucaacucccucgucugaucuucagcugcagaaaaaaaaagggacuaauuuagaauaccaaaagaucucuguaggauuuacuaaguagaggugguggcguguguggaagaggucggcaaauguuauuuugaggauaugcaguccggguuucugcccugaauucagguucuaauguggaguaagacaagucuugucuucucugaagaaggcccuggugagucucuguguuuccugauuugccugagcagagccacuugacaacuggcccagaugcacucauguccaguguccauacuuugacucucaauucucuuuuuaaaauauucacugucucacuaucauucccugucuauagcacacaauuaagcacugguaauggucucauauuugaguguugcacaacuuuucuggggugcaugucuaagagcagugauguggguugacaaacagcacuugugauuuuucuuuuuuucuuuuucuuuuuuuugagacaggguuucucuguguagcccuggcuguccuggaacucacucuguagaccaggcuggccucaaacucagaaauccaccugccucugccucccaagugcugggauuaaagacccccacggccggcuagcacuugugauuuuuguuauuuuuuuccccccuaguuucgacaccgacaguguuugaucuugaaucagacaccucuacuuuucaaucuucauuguuuccaaauauuuuguccuuuaaagucaagagaauugcucugguuuuacggugacauuucuguucaaauuuuuaacuguuaacuauuaucagagcaacccuuuggcacgaaacgucucugaacugaaugcaugcgcuuucuccuauccuagcuuugugaguccaaauuguucugccucacguuaugauugugaauggacccuugaccuaaccaauugccuaagggaguaguagccagcuccuggacauucccagugcugccuguggauggauaccacaggacuugugaacuugaagaaccuaccuacgguacaacacggacuuggagcacugcugcuacccugaggccucagagaggcagggucucugcaagaaaagaaaucagaaguagauuuuuuuuucucccuaagagauuuuuaguagucuuuagauaaaggggaugggguggcuuguagaauguaccuaucuuuguucagucucauccuagagagaauauuaucuuuuagaaaaauucccugauuugggguuugggaacuggauugaaguccucucaggaagaguagcaaguguuccuaacuacggagcuauguuuucagccccaagaagguauggauacuccggucuaugaaucuuagcuuguacuucacuuuaguauugaaaugguaugccauacauaaaacauacaauguucuaaccugcacuguaaauaacaauagaacucuuuugacuuuuuaaaucuuuuguguuuagguauggguguguguucauguguguggguucagggacaaacuuguuugaggcagcuuucuuguuguuugccacugcauauaccaggcuagcuggauugugaguuucuaggaaucuccuguguuagccaguagucucucuguaagaguucuaggauuauggauaauucauuacuucauccauaauuuugugggcuccagugauugaaucucaggucuucaugcuuguaugcuuucgugacaaguacuuuacccaacgagccucucuccuccuaucuccuggaaauucccaccugcccgugucccucacagcauaaccacuaucucccugacuuccuuaugcacuguaucauaggaccuagaacacagaaggagucugauuugguacuguuagugaaugcauagagugcacacaguagcauagagugcaggaaaggaacaguuugcccuccguagggaggaacagccaugcagucugaaugcugugcaauacccacugaugccaugugggaaaagacggugcccggcccuccuuugauccccucacuacaccagagaaacuugcugccccagaaucgucuggugauguugccuaggugugauucauucacaguuuaauaugcuuucaguucagucuugacuugucccucaggaagagccuaaaaucucuucauuagaauauagacaguguacugcacuuugaauacaaauuuauccauguucagacuaauuuuuccagugauugucucuacccuggagaagugcuuuuaaugaauuacauacaaauuguguaauuuaagaaguuaauuugcuuuucugguuacacaggacugaaaacagcccuuguagagagagaugacuucucaucggggacuagcaguagaagcacuaaauugauccacgguggugugcgauaccuccagaaggcuaucaugaacuuggauguugagcagguaauuguguaugcuggcuguuaaacaaaaauuaccaccgugcuuuuucuacccaauuaagucaggcuuuuuuuuuuaaauagcuuuuaacauuucuucccauucaaaauaccuguuuauaguguaugcugcuuggagcaucuuucaggagagaugugcuuguucguucuggggaggauuauguuuauggguaaucggggccuuuuucuguacaagcaugucaaaggagcagauuuacagaaucacuuuuggauauguugcguuuuaacaagcgugauuggguuuuugccaauggccaccaaauugcuacuugcaaagcaguuucgggggagcaguguugcauugcugacagaguaccaaauugaucucuuaacugcagcugcaaucaugcagucauauugucacugacauauucuuugagggugggggggauggucugagucacgcuuucugugugucacacuuuauuguguccagucugccaucauuugaagacugccaaggcaguguggaaaaugacauuucccagaggaguuggggaaaaaaaaacagcuuccaucuuaucugcuuuucauacaaggaaaacacagcagcauggacuugccauugucaaguguugagucuguccccuuucuugccuugacaagucaguuuugaaucuguccccuuuucuuacguuucucuucagcauccgugauggaggcaaagaaaauagcccagaauucacgaucugcugauuucucauguguucugccuuauuuugucaauauauaccgucauauugucauguguaaaauucguaugauacuaauaaugcaggcaugcugggggcauggguguguguguguguguuugucaugggaguaaagacaaaggcuuuuuuuuuuccccaucuguaaaauacuuguccagggcuauauagcaucuuuguugaguuuacggaaggccagagaacuugccaugaauuugaacaaucuguucucucuuaccuugagaaaacagucuggggaacagaauaagggagcaguccggagaaagcaagauaaaugguuacaauaaucuuguaacucaagucaggaaaauaucuuacaccugggaacucugacagcauguuuuucuccuaugcaaauacaguuaagguuucuaaaaaaucuuugagguugacagcaugauguauuauuagagauuugauuagggggagcucuccucgcuccgagguagaaggcuucuguauaucaaucaguuggcagggugucuauuugccauuugaaaauauuaugaucuguuacugccaaacuaauuuucucuguuuugauuuucaguauaggauggugaaagaagcccuucacgaacgugccaacuuacuagaaaucgcuccucauuuaucagcuccguugccuaucaugcuuccacuuuacaaguaagccuuugccuucaccugcgugcgaugggcuuguccgaggucagcagaucaacgggcuucucauggaaauaguccuccuguguguguuucuuaaggaggcuuuaauuggucuuaaucuuucaucuauuucaaauacguuccaugguguauuuaaaaaaugaagauuuuuaaaaauacucucugugggaccuaugucuaagggccagauuuuugaaggcgaugaagguugaguucuguguuugcauuuaauggaaucucauuucaguuucuuggagcguguaggugaacaccuguguuuaccuguguuucuaaggcauucagugagguccugugugcaguguagaaugcagaacccccccuccccaaaacuauccugauaacaaaaucugaaacuacaguguagcaacccaaaacccagcuaucauuuuauuaucuaaguuaauguagaugaaauucauccaagaggugugauuaaucauuucccuaauguuagaacugagauugagauugcccuaggaagauagacccaguaaccuggaaagguggguuauggcauucuuuuaaccacauggcugguguagggcuugacacagguuugaccaccuagugccuguuuaguuacagauuucugagggccucuucaaccuaguugcaguccacauuuaccaaggccuccaacccacacuguuugaauccaucucuagacuugcgaggcacaggcaugggugucuguuuauucuggaugcuuccugaagaauucuaacauggagcaggcaggaaccauggagguagccagaaacucuugcagauucuccuguaugccagcuagcguggcgccagaagcaacuaugugccaacccuucccacucccuccuacagccccacucuccccccuuuugcagccuacuacuuguggguauaaguuugcuuuuccuaacuggccuuucuuguaauuuaaggugccaaucuauagugcuauaccguguuucuaaaaacacccuucucucucugcuuaugcuauaggugguggcaguuaccuuauuacugggugggaaucaagauguaugaccugguugcagggagucaaugccugaagagcaguuacguccucagcaaaucccgagcccuggagcauuuucccaugcuccagaaggacaagcugguaggcgccauugucuacuaugacgguacgugauauuucuuauguucuucuguccggugaugaccaccgagaguacacugacccuuauuuaucucacggcagagaaacaggcucgcauuccacuuuccauguuaaccuuaaggaacaaacaaaugcacucacguagguagagagucaccauauuugguaguauuggcugaaaaacuacccacaaugauuugcuucuaaccuuuuuuuuuuuuaauuaauuaagaugcuauacauauauucuagaccagacuggccuggaacucacuguauacacuagucuggguacauauuuguauucauuuuccugccucagccuccggagugcucguauugcaggugucagccaggacaccuggcucucuguguaauuaauguauucuuucuccucuuuugcuuguaucucaugguuggcuuggcccauuucucauagcuaugcauuucacuccacccucauaccacuccauuuguuauauguuuggcagggaaugccugccuuauguauauauucugaucuugaaagcagucaaggagcuguagguuuucuagugaaaccucuguuuucagggcguuaucaaccuagagaggaaacauccccugggcugaaaaugacacauuguuuuguacagacauuagucuugucuaauaucuauuugcaauguguucacuacgaacucuuuucugcaugugcguacaccacaucacuugcucguuuuuguuugaggaaacugagcaguauauuuccagacagaccacagucaacagcaacaagacagagcaauauaaggaaaaccauuugugaaucuucguugguuauuugaaagcgugugcagaacuagaaaacaauguagugauauuucucuauauggaacuaagaaggcacaggugguugcacguguccaaaugguuuagaaacuuuuuggcacaaagacgucuuaggcucugaaucuccgugaucccauccagcuaugugcucuuuauacuugguguuacauacauaaacucuuagcacaaaggaauguuuuguugugcuguuuuagaagauuugaugaauauuuccauguuagauuaugugauacuguaucugccuuuuaaggccucuuucuuucuuccuuccuuucuuucuuucuuucuuucuuucuuucuuucuuucuuucuuucuuucuuucuuucuuucuuucuuucuuccuuccuuccuuccuuccuuccuuccuuccuuccuuccuuccuuccuuccuuuucuuuguuucuuuugccuuuuauguagcuccacuguuaccccacugaaucaauucagcugcugucugacaggcuuuucuauauaaaugcagaauguacgugugcagagguggcaauggggaccaaacuuaagaaaauguccuaggagcaacaauauuagaaaaauguuaagggucuuagacagacauuaaaagcuagaaaauuaacaguuuucagagacuuucagcaucugagacaccacagggggggccacuuaacuacuuuuuggugcccuugaaggagccuacauguuaaaggacagccuucaccgggaaucugcuuucucugcgucagacccuuaauguuaaccauuuuaguuuauugggugauuacaguaaagagguuucugguccaggaggaggaggcauucuguaaauugcauccugucuauacucauguggaaauauuugugaccuuggccuucucuuacuucuuccucccacacaaauccucucaaauucuuacuguuucuauagcaugguguauauguuagguacuaccgucuuauguguuagacugugcaugcugaaaucacucacugaggaaaaucacugucauaccuggauucaugacugucuuaguuugcuguuaucacgaauuauagauacuuacuguggagaauccagggaaagccuguauccuaguuauggauguauuacugugagaccccaugaccaaagcaccacuuauaagagacaacauuuaauuggggcuggcuuauagauucagagauucaguccauuaucaucauggacugaagagcaggauccaggcagacaggcuacuggagaaggaacugagaguucuauaucuucauccaaagacaguagaaggagauugacuuccaggcagcuaggagaagggucucaaagcccacagccacagugacacaguuccucuaacaaggccacaccuaccccaacaaggccacaucuccuaacuaugccacuucccacgagccaaacauauucaaccuaccgcauguuuuguuuuguuuuuaaagcagaguacaugcuaucuugcuagaauuaagaggaaaaguuccuuuaauucagaacaaauucacuuuuauaguuuguuauaggcuauagaaauagaaguugaugaaaaauuauugagaccucuuuuagaauaauucaaaauugauguuuggaaauuguauagucucaaguuuccaacugaagaagucaaaacaaauuacucugggcauuuaaauuuaaauauuugccuuucacuuuguucugaaacuacucaggcuuagauauguaauauuaaaggugaggcaaaacaaaaauguaaaagaguagaguuguuugcccucacaguguauccacagaucuugacagauccuguuuuagccaguauggugugaugagcagaccaaguguccccugugaaaaugaggagaaaagccacaccagggcaaaggaaguuaagugcacugacuagcgcucucagaauaaggagaggaagcuccaguccuuuugaaucacaacaaacccacuuguauacuugauaagaccaaaguuucauuacugagaugaaauagccucguguucacaaggaacuaucauguguaugguuaugcaaauggcuuuuuggccaugagcuacacaaggacuaaaaccugaaauaucuaaugcucaaaugaaaagccagacauggcccuguguaccuguaaucccagggcugggagguaggagugggugucagcagaaauggguugcuaggguuugccuggauggccagccuagcucccacacucucaaaauaagaauaaacuaaaaccaagcaagcgccagcccuagcgagagacccugacucaagggaauaagguagagguaauuguggaagaugcugagguuauaacacacacaugcaaagaaaaaaaaaaauaaaagaaccauuacauuacaagacuguaaggcaauucaaguuauuuugaaaugaaaccaggccugaaauagcuuuaaacacaauacuuaaauucauauaccauuaccuauuuucgaguaaacaggaggaguuuuuauaauuucuaugugaugagacucuugauucuaaugaaaagaucacguguguucauaaaugaaguuuugaaugaugccagaaguuuuauucacuacagacucuucuuauugauaugugauacagcugcaucaguccuagugaaugugaugcucugagaccaucguggcacagaccagcugcauugcaugaaguuagcccagggauugaaguugacacaaccuuuaaggucuccucaccacagaacuguuagaaguuuaagguguucauuuagaagacaaauuguacaaauaccagaagauuauauuuuauuuauuuauuuauuuauuuauuuauuuauuuauuuagagacguucucagucugugacacuugucuauguauaauuacauaauuacacuauguaauucacuguguagcaccaguuagccuugaucucacaaagacucaucuggcucugccuccugaauccuggacuuaaaguuguguaccgcuauaucuggcucaaaaguuaaccauagaaccacaguuaaugcuaaauaaauucagauagccacuguauaugacuaaggcaaaauaaauuuuucuaauuaaguuucuauaugugauagaacauuuuuuuuuucauuuugcuuguuugcuuuuugcuuuucauacgcuggccuugaaguuuucucccuacucccugccucucccacuucuuacccaaucucugccccccacccccaccccuccgugcugguuuguaggugugcuucaucacacauagcucccauacugucugaugucauuuaugggcuauuuuauauguggcauacauaugacccgcugugauauuucacuguuaacugcuaaaugacaaacugauacauauggaggaauaacugcuaucuuuuuauauguaggcagaguaaaugucauguuucuccauaaaauccagaugaaaugaaaggauacaagucacauaccauuuauaaguccuuaacauucuuaauugaaaacuuauaauuugucccuuagcuuucucucugaaccauuaccuccugucuucuuugagcuccuaggccuuaacaacuagauacuuagggguuaccagggagaaagaaugcugaccaagccuucucuaagaaagcaggaaggugcugaaaguaucucugcuuagguguccuggcagucucuucgauugugugacugcugcugggggguagccugguccugaggaagucguugugucaccuuucagcuuuaguucaauuuucuagcuccucacagugguggcacauccugguaaucccagaacacaggagauggaaucgucaggaucaggaguugaagaccacacuuagcuauuuacucaguucuaggccagccuggcuuagauaagacccuggcuuuuauguguguuuguguguugagaccagcucucacuauacagacuaagcuugcuuaaacauaugccugccucugcuuccucaguaccgggauuaaaugaacgugccacaccauccucaagacugugccauaaaaauaaaaauucuagcuuccagaguagacuccuggugccacucuagauggaccuuugucauccaauccuguguacagaaagugagauauaauuaaaaaacauuaaauauuuacagccguuaaguaacuccauucaaccucuguaaaaugaaauuggagaaacaaaauuauagcucuaaauuuucccuucugucagucaagacauggauagagaugucuguuacuuuauacccagcaaugcuucuaaguauuccuuacacacagaugaaaauagcaaccugaagaaauuguauuggcuuuucccagugugaguaaaaguugguuacaucuguguuucaaaaggggaauuaaaaagccaucauucacuagaauauucauuuuuauuccaguuuaaaacucacagcauacauagaugaauucagcuggugagagagcaaagccaauuuaaucucuggcuccccugagguaaauguaguucacgguccugcccccacuccaaccucagcuauaaucccuggcuccuggagguaagaaugcagugaagugaggaaaauccugcagcaggauauaaugauccaaaaugacagggacaauaaugacaaugaauuucaugucucccagucaugagcugaagaugcuugacuaggcugacguauacaauuaaauuguuacagguacagcaggagcuugcacuuagcugugcgcuuuggggagacgaugccucgggcagaaggcagauaguggagucuagccucuuuuguuaggaucagccuauuccuccuuuaggcaggcaccgagaccguauacuuuaauaaaagaaccccaagcuaaagacaaguuuuuuaagguguuuaucuacuuugaaaacuuaaucaauuacuaaauaccauaagcauguuuuuuuuuuuuuuguuuuguucuuuuuagucuuauuuuuccccauugaguuccaggaacauaagugaaaucuaagguggugucauuaauccuuauuuaugauaccuguaagcaaagagguugagauaauuaacacagagagucuccagaguuaggggaauagguugaaaggauaaacaaacaucgcagauuuaugaucucccugccuguacucaacucugggcuaccucugcugcuucccacagguuuuuaagguggagugcuaucucccagaagaaagguuaaggcucaugggucacacagggucaucuacuguguuuuagcaagaauacacugaaaggucugauuuuuacuaucaaauacuuagaaauaucuacuuuugugugcuucacauguguauggugcauaaauacagugguccaugugucuaguuuauaauuaaccauagcuauugaggcuauauaaugauauucacuuuacuuuugaaguacuuaauuuuucuuuucuuuuuucgcucacuggggaaguagucauuuauuuuuugauaccugguuuauugaaauguuuuucaaauaaguauauuuaucaaaagaaaaaaauugugaaagaugaacuuaccaauugcuuuucauuucuuaaggucuaauuuccuuaaucuuugauugauugagauagcuaaaaagaaaccaugcuauugaauuaagguuauugucuacguccuuauuacccuaaauguauccagucucaucuggauuagggguaugucaucauggggacccagaauugucaaaauuuggcacaauauaauaaaaacuuguuaauacuauuuuuuuuacuauagucucuuaucuuaaaugaaaaaaaaauuagaugcauuaaguucuauuugcaaauaauccccaugguuuugaccauuuuuagguuuuuacuauauaaagcuuaaaacuauauaaauuuuagcacauauauuaggacauacauauaucauaaauguagguuacagagcauaauaaauaagacucuggaauuuacagccaggccagagcccagaauauuaccaauacauugaaguugucugugucugucccacacucguuuggugucucuguuuccuagauuagggaucuuucucuuuuuaaaagucugaccacauagauuuuuuuuuaaauaaaauacuauuugauuuuuaaauguugcaauuauuauuauacaguguacuguaaaaguugauacaagcccuuugcagaguggucgaugaccagugcaaaguagauugagaugcugccauuacaaauuccccagaaaauguuuacauauguccaccgggagauguauauauacagaaagauucaccaaauugccaugccugauugaaaaauggaaauaaggaaaauauccaucaaaagacaaauaaaugauuuauuucacuguacaguuauacacuauauacacuauacaguuauagcagcauugaaaaugaauaaacuaugacugaaguggacagcauggaugagucuuagcaacagggugauguaguaugguuaauguuacuauggagagcugcuuuacaaauuuaacuguauuuggaaucacacuguauauggaugaauuuaggcuaggauacccaacuuauagucuauuuugaagucuaaauaagcaaguaaguagaaaaaccguuauaaacaagucauuuuccaaguauugcuacauuuggguugguucuaugguuacccaucucuaguuuucauugaaauguucugaaguauuaguuguacaaacauccgcuuacguaguuaaauuuucaagauuuuccccaaaaaacauugccaaaccuuuucaggaaaacaaaacaaaacaaaacaaaacaaaacaaaaccauuguccccagggacauguuccaaguaaaugauaauguuugugauuucaagauucaaaacaagaugcuuucaaagaaaauucucuggcuuuuggauguuaacauaaagcauauuuguuuucuuaguauucuguccaugcauaguucuacacuucuaaauugaccacauagcuguuggucuugauuuccucguguccucuuucccguuacauuucccuucuucuuuuuuguugguuacauaaaugaagcugacaucauugcucacauagcaggcauuuuuuuuuucuuuugcccucaaaugcugccuuuuugcuauucaguauaucuggauaccaacuaaugcuaaaugaaauuugacauauaccccuaagaaacaaaacuuauaaacuguggcuuccgaggaaacccugaauaaauaggacacacugcgucuacccaggcuaaccuucagcauaugcuucagcuugcugaugacgaggcagagcacgggagcccccgggaaacugggcaauuguuuauugcucgcuuggcaagcguguauuaaauaccaggcuuucauucucauguagauacauuaaaagaaaaucauacagaaguagacgugaucagauguaacccacagagauaauaguuacucauaguguaccuuguguguauauaaaagcuucaaaaaccgcuaaagacuuaccagggucuucagggguuguauaaagcauccugagcagauagagcuggcagguucaggagaagacucuuccucccccacucuugcucaauggcccuuuucuuggauggggcaaaaagguaucaagggcaaaagcuauuauauuaaaucccauguauuugcccucucaguuugcuuauuugucucaaaguaaauacggaauccauuaaccaaucauuguauccgcuaguaggagccuauggguuuugagacaauuuacuucguuugugccaguuagcaguacacuuuccaaguaauuuuagcaaguccuuuuagucaacucaauccuuuauauguauguuaggaucagauauuaagguccauacuuuucaggaaggaaaggagaauguaccuaaacauuuuguguuaauauuuuugauacauccaauuggacagguguuugguuaguugaaagaaccuuacagaaugacgacuaugcuaucaugaccuuuccuguccgucacugauggcuuaucuuacuuuuuucauuccugugauagagcacucccauaaaaguaaccguagguagaaaaggguuuauuuucuacccuuuuguguagcuaucacagacaggaagacaugguagguaaggaaaauauuggugucaggggcaggaaauuuguuaaucacagaaagcaaaugggaaguggggauaggcuguaaaaucuuaaggcccacccacacccaguguucuacuuccuauagugagacucuacuacaggguccacaauuucucuaaucagcaccagcugugaaccaaacacuugaguccgugggggacauuucauauuucaaccacaauuaauuuuggaacaccaguaccaggguguaugagcccucuucuggcauccaauggaauugcaugcaugcagugcacaggauaaacaggcaaaacacccacacacaccaaauaauguuucuuuuauuuccccuuucuuccucucuuucucucuucccucuuuuuuuuucuuuuccccuuuucguuuucucauugagaguguagauuuggcuguccuggaacucacuaugcagaccaugcugacuucaaagucacagaucugccugccucucucuccuugaucagaggcaggugauaccauaccugucaauaugucuuuuuuuuuuuuuuaaaaaaagacaguucaacaagaaauguuuuuaucaucuguagaaaauaaaugagaacaguaccauacaauacaauaugaugcaacaacagcuacuuucaaaacuuguaagcuaacucauggcagacgugaccuccauauaacucacuugacaaacauucaagucaagaauaaucuguuuugaaaauucccuaucuucuuccuuggacuggaaugcagggcuucccuugugcaugcugggcaugaacuguauuguggaguuauaucccaguccuuagucuaugccugcaaagguaaagauucugcuuuaaacauaaccaugcuuccgggcugaaugguaucuuaauaucuaguaucuagucacagccacauauccuuuguagcuucaucauaauuuuaacagauccuugaaugagaauucaauuuguaaaucagacaaaauauuccagagguggggggacaugccuacaaccucaguguucaaaggugaaguuugaagguugcaaauaagaagucauuauggggaacauauaccuuuuuuucuuuguaauacaaaacaaagaaacaaaaaagcaagguguugcaugcuauucaguggcagggcccuugccucaaauguacaaggucuugggcuugauaagcuggagcucuacagaugggaaaguucugaaaggagccuggcgugcuaugcaugcucacagugugagcacccuggagccuaaggcacaagaacaaugaguuuggggugcuaaaaagcaaaggucucccuguuuuaaaauguguaccaacaaacaaaaaagcagacaaaaucuugguuauaaauuauacgcucgacagauacaguuuuagaaaaagggggcuagagauggucaagagcacuuauucuuucagaggcccuugcuuugguucccaucacccacauggugauucacagccaucuguaacuuccguuccaagguauccgacguccucuccugaccucuaugaacaggaggcgcauauguggugcaguuauacacacaggaaauacacucauaugcugaauauaaaauuaaguugaaaaauaaauugaacucagguggcuaggcauggcaucuagcacuguaagcacugaacccucccccaacuccccaguccuccuccucccucccccuccccucccccuuccccuccuccuccuccuccuccuccuccuccucuuccuccuccuccuccuccuccuccuccuccuccuccuccuucuucuucuucuucuucuucuucuucuucuucuucuucuucuucuucuucuaaaacagggugucacuauguagucuuggcuggccucaaacucacugugauugauucaucugcuuauguucccaguauaugucuaccaucacuccagccccauuuuuuuuuuccuugauuaguuuuaaaaucgcuagauuccuuuucuguuaaaaauaguuuccuuuaauauggcccccaauuuuuccugugccaauaagugguuguuggauaggaaauggcauccaagggcaguggcuuugacacuacgcuugccauucauaggcugagagacacuugagcgagucuugugguucuuuccugaucuuaaauucacagugugauugcuggcugcugugguuggggacguucaaaggugucuuuacugcucaguuuggggcuugggaaggaaggcuacaguaguuguggcaucagcuggcaucguucuccucauuucaucgcucaucuguauuaucccuccucuucacgcuucucaugcagcugcuggauuccucauaugaauagucagaauagucagacuucucaaucaguagcuggcuuaccucaaagaacacauaagcgaccaaaacaggaaagcaaggcuucucuuggcuaucacuuuggagucacacagugucccuuucacaccaugcuaauugaauugagccccagaggcagccagauuaaagggucagggugauuagggagcaagaaaguagguggcaguauuuaucggacagagugggaguggcccugcuggcaaaguuuaaggaggcacacccaacuguugggucaggaauauucuagaaggggauguggguauccugcaacccagcuuuuggaucccauccccuucugcaguuaccauugcauagcuaauuggaauauuccauuagagccugacggauuuuaaauuaguucuuuucuaauucuguuuuuuuccuaauuuauuaacucaguuaauuauaacuuuccuguuuuaaccauuugcuuccuuuagaaaccuugcauauaggcauacuuugcuccuuuccuguuauuuuugaguuuucagaaaguaguggaaacauaguuuuccaucaucuuuaaugugcucauuacgcguguauauuugaugcgucuauccaucagaaauacugaugcucaaacagucacuuccuugagguggcuccugagcacuuccuauuauugcugaucugaugugaugucuguguuuucuuuuguggcaaguuguuuggagcuuaccauagcaucucuguaugcuccaauuuuuguaaaauagaacaaagcaaagcauuuauguauuguguaugcacguaugccaugguggcauaaggaggacgagagggcaguuugcaggaaucaggaaucagugaagacuccugccaugaggguucugggauggaauucaggucagagucuguugacacacaccucuuuaugagauuagccauuuuuggaaguagcugcuucuccaaggaagaacuguguggggcugcucucuagggccuggaugucuauuguugcugauugguuccuauuuuuuggucuuucaauagaaagaauugggaauaguuuuguuuuuagagauauucccuugcuauucugucuaugcuggcuccuacuugugucuucugagugcugggacuauuuuagucaugugucacaaggccuggcuuacaaaaauaauguaacgguuauuuuuuuaagauuauaauauaauuacaucaguuaucccuucucccuccaaaaugucucauauacaccuccuuguuacuuuuuucaagucaugaccacuuuauuucauuaauuguuguuaaguguguguauagucugucucauguuauuuauauacauguuuucagggcugaccacuugguauuggauaaccaguuguuguucuuuuccuuggggaagacgauuucuucugcuuucagcauuccuuaguugccuguaguucuuugugugaggcggaugagcuuucccuauauguguuagcauguccacugguggcauccuuguucaggaagucaugaauagacagucauguugguaaaacuucaugguuguuguuacugacauuucuaggagauacaaucugacaguaaacuccuugguccucaggcucugacagucuuucugcucccucuuucuuccucaguggucucugagccuuaggugcuggaauuguaugguagauguauccaucuacugggacuuguguaauggucucugcugcaaagagaacuuucuuagaagugugacaacuacacuuauuugugggucagaugauuaauggcaaauaucuagaguauagaguucaugcugguaguaaagugggagcuguaaauuuuucuccaagauucaugacuucauuaaccuuggaugguuggcaaguuuuccagcagcaggcaugguguuccuuugguugagugucuccuaaguccaaauagagagggguugguuauugccaauauaguugugucauuccuacaggcuuagggauaucuucugacccagcacauuuuugagcagagaagaaacauaugguauguucuuagauaaauugcaacuguagaagucauguuuguagcuuuuauuucaucuaaucagucauaguuccaaggaaguauuauugaacacaguuuaauuuuauuuucaauuuuauuacugucauuaggguauacgucaguggauauauguaaacauucucauuuaaaagauauuucacauaguuuuggacacugugguuauguugccaagugaauaacaaauucauuuuauuuugcuuuagaccauuauggauacgucuucuuaaagcuacauaaaauuacacacacacacacacacacacacacacacacacacacacacacacacaaugaacuuaggacuuaaagcuagagaccagacuuauucaagcugggaccagacuuucuuauuuuucuuuuccucuuaaagguaauuguguguguguguguguguguguguuuaugcacauguggaggccagaggagacucagguguucuauugcugucugccuaauuuaucugagacaggcucucucucuucccuggccuagguggguggccgugauucuccuguaggcccgccacuguguugaaguaacaguuacucacguucaguccugcuguuuuaacuugagugcaacucagguuuuauacagaaaacgcucuuauccacaagcaaccucccuaagcuccuaauaauuauuugugucuuugaaucuuaauauauccaaccauuaugaaugauagaggaagauacuguucgccgaccucuagccucuguauucaaauucauagacgacuguacucacacaagcaaguacacacaaucaaaccccacacaauaaucauguuaauucuuugacuaaaguguauacaaugcuauauaaggaucagugaaccuugcagucgaguuguuuuucacuuggugaauggaaagugaaucuugccucauuucuuuggaugccauaaaaaauggcucauccaccaguuuuuauauguauugaaaacgugaaauuauucugugagucugccaugguauuaucaucauuauguaaaauauccucugauuuguguaaauuugcuaaaacccaguucauaucauauucuuguacugaaugccaaucuccuuagucagacucaaugcucauguuaauuauagucuuuuaaauagaugggcuguacuuauauuaauacauaaaauuauauacuucuuggaaaaaucucauuuucauauggaucauauaauagcgcauuuaaaaaauuuuagagaugaagcuaauuaauuguaguaugagguuaagauuuuaagguucgggggcuuucuucuuuuguuuuagagaccaugaggaaaaugcacggucagguuuaggccaugcucagagcguggcauuuugaaacuuaauguaaauuuccaacuguguucaucucagaaauauuccuuuagaaauaacaguucagggcacacuuaguaagaagggaagacagaaagacuugacauuaaaauuugaagacaggaauagcagauaaaaguuuguaaugauuggucaucaggaaccugugaggauuggccauuuaggaacuguuuuuuaacuucauuguacaguuuaaugccuacuuacuuauuggugagauugguagguguucagguucugaccacucuuaauguuaguaccagcagccuuuguaggcaauccauuaguuuguuauggaaaugcguagaaaaggcagaaaaugggucagggaccaaacaguuuuggaguccugcagauggugaauagcagcuguccuagaggaacagaaaaccuggcuagcaauaugcauuuggccuucaaagaaagaacaauaguaaaaguuuuaguuuaauuaaugauuaaaaaaaaaaguagaaaaccaaaauccaaaaacaaaaagccaaaccaaaacaaaacagaaaaaaaaaaaaaaaccacaacccuacauuguagucuuaauuaccccucuacuagaaagcuguggaaggguagcagaaugugugugugugugugugugugggggggggggggggaacaaugagguggcuccauugguaaagucucuugccaccaaagauagcuuaacugaguuggaucucuggaacucagaugaaggcagaggagagaacuggcuccacagagcuguacucugacccacgugcucaaaauguggcaugcaucugcuaccccacaauacgaauaauaaugaauaaaacuuuucuuuuuaaaagguaaacuauuaaagucaccuagucucuguggcuaugaauaacacaacauaugcucuaggguuggcaugauaauuucaacacugucuguaaugcuuacucggaccguaauuuacaaguuaauauacuuguaggucacugauauaucacuugcuuguaaaaauucauccuuguucacuaagcaaggauguacacacacagacaugauaguuauaggaaauauguaugucuucuauguaaagcaagaucaauauucuuuuaaacguuuugcugcuguauuuuuucuuaucauacuuuuguuuaaaauguacaucuuuaugaucuuuaaauauaaaaagaaaaaagugaauuucuucucaauuacgucaaauuuuaaaauagcagaagacaucacuuuuuuugcaaaagcugaguauagccaggcagugguggcucacuccuugaaucccagcauuuguaaggcagagacaggaucucuuugaguucgaggccagccuggucuacagagugagucuaggacagccagggcuacacggagaaaccccgucucuuuaaaaaaaaaaaaagauaaguauaaacauuauuagcauaagcagaaugaaacacauauacaauuuagaguaauauuuaaaguaauauaaauaccuacuugcaauuaaacaccucacucacuaaagucuaauuauuuuaauuugcugcauuugcuuuuaauuuaaccuuggcccuguuugcuuccuaccccacccaaaugugaacagaauuaauucaccccauacauuuuaauuuaaacuuaucguuuuccccuuuguuacuauaguucucaguuccauuaguauguagccacacccagguuguagcugaggcuuccccaggggucaucugugaggggaccuuucuccuucucaacuguuccucugcccucuuugaggaaggcccucucaauauguucauucucugcuauagauuugagacugugugcauaugguaaugcucuuugaauucuggcauguucauuauuuuuauaaacacuaaaccuaaauuuuugggacaugggauauggggugggcuugugauucuaguagacccuacuugagauuauucacucauuuaggauuuccccugaacaguaccuucccacaaacuacacgagaucaaucuggaaauucuggguacuaccaacagcaacaacaacaaaaaauccacugagugguaaagaaaaggcuugggaaagaagugacugcuauuggugucugaccuguguuugguaagggacucauauacugucuaggaacucacagggucagauguuagaaauaacucguguuucauaaagcugcagugcuuugcaucaggaagagaaucagaaaagccucuggacguuguugucccauacuuucaaacugauacuuaaccuucuguagacgggagagcucaaggauuaaaggaagggcuaugagggaguaugaggugaggagugggccucuccugcacucgaggguggaaccucucucacauugcuuucagguuucuuucuguccagaguagaacgggcaucuucuaggaaacucaguaucaucaaaccccaaagaguacguugugugauugugcuguucuccguguucaacauuuaguucauccgauaaagugaagucaugcaaagcggagcguguucuccuccugugguauugcaugcauugggugagcucuagagaaauguuggcugccuucggaacagcauuugacuuucagucuccuguuucugggcuaaugagcagccugugccucggcgcgucgccccuuuguguauuaaggaaucuggcccuaucaucccuuccuaucgcugccuuucagaaguggaugagaagucuagagacagagcagcucaacugcaugggacugucacggaacucauaggguuucugggaaguugauucaauauugacaugugguuaugaauccauauuuuucucucgucuucuuuauaucuuaucauugauacaucuacgggaauuccacagcaaguaucaauacuauauuuccuuucuuuaaacauuuauaaagaccuugcaaaagaaaaaaaaaaucacauaccaaaaaauaaccagauucaggcuauaaaugucuggaagaauuucuguacaguuaguauagccauuaucaauaccuucuaaagauuuuuguuuaauucuuuuguuuaauucugcgcucuguucuucaauauuggauugauuuuauugguuugugaauauugggaugacuauuuagauuuagaauauuagcuuguaauacugugcaguucuuuuuuuuucccuaggaaugauaaauucuuuuuuuauauaugacuaucaauuuuguuuacuuuuggugguacuggaaucaaauucaaaguuaggcaagugaucuaguaacugugugaugcuccuagcucucaauuuuacuuaguuuuaauauauuuaguuauauuauuucuauuuaguaguugcauaucacaucucuaucagcuggauaguauaauagauggugagccaaauuagaaaaugcuucauagucucuaaagacaaaaagaagccauaaagaaagcguaugagcuaacuacagcagcaccuagauaugccacacuaggugugguaggucuagaaaaguucauuaagugugcaauaguuugcuaaauuuucagaaaguaugaucaaauuaguugaccacaccaagucaagguaguugggaaggaugugaaaaggaacauguugaccaguggugugaaagcucaggccaucuaggaggcagccauguggaaccucagaaggugcaaagcagagaguagcacagagggccugcaccauggagacgcauauauuccauucgaauuguauuggccauggggauacugugagugaaaacauuguuuggcagagauagagcaaacagguuugggggaugaaugucuuugaagagauuagugcugcucugaaggagcccuagauuagaaagagaacugaagagaaugggguacacuuccguugcuucccuucaccacccgccacccaccucccucccccaccccaugcccacucucugguuuuucuuauguuacugguagcugucuuugugguuugcuucaauuuuaugucuaccuuuucugcucucuuguuaaagcugcaguaugaggauguaugaauaaaguaacuucaaguguuccuaaguuuuguuuuaagaauauucuagaucuuuaaaacuucaauaauguagucuuaagggaaaaaaaaacccuaugauugcccaacugguuuaugucagcauuuuggaaagaacaguagucuuuagagcuguauuagugauauaaaccccccuggagagugaagaaugcccggugcaugcuaauuuuguacuuauccagguggaagaagggaggaauagccaaagcuauagauagaacaaaggcaugucaguugcaaccuggucguaguuugggcucagcucucuucaccaaucccgaauagugacacugguaguuuccggugaaauaaaauuuauuuauuuuuaaccuguaucauauuaagaucuaacuuugacaaauugcauuuugauuuauagucugugcuuuuggcuugugcuuuaauggcauuagccaacucuagacacauacugaauucauuauguaccuuauguauguaaguaguaauacuuccuuuuaaugaacauacggucacaucaaagcgcugucgagaguguuuuacaaaggcaucuuugugcagugcuccucagaaguuuggagacguguguuaagucgaagaguaauaugcuuuauuuuauguugcauuuuuaaugguguaauauauuauaauuuugcucgcucuuuaaggugaauagucuagugucgucugcuugagucuugauuuuuagacuuagguuuuuaauuagaauucaacauuuugacauauaaauuuuauuuaugaccagaugaauuaagaauucauaaaguaagucaacuuuaaaucuguaaacugagauauguugcugagaaaaauuagauaaggcacucuuuuuauauugccuauaggugauaagaaauucauagaaucuauguaugcagccauuugggguaguacuaagucuuagcaaugucagcuaacaaggcuccacuccucuuuuucuaaacaucaauuucaucuuuauuuauauguauguauguaugugucugauuguaugccuggugugugugugcguguguguguguguguguguguguguguguguguguguguguguguguguguguguguguguuguguguuuacagaagcagaagaagacaucagguucacuggaguuugauggccuuccagguaguuuugagccaucugauauggguacugggaaccaaauuuggauccucugaaagaguagccagcucucuugacuaugaaaccaucuuucuaguuccauaaacaaggguccugaaaaugugcauaacauuugaagacagagcuuuccaggcagguuggaaaaguuagaguauugacucaucagauagguuuaaugucccucuguguucugagcccuugcccgugauguagauuugagugauuguaaggcacaccagauaauccuuuuaauuguugagaaaccagacucaggagaaagacgaggcaggauguucagacucuaggcaaaugagcuuggacaggcaucuaguccauaggaauauggugggcauccauauagaguuccaguccacuggaaaauggagggcaccuuugggaauguggagggaauagauggggggagauguauauuuguuuaggguguacuguaucuguaggaaccacuagaccccaguggucugaaggcagacaauggugugugggcauaugauagcuuuaggcaggugggggcuccuuauaaaccaccagcuuuggugaagguugacuguggaacugcauggggccuggccugagguugaaggcuaccaagagugacagacagcagggcaagggcaccuugacuguccuaggaacuaauaagaugcuuucauaauagcccagagcgaccuugggcaagaagcccuacacacagaaacagaauuugauuccuuuuacuauuuucauuauaaauuaaagugaaaacauugguaauggcuguaugacccaccuuuguauuuaagaguugagagugcaaguaaugaguauauuuuucuuuuuuuaaaauuguaguguuuagaaguguaagaugcuagcuuuagaguaauuuuuaaauauucuuauauauucuuacagucuuauuacauggacaugacuacuucauagauaaaggggacauuuuugacguucccugaaacucuuuauguuaguuuuuugacagagcuauuuggaguaguuuuguuauguucccccccccgccccccccacacccccgauuuuucuucuugagacaagguucugcuagguacccuccacuaguuucugucuucucagcuuccaggaacuagggcuauaggcuagugccuccauuuuuaucaagagcuauuuaugcuauuguuuuauuguaauuuauguaauaauuucucugaaaugaaucaacagcuuauuuauugaaugauuucauuuguaaccucacauaauuauugaguguaaauuccaagcuguagaauaucggaaaugccuuucuuccgucuaggggagauauugauuauauauguagcuauuuccuuccuccugcuaucccaaagggggaaguuuuguauuacauguuuauauuauuuucaucaacacauuuauguuaauacaugguuaugguguguggcacauuauuagguauauaaaguugcaauauugauacccuuuccuuguuaacuauguuguacauaaucaccauauuguuuuuugucugaaagacaauucagauauucugcucucagcaggcgaugaaguuaagcugaauuuuacaauauuuccaccuugcugguuuuuccugaguaugacuauuggugaccaggcugugguaagcugauuggaauuaggacaacucagucuuuguaaauugauuacuuuuacuaaaccaaacaaacaagaaacagaaccuuagcaucucucugcuugccaggcaggcaucauggcccuugccagagauaagcucccgagguagugcagggcacagagucuccccccauucauucuccugagaaacugaacaucucacaaagucuugugcuguucaaauagaaaguucagagaacaaacccaugauaauaaucaauauacgauuggauauuuucaguaaaaauucagauagagugugggguauagcuuaguuuuuguuuuuuuguuuuuuguuuuugguuuuuuuuuucccuuccugaccuucacaaaggccuggguucauccuagcaccccauuaagcugguugguggcaaaccucuaucauccuagcauucgggagguggagucacaauguuuuccauuugaacauuauguacaacaagagauaagaucaauuuaauacaaggcaaaguuucuugacugugguaguuucauacuuacaauuuuucccuguaauuugaauuuggccauuucagaggcuucaguagaugguuagagaaauuguucuaggcaguaacuuacagauucaacuaagaaauagucuaaggaaggguccgagccugguuguggguagggucccgaccaggcguggccaguuuucaugucugcucucccuggcggaugucagcuccugguaaacagguuuucagauaaucuggacccccagcgcugguccuaaugauuugauaacagcuugauaaggggcgggaucuuuugugauuagagagaggagucugauaagaaaccuucucugggacaaaacagauaaagguucuccgaaggcuucuugcuguuugaauuccccggcugguccucagugcgggauucucuguguuuguuauguaggucacacuccacuccgagucagucaucccuggggcuggcggcuccugcacuuuguuaaaccuguuaaaauguacucagacaaauggagagguugggccuguguaaguggagaggcuccuuuguguuggccuggcccaugaggaaagguagcuuagucacauaaaguuguuaauuuuguaguuggcuuauguuaaauccaaaaguaaaaacuuaaacaaauaaguaggucugggagaugccaggaaaaucuucucggccugcccugugguaggugugcggugcuaagcagucaaggcacagcgcagggcgugcucaguuuagugaugugcagagaagaaaaauaaauauuucguucccucccuagcuuuccccuccucccccuuccuccucuucuuccucucccuccuuuuggaauauuugauauagagucucucuguguagcccuggcugucuuagaaccaggcuggcuuuaaacucacagagaccuaccugucucugccaccugagugcagggauuaaaggugugugugugccagcacuagccccucuucuuguuccugacucuuauuacuuuguagcccagacuggcuuuggaucucucauuuuccugcaucagugucugaaaugcugggauugcagcuuugacccacuauaguuggcaagggaaagagcuucucuuuucucuuccuuuucuuuucuuuucuuuucuuuucuuuucuuuucuuuucuuuucuuuucuuuucuuuucuuuucuuuucuuuuccuuuccuuucuuuuuuucuuucccuucuucuucuucuucuucuucuucuucuucuucuucuucuucuucuucuucuucuucuucuucuucuucuucuucuuccuuuuccuuuuccuuuuccuuuuccuuuuccuuuuccuuuuccuuuuccuuuuccuuuuccuuuuccuuuuccuuuuccuuuuccuuuuccuuuuccuuuuccuuuuccuuuuccuuuccucuccucuccuuuccuuuccuuuccuuuccuuuccuuucucuucuuuacuuuuucuuuuuugagacaagguuucucuguauagccuuggcuguccuggaacucauucuguagaccaggcuggccucugauuuugagugcugggaugaaaggcaugagccaccacugccuggcagggaaaagauuuuacuuaggaagauucuuuaguggcaacagaaagauugggaaggcaaaaggccuagcuugaaaauaaugaaccaaaaaugauuugaaaaaacccuuuccgucucuccacugcugcaaguuaacaggugacugccuaagcugcuggccucucugcugcuguugcaguuagaaacgggacagugcugucaccacccuuacacugccuuuuuuuuuuuuuuuaauuuauuuuuuaagucucuagcacuggagagaggaaggacuguggcuggggaggaagcaagacuagaggcugacccuucuuuugugugaagggacccucuuagcaaggcuaauguaugagacggggaaguagguagacauuaggaagccaggcaggaaaccacagccagguccaggcuacuguuugcuguuuaagggacuguaauuuggcuuuaccauauuuuuccuagguuauuacguuuuauagcuaguguugguuuccucuguaaaaagcagcaaaauuuccucuuuuugguuucauuuuuaagagaaaaugaagagagcccuggauagagauuugauaaguuuaggagcaauauaauguuaugucaguaucguuuuccaagauccauucauuuuccaaauccauucuuuugacuuccuauuuauaaagaaaaaaaagucugcuugucaguccgaguggaaggaaagcaaagacaaagggaagugaaauucagggauuuagaaacagguugucaccacacguuugagggagagaacguuugccagaccgaugaccaguaaacugcuauucuccaucacgugggucccggggacugaacucaggccaccaggcuugguggcaaacgcuucaaccugcugaaacauuuagaauuggaaaauauucacuauguuuaaaaaaaacauugugacaauaaccauaacuuuuuugagacugcauuucacuguguagcacuggcuguugauguacaucugaaaggaccauuaagaaacucuucccuccccccucucucucauguguguuucacauguacacguguacaggugcuggugacuuugggugucuuccuccaucucucucuaacuuauguaugaagcagggucccuuacuugaacaaagaguucuaguugagcuaguuaguuccaugaaccccccccccacacacacacacccaccgccauccccccuccaccgccgcauacacugguacuaugauacuaagaccacuaaguauuuuacacgggugcugggaaucuggaccucaugguuacacagcaaguacuuuacccaccaagucuucucuccugcccccauuucucucuucugauaaauuagaugauagugguagcucuaaucaugccuuuggugaguuuauaauccaagaagguaaaucaggaacccacgaguguugcacaaggagcuuagggcauaccuuuuacuguaaauggagauucuggugagauuccuauguuuacacccagaaaggaaggaaguccuuaauugugcuguuacacuugagucuccuuugucuugggucuucaacuugacuguggacugaaggacuucuuucucuuucuccugccuuucucucuugccucaucucugcuuguguagcugagagaagagacugucagaugcagugaguucaggacuuggucuguggagaccagccuugacaccaaacacacauucucugagaaagaaacuuugcaaaucuucuccaaacuuaggagaaaagagcugauacaucuagagcauuagucuugguggcauuuuagaaaacuucaggggaaagggagagugcuauaggacaucauggacauugggagcaugugacugucacaaauaugugaacuuuacuccaguagcccaaaauccagggcggcuggaucaaucugaccuuuuugauuucuguuuccacccaugauacuuugguauacagcacagagguaguagcuguuuaaucaauaugcacaaaaggaaugaauuuaaaaauuauucagcuaaauuuuuuuuggggggggcacaauucuguguugccuacagacuugcucaacgaagauagaucuucuccgucagaaguaggccuuccaauccaagaggacuuaucaaugaguuuaguucauuuugcaaaucacgaagagcaaaucugcgcuguuaggccucacaccuguacaguuuaugauauuguuuguauaugcuuggcccagggaguggcacuauuaggagauguggcuuuguuggaguaggugugucauugugggugugggcuuaagacccucauccuaguugcuuggaaguuaguauucuguuagcagccgucagaugaagauauagaaugcucaguuaugccuacacugugccugccugaacaugguuccugccuuggugauaauggacuguaccuccgaaccuguaagccagccccaauuagauguuguccuuauaagaguugccuuggucaugguaucuguucacagcaguaaaacccuaacugggacaguuuauuuaacagucucuugucuuuugacucccccgacuucaauuaauuuuugucacaugggccuuuuuacuuugggucuucuaaggaguaguaagaggaaagaaggaagaaagacaaaaaaugacucuuggcuugugcuagagggaaugcauuguccucgaguaggcaggcacagggaguguucauuguaaacuaauguauagaacauuuuguacgaaaauagcuaaugaauacccaaagcauucuguuguuugcauuuuaaaugaagcuucauuuuuguuacucuaguuagacuccuaagugucugagaaguagaaaacucacuccucauuagauucauuuaaaacuuuuuucaagagagggaaaguccuggggguauagaaacuucgcuuguuucagugugucauguugaggcaucugacaguguuuccuuuacaggaggccaaagaccacagauccacccugauugcuaauuauucagauuguaaauagcuuguuccagaacuuagggcgagacaaaagaaacacggaggaacaaaaggccuaggauaaugaaaaagauacugggaagagaaaggccaggcgaaauugugaugcgggucacauccugugccugcauuuaauuguaccuuuguauuaaauaauaaaaaugauuacauguucggugcuaacaggugucccuucuugagaacuauaguauggauaagugacagcaaauuacuccaauucaucaacuuagaauauuaugccuuugauuuucucuacauuagaagacuauauucuauauuagaagacuuuuuuuuuuuuuccuggaaaaauguacaucaacccaggaugauuuuuuuaaaaaaacaaacaaacaaaacaaaacucaauucuugguagcuuguauaaaauauagaugaguacuuuacagucucaguaaaagaaaagucauuuugugggcacuaccuaacauauuugagauacuagaucuguauuucuggcauuuuguguuucuguuuaagcuuugguuaucacuguaaguuagcaguuauggaccgucauaagcagucuuucuuaauugcuuuuuagaagaaagauuuacuuauauuauauauuucacgguuugucugcaugccuguauaucaugguugcacugucuguggaggccaaaagaggacauaagguccccuggcaccggagguacacauggauucugggaccugaacccagaggacacacucuuagccacugagcugccuccccggcccuuccuuaauugcuuuaauugcuuaaggcuuauuguucaugcauuggcauuugucugggguaggcuggacgacucucuggcuguccuguuugugagguagguguugacugagugauagccagcagguacagccugggcugugaugcugggagcacuccacacuugcaucuuccccugggcccugcucaccugaggguguccucauagcguuggcagagaggaggggcagagguccuuugaagccccacuugguuacuagcacuccacugaccaauuaauuucccguuguggaguccagaguaagagagagaagggguuaaugaagacuuaggacaaaggcuacaggaaugggauaagagcgagacaauauuuguaguggauuacacagaugcacaagugaaauauaaaugaaauuucuaguccagggggaaaggaugauuucugguuuuuguuguuguuguuguuuguagguuuguuuguuuugcuaauuuccuugcugaagcaccugguugggguagggggaaugagagagagagagagagagagagagagagagagagagaaagagagagagagcgcgccauuauguugcuuuggcuggccuggaacacuuuauauagaccuugcuguccucauagagguucaccugccucucucuccuauguacagggauuaaaggaauguguagugaugccuggcuugucuguuuuuuuacuguacauuuauacaaaguaugggaagcaauaccuggagaggcacagguacaccacaggaacuggguaauuucagaagaacucauccuuucuguaaaggacaguguacacacacacacacacacacacacacacacacacacacacacgagcugaguaauuuuagaaguagucaguuucucuguaaagaacacuaugcacauacgcacgcaugcauacacugccuuauccacauuccuccacccaggugagugagacccugaaaaguugcagcacagugcucucaaucccagcaucaccgcgguguguccuguaucucgcucgcucugcaucauucccuccgugguucccgacccaaccagcccugcccuacaucgcacgcacuuucagaaagugugauuuuggaaaucgugugcugucagaaguccccaagaagcgguucucauuuccacuuuugcuuuuccgccgugcucgucacacguacuugaagcagaaguuaagaaucuccacacugucacguacacauaccuauuuugcucaguuuacugcacucuucccccucagaaugggaaguuuuaaauguaauggcuacaucaaauuagcuugacuuuuguagauuagcccaacuggaaagggaaagcugcuacaggucaccgugacaccagaagccugagacaaugaagcauuccgcgaggauuuuguuggaaauggggcuaaggcuuuagaagaacauauucuuucuggcaggcauccgauccccucugcucaucaaaaugauugugucagacucaggucagggcauagaggaugggaggaaauucucucaguugcaaacuggcuguuuggugaugaaaucauggcugguguuauuuuaauaaauuguuguucuuaaaaguuagacuuucuggacuacuaguagagagaaguuaggcacgucuguuuaugcaugggucuuuacauaaccaaagaccauuuaaaaguguccugugcuaaggaacugcagggcauccucacagcuucacaaacuuuaaccagcuccuuaacgaccuuuuuacuuuuucuuauuggucucuucuucauauucuuuauacauugaauaauuuuccuuccuucccccucugauucccuccucccucccucuccccguauuuguucuuuaacguagaugccagacuuagagaauaguauuuguagaguguuuguguaaggccugucucuuagaugguacauuccaaaaugcacauacucacauguguuucuguuagaagacuucucacucuucuuggucaaggccauuagaagauacaaucucuaccccagcaacuguguucuuuuugguggaugcaucuuauacucuguguuuggacaguucuccuccaccaccaccccgcccccgcccccgcccccuucugugauucugugcugugguuguaagcuuagugugugcacauauguaagauuucaagugcaaaugagaucagagcaggagacagauuugugcacuugcugccuggacccuugugugccuuaccccagguaaugcugaugagugaaacagagcugccgcgugguucugaggaaauggguuggagugagcagggcaauuggaugggcauuugaggccauccuauccuggacucaugacuggcagcuuugucaaaaaguccuuuuuuaucuagaaauaaaauuacaagacacagaaauaguuucaaaaugucaagaaacagaauggggccauuuagaugaaaaaaugaaaauguaucacaccucaggaagugcucuccgagggcacccgugucccagggcagagggcaaguugaagugaaucaaggugggguuuugcucggaaugcagagaggaaaguugugaaggaggugccugggcagaguauuucugggaggagacaggaaccacugggcucagacaggaguuaaaugcuuugguuuucagcuuuugggagcuaugagccacugugugugcuucuccacagagcaggaacuacaugugggguacuucuuagguuggucugucugucugucugucuauuuauuuagacagucucuuuguaguucuggcuguucuggaacucacuguguagaccaggcuguccucaaaagucccagagaucuaccugccucuacugccugcugagugcugggguuaaagguguagguaggucacaugaccagcacucuugucaccucuuuuccccggagagacagcaacucuagagugucguuccauuucaucucuugggcuguguguauucauccagccuugugcaguguguucugguuuuaaagaacuuccuccacucuugaaaguuggcuucuuggaguuggcugucuuaagccacuuuagggucacgcugcguugaaucugccccccaccuccuuguauuuuauauucuugauuuuuuucugauacaguauuuuaagggaaguaaauggccccgcucuggauaaaaaacaauaaacauuuugcccaucuggcuuuaguagucacccucuucuuacagugagcucguagacuuaggaggagaguugcuuccagccuggcauucuucaggcaguuuucgaauaagcuguuuguggggaggggccgcagggucuccagucaucgauucucucuuuauaacuuugcccuuuucccuggaacaucugacuuguucagggcucccagacugaaucacaaggaagaaacuuuacauaaaccauuuauacuacgaguuugguaugcuggaggcaucaaucaacaacaauauccauuagauucaucccuguaucaguaguaucuugauagaacugaucccgaugugugggaauuugaacucugcuucaauacaucuagcccuggauaauuaauuauucagggcacagagaacccggaccugcaauguagaguaauucucccuggucagcguuaacugcgcuggcaauaauaaauaggaaaagccuccagugaugccaguauuuuaaagugauuaaucaucucuucccccuucuccucccccuaguuuucuuuaacuaggauuuuucagcaauaaaucucuaacaacacagguagggauuguucuguaauuaaauuuugcccugcuuaauuucuuaccuuuuaugugcuauuaaaaaaaauguuacauuuuaaggagcccugaucaaaauuccaaccauaugaaauccuuuuauggaauucugagauucuggaagaugaaagucuugguuuugaagacaagauaggcaugcacucauaaaaaauuguucaacaccaccaguuggggugucagauauuccaagguuuugcauugccucgcuuccuaguuuaugguuuuugucucuauuggaaaaagucugacauauacauauguucccacauaaagagaauaaugacuuauuugagaaauaaguuuaaaacuuugggauaauugaugucagcucugcaggaaagcaacaaucccaucauuuuucuccuacacaaaacgcccuugcugaagaagcagguaagugucgcccgaggaugaccacauauuuccagaugguaccccguagcgcugcccagccaucacacagaucccaggugacagggacagaugugacauauuuguugugacacacuucuguaccacccguccguggcucgaggugacuccugucccucccuucaugcuucucucugcuucaggacaacacaacgaugcacggaugaaccucgccaucgcccucacugcugccagguacggggcugccacggccaauuacauggagguggugagcuugcucaagaagacagacccugaaaccggcaaagagcgagugagcggugcgcggugcaaggaugugcucacagguaugccgggguccaccagggaggcauuuccuagcauuuugccaugcuuguauaaugaccgaaugaggauuugucugucacccuucuuucagugaaaggcagacuucagucaucuuaauuauauuccuuacagucaacaaugccuggcuuaacaugaaaauguucccuugugggacuugccaauuuucccccuuuguguuaaauaguaacacuaaugauaaggauaauaauaaaugcccacagaacucucacagcugugaaggccuuucauuccccucaccgaaacaugugauuaauaaaauuaaaucaaugugccaagucuccgagcaucacuuaggugacacaggcagagcuuuugagucaaucacguauaacucaauaagauuuccaggcuuggcacagcccuauggcuagguaggcacuuggaaaacugcaucguuuccugaacaaaagcaaggcuugcgagauauauuuucccaccguaauguggcuaaacauuuggguauuuuuuuuuuccuagcugacaaaaauguaauuaacuuaguguaugcguuuacaugugugcgugcacgcacucacaccugcacgccauagcuugaauuuggaagucaaaggacaacggggagucaauucucuccuuuccacccuguagacucucaggaucaaacucagguuuucagacuugaugucaaguaucuuaauucucugagcuagccagcccuuuucuuucauucccucccucuuucccuccuucccucccuaccuucuugaccccagggccuuuugaacauuaggugggaguucucauccccaguggaagauaccucagccuccugaucacagcacuuuguaaauagacugagaaccacaaugaaaaagugguuuggguaaauuuucugaaaagggagccuuuccuuuggcuguuccugucacuuagugugguacgcacuauauagacuucaccauagguuaaguuaacagaugaacuaauaaucagcuccggugagcgcagaacaaaccaaguauguaaucaaugcugcuuuucuucacagggcaggaauuugacgugagagccaaaugcguuaucaaugccuccggcccuuucacagacuccgugcgcaaaauggaugauaaaaacguuguucccaucugccagcccagugccgggguccauauugugaugcccggauacuacagguaacagcacccugucuugacauccauuaccagagaaacuggcucccaggggauuacauacugaauaucuucuaugacaucccccuuuuaaaaaguguuuuauuuaaauuuugugguuuacuuaaauuuuuuuucauugugcauacuucuuguccuacggacacuuccucauaagcuucuuuguccaggagcauaucccucccauguccccuggcuuucucuuuuuucuccuucccagcccacuagucccguuuggcuucuuccauaucauauaugcauacaugauauacuuacaugauuuuagagaucuauauaaaauaaaaucuaggagacacaauugagagaaaauacaucacuugucguccucuugggacugagguaacuggggugguaugauuccuucuagucacauccuucuuuccguaaucagcaugacuucuucaugauuaaagaaauuccauugugugcauauaccacuuuugcuguacccauuccccugucguugggaccccuggguucguuuuguagcugaacuguugagagcaauauggcagugacauugaugcaauggugucugucacguuuggcgucgcauccuuuggugcauucccaggugaggcauagcuaggguuucuguuugagcuccucccaccccucagaaccuccaugcugauuuccauaguggcuggacuaguuuauacugcuccaaauaguggaaggggcucccuguagcccacaugcuugccagcauuuaucguuacucgcucucucaauaacugccauucugaaugaugguuagugagaggaaauacuuuuucacacauucauuggcuauuuugaaaacuuuguuucauuggccuaaucuacuuauugcuuggcuugcuugauuuauuugauuuaaagagcacacuugagcacacaucuuuuuauuugugcucgagugugugcacaggcaugcgugugagugcguggauaugcacauauacaggugugcucauggacgugugugcacauggaugccugccacagcaugugucuugggggggggggugucacagaacaauuugugugagucaguucuuuuccuucucuguggguccagguauuugaacucaggucacagggcuugacagcagacaccugccccugguuuguuuguuuauacuuccucauacauauaucucgcaagaacuuucuuucauucugcagacauucuucacuugacaucucuccuuuuuguacaauuuucaguuucauaaaaucucaugugucuguuguuggcauucuuuacugagcaauuggaguccuacucagaacguccuugcuuggauucuauagcaccuuaguacaugacuuuauaaaguuuggcagugaucuguuuugagacagggucccauccauauugucaucaaauuccugccuauucucuugacucaacuuucuaauaauucggauuauagucgucaaucaccacacucagcguuaucuguuuuguuaacugcuguauccuuaugucugacuugcauagaaauaaggugauuuuuccuagcuaucgauauuuugagauuaggcuaguacauagagugaaaauugugugcccucuuucuuuuugcaucauuugcagaaguguguuuauggauuaguaacguuuguauggauuaguaacguuugauauaauccuaacuaacaguccagguaugaaaugaucauuauaaguuaugguaacagcuuuuagguguguguuugagagaagcagggguaguuaguauuauuuuuuuggagauuuauuuauuuucauucuauguguauugguauuucacuugcauguaugucucugugccacaggcaugucugcagcccguggaguccaaaagaaggcuggaguuaguggaugccauacacuauguaggucuaaacuauguaggauacuauguagggaucaaaccuggguucccuugaagaacagccacuguuuguuaaccacugagccaucuccccagccccaguaauuuaacuauuaucauuuucaguuauguguguacgucugcacauagguauguacacaugacuacagguacccaaagaggauauagggggaauuggcacuccuggagguggagccacagguuauugugagucacccaacagaggugcuuggaauagaacucugcuucuuuggaagaaccaaaccacugagccaucucuccagccccagaagaauuauuuuaaccucagaaaaacccaacauacaaaaaugauuuuuguaaaucuacucuuaaaaacccaauccggaauuugccucagauuugugguuucuuccaacagcagcaccagccucccacuggcugccgugcacgaauguaaucacuccuuccuucuagccugcuuuuuuacuacugacaagaggucaauuuuuuuucugguaauguguguacauacuguuagcucuaacacugauugcuaaguggcuaacaauaaauugauuucaguuuaacuaaggguuccucaggaaagcaauggucugcaugagaaaaauguucacucccuuuaauccuagacacacacauaaauuagccagcuuccccugcugaugccaaaugaaucauacagauugaaaagagcugugcaccucucccauccuacugacugucaccagagcugacucuuuagggugaccuugcagaacuaauccuucauaagaaaacaaacuuuuccucgagggagacuaugaauuagguaauuuagaacugaugaaagauacuuccaaguggauucuuaaaauuuuauaccauuuguuaguagcucugucuucccucugugcuuguuaauuuuaugcuugacacauaugucuuuacuuaggcagcugauucucuacagguuccagguacauguuggcugguaacugucaccuucacccuuuaaauggcuuuuauugcaguggaaguuucugagggucucaguaguuucuaacaauacuuccuuccuaggucacuaaauauuagaaucuuaugcuuaauuuuaucaucuguauuauuugaaaccugucaugaguuuucuggaccaugaggugguuguauauaaaugaagucaacaugauauuucucagaaguuucucaaauguuuuguuucaacaaaaagccauuuaucaaaccgaagcuuggaauuuaaaugcguuaguguucaaccuaaagugacugaugacuuaaucuaaggcugugucaauuugcagcccccucuccuacucucaaaguuuauaagacuugagauugacuaggaauuugaggucuaauagcaaauaaauuuaaugcuuuuuagagaccaaaaaauaucggauacuuuuuuccgugcauaagaguaaaauuuacuuccuuucugggucccuggauggucaagagaaccucaggaaaagucuacuuaaugaaggaugcuuucccugggcucuuuggauuuaggacacauacuauguagggcuggcagcguugcugagaaagacugguccuccugguaguuuacauaacaaagaagaacgaaaguugauugaacauuucuguuuuguguaaaguauuuuuggguuugcuuuuaaacagcuguuacccucucacucuuacccacuugcauacauuuuuuaaaaaauauuuuaaggguuuaauguuuuaagugaauaauaaacauaagaggucuacuauauguucuucaaauauauuugcguaaggaagauuucuggaaaauugcuuaaacuaaauaugauuguuuccugucuaaggaaaugucauuguagaauauaccaucaacacuagcucucuaugagaauucaauaaagugugacagcuauuuaaagauuucuauuauucauuccauuugaacgugacaguuuuggauucuucccacuuuaacaacuucauguauucuugaaaguggaauaagugcacucgaacaauaguuuuuagucagccauccauggguuuuauguuuaacuuaauguauuuauuuuaugcgaauggauauuuugucugcaugcaugguuauucaccuugaacauguccgguacacaaggaggucagaagagagcauccuauuccccaaaacuagaguuacagauggcuguaagcugccacaugggugcuagcaauugaacccuuguucgcuggaagagaggccagugcucuuaaacacugagccaugucuccaguccaccuaccgguuuucauuaaugcuuguuuguaguugcccauucuuguaagugcauuugugauuuugcucuugaauuguacaguauguguuagugaggauucuuggcuaagguuuagaaagauuuuuuuuuccaucuaugugaagaguuugucuuucauuuuaauuauugacauaauacaucacuguuuuguuugaaaguuucuuauugcuaaccuaguccucuccauuuggcccaucuaaugacauuguuauuuagcaaaucuagaaaccacaugaagagcuguuuucuuuucaaugcacuuccugacucgccugucacacuuugaaauaaaguaaggaaucucauuugugacaaaguagcacagguucauuuacgcaucacagaacgaaggaguuggcgauucaguuucaagaaaguuuggcuucgcuuucucaucacuucucaggcuuucuacugugggauguacaaaaugucaaaugucccaggaaaauacuucucauagaucccaagaaagguugaagaguuaucguuaauuggccauaauaaaagaaauuauaggcauuuauuccacugacauuaucuaaugugaaugauccagaguuauaaaaaccaaaacaacuaagagacaaccauagauuauuagguggggaagauuacaagauaauauuaucucauuugcucaguuccuuaucuuuucuuaacuuuuuuuuuuaauuuuaggaauaucuauggauuagaauggaguaauaaaauaaaaguucauguuuuucuuguuuugcuuauuugggcaugagcgccaaacaaaauagaauuauuucuuuccaccuuagcccugagaacaugggacuucuugauccugcaaccagugauggcagagugauuuucuucuugccuugggagaagaugacaauugcuggcaccacugauacgccaacggacgucacgcaccauccuauuccuucagaagaagacauuaacuucauccugaaugaagugcggaacuaccugaguucugacguugaagguaacauaaauauuccugagacauuucuuccuucuuugguauuuacgacuuucucagcaacuugcugggccuuucuugccuccagcccaaaacauaaccacaccuuguauacuauaacccucagccuuuuccuccccacaccccugcucaugucccauucugcuguggcaaaccuagauccuugcaaauaccaggaaguguucccucuccuagcuaauacccucucccaacaaccacacuuuuucucuuuugggugggugagugggugggacagagggaagacagggcuguauguauuccaggauguccuugaacucuauauaguucauggugaccuugaauuuaugaucuuccugccuuugccacuggaaugcugggauuauagaugugugucaccucccugucucaguuuaccaagugcuggaauaacaagccugaacuacagauauauuagcccguguugcugucuuucuguuggucugacaaaaauacuauagaaucuauacuuuuaaagguuuguuuagccaauaguuuugucuuacuuagaguuuuauugcugugaagaaauaccauggccaaagccacucuuacaaggacaacauucaauuggggccagcuuacagguuaacagguucaguccuuuaucauggugggaagcaugaaggcagacaugguguugguguaggaguugagaggucuacaucuugauccaaagguagccaagaggagaguugucaaccgcaggcggucaggacaagacuaucauccuuacuggguggagucagagcacaggauauuucaaagcccaccuacacagugaccccaacaaggucacaccuccuaauagugccacgcccuaugggcaaaaguuaaagaguuaaaacccaagaaucucugggggccaaaucuauucaaaccaccacaaguuugaaaagugcaaagacucagauccagcagccccauguguuuggacuuuggggagggccuuuuggucauguucagcuauuacaugcagggaagcaucacaugauaacaauauauaugaaaaugggagagaagaugaggaggcaagaaaguccaaagacugggcuuaggucugacuuggucuuucaugacauacugcucuuggaaacuuaacaagucccagguaggcugggccauucagugaggccaacuucgauccugagggugcucucaauacagucauuuuccucuagcucaccucuuaacguucccacuaucuuucagggcuguuaaaugggaaccaagcuucuagaaauugacucuuugagaaagaagucaauuuucacaucauaguggucugguuagugaugaaaguucaacagagccaaagaugacuucuuuucaguuuauaacugggcauuuuuacuuggaugucauuugcucucccaaaguuguaugauggacuuucuuaugcauaauagccucaauuuuccuaguuuuuuuaaaaaucauucugguucccugccucaauaguuaccccaucuucuaagcuagaaauaacauucccucuucguuuuuccuuaccuagugucuuagggcuucuacugcggugauaaaacaucauaaccaaaacaacuuggaaggagagggcguauuugccuuacauauccugaaucacaguccauugaagaaaauuaagcaagaacucaagagugagaccuaggagggaggagcugaugcagaggccaugaggaguguugcuuuuggcuugcucauuauggcuuguucagacuguguucuuacagcauccgggaccaccagcccaggguggcaccagcauuaauggacugcucccccuccccaaucaaucacuaguuaaugccccauaggcuugccuauuaucugcuguuauggagacuuuucuuauuagagguuuccuccucagaugccucuagcuuguugacauaaaacuagcuagcauaccuagaacacuaugcacaucucuuugcauuuuaucucucugggcauuguccagucuuauacccgugccuccuucuacccccagacuguguuauuauguagcacaggcuugccuugagcucauagcaaucuuucugucucagucucucaagugggauuauaggaguaugccauuaugucuggcucaggugucauuugauacuuaguugggaguggcccuugaaugggcucucuauguuaguuuuuuuucuuuuguuuuguuuucgagacaggguuucucuucguagcccuggauguccuggaacucacucuguagaccaggcuggccuggaacucagaaauccaccugccucugccuccugagugcugggauuaaugacgugcaccaccaacgguuuuuuaucuuucuaaucuuuccuuuugucagagucaguggucaucucuuucaugcacacacaaaagagaaaaaaagucaauugagaaucucccacugacuuuaagaaaaucucuaacucucugaagugacauauguagauucuuacaaugucuacaaguuuguauauaaacccuuauucuccauguauucugugguuuaaugguuguauguuuaucuuuaccaaguuaggccauauagauuuaagcccuugucaccuuguuucaguauagugaugacuucugggcuguccuuuguccauuaccccaucuuugucacagauauuuauacuucagaauucaccugucuuucgguaguuaacuugcacuaaacaguuauaaaaucaaagagaccaugcucuauauauccacauuuccaggauuagugguugacugggcauacuucuccccccuucucuuccuuccuugugucacaagugccuuccuggccagguucacuuuaguggcuuuguuugugguaaugauauucugaggccuagagggugugaaugagucuuuuuuacacuuaguauuaguaggccacagguucugaguucaguaugcauucuauggcccaucuugggcuauaaguucauugucccacuggauuguuguagguuguuuucuugcaauacccuugucaacgcagaagauuuuaguaaccaaccucuucuauuccacccccccucugccgccaaucuuguuugauuucuccuuaggacacgagcagaaggacuuaccauuuucucauuuuuuuccuucuucugaaauacguuggcacacuguuaugguagagcuuagccuucagaacagaaguuacucuuuccauuuuucccuuuuucucuucccaugguaauccaaauaagcucuauaacauucaccauguaguucaguguucuccuugugugagagugauaguuacauagccacuggcugcagccacuuaggcugcaaagaagcucuuaauaguugggaucucugagaccugcucacugauuugcugaacuccaaaugggaaagcucaggggauuuaguaggugcguuuacuuuugccaucuuucuaugguaaaagagacagguuuaaugguuuugaaaaaaacaguuuaucuauuucuaggagcagucauaacguuggcuucaguugaggaaaugcagacacuauuuucgucuggaugcagaucacuagcauuuaagaauccuuuuucccuaaacugauuuuccauugugugauccugaauuuuccaacaaaacaaagagcuuuagaaaguggcucagauuacuaucuuaguuugaucggucuguacuguacauuuuuaguuacuucuaauuuaaagaauuggauaugagccuauucucuuauuaaaccaauuauuauuaauuuuuaaaaguguuguguauguucaauacauaucaucuggaugcagccauucuuuguuuaacauuucuauuuaagcaucuuaaagguccuuguaauuuaaacuugaugcuuuuccauugugcaucuagaguucuagauggaggugggauaccuggauaugauuguauucugauaugauaacaacuucuguucacuuuuguauaauguuugucaagagaaggguuacggaugugcuauaagauugugggaacaaaguacagaaugaaucccagaguagagagcuccuccauaugggcacuuccuuaaaccuuccauuguaagugcaguaaggacgccgauccugacugcuuacugugcugagcgagaggcugggugugcuagagguggugguggguccuggaaagccacuguguccaggaugagugugaaaaccugaccccgauaggagauuugacauuuaacagaggugguggcacuuuuacucugcuuauaaauagaagauguggccauaccugcuuguucuccagaguccccuucaaaucccuugcccuuggcuuaucagagaaguagagaaacuggcaaagagugcuucuuaauucuacaguuuacgaaagugggugagcuuuacugaucauguuuuucucuuaguugcauaggggcuaucuugacacuguguccauuagguaugguauccaggaagugacagcucuggauuacaggaugugauacgggaucagcacagacuggauuaagucucucuuuauuucaagauacaaaccuugaaaugaaccucucaggaucauauaccuuugggaugaugugugacugaauauggggugugugugugugugugugugugugugugucuguguuugucugugucugugucugugugugcauauaggcaugaguguggaaggcagaaggccacuugauuaagucgugucucugucucccuuuauguggguuguagggauccaagucaaauucccuggcuggccgagcaguugccuuuucccccccagagccaccuugcuagcccagagucaaaacgcuuugcauucacugagguccaucuaaccaucugaaaaggcuuuauuaaauggauaaguaaguucugacaacaguuucugagucuccucaaauggcucuauccuuaagagagggggagaggaaagugucaaauccucacacuccugcugcugcacuucugcagaaugccugggaacaauucuaaaaagcauuuugccuguugggaauaagcccaugucuucuuuuacaguuuagaaagccuuuucauucacaggcugaaauuucuagauuacuuguuuguucuuugcugaaauggguaauugauaguucugcgguucguguugaguuaggaagaaaaaugaucuuuuugaaaaauguaucauuaaguucccgugcagagguuaaucagagggaugccgugguggggacuaagcuauggcugcaguggauuaagagagacagaagauuugcugggcgcuuccuccaggcucacaguguucuggggugcuucucgacgcagcagccucugcacuugcacaugggcuugcacaugugcaauuaguaguguuuauagauugccuguuauucaauuaacagccgagcuggccauaucaacucacugcagaccugccuuucccugccagggauuguacucggguuaucaacuuacacaggcuuggcugucuuccagcuguuuaauuagagugucaugcgccuugcuuuuucuaguuucauuaguuuauaaauguaauaugguaucuuauuucugcgauuaacacuucauuccagcagguuaaacccgcugguugaggaguauugauuucugacacuguuucccuguguucauuuagauauuuucacauggcucuuucagaagguuuuuuugaaaguggcaagcaugagaaagaauaccccuuucucuaaaugcacaccuggauaacuaccgucaaacagaaucacacauuuaggcuuaauugucacuugcuguggccuucacuuucuauuaaucuuaaaacaaacacuugucuugcccaggauuugaggggaaaaguauuaauuauaaucuaaaacaaucaccuggagcuuuucuccuucaaggagccauaaaaaguucugcucaccuuuauacaauugcuaucuuacucuucagaccauagaguaaacugaacgagugaauuacugaagacauaauagaaaugaguuuaauagggucucacuguuauagcccuggcuauccuggaacucuccuugaagaccacugggcugaucuccaauucagagaccugacugcuucugucuccugagugccggguuuaaaguauaugcuacugcuccuguguauuuauuuauuuauuuagccaggcccucauauuguagcccagucugaucuugaacucaagguauuucuccugucuccaaguccagagauuccaugcuugagacacaaaccacucugagcucagagaacucuucaguaucccaguauaaaauacuuccaacucuaucuugcuuuuuccuugguacacuguucagaguauugagcgaccuuagaaucucuacugccaaagacaaguaacacagcaagaaagagauggaaaaguaaaggaaucuugauuagcugcgugagcagugugagucuuagaucuaagacaccaaagccccaguuugcugugcucuccacaaaugacacuuuccacuccuguaacuguggacaguuuacuacuuacucuuggcuacaaagguguaugauaggaccagugucaguuuaauaauuugagaagaagaauguuuaguugaguagacauaguuuucauuucuugauuuuuaugaggucaauaugaaaggggaauuguuuggaauggaaaguaagggccaugagacuugaagccuuagguguaaaagcacacucuuaggagcagagccagcuagucaaauggcagugggaggcugugucuuagaaaugggggcaagguggccuugaugugaguagccaucuugaucaucugaucagccugucuguguuauagggagccuuuagagaccuguaugccagcuauuuaaauuaaguccaguuuuccuuccucaguugccuaaaucacauuuccaggugcuagaugcugcuauuggcuagugaauuggacagucuaauggcagacuuucccccacacugcaaaaagagucuguaggacuguccugcuccuuggagucuagaucaucaaaguguugaagagaaggaaacccuugguuuaauggagucauugcacugagggaggcuacagcucgauauuuuacaaagcaagaauuccagauguaagaagacaaaaaagcugguuaauuuaguaauugugcaaugccuuagguagauguuaaucuucuuugcucuaccaccucuaagacuucuuguccuauccuuggacuguuucuuuuguggugauagcacggcugcaaaugguuauagaaaaugagaagacaaaauggcgguuuguuauucugauuauccaucuucuuugaaucuccuucuuaaguuuguuuuacaagugugcaaggauuccauguuggcuuauagaucaucaagagagaauucggucagcuucaguuaguggcuauuuauucuccuugaaaguuagaacugauguugcuauguguacgcucuguacucccuggacagaacauacagcuguagccuugcgcuugagcuggcauugcugaguuuguguggugguaggcuacagacuucaguagcaaauagcauuuugaguaaucuguaaaaaucauugugucaaguuugggagagggugagcagguagagaauggguauguaagugggggugauggagggagaagggggggggagaggagaaagauggaauuuuaugaccuuacgcuggauuaguaaugagaaaguccuauagaccauauagaauaaauuuuauucuuuaaaaaaacuuauuuacuuaauuuauuuuaucugcauugauguuuugccugcuuauaagucuaugggugucaggaccccuggaacuggaauugacaauugugaaccgucguaugggugcuaggaauugcacccaggaccucuggaagagcagcuagugcucuuaaccacugacccaucucuagccugauuuuauuauuucuaaaauguaauuuuuuucugaauaauuauuucuaauauccaugugauaaaauuucaguuuugcuuuuaaucuguauuuuuaaauaccgccuuuucucuucgauugcauuucuugaggcuuuuauccaugagucuaaugggugcaccguuuccaccagcacccccuccaaccacuuccacauacucacccacucccucaaacugaugacagcaucgcaaugcaaauuucaagcuaaaaaagcagaugcugagauaucaaguauuaaggauuuuccuggcugugaagucauucuuccugguggggagugagccucaggagccgucccaggacugagggaggagacaagacaaauccguuucauuccacuuugugaacgaacuccuugagugucucagguucacccucuuuuccaacaguaugaccuuggauguguguuguuuuaugucccguaguggaaaagguggagccuuggccagaucguugcuuugcauaugcuucauauuucuucuggaaacuccaguuuucccuaaaacacuucagacauuagucauagggcuucaaggguuuaaaccacauuccugaucaguguggcuaccaaaggaauuucacagacacgggagggacuguucacugaccacagugacguugaagguggguugguugcuuuauuuuugacucugagggcuguguaaauacuaauggaaaauacaguaauuuccugguuaagaacugcauaaagauuacagcacuuuguuuauguugaaaguuuucuuuuuuuaaauauguguauaaguuugugaagcaggguuaccccuaggccucagaaaucucaagauuacacuuauuuaagagaaugcaagcaccagagcgcuagagcuagagagggccagagaccauaaagucucccauggccucucuagaccagacugugcagcuguaagccugacgcuaucuguccucagcagcucuuuauguccuugcaccccugaugcaguauaacuguuggaggggaucuuucagaccauagucauuuuaagacuggccguuaaucaccuacguuaaaauaugcuagauuuauuuugguugacuuaaucuaccagaaagcuaauuugauuuugagauaggaccuauguagcugcugcaagccuacaacuuagcuguaguagacuuggcuggccucuaacucaugguaaucccccugucucagcuuccugagcaaugauuacauguguuccuucccucauuguggacaccauugaacuauauuccucacccacugguagaucgauaacaaaugcuuuucagcagguaucugacuucuugguaucgguauuaguauuuugccaaagauaaagaauaauuuuauauuaucucguuauucugagaacguucauacucuacaaugcaaguaucacggagcuaauaggaggagccaauaugcccaucucuggaucaguuacagaaguuaaggaugugaaaagaacagagacugaaguuguccucaguugagggccaccccaguuugaggaguaaagucaaaaagaaccaagcuugacucugggaaaaggucauuugcagggacaaguuaguuacucgugauugcugguuauggagaaaaauccccgaugcuuuguggguucugugaggugaaaugagaggauuugggacuagcaacuguuguucacauaguggggccuacugcagcuguucaugggugaguggauuggagagagagcacaucuggccacaagacucauuaacaaagcucuugucacucuugaggagacaaguuucuucaagaacuuauuguaaacuuucauaaaugcuuuauuuuucucuugaugguaauccuuuuccccauuagggcugucgacacuggcuucuguggcuuccucuuugacacguuuccccaugaccuucagguucuuuccuccucccaagaaaauucucuuugugucacaggucccuuccccacccccacccccacccccccaaacacacacacaauuguuucauuucaggcuaauuucuuugaucuugccugugccucuagacuuaugaauucuuuccuguauauucaucuucuguuaaaacguuucugauuucuaccagugagaagaggggaugucuuggcagccuggagugguauccguccccuuguuaccgaucccaagucugcagacacucaguccaucucucgaaaucauguuguggacaucagugacagcggacucaucacaauagcagguauguggggccgacucauucuucauugauugcuccauuucacucuaaugaacaaguguuuugucuuauuccuugccaagaggugacuuuuguuauuauugguaaaugaucaauuauaagaaaaauucagaaugccaacuuaauggcuuacugaucuccuuguaggugggaaguggaccaccuaccgcuccauggcagaagauaccguggaugcagcugucaaguuucacaacuugaaugcgggaccgaguaggacuguugggcuguuccuucaaggaggcaaagacuggagccccacacucuacaucaggcuuguccaggauuaugggcuugagagcgagguucguggacauugccacacuaccuugccuugcuguuguugagaucucagucaguggcuguggugugaccuuccugauuuagggugaccuuuuccugggcuugcuacaaaaaaaaaaaaaaaaagaaaccaaaccaaaccaaaccaagcaaaaaaaacccauaaaaccagaaaagacgauccaacuuuauuauaguugucuaaaaauuuaaggaugcacguuugguuuucuuuugaaaucucaaauuuacucaguuugcuucuaguagacaaaauuuccccagccucuuugcaucuugagugcucuucaggagugacaucaagaagaaaauggagcugaagcgccauccgucagucacugagcugcugcgagcugcugcuacuccgaugcugagucagugcuggccuaagcauucaaagcccaagugguuuccucccacagagccuggcccuaauacucccugagagcuauucguuaccggcugugggaaaacugacaguucgagagcacacuguugcuuucuuccguaucuuaaaggaccuaccccucagaaugccugucuaaugcaguuucauuuugguagguugcacaacaucuggccaaaaccuauggugacaaggcuuucgagguggccaaaauggcaagugugacuggaaagcgguggccuguuguuggagugcgucuugugucagaauuuccauacauugaagcagagguaggugguggccaagggacuuccugugugugaugcucugccguucauugguucaucccaccucccccccccacccccccaccccccacucccccccccccuuuuuuuuuuuucucaagacaggauuucucuguguaguccuggcuguccuggaacucacuuuguagaccaggcuggccucgaacucauaaaucugacugccucugccucccaaaggcguguuacaccacugccuggcugguucauccugcccuuaaaagcuacauuucaaagcacacaccucaggcaaagucugcaguaagguugcggguuucgacuaaugcucaacuccuaagugauguugcuagugguaauaguacuagugugagcuccagcguucguucaaggaacaucacaaaucugaaaguucuguuucuccuagaguuuguaagucuuuauguucaaaucacuucuaucuagucugguuccaugcccuccaacagugauuguuucucaagagcuuucccuugauuucucagcuuguuuucugguacuaugaaaccagagagggcaccaugcugggguuucauugugccuccagucaguagcauccaguaagugacacuuguuggucucuaaggccagaaaacuuuacagccagaagagcugaaccacagcuuuucuuucuguccucauccuuugcaucuuccaccguguaaauuccauguaaauuagcauuuccauuagguguuagcaaggagagcgauuccuguggauggugagaagugaugucucuaucaucauucaggaaaaaggcauucacucauacccaacccacccaauuuccauccuucuguggcaggcagagggagggcacgagcugugccgcaucuguaccugugccugauggagagccagagaggcugaagaaaacaccacccuuucucaaagcauuuuuuaaaaugugaaaauugauuauuuuuaaaggaaagauugagaguagcguucuuuucucuuuaauuuaggugaaauacgggauuaaggaguaugccugcacugcaguugacaugaucucacggcgcacccgccuggccuuucucaauguucaggcugcagaggaagcccugccuaggauuguugaacuaaugggaagagaguugaacuggagugaauugaggaaacagguauuguacaaaagccuuuacagccacaguucuguugguaaccauguaacagcuuggucuauaaaggcuaacuuacggugaugguuuuagguuuccaguuaacuucuguauuacacacaucaacuauugcuaggucuuaaaauggaaagacauucuuaugccaaaauuucauuguuauagaaaucuagagaauguuuuuaaauuucugaucauaauuucuggaaaagaaagauacaaaagacaguuggaugcagccuuuucuaggucucauugaaaauacucuuaauuucugcucuugauaguccuuggauuaaaaauuguaguuuuacugccugaccagcaagggcuuauuauuugaaucaauuaauauuuuaaacgaugggagaccuugcaacaugaaggaaaaaaagugucauuugauauuuuauauuuauuaccaaauuaaaaaaauuaauuugcuagguaguggugacacacaccuuuaaucccaacacucgggaggcaagaggcagguggaucucugaguucaaggccagccuggucugcauaaugaguuucaggacagccaagacuacacaccaugccugccuugaccacuguuuuacauucagaaagaauguuucuuuucagucacuucauagcuucaucaaguacugucccuagagucuuuuccaugucauaacagcuuacucacugccccucagugcuuagaucuccacuuuaacaucauauuguauguucacucacucuccaaccaaagccucuccaaaugucacuguuaucauccaaaucaggguggagugucacccuuucuuauugcauucauuauuguuaccuugguguagacuccuggugugucuaaugcacuguacuggcuucucgccaaguaagacaguguuuccaucuuaacaacuuuggaaauuauaugagaacauaauccagacugucacuggauguguccagaggccuuagcagaauguacauuuuacaguuggcuuuugagacauuauauuagucguggggacacggggagggcacugaauacugguaggcgaggaaaguggcccuggaacuagucuaggaacacuucaaaguuuagagccuggaacgauaaggaaggauauagaagacauagaaaggaguggcuuagguugggcagugucauaagacuaagagggcauugugacucagaggcuaauaguacgucagacugcuucaaauagccaacauuuaauucucaaauuaaucccuucaguuucuaauaugaaguccaaggucaagguaccaucagcucuaaaccucuuucuaugguucauggacagagagcuccuuggcauauucacauguguauguaguaaaugaguauuauugggcgucuugucacguauagugcagaugaguguugggcacuagccuaaccuucaaguguucauagauuccuaaagauggaauuccugggcaauaugagugaaagggacauuuuagaggcuuaacuuuauuacauucuucaagggcauagugagugaguggcccuauguuuuaaaaauucugcuguagugauucuaacgucauauucuucagugaauugugguagaaaucuguggucagugccuugauguccucauugucugugucaagaggagcccugucuuuggaguauugauaagcaucccaauggacagcccaggcucugagagcugaguuuagucaugugcuagugcccagcugugaagggaauggcggccuccacccaaauuuuauaguugaggaaacagaucuagaagcaguagaucguggagcugcaucuacaaccugucccuuggcccccuucuugcugccucuguacuggcuuagaaauaacucuuccagguuuuggguuuuaccucuucaugaagacagcacaagaaugcguagcuuuuuuuuuuuuuuuuuuuuuuuuuuuuuucuguguagaggauccagagcauguuuuuauaaguaaucuuuugugcuaggagguaggaagaaagagaacauucuaaaacccaguugugcuggguuaccaagauuuaacuugauugcaaacuuuaugaguaggcggauguucuuaggaaguacuccuaaccucuagaaaguaacaaaacuaaacagcuaaaggaauuauucaccuucugagacccaggagcuuaaugaggacaguggauggucuggagaguacaaaagagagggaaacaagaaggaaaagguuagaaaguuguacuucugagaaaagguuaaaagcauugggauuauuuaaccugcaaaagugaaagaggagcagggugauuaauaacucugcauagaugaauuguguuguuuccacggucaauacccaaugaguggcccguauacggagcacgcuaccaaacaguguagagaauaauaaauagcucagaguuccauggaccuuccucucuguguggauacaaugcacauaugugucagaaaugcaugcuugucuucaaaguuuacagauauauuuagagaagugguugguugagacugaaagucaacugauagagaaacauaaaggagucagaccagggcuguguggggagucggggaaugacugaggagcuggaaagggcaugaaggaaagggccaucuccaaacucugcacacccgggcaggaaugacugugugcgagaagauggcaaacagggagauuuuuguguucaaugaauacgggaagcuuucacuucacuucagaugauuugaaacguuugcaaugcuauguguaugguaaguuucaacagagaaauucccuuggagaccucagaugaagcuugcuuuuuaggagggccgagcaggaaagggcaugagcgucacucagaacauauuuagggaaaugcugucuagaagagagacagggagacuucguaauuuucauaugagguacaucuugauuuucauugugaguccuugaguuucaguuuucaaucagauagaagacauagucagauaggaggugacuccucaccaauuuuguuccagucagggaacuugcuguuaggauuuuuucuuuucugugaucccuaaauuaaccugauagaaaaaagacuagaaaaacagaaggaggcaagugcaauaccaguuuuaaagagcagaaagcaaaauaugucuuugugaccuaggaauggucuucacauugauccuggcuguuuuucuuaauugagcucauuaauuuuuauuauguucacuauguuucuuauaauuuagcaagaaguguaggcuauucaugcaaauaaggggccccuaaggaaaaaaaaauuuuuuuucauacauguccuuuuugcauugcaguaaggaucaagagaaugcuauagaagugauauauacuguauuucauacagccccaugaaucuuuuuuugcaaaucaccaauuuugaccucugaaggggucuuaugauagcagguuacagcgcucuguccccucgaccuagucuaguuugguucaagcguuuacauuacagggcugaugcugugcuuucuuggugugccaauaagcauaggagcaagugcauuucugauaauaagcuaaaacaauagccaccaguguaccaggagaguuuuuauagagacaaaugauaaaccuuguacugggguagacgaacuucauucauucaagcuaagucugacaggcuuagcaauauaacaggcaugaaaaagaguagcuuuaguugacuaugacugccaaucaauuuacaguggaucaugauuguccccuacucuaauguauucuuuauuugauagcucacauaacuagaaagauauuacuccuuuguagguacuuuaucucuguaggagcauggcguuuguuuguuugcuuguuuguuuucugacaauuggucuggaagaaaacauccaaaugacauagggcuuugaagucacgccucuguugaagcucuugacuaacaaaucucuaagggguaaaguacuugacguugcuuucaguguguaaccuacgauucggauggcucuacuguagcaacguccuggucaucccaaguaaguuggaagaauuggagauuauaucuaaucucaaccuaaaaugucuuaauaggcauauuacaaguagcagugugauuuagauacauggcucaggcaguccauaauggaaacacacuuaggaagaagcuacauugugacguggauggacagauuuccuccuccucugaaacaucacaauuauuugguagagggugaauaaacuucauaggcagugaaagaauaugcauuacguaagagauugucauuggagggaaggcucagaggcagcauguccaaggacaugacuuuuagaauaguuuauagaaaguagccggaaaggagucauugaacaagacaauccauuuuaaagccgugacugguggauuuucucauguaaagagagaagucugcagugaagaauaucacuggagauugagaguucgaguuuuauuuaaucacagaaaaguagauguagacacacuuguuuaguuuuacauucaguauuaugcagcauucaugagguuucauuucuucugcugcaucuauuuuugaagagaaaggagguggaaaggaauacucucaaaaaucguucugucuaagaaaacagaaugccaagccuugccgcugccacggugugcacagugcuuuguguuccccagccuccgucgauggucauuucaguuucacauucaccacauggggccugugaaguugggaauuuaagauaugcauuggcuauugcuuggugauggugcauggcacccaucuccguggcuuaggcuguuagagaugacucagucauuaagagggcuugcagcucuuacugacugcuucacacccacacugugcaacucaccacucucaccacucgugaaacuccagccccagggaaucugaugcccucugcuggaugccaugggcaccccacaugcgcacauacauauauaggcauaauuaaaauauaauagaaaugaaucuuaaaaacccuucucaguggcuuaacacaggcagagauuuuuguuuguuuuugaauuugagacaugcuuuauguagcacuugcuguccuggaacuccacauguagaugcugucacucacagagaucugcuugccucugccuccaugacuuuccccgagcacuggaaguaaaggcgugcacuaccauacccagcucagccagcaucugaugcuucuccuccaugucugucuaagucaugcuugcucucagggaacaggaacaagagaggcagagaaaacuaggaagucucuuuaagccauauuucaaaaguggauuaucuuauaccagucauguuauuggccaaaguaagucacauggcuagagcauauaaaaauagguuuaaggaauacaugaugugggaaguaggugugugugugauuuauaccauuuauuuauuacauuuauaccagugaagagagauuugcaaacaguauauacuguaauauugucaccugaguuaguuaggugcgagagugacaaaugggauauaagggcagugcuuguugcagaugcugaccugagauucugagagccucuagcagacuguggaggauagccagcuuugugcugauugacugucagaagcccuugccggaacuucugcauggcugaccaccggcacugccagccaugcuagaguagcugcucaagucauauagaguucauuuuuauaugcuuuccuugucaccacgcuuuaggaaaugugcucuuguagaauuugauagucaacaccacacaagagcaacuacaguaaaaagaagcugugguguguguuaccacauguagaaugggcauccugaugguguggggaagcagucaguaguaccacauacauguagaacgggcauccugaugguguggggaagcaaucagagaggugaaaaacaugcucuaugaaauuuaagaaaggaugaacugaccgcaagccccacaagagugugccuagcuagagccaaagcuuuaggaagaaccagacaaaugcaggugaacacagcaaguguuuaaggucacaguguuuuguaucugugguuauuagacugugucuuaaguugcccaacuagagggagugguggaaugucaguaaaacuggauguugauucaaugagaaucaguuucugcugauaaaaggggcagggggagucaauaacuccuauuaaucugcaaccuuugugcaugugccuucuccuuuguaggaagaacuugaaacagccacgagauuucuguacuaugaaaugggcuacaagucucgaacagaacaacuuacagauagcacugaaaucagccugcugccuucagacaucgauagguacuuucaaugcucuucccguccuccccuuccauagccuccuccuccucuuccuguccacucuuuuauguaagacuaucugccauuauucaauuuuggguugcagguacaagaagagauuucacaaguuugaugaagaugaaaaaggcuucauuaccauuguugauguucagcguguccuagaggugauacauacucccccaccccauuauuaguucucugguauagaaagauauaaaauuaauauuaguuugcauguuuuccaaguagcauuuuaaggguugaacagucuagcuacauuaucaggaaguuacacauaauuuuuaguuuaacccucaccucucugugcuccccugccuagaguaucaauguacaaauggacgaaaacacacugcaugaaauucucugcgaaguagauuugaacaaaaauggacagguugagcugcacgaguuucugcaggugaguugucacgaggcagaugccgcugcggucuugcuuuugcuuguccucaucccgagaacggauucuuaagucgaccuguuagucgcuucauucugaaaacauagccuuagccagagcaguugaucugucugcccucagugaugaguucuguuugugucuguccgcuuuuauaagaggcaccuguuuuauuggcuaauuuagauaaaauccaaguuaauuguggcguacagaauugcauaauuaaagaacaaggccgugggcuaugauugcgccgcugccuaugccgagaggcaacagaguacuucuaguauggaaagucaccguucacuguugugugggagaaauuauaacccauaguuuuuuauucauuggauaaucauacucaccuaagaauacaauuagucaguucuuauacuuugaagaagcagaaaaguaaaugggaaggaaguuaaacuccaggaucaagaccacaaauucaaacauuuccgugucugguggucagcuaaccaaggcuccaauuguucaauccuucuaaccaugaaggaaauccauuuuguuccuguaaccucacacuagaugcucuacaucaccccuuaaucguucuguaaaggaaaggauuuuagcaauguauuccuagcuguccaugggacugaucguuugaagaacacauugguuucaggcagcccggguuuuucuguaguguuucuugggcagguauuucaaaugaaugccaggucuugcuugcaccauggcaaugaugaaugcugaacaugaaauaaauuaaugcugggauuuuggucaaugucagcccuuucuucacugugucaaguuaaacaaacaagaucaaggcagaggaaaugguaauugucucucuggagaugagcugcagauaagagcauuguugaaucuaaaugcagaaaauuuucucagguuguguccagcauuacaaaaaagaguguuuaguuauuuaacuacuaacuguuuaacugaaugcgaauuucaaauggaauuugagauuuaugguuaggacuuuuaacaggaaacauuuaaagccucuuuuugaauaguuuuucuggagaacacuuccuugucuuagaauuucagaaaacucuucuuuaaauaaauagcuuaugcuucauuucuuguguuuuacaaacaaacagcagcauuuagaccuaaaaaacccagggcuuuagagacaaugggagucuaauuuaaugaguauguuguaugguuuggguuuuaaguaauuuucuucaaugucguagaauuauacacauagaaaauaauuuaaaccaccugcagguuuuccuguagaguuuuaaaauaaauuaguauuuccuguccaguucuaaauaaaagcaaccauucaugcuuucaagaacacagcauaguuuccaaguuauaaaacacauuggcucuuguccuuaugaggucuguucacaccuagauacuauuuuuucuugcaguacgguucuuggauacauguaauaccuaauagaaaacuuuaagcuuguugagguugguacaggaaacacugucaguggcugagagaagaggagccccacucugacuguuguuaccucugauaagucccaagguucucccagcaucagagagaaaacaacagucagaaaacuguucucuuguuaaaugccagcaguccuuagguaaaauaguucucgauguaaaguauguuuccacaucugaauguuuaaugaaauauuuuccuuuccugacuaauaagagcccacauuuauccugccacaguucugauuuuuggauauggguauuuucagucaucaagcuaggaggaguuauggaaacugucugggugcaggauuuuguuugccagccuggccacaaugacauuguguguaagaagcaguugcuugugaagcggcuuuuaauaaggucaggagauccagguccagccuggggcagaugccccaaacucccauguggagcacauuuuucaaaauguaucaccgugggcuaaagccuuaauuaugaaaugauuugaauauuuucacauguauuuuuaaaaauauagcuaacuaucgaggacuuuuuuuuaauuagaaaaaaaaauagauuuuaaaaaauacgaguuaguggaaggaggaggcaguucucacacucagaauugcaagggguuuucugcauuaaaggccuuugccuacugucugcaugcaauuuuagaucuaacucugacuuuaaccauuggauaagaaugaaucagcuaaaaucugagcggugaaauuauuucaguuagggcagaucucgaaguccauuuucaaugacguguauuuaaauuuguuuagaaagauucccagggauuuagauuuagaggccuugaauugucaaguacaauaacaccgaaaaaugauaauuaaauauaggaggucaugguuuagcuuggcucuaucccugagauuccuguuuagaauguaaaaauagaauuaaagauccaauauuugauguaaacuuuuuuuuuuuuuaaagugacccaaaauguauaaugugggcgaaggaguucauuagauuugcuuuuaggguagccugaucuacugaguagaugcaguuguugucagcagugugaaacaugucucccuucaucucuucuugaacuguucaagaagucaaguguuugcucuggagcugauggaagagcucuggggcuaggaggagcgggugaaaggagcgggccuggcugcugaguguguuccuucuuuucucuuuaagcugaugagcgcaguucagaaaggaagggucucuggaagccgacuugccauccugaugaaaacugccgaggagaacuuggaccgcagaguuccaauccccguggaccguaguuguggaggauugugagucugaccaguaaauccgccaccagcaagcauaggacagccagcgcuauguacaaccagagaugacuuaaacucuaaaauaguggaucucguagcugccuuuuuuaaaacaaacaaacaaggaaaaaaaaaaaaacaaaaucaaagaaaggaaagggauaagcaaauaaacaacacuggaaaacauuccaaaacuuaagauguugguguguuugccaacuuacuuugccaauacuuuauuuauauuugccacucagucuggcuucuacaaagcgcuuuucuuauuuuuuagugcgcacugauguacuguuuuguauccauuuuguacccugucagacuugacacucugccugcucauucauucauucaaacuaguuuuagaggcagaccccguauagauuggaaugaugcuagaaagacuuugugagcacccaagagcucaggagcucgagccuggagagagcauucuuucuuuuuuuuucuagaaaaucauuugaucucuugaccuguuaauauuuugggagacuucucagccccgucuugcuacccacccccuuccgauuaaaacugcacacuuuucugucuggagcaacucuggcuaaucuggagagggaagacaaaguuuagaucugguugagauuugguuacauuucuaaaagagaaccuccaaaagcuuccagauuugcaggcguaagauaaagacagcccugacauuugccgggagguacggugaucgcugcuucucagcaguucauuuuuuuucccccaggcacugcuggcuuccuuugacuauuauaguugccagaaaaauccuugcuuuuuuuacuuuacaaccagcauuugaguggcaaguuggauauaaugggaugagaccaaaucucuccauuccuccugggagcaaugaugggacacaauuuccagucccacaaguucugaaucuuguagcguguagcacugucaggccuguucuugucggggugggcaguagugacgguauuugcaaagagauaauaaaaaagaacugggcagacuuccguuaacuuuaauuaugaaauugaaauaaggcaugccacuuuaauauuggaggcuggucuguuugccaaaggcccuucucuuuguguacucacuggaaaaacucucuuucuaacaaaaaaaaauacaauaaaauaaaaauccaagauagacaucagacauauacguaggaauacacacaaaucaaaccccaaagucgguguccuuugaacucagcaaauaaugcacagacuggagaugcccgccagguggaauguuuuuuguuauauucuguuggcauuauaacuaguaaucuuaauacuuaauuaauuggcuucccuuuucugaaacuaccagugaugagaucccugugcaucauaggagguggaccccuucguucccacuucucucccggcagccuuucuugcacaggcugugucucagcuuugugaacugauccauaaagcacccuugugcugcuauucugccugugcaaacauugugucucucugccucauucauuauggguuaugaguccacauaucauaauaugagcugggaggucucagcccccgucccacuccacccccaccccugaaauaugcagacuucaggaauagacagcucaacucauuauuaaaugaaguaucgauacuuccacuucuauuuccgggaagccugacaccggacaagugaugucacagcagaugucacugugaaaucuuuuuuucuuucaaagugucaauuuuuuacacugguuuuuaaucuuuauauuuuuuaaaauagauggaagcauguggcuuugagauuuaguggguuuuuuucccuaucaugacaauaaaguucacuuuauaccucgugacagucaagucggcagaaaaagcuguccuuuaagacaucccagcagauauaucacaacauucuacaucacuacuccuuuccccucucucuuucucucucucucucucuuucuaguuagaucaagauaacgguggcuugugucaucccgauucucuuacaguagggaccgggcucagaaugugacuugcuuaggccgaugugggcuuggcaagcacgucucguuuguauauguuuugcugugaaugaaguuccuuuaaggacaaagggaagugcacugugcuucauuugagcauaucugccuuggcuuagcaucugcuuauucuaagacacgcuccuucacccgucccagagacucacguuggacaugaaauacuuuuaucacguuccugugaguaaagcaacccgggauuuuccugaguucccaauuaaaccuguacagguuuucacauuuuaaauccaauuuaagcaaagagggaaaggacacaggggaaagaagccccuuuaaaacucauucagagaauaaaccauguuugcuuuuucauauaaaccugguauuuguugauuuuguuugggugugggagugggugcgcagagcucaccuuuuaucaucgagugauuuauuuccuuugacgggauucaggugaaggaagcccaucugugccggagagcucuauaugccuugaacuagccuagccucugucccaguugugaugacagcgauaacgcuggauuacugguuuagcuacaguugucugccucugaguccucaugcugcauauuccugcuuuccagucuguuccuacugagugugaugucacaucucugcucucaaaugcaugcuuccuaaucugcuucagguuaugccucgaguuuggucuauuucagaauguggacaacaaaaauguucauucugguuuuaacucaguacaaauagagguugucauugauuucucuuucccucuuuuccuuauuuguaaaaagucuuuuugcauaugaauguaaucacaccaacgucaccaaugcugugaacuugcacugccuagggagcggaaaaaagcccuacuguguuuaaaaagaacauccgcuguuaacccagcccuggagcggacacacuugcugcauguucucuuacuuccucaguuuuagguguuguguuggguuaucguucuagacuggacuguuaaaugccgucugugaggcuggacugucacuuuuauaacugucuucguauuuuaucaccauuauuuauuacuuuugauauacagaaugagccgcaugcauuuauagagccauaagaagauguauuuaaugugccuuguuuuuaacugaguaagagcugaaagcaugaaucaauaaaacugauuaaagcgcucca

SEQ ID NO: 823 - RNA, 2198 nt, Mus musculus
uggaagcaagcaguaguuuuaauucaugaauauaucugcuguagagcauuuuccucucuaauuuugcuccuuuuauucagcagugguggggaugaaaugugauauacacaggaacaaugccaaaaugcagugguuuugacagagaggacucaaaagaaacacauggauuguuuggggcugcuuccuggcucuuuacccuuuucccacauugucgcaucuuuuuccuuuagggcucuucaugaauccuauuggaugcuuccuguucugaucuuuuuuguuuguuuugaggcccauauuugucaagugcaaugcugcccagggcuuccgauuuuucuccucugucgucuaaguuaugccgaggucugaugggugcucauggguuucugaugagagcugaauccuucauggguggaguacuuagugaagaaagacuugacauaguugggccagaaacacacuguucacuuaagcauccacuuaaagccaacgaacauuuaaacaucuuuuauaggcacuaggaugcgaaagucaauggcggaaugguuucauuuccaggaacugcagucuuuuaggugaauuagugggaagucagcauggacccugauuucgaccuacuucuuugcagagaaacgcauugaacuucuaaguaaauauuugagaucugaaaaacaggaaaaccgaaagucaguggcuuacuucuagggcucucaaacuagaauccuuuaggaccgagcuauugaacaucagcucucaacccuuagugugaaucuggaccucuguaaugcuugguuaggucuggagcuggaacucggauguuugggacucagguagccacuagcucagauuguuugcauuucugccaaguucucaggugaugcuguaccaggcaccauagcuguacugugaaaggcacauuuuaaacgcuaaagauucccuggcuuauuuccaaacccuuucagugguacagcgacagaagcuuaguucguaaauuuagcguguccaaggccaggaacaaguucuuuugccuuuacagaggguuuguuugccauaaguuacugugaguuugugaccccaaacuauaggcauuucuacaggguuuaagaauacuauguaugugacuuagcaauugauuacuaaacacugcuacaauuuccuucaaacuaauuuggcacgaggagcuuuucggaucagucccugccuacuuuucaacaccauaaucucaggauuuaaaguggggucuuucggaacccgaacugagcccuccuuggguacccuugguuuugcuuaacccuuuuaguugcaacaagugagcugggcaugcucagugggcagggucggguugggagggggugcaagugggaagccuguggcuccgcagccaggguucuccgccuccccccaccuguacgaggcccggcccgcugggccagcgcucagcaucccacccuugcugauuuggcuuguucuucucagcgggucccggugcuaacauucaggcccgggguccacaggccuggagcgcccacagaacacgcugggguaucugggccgagagcugcaggccgagucccuagagucccccgacuccuagacgccuuucuaggcccagggaagccuggcggcugggaggcgcggaggaggggacgccggaucuaagggcgcgcgacgggugaucagguaaggcaaccccgguaggcagcaggcgggggaaacguccucccccuagggcagauggcaggaguggcccgcguggggagggacagaaacccaacaccacagcggcuuccccggccuagcucagcccucucuucuuuccuccagcuagcaaggaguggcaggguauggagucgugcuccgccggggcucagggcaggaucgauaaccucgggcauggccagcccacgucccugcgagacccagagcgccgggucugcagccgcccuuucccaccggcugcacuuccgcauuucccugccgggcagagucgcccgggccgcggugucgcggcgaaggcgguggcugaguugccggaucaucccccggggaggcggaggcgcacgaggggaggaggaaguggccgggaggggcgucggcgggcgggucggguuacgguggccccgccugacccggugacaucccggcgcgcucgccgcgagcucagggccacucugguucucggugaggccgacuccguucug

SEQ ID NO: 824 - RNA, 431 nt, Mus musculus
gagguacugagagcaacugcuugauaggacagaaaaccagaucagcagccuggaagccaugguucagagcaucaaguucacgcagaucgagaugaaggugauggaggagcuucaggugggggacgaaugucuaaauaagaugcaccaggugauguccaaagaggagguggagaggauccuggaggagacccaagaggcaguggaguaccaggggcaaacugaugagcugcuggcagaaagcuucacccaggaggacgaggaugccauccugggagagcugaaaacaaucacucuggaacaaaucgaguuacaagagguuccuucggagccccucccugauguuaacccaaaagccccugccaaggccagaugcagggcuggugacggcuucauuaccuggccucucgagggacucuuaggcauacucugag

SEQ ID NO: 825 - RNA, 797 nt, Mus musculus
uuuuuuuuuuuuuuuuuuuuuuuuuuacgggugaagagacacagcuuuauuguauaaaagcugagccaggagguuuaaaucagggacacaccaucaagggcauacacaagagucuccaguuuauauguaaguccucaccaguuacccauaaacaucuagucccccucaacgucaaaugugcuuuguucucuucaugccagccaguucccuauagggucugccacugucacaaaacagaacccuuugcaggacacaggauaccacguagcccuagacaguacucccuuggucugacuuccccaggucacaaguucuaagcacucugggagccuggcugcucaauggaggauucugcuggugguguagugggcaucucuggcaucgacucagguggcgggccacuuucuucuaggagauuuccuugauagagucggcgaaggcgagacagcucucucucugguggcuguugccagcuguaccauggguaccaagguucaccugacaacagugugggggcugguggagucacacugacagcuccaugcacaguacgaaagucagcaucccggggcucaaccugggggacguaguaacugagaagaccacacucccuggcuuucuggauggccugggucagcuucuugugcugcuucauacagaccccuguguauggggcgugaaagaugauacccgugugugcacagacaaacuguuccaagagcuucacauucuucucaauuaaucuaugcgcaucaucccaguagaaaggagcuuucucuuccuuucuguaauacaua

SEQ ID NO: 826 - RNA, 797 nt, Mus musculus
uauguauuacagaaaggaagagaaagcuccuuucuacugggaugaugcgcauagauuaauugagaagaaugugaagcucuuggaacaguuugucugugcacacacggguaucaucuuucacgccccauacacaggggucuguaugaagcagcacaagaagcugacccaggccauccagaaagccagggaguguggucuucucaguuacuacgucccccagguugagccccgggaugcugacuuucguacugugcauggagcugucagugugacuccaccagcccccacacuguugucaggugaaccuugguacccaugguacagcuggcaacagccaccagagagagagcugucucgccuucgccgacucuaucaaggaaaucuccuagaagaaaguggcccgccaccugagucgaugccagagaugcccacuacaccaccagcagaauccuccauugagcagccaggcucccagagugcuuagaacuugugaccuggggaagucagaccaagggaguacugucuagggcuacgugguauccuguguccugcaaaggguucuguuuugugacaguggcagacccuauagggaacuggcuggcaugaagagaacaaagcacauuugacguugagggggacuagauguuuauggguaacuggugaggacuuacauauaaacuggagacucuuguguaugcccuugauggugugucccugauuuaaaccuccuggcucagcuuuuauacaauaaagcugugucucuucacccguaaaaaaaaaaaaaaaaaaaaaaaaaa

SEQ ID NO: 827 - RNA, 234551 nt, Mus musculus
gaugcuuucagagagcagcgcagaccgaaggccgagccacuuuacugauucuaaaacggcuaaaaaaaggaggagagggcuaaucacacuucugauccugucccacugggguccaggcgaggccccaggggagcaaccuucucccggaaagcuuagcuucccgcagaggacaugcugggugaggagggggcgaaggcgccgggaggaaaguuggcgugcggcgccccagcgggucccagagccggggcagcuccggucgggaggggcgcgggaggcacagccccggcgggcgcgcacagggaaggugccuuccggaacacgcgcaagggcggggacucgcgcugccaaugaggucccggugugggccgagcgaggcgcggggacgggccggagcgcugccuccgcgguggcagcugcgggagcccggcucgggagccgcaggagccgcagccgccaagcgcccagcccucugcgcccugaggcucggcccccggggugggaaccgcgccgaaagcuggaaacuuuccuggcagguaacucucgcugccggggcgccgcugccggcccccgggaguccgcagcgggcggggaaggaagggucccggagagcagccugggaaacgagagccaggcuggugggaaaguuucgggacgcccccuccuccgccgggcccagcgggagcuuucccggaauaggcgcaggcacgccggagcucccggccuggggcuaggcgcugccggggagucggugcaggccguuuccugcgcucccggaggaacggguugcagcagagccgggcuagggggacauugggaucacgcggcgcucaggacuuucccagccggcccuugcccgccucuucggucccuuggcuagacagggccugggcugcgccgggcaccuggguggggggaguagggggacgugcaggcggggcgccuggcaccgcggggucuugagugucgccgcgcgcgggucgccaaguucccgggagaacuucagcgggggugggggugggguggggaaucguaucgcccaccgugagcugaaagugugugauucgcuccugcaggcugcggcucgcagaugcaagccaauuucuuucccuggugguguuggugauagggugaugauuugggauuagaccuugaggauuuuuuuuuuuucucuuccuuuuaguagugccagcuaaaugaagggucgugucaaguuugcgaguccccuuguccuugggcgacgaguaguuacuuuggaggcauuauggggauucagguucuuccuggaggacuuuugggugugugugugugugugggggggggcccuuggguucggcgcggccgcuuuccggaacggcuggcggggaaggaagcccugggcauuguguagcguguuuucagucagcaagaucucuggacuggaguucccaaaacuuacuugacuuauuguguaaaggcucccggaggaaaugcggccauggccagguagaagaaacgcggugccgcggccgagggaggaggacgccgagcugugacagucuucuucaggcugccucggcuccggcuuggcagccccagauucuugugccuggaguagugggaccggucugaguaauacagcuuccugcagagugaacucaggguggugaggagagcaccuucaucuugaacuugacccccggaguagcguccuggcggguuaaaagguaaaggcaggcugagucuuaaccuguaaaggaguucagacgccgcuagcuccugguucaagaucuuucaggaaaggacucaggguggcugaggucgcgaacucuagaaaugccagacucaucagacuacgaaguuagugugccuggggagagcaggagaaaccugguuggcuggcacagaggguuaguuuuucuuuguggugaaaaagaagggagucuugcgucucugcuuacaccagauccgcuacuccccuccacccacacccccuuccugggucauccuuauccugccaggcuggcacuccagggaugggggagggaggaagagaagaagccguuguggagcuucucugggcagcccggagguauuucagaucugcuacugggaagaguucuggauuuuaacagcugcuuuuugauugcugggaaugaaagaauuuaugagcgccugagagaggugcucauuaugguacuguucugcgugcuuugcucaucugggcuacuuaaagagcucacagggacuuccuuacaaucugcaaagucugugucagcuggaaugcuugugggugucaaucaaaaagcaucauaaauagaucuuggugcuuuuacaaugaaaagcaugccaagccaaggaaguuuggcgugugacugcguuagagauuccuucguagaccuuuuuuucuuaccauccaacuugauguuuccaggcuucuugacugcugugauuggacagugagggaaauagugugauuggacagugagggaaaucauugauuuuggugggggugggaaaguccagaaauaaauuuaaggucacuuccauguuucugucuugcaauucucaugccacgaacuuaacuuuugcuggaacgccaaaguauugauuuucuugcuuuuuugguuuaaccaccagaaugucuaaauuaucauaauucauguucaucguggagcuaaaacauaacugauucguagucagcccuuuucugcuucucauaacagccagaagaacauuuugucucuuuaaccacaugcaauuuauuugaugccauagucggguuuugaugccuggugaucgagggcacaguuuuagagacaauggaauuacuuugacuaaaucauccauuuuuagacaacuucuuuucuggguugcugauuaauucuuuaucucccagagaacauuaaaagcccugucccugggcuaguagagcuguaauccauauuauaaugagguuugucugaauagcugggagggagguaggucuguuuucaccaggcacuucaaacucaauaguaaagaucuuauuucuguuacgucaagaauuugcuaguuagaaaaauggauuuaugcucuuguccaauguauaugaggccuuguugagggaagaacaaacuuuuauuuuuauuaugggaccuuuaguuuuaacuugugggaauaaauguauaaauaaauuuauagacacacacacacacacacacacaggggaauuguguuagucucuagaacggguuuguucugaacugggccuuuguuugcuuguguguguguguuugagccagggucucacuguuuaggccaggcugcccucaaucucauagagaucagcuugccucugcuucccaggggcuggaguuaaagcucugcaccaccaaacugggcucugaacugucuuuuaaaugcuuguuuuagguguagaacuaccucucccccaguuuacagaaggguuuggucuauagggcugugaagucuuuaugggauuugguguccucaugaucacucccgaaauggaaucacauugcacccucgugacugcaagaauuggagagaucuaggaauuuuggagccugggcuguauuguuagaacaguguaacggcaaucguaaagggcuucacugcauauuuuaucccuaaaccucucaguugaguaaaccagggcccaggaaguuagaucaguuugccugaugucaccugugacguugaacuugagcccagcagguccccggcuccccauuccuugcccucuaucucuuuuaauucaucuaagucaccugugaacucgcuaaagccugacaaacaacauguggccguuucucacaguguuucauuuaugguuauuuugguuccagaacccugggguuuauaucucugcuuugacaggauggauuaaaaacagcucucuaauaaugauaacuaaacauucccuguaggagaguuucagaaagucacauaccuccaacucaucauuuguuuucuuucaguuucuuucuuucuuucuuccuuuuaaucaaguaggcuucagggccuaacaugauuuacaguucagaugucuaucaacuuaaacauaaggauaaaaacaccauuuaccucucaucuuggcuucugucaggcuaagcgcgaagccugucugaauaucccuuucuuggaguccugagcccuuccuaucgacaagugcauagaucaauuucgagccgcuucccaugcuauguaggucuccuuuuaugcuccugguuaaguggugaagagguaguuggcugcagugauacauuuccacuguuugcuguguucccaucugccaguuuaggaguacuaaguguagcugggcccuuagucuggaagcuagguuuuauuugucuucuugguagugcugaugaccaaaucuagguuuucggacauguuaaacacauguuguaacacugaacuacaccccuggucugugaacuuuuaacagguucaaaaaugaaaucauauucuaggauagcaacuucuucuuuacagcuuucauuucacuucucgucugaucugcacgcaugcguucgugaacgugggugcaugugcuacugugcguggaggucagaggacagcuucuggaguucuuucuuucuacugugggacccuggacucgaacucagguugucaaucuugcacagcaagccucugaaccaaggagacagcucuuuuaugcugaggaacuugucuguguaaggcauuuauuuaucuguugguuuugccagaaagucuuacuauguagccuagucuggcuucaagcuugcaaucucccugccccagccugcagugugcugagguuacaaguaugggguucaaguaugaggcuucagacacagcucuuaaaacuuacucuuggagagggguggcuuugcaaaguaauaagaaacgguguuucaacucagaagaaguuaguaucuguugacuggccagucugaaauuguugcccuuuccuugagaagugaaagcagaagaggacacugggaaacaucauuuccuaguaguguuggaaggcugucacuauccaaaagggacagaaacagaaagugggaugaacagauuuccuugaagagugcucuuagaagccuuaucgugccguuagagaaaggaguucugguuuuguuugccucuguugcuggucagcugucuuuguagagugaguguugucucuuagggcuucugugagugugggugauggaggagaauguuccagagagaauuaucccauagacagaagugucaagggcaagacaaauguuacagagacaggacacagaccauggauuucagcauggauuuuugccauuagcaugagagaauuuauuaguucuaaagucucccagcuaaugcucauuguagacagaugugaacccagaauguucagccauuuaacauagaaccacggugacucagcacuuucuugccuuacccagcauacuuagggucacacaccugugguggauuggcuuguugccccugagggguggaggagaguggaagaaacugucaaccguggguggccuuuuugcacaaaggauguacuguagcaaagugguacauuaugccacauacaguuuuaacacaugaaagacaucaugcaaaugaagaugcauauauuacauuugugcaguuuagagucaguauaugcucaugugacacacuuugucuugugucccaugucagacaugccuucccuguguuuauucuuuggcucuguuuuaaugacugguuaccaaauccauugcauauguguuaccauuaccaaaugauugauuuuuggccuuugacaucuuuggacagacagauaucagaggccuuugauucagaugggcacacauauuauuaagucacuguggccuuacacaacuucuggcuccuuguagcuccaaaaccuccaucaucaagaagcugccucuuggcuguuagcaccaaccugagagaaauguggaaagaacccagauuggccaaagaagaguuccaggugacggaccccauuaaacccacaagaugggucugugggccacagugucccacagaggaggcuauuguggauggaagagacagggaguaagaaaacacaaagagcuggccagcauagcaaagaucucuaggagugguauuggcuggccuuaaaagcauaccuaauggcauagggugugaacauuccuaaugucuucaugccauauauauaugcuccuguagucugggaagccuagacguagccacauucuacagggauuuagucacuguguguauagccauuuguguaaggggugggguauugaauuacaucuaaaaauuuggagcuggucaugacucccauguagucuguuaggauccucucuuacugccagacuuugcucuaaauuacucgagauucacaacaucaauuauuaauguuuauugaguacuugcugauguggaacuagaugugugaauuuuaaauuauccauggaaauaaaagaagaguagcucuucucucauugaccuaaacaagcaacgacaguuauacacagagccaccuccuggguccuggcuucccuugcuuuuugugacauagaccaaccacaguuuauuucauuggaaugaaacuggccucauuuggauggcaccgccguacaaagcucaaaacauuacuuccuacccuuccuaccacgauucuggcauuuauuuauuuguuuauuugaguugggggguggucauggggaaggggagguuuucucuguguagcccuggcuguccaggaacuugcucuguagaccaggcuggccuggaacucacagagauccgacugccucuaccucccaagugcugggauuaagaccugugccaucaccacccagccacaaaucugcuuucgauuacuuuucaguggaccacauauucauggguuagcugggaaugucccagagagagaaucuugagucaagauaauuucaguauagccgcaccugcugucaguggcugguuaacgagcagguuugugguauggaucgugacuuguauaucugcagcauuccaugagguuaggaggggucuaacacacuacagagauugaagguaccccaaaccacagugacuucuucuuggcugcugaauuagccagcccuagagcuaccaugacuugugucgucucugaggaaaguaauauuuaugaguguaugagacagugaucaccaaagcagaacgugccagauuauucggggugggagagaaggaaagcccgaagagcuuuauuaacauuuacguauggguagacacuggguauguauccgcccagcaccugucacuugcguugugugaggagcauuuuauaaccuagcagaguggacucugguacccaacuugcccuuuuugcuuuggaucagugcuucucaaccuuccuaaaugcuacgacccuuuaaugcaacuccucgugcugucgugaucccagccauaacauuauuucauugcuacuucauaacagucacccugcaaugguuaugagucauaaugcaaauaucugauaggcgaccccuguagaaggguuguuugacaccaaaggggucgggacccacagauugagaaccacugcgaauugaagguuuauaucauuuauuuauuuuuuuaauuaaacuggcucacacaaaauggaagcugcuuuaaaaggcucuuggaaagaaagugugggaagaugcuaauggcacacauuaggaauaaagcuaaugagacggucugaaggaggagaguuuauuauaaagugguuaggaaacuggcuuugauagguuggcacaagauuugcauaucaauuuauauuauuaauaaaaaggaacuaaaaugcugacugaaucuaagucucauuagcuucuuaggaaaagccauauguuauguucuccauaugugggaucuaguaaauauuauaugcauauauguaaacaaauacccauguggguacaguguaacaugcagaaaagaacaagaaaggcuaaauguuaggaaaugaggacccacugaauguagaugauggcacaaguuaggaaaggauaugaaauugcuuucuaguucuaacucuguuguaaauugcuuauuuuucauaguauaacugcacaaaaaauauauucaauccaguaaauauaaauauaaaauccaguaaaauccagugugcauuccauuccagauggccacucuaugcugugugugugguggggcauacuuguaaucccagcauuugggaagcagagacaggcagaucagugagaggccaaccuggucuacauagugaauuccaggauagauagccagggcuuuguagagacagcuggucucuaaaaacguucauugagauguacuuugagucugauugguuaauucugugugugaugaauuuuuuuuuaaauaauucuuuuuuucuuuaagaagaaaauucuuaaagaauuuuaaauucuuuuauuuauucuauuucuaugaauacacuguagcuuucuucagacacacaccagaagagggcaucagaucccauuacagaugggccaccaugugguugcugggaauugaacucaggaccucuggaagagcaguugguguucuuaacugcugagucaucucuccagccugaauuuuuguuuuuuauuugcacccccuaccccaccaccaccacccaggguuuuucuguguggcccuggcuguccuggaacucccaucuauagaacaggauagguuggcuuuggagucagagaugcuccugucucugccuccuggaugcugggauuaaagguaugcacaccacacccagcacacuagucucuucauuauugcauacauuauauacaguuuauacucuguuuggguuauauguuuaaucuuuuuuacugagaggucugugucaucacagaacauuugaaaguacccuuuaagucacuuauacaaagcacuuuucuuuuuuuuuaaaaaauguauaugugugaguuuuuggguguacauaugcacuguuuguguacaggagcccacagaggccagaagaggguguccgauccuuuggaacuugaguuacaggugguugugagcgccauguggguucugggagccgugcccugguccucuguaagagcaguaaguccucuuagccacugagccucccucuagucucugugcuucccccucccccuuguuacuugcauggcagcagugccuggucugaggacaguugggggcgguguccuccauuuuacuugaagcugacaagucuccuuacagucuagucccuuauguuuaauuuucccuuuaguaacguucuucuucucuuuuuucccccaaacuaaaaaaugacauccauccuuacaucacagcucaaagaaacaaggauuucucaugaagauugccccucucuguuucccacaucauagccacuccucccuuaaucuuccugacacauugccuaugcauuuauuaaaauguuuuucuccuuuuguuuuuuauaauuaauuaaguuguucacccgguugcccuggugaugguuugugagcuuuuggauggaaggggucuugccuugccuuagucacuuaaaaaaaagguaauuauuuacuucugcuuuggaauaaagaggcaggcagaaaauaaguuuuucaauuuuaaaaggauuuauuuauuuuucuguguauggguaucucaccuucauguauguaugugcaccauuuucaugucuggagccuguggaggccagaagaggguguuggaccccuggaacuggaguuauagaugauugugagcugccaugugggugcugggaaucgaacucggguccucugcaggaacaugagcuccucauugcugggccaucucuuuccagcaccagaacccacaguuuuuaaaugugcaccaaguauucuggguaucucugccacuuccagagcuuagggaccucgagaaagcagcgaacuguacauauaucacauagaacuaagaaggcuccaagacaaaaacccaagucacuuaugugccacagaucugugcaugccugugucugugcacgugagugugagcguguguguguguguguggggggggggguuggaaauaaagacugaguaucuugcucuacaucauuagcuguccuauguauacaacauauaauauuaccacaguaaaauguacacacucaauaccuacacuaccuugccucugaaucugacauucuuuuuguuuguuugguguuuuuguuguuguuguuuguauuuuugagacaugauuucucuggguaguccuggcuguccuagaacucuguacaucagucuggcuuugaacucaagagauuucccccugccuuugacuccugaguccuuggauuaaaggcaugugccaccacuaccuggcuuuuuuuuuuggugugcuuuugagacaggaucucacuauauaccucuggcuguccuugaacucagagagauccacuuaucucugccaccugagugcccaaccucaaccucauuccacauauaauaauggagaucacaaagguauuugucuaugccuggcuuacuuuuaacuuauuuaauauauuuacuacaguggccacuugcauaugguaaaauaugaugagauacuuuccuucuuauggcuauauaauucaccacuauauacauccauccuuccuuccuacagggguggagugggggaccaagaaucaaacuuagguugucagacugauagcaagccccuuuugccuuuaucugcugagcuaucucauuaaucugauuuuaaaacaaacaauaaaacagucucauguagcccagagcgagcucaaacucaauagcugcagcuagucuugaacuccugaucccguugucuccaacuugaagugaugggauugcaggcaagugccaccaugcauagcugauauauaggaagacccuaaaugccuguggaugguuacccaucuguaauuaccgacaagcaaauuccugggagacuguccuguaugcuacugugauacuggccagagcaucccuguugggaacgguggccucuacacugcucagcugacauuccuucuauggaaaggcuaauugaggguugacaagcugucugcuuucaaguugagcuaugcuagaugcuucuugcuacuaugaugaaaaacagacuccuccagaguuuugaaggucagaugacagaguguauacggaagugucuggaacauuguaaauggccucccaggcagggggaagcaucgacucugaucauuuccuugugggguugacuucuagcucagaugucuuuguuagccauuucuguuuccuacggaguacauuuccauacauuucagggggcauccuaaguggaacgggaugugguuuuuuuuuuuuuuuuuuuuuuuuuuuuuuuuggaaaaaguacagauagaaguugguaggggcuguaaaacauuuaguuggaaguggguaugaugugugauccagugaugcucugacaguucaguuggccagguacuugguuauuaagugggacacugcuggauaaagaugagaaucagggcaagcuuuaaaugguacccaggagauguuugauuucuaugggaauuucaaucacuuccuuagagagguguugcuauuccuuggaaguagcucaacauagaaugaaacugaaaaguuaaguguuguuaggcagucuggaugaguuugaaaucguucgucuguggauuaaaaagaaaaauggguaggaauaagacugaacauuguggaggccaaguuugccguggaauuuuguacuguagagauuuacaaacuaaaacaugucagagacaacguaauuauagaugcgagagacacugaagcggucaguagcucuuagauugccaacgugcaauugugauuuuauuuauuuguuuguuuuuguuacagggaccagcuuugcagcccaggcuagucuagaacucacaguucacuugccucaguugucucaaugucgggguuccaggcgggcaccgguacauucucccugccuugucugggguucuuaauuugcaugugacuuaagaugaccuucccauagggugauuugucuaaguaaacagcagcuucccaaguggguuccaugagaaacuaagagucaaaaaacuuaggcaccacagggggaaaggguucuagagauuaaaaaaaaaaaucugggccaagcaaaguauaacagguguguguguguguguguguguguguguguguguagauguuagguguggaauuaguugcuuucguugcugugauaaaacaccaugucaagccaacuugaaaaaggaaggguuuagaugggcugacaguuccagaggauuagaggcugugaugguggagcagaggccugguggccagaacagcugagagcucacauuuaacugucagcaggaagcagagagcacgcugaagauugcuugggcuuuagaagccuugaagccugcccugaucacacacuuccuucaccaaggccacaccucccaguccuucacagacagcuucacagacucgcccaaguguucaagccgggaaaccuaggaggcuguuggaauucuaaacaccgaaggugucuuccuccaucacuuauuuucuuuacuuagggugccuugcugaaccuagagccugccagaucagaguauccaucuuagcaaggaggccaccaugccuagcugcuuuuaugugcggucugggcuucugaaggcuaauccucaagcuuguauggcacucacugagcagucuucucagccccaaacuagguaagcuuuuacaaaugcugcagcuuuugaacacccaggugaucuuaugcucagaucucuuagaaggcaaauggaguauucaugcuuuacauggaacuguggguauuuuuuuuugcaaagcacacagagcgacagugguugaguaguuuaccaggcauuuuuaaggcaaauccagggcuggcgagauggcucagugguuaagagcaccgacugcuuuucugaagguccugaguucaaaucccagcaaccacaugguggcucaaaaccauccguaaugaaaucugauacccucuucuggaguaucugaggauagcuacaauguacuuacauauaauaaauaaguaaaucuuaaaaaaaaaaagcaaauccaguuaauacaauuuugcuucacaaacuuuaguauauauuucuaacuaaggacuacaaaaauaacccucuucauuauugcauaaacuuagcaauaaucuguuaucuggcuaucccuuagaugucauuguuagugauuuuuuuuucaacagagaacacguagauuaucucauauccugagaugguuuccauguggugguguuuauguuguugcuuugucccaauguuuccuauaaacuggaagcuccuuuuaaagguguaauuaggggcuggagagauaaccaguggauaaaucaauguaucugccgucaagccauuugaccagaguuugaauccuagagccuacaugguggaagaagagaagugacuucugcaaauuaccuacccccugacuucuagucaaucaacaagccaugccaguagcaugugcacaugcacacaaaauuaaauaaauagaaauuuaauaaaggcacagggagauucaggauaaaagucuuuuggggggacaaaaaggucuuuguguauuuuuucacuccccuuauuugggaacaucauuuagguuuaguaacucauaagaaguaucuuaaaagaaaauaaaggaaguacugucuuuuuuuuuuuuuuuuuuaagaauuacuuauuuuauguaugugaguacacugucacugucuucagacacaccagaagagggcaucagaucucauugcagaugguuguaagccaucaugugguugcugggauuugaacucagggccucuggaagagcaguuggugcucccaaccacugagucaucucuccagccccaggaaguaaugucuuagaaucucuuuguaauugauucuauuauuagcaugccaaggagguaaaguggaaugggucuggguguguugagaagguauccuuuguugucggccuggggaucuggguguaacagcauacuguaccuuuuuggcaugugucuccuaagcguuuuuugguguugaacacuuuugguuuuauucagaacaacaaggugguuuuaauaaacuauuguauaggggcucaucuuuguuugccuacuaauuuagaaguacacaucaauuuuaguucuacuagauaacaguuuuuaauaaagccuuuccugacaaaugcucagaccaaucuaagaacaaaaauguaaggaaaccuucaugguagcaaauuuaugugcacauccucugguaaccgcagaugaauaaaucaaaguucccgucguugcugacuuugcuaauuuaauuaagccgucgaaauuuuuccccuucuuuagccuuuugagugcuuuuaugucugggaaaacguaaaggaauuuuuguguguuagugaagaauaacaaccacauauaaaguggcuuucuaugaugaauggcaaccuuccuaagccuugccagcacauucuuauauuuaaucccuuagcgggcagggauuuauacgcuguuuuauacauuaaaaauuuuccuuggugaaguaaagagccuuccuucaucaggcuggguauuuuauaacuaaaaaauaaaaaauagagaggaaauggaauauagcacagcacugcaaauguacauauauacuccauuuccucucuauuuuuuuuuuuuuuuagagauggagucuuguuauguugcccagauuagcauccuaagcucaaugugugugccucugugcccagcuccucuuuuuauuuuuauuuuuuugcuaguaaagagcaucaaaccccagaacguccucuuggaccuugguggugguuugcucugugguucagaacagugaauuguauuuuauuuacaugaagcauuucugcauuccacacuccaguuguguggauaugcuuauuuacagggaguuggccagccaggagggaggcuuccccagagaauugccaaagugggggugggcugaggaauccuccuuagagacaaggugucuuguuaaaaagacaucugguggggucagcucuucuguggcucaucuccacgucuuaugucccuggcuucugaucuagcuucugggagaauacucaguaggaccaaggggacuuacauagauagcuucguacccaggaguuaucauucucugaggaugaacucagaaccccagugacaccugaauucugcuacacuuuccuccuauuaaaaguucuccuaugauauuuuccuuucugaaucuuuuguuuuaagcccucuuccaccgaccggcuucauagucuggaagucaggccaggaggaagagagaggucaugucuaggaggauggagacuggguacugagccaguggaauuuauauauagauaguucaucuuccucagccuccauugcuuccuccagccucagccagucucacaaguagaauguuuaugcauuuucaaagguacauauccgcaaaggugcugccuugucaugccggucggucguugaugugguuugccuaguuaggguuacuacugcuauaaugaaagaccaugaccaaaagcaaguuggcgaggaaaggguuuguuaggcuucugcggccacauugcaguacauuacugaaggaagucaggagagggacauggaggcaggagaucauguacuggccauggaggagcgcugcuuacugacuuacauugaccguuuucuuucuuacaguacucagggccaccaaccagcccagggguauccccacacacauuggguugggcccacuccaccaaucacuaauuaagaaaaugcccaauaggcuugucugcuuacagccagagucauuuucuucuagagguguuuucucaauugagacucucuccucuccaaugaaaauagcuugugucaaguugacauacaguuagccagcacauguuucauauaugucauagcuggauaggacugugggcugccucccugccuuggaagcuugaauagaacaguaccuuuuguaccgugaaaagagggaggaggcuuuccugucaguuccagcuuagcagcagccucaaggccugaacuguguguugucugcaacaauagggacuuauguuccaccccuggggacagccaguacaauagcaguagcaccaauagcaguagccuauacuguuuugggagucucuuggacaaugcugaccaacaacucaaaagaggacuucucaugccugggguggagguuuuuguuagauggucuuuggcucuuguagccaacaaguaguuuuugagggcuaccaugcccuuuugagguacaggccuaugucucugucugagacaguagagcauacacagcuccucgggggacguucgugaccaggagcuagugcaucuggaggaaggaggaagaggaggcggaggaagaggagguguugguucugggcuggcaucagggagcagagggaggagaugcagccuggguaggguucugccaggugggagggugugcguucuggaugaagggagcacaaugaacagaggcugggaggcaugcaaacaagucaugcuuggguuguucaagagcagacggugccuggcauuugguagaguaggauggaaggagagagccagauugcagaggcauugcaugccagaccaagaaguguggacuugcucccgagagcaagugauagcugucaaaggccuuuccgcugggagaugauguaaucagaucuguguuuuggaccaaagccuuggcagcggugguauggaggacaggagacuggcguggggacagauggguggcagggcgcucgcucuguugggcuuuugaaguagaccagcugagagaugacagguagggcaggaagagaacugaggcugcugaguacccuugaguguacacuaaagacacagcucauggcguuuucaugaagggaaacagacccaaggucacuggggucuucuuagaacaggcuguccaagaacacucuuaacaaacugaguuuucaagaugcaacuugccuuucucagaaguucaugaacugggcagcauggaguccacagagcagacaggaacucagagaacggcagggcggggcagaagagucagcagggauggugacaaguaggcagacggcagugcugugcagaggacagguuagggccaggcugaacccuucauucguaugaccguguuuguugcgggugauauggcugugagucuuauguuacuggaaaacuguccauucgggaauuugaagaaauaccuucucucuugugauucuuagaaagcuuagacuucaagaggacacgguuuauucuucuuucuugcuuacuuuuccuuaaacacccuguuaagaaauccugcccugugacagggucucacugaaguuggagccuguggauuuggcuaggcuggaggccaguaagcuucugugagccaucucugucucccccaggccuuaacugacugacugagccaucucccagccuugauuucaggaacuuuugauagcuuauuaaaccauaugguguugaucuuugguuuaaaaaaaaaaucaccuaggaaaaugauuuauuuuuaguaucucgugugcauuuauauggaauuuugccaagguugcucuuuuuaaaagucauuuggauuagcauucaaaaguggcaagcccuggaaauuagucuuugccuuggcuuuucaauggacuuccagaaagagauuucuaggaaauuagcuuccugguuuucuugcuuacacaaaagagguugagggccggauguugguggcacaggccuugaauucuagcccuugggagacagagaaguaaguggaucuguguguuugaggccauccuggucuacauaguacauuuuaggccugcuagggcuacacugugaguccacgucuuagaaaaaaaagucagaggaguuucggaaucuuggugaguagagagaaugaaugaggaauguuagauauucugggguuguuaaauugcccaggaauggccuagguuguuccugauuaaacucagagucugggugugaagcucaaugggagacuggagagugcuugucucccaugauaaaaaggcccuggauuugguucccuaucacaagucaccgguuucagucuccuccacaucccccaaaguaacagaaaguaccuguuugaaaucugaguguuaaagucaagccaccacuuaguauauguuggcgugugucuagugccauccagucccugcccucuuugucaugugcagcucugccaaguugagguuuugaagccaggcgacugugguaaggcuccaacccagugcccuggucccagugaccugaguggguugcacagcugccuggagcaugcucucuggggaccugggguguggcuacuucugaagguuguuuccggaauggaguguggugaaguccuagacuucagguuaauggugggagguggcugagcuugaauaucugcccugggacacugggggccuguuacuaugccugcaguggguaucgugcugacugugugcugcuuuuccuugucugccuccugggacucuccagaguugggaggaaaucucugaguuggguguggcucuggcugcauggaauagaagguggguuuggauuuuuuugguuuuugucuuuugucagagucuggcugcucacaguaguuuuugcuucuuugguucucguagccagcaagcuuugcguuaauucucgcagaucagauuaguuucuuguucaugauucuuguguuggggagagagaugagccuucucugcccacuuuggguaaaugccauuacuacuuugugucuccuugacuggacuucucagcuccuagcuccuugacccucaccuccaccccugugauacucauuuuguguucuuagcccuaucuguuucugucacgggcuccccagugauuauuugcagggauugcucugucucugcagaagggaucaacuuguaacucccuauggguuuugguucaaagguccgugguggugaggagugagggccuagagaugcugugcaguuaggcuguggggagacagauuugggacauggggaaagcuaacagguaggauuaagcugggcuaccguggcugcuuaagauggugugcccuuuggauuuuccguagcccuccccaaagcccuuacuuggggauucuaaagcaugguuguggggugggggcugguuacaaaauuuguuccuaagaugcugucuguuucgcugccauuucuagaugguuuuggacugacaguugggcgugaggagcacaguguccuuagguugcccagaguugugcgcucauccuuaccuucagaaccuuagagucagagcuccaaaauacccaagagaacaguaaaacuuaaggaguaaugauuguggaguuauguagagagagacuuggcuucagguuuccucaucugcuuaauggccuggcagauguuucuuaauauuagagucucaguuucuccguguagaaggggggugucauugaacucaugagagguaauauuuacacaggacaccuggaauagggugugcucuuguacaaucaacagcauugaguugagugaaagucugggagcuacgaggaugaagauguggucuguguuuuggaagagcagugcaucugugggcagggcugacagagcaagcaggagcuuaggugccaggaccuacucugaggagcagaguacgggagaggcuccucucgccagggcuugccaauucuuugaaacuuuucaagacaaguuugugccuaagccaucuuuggaaagacuaagaacugaguuuguuucucuguugcugugauaaacaccaugacuaaaagcagcuugagggggaaagggcuuauuucauuuuacagguuacagccaccguggagggaagccaaagccgagaacacagggcaggaacuugaaucugaaaccacagaggaagggugcuuacuggcacgucgccagguccccuucagcugcuuuauaaaaaaaaaaaugguguuagcauccuuucuuccuaacugagaacaccuuucacacaaagccuugaucucauacuaacacaccuggcguggggauuguucuguaggggucagaggacaaggaugcagccaagcuuuccugauggugaugcuuuaacugcagguuacaggagccacacauccccaguuuguuuucucuguacacacacacacacacacacacacacacacacacacacacacacacacaccuuuggguggcugucuuagucaggguuucuauucuugcacaaaacaucaugaccaagaagcaaauugaggaggaaaggguuuauucagcuuacacuuccauacacaggguaggaacuuggaggcaggaauugauguagaggccaugaaggagugcugcuuacuggcuugcuucccacuggcuuucucagcuugcuuucuuauagaacccaggacuaggcaccacccacaauaggcuaagcucuauccccauugaucacuaauugagaaaaugccuuacagcuggaucucauggaggcauuuucucgagggaaacuccguucucugugauaacuccagguugugucaaguugacacacaaaaccagccaguacaguggcccaagucacuaaccucaccgucacagacuaugaccaugcagugguccaccucacuaacagguugcccuacuaucaaaucaauggcaaaacucucauucacuucuuugugaugauuauaaacuaaaccuaccugccuaguaauggugauaaccugggucuucuacaucaaucagcaaucuagaaaaugcccccaaagacaagcucacaggccaaucugauaaagaacaauuccccaacuaagggucccucgucccaggugugucaaguugucaacuaagauuagccaucacagauggguuguagccaaagcaacagcaugagcaguggauggaaauauuuagagcuauaacgaaucugagagggauggguagauugcaggaggaaggugguccagagaugggggcucagagagccugaugugaguaucggugggccucggagaccuugcugaagaagaacugauugauucuguagguaguggaaccucugaaaggcuuaaugggaaggacucggucaaauuuucuuuccuguuagcuugguaggaagggagaagggaggccaggaagccagccagacucuugcaugguaagauaguaucuugaccuugggugggaacgggaagcaugggucgauugagaagaugaaaucagugauugauugauaaguacacagaaggaagaaggaaggaucugucuagaguacuggucaagaucucuguguaaauaauggugagggggacaccagugugaaggaacagaauagaccccucucugggagcaugaggaguagagggaucucgguagggaaguuggaucuuggccaucgaggaucuagguagaguuugggagaaguuggauguuggccguaggcuuuagaagcacauuggaaaaaagaagucagcgcuggaacagagaggaugguuuggaauuaagaugcagcaccucgaaugaaguguuaguaguacuuacauguaaaccugugguuaaaacagaaauguagcauucacuaagauuaauaagacuacccaaacguuaagaaugugggacaggagaaagccuugccuucccaggccccauuguacuguucagcuguuuucuuuuacauuuguauuuuuuaaagaguuggaggaaauacuguaaagagaugauuaauguugcacauuaucaggugagcuggaaaccaagagcauaacuuaaaaauaaccugcgcugcagccugugaugcuauuaugcauaauucuagguuacuucaugcucugacaguaauaccauucgugggggggaggggucagcuuccaccuuuuacauacauuauuucagucagaauuaaucaugccuccaucugugcucccggcaauuaaaauauuuuaagaauuauaaauguuaaaugaugcucuguaaaauuugggaaaggggagaaagaauaccauuauguguucaaggcagcggccaugacuuccuuccuucucggccucugugggucuuuagcauaacaguugcagccaagucugagucuggugacuuaggggcuguuguugcauguuucagagggagucacagauuucccagguguuggcuaguugauggcagguguguguguguguguguguguguguguguguguguguuagugucugagucuucaccccucccaugcuuucuaguauagucaggucgcuguuggccuuguugcucaucucucucuggaugcuuggggccagcauggccucuuugucuucagaaucagggcacagagaaagagcucagcagguacucuggaaagaauagcugcucaucuuaggcuuugcagugcauuguaaagguagagaugggagcuauuuugggcgguuuucagccaagaggagauucaggaaaacaggcgcaagaagcauucuuuugaccucuagccuggcagccuuuguaucauccuugaaauuggaacccucgguagguuuuacuguggaagggugacucagcaggaagaaugagugaaccaggguuuugacuuuuuuuuuuuuuuuuuuuuuuuuugagaagcugaagcgcugucuuggguucuggagaugaugaacaggggucauaucccagcaacauguuuggcaaguugugugaccuugaacaggucacaugaaugugggccuuacuacccuagaguagugugaccgguuacucggguauaauguauuuugagcaccuguuuccacaucacuauuguaaggucagaugcuaagaacuguguuaguuauuuuucuguugcugugauaaaacagccaggaccagugcaacuuaaggaaggaagaguauauuuaggcuuaggguuucagaaggauuuaaggguuggugauggcagaguggaggcaugguagcuggagaagaaugcuaagagcuuccaucugcaaacugaaagcucaagccagagacagccacuggaaaggguuuuggggccuaaaguuuagacucaaccuccuguagauguugcuucuauuuccucagaugaugggaugagaugagcugggcugagcccagagcacuuauuucucuuaacuaucucuaggccuaguccugcaaagcuucuagccuccauacaauccaaucuuucaagcuguacagaugguugugagccuucauguaguuguugggaauugaaauuuaggaccucugcucacucuggucaacccugcuagcucuguucggccuuacucgcucagucccugcuugcuccggcccaauuuauuuauuauuauacauaaguacacuguagcugccuuccgacacaccagaagaaggugucagaucucauuacaguugguugugaggcaucaugugguugcugggauuugaacucaggaccuuuaggaagagcagucagugcuuuuaccugcugagccaguucuccagccccaggccgauugauucaaucuggcuuuucucuguuucugacugaauugcucugcuuggccucauacuaacuuaggcuauauguucuacucuucuggcucauucucauucucuggcuuguucuaucuucaccugugucgaguuugcucuuuuucugcaaucugucucuguaaaacugucuugguaaaacugccacacacaccccacauacuacacuauccccccuccuccccacucuuaaguagcuucccuuuccugugcaguucuccgaagaguuggguauauccuaucucugagucauucugucaacucuuucucugauucaucacuuugucugccccucgauuagaugccacuuucaaacauggcugcuuucuucuacaaaguaaccuuacuuucauuguuagggauuaaaggugugcacuaagggugugucuauacuccagccagaucauacuguaauccagggugugucugcaucccagcuggaucacauagaccuagaagguuuuaggauauaaucccuugccagagcagccauguugcuggauuaaaauccucuguaaccuucagugauauacuuucuccaaaaggccacaccuucuaaaccuccccaaacagcaucaucccucuggggaccauguguucaaaucacgaaccuauagggagccaaccucauugcaaccacagcagcuggagagcagcucaggugggaccuggcguguggauagugcucacuggaugcuggugagaagaaucauugauugaaaagaauacucauguuagugaggcugguggggacaugagaacuaucuuccaauguuaggaggacaacuggggacagaucugcaggcagccugucaguguauuuaugcaagucauuggaacggaaguucugguucuagaagcuuaugccaaugaaauaauugugcaagugcacacauguauaucacauaggugguuaccacauuauuuauuauccagaaaaaaaaaaaaggacagggaaaguguucauuucaaaaggaacauggggagaaaccugucacaaaaaggagcccaaggacaagcaugucauacguacgguauguucuacuaucauaggaacugaaauauuuuaccaggaguaugauggcuaaucuuggggagaagggccuucaguugaggagcugucuuguauuagauuggucuguggggcauuuucuugauugcuaacugguguaggaggguccagccaucccuggguaggugggcugggcuuuguacgaaguguaucuaagccugagcucggaggcuugagaguaaguagcggucuuccauggucuccgcuucaguuccugccucuagcucccugccugagucucuccaugaugaacucuguggggaaguguaaggaacggaagcccuuuccucccaagaguuguuuuggugaguguuuucucacaguggcagcaacugagcuagaccgaguaggcagcucugugcagggggcagugaaugaaaaugaggacaugcccaccccuagagguaugguugcggagaagguuuuuauuguagauaugaaggagaguucagccagaggcaucuggaagaguccagacugaaccgggcugagagagagagagacagagagagagagagagagagagggagagagagagagacagagagacagagagagacagagacauuuagagagacagaggcagagagagagagacagagagagagagacagagagagacagagagacagacagagauagagagagagacagacagaggcagagagagacagacagagagagagacacagagacgacaagagaugaagacagaagaccacagagucuagaggacuaagugagagagaagaaccaagagcaggggaccagaagcacaaaaagaaccgugcgagcgcagggcccaaauggcaggguuuuuuaggaaccagaagcugggagaagggaggcgaagcuugcaggcuggagaggcuuaggguagcaacagggugaaaagugcugagagaaaccacgaguacugagcagccuggcggcagccugugcauaacucuauuaaguaggcacuacaguuagccauuugaacugaguuucucugggagcagacaugaggaagcucaguggacugacaggggcgagcgagcgucuucuguguacugcugaggugaagaggagcagcccacgcuugcuccgcguaggugucccuccuauccaccauuguccuuccugugguuuagaaggccaccaucaccaggaucuggaauuccuaguauuuaccuugauuccuucaagagggacagacacacacauuuaccaacuuuuaugguaggguuguaauuguuuuauugcugcuguggagguuugacuaggaaugccauagacucacgugguugaaugcuugacccauaggagguguggccuuguuggaguaggugugucacucuacccuugcuggagggagugugucacuggggguaaaggcaggcuuugaagucuaagaugcucaagcuaggccuaguguggcagucguuucggaugaagauacagaacuguaagcugcuucgccagcacugugucuguaccugcgcgcugccaugcugccaugcugccaugcugccaugcugccaugcugcuuucugugaugauaauggaccuaaccuugcaacuguaagccagccccaauuaaauguuuauaaggguugcugugguuaggcuguguuuuuagcauugaaacccuaagacuauuaauguuuuuaaucacuuacuaugacuaauuuauaaauuacauuuuauuauagguuuuguguguguguguguauguguacagguagacuuugguacugaggguuuuuuuuuuuuuaagauuuauuuauuuauuauauguaaauacacgucagacacuccagaagagggcguuagaucuuguaacggaugguugugagagccaccaugugguugcugggauuugaacucaggaccuuuggaagagcagucagugcucuuaacugcugagccaucucaccaaccugguacugagauuuuuagcauuuguugggauauauucuuuggacaugggaguuaauuuauuuuuuagaaaauuaauaguuacaaaacauuuuuuuaaaacagaaucaguauaaaauagcaguugacuguuuuauaacuaagagaauuagacuugaagucuuggcuaaacgaggcugaaccaaccaaaggccuuggccugcuggcugggaaaccacccucggaagccggcccugcugauaucugucaugcucagacgaugagaugaccagaucucuuuuaaaaaaccuuucucucuccucauuuuuuggaggcuugaagugaauucagcaugcccaucaaacaccucccagcuccugucauuucccacuucuuugacauuuaguucugacugcauucacuucaacuuuguuuguucuuuucuaaguugcuuuaauaacguuaagucauccagguuuuucucucucuucucggagacuuuacugcugaggaggucugggcuaaaccguucuuuacaacucugucccuacugacacgagcugccaucagaggcucacacggcugcuuacagguuuggcuggcaucaguuuucccugcagaggaagcuguuggaacuguagcauuuaagucacgugcuauccugucaucagugguccucaucgccuugaguaguucccagaacucggugaguggaggccagagauggcggcuuugguuggucucuuccaccaugugggucauggggaccaaacucagguuagcagcaggugacuucaucuguggagccuucucaccagcucuuuuacacacauacauuaugccaagauaaugcccauuaagcgagugcacacacacugauucuggaugguauuugguugguaggauuuuucuuuuucuauuuucuuuuguacuauuugucauaaggacaaaacauuuuuaauaaggacaaaacauuuuucucagucuuaaaaaaaaaugaagguagccaggaaugguagugcauaccuuuagucuugguacccaggaggcagaggcagguagaucucugaauuuggggccagaccgggcuacccugugagacccuggcucaagcaaacaaacaaacuucuucuccuuccuacguuucaccuuaaaauuucuuauugaacuuuuaaacauuaauuuccgaaauccucuuuagaguugucuuguuguccugaauugcagagugacgggugguaggaugcucagcuguaauggaugaugcucuggguaucuauaauaaaggccugaaggaguaggggagagaacuuggcuucucgucacccucucacagaacagguuaguagggcaauccauauuauauggacaggcauaggaauauauaucacaaagcaagagagcuagaacauugaagcuuacuagcacaauaggcauggggacucccuguguaggggggggaggucgccucaggcggauggagaccgccuucuaguggagguaagccugggauacaguggcagcuguugggagcagcuuucuuacuaauaucucuuuucugcauagguaccuguucauuuacagaaggacagcuccucagaauaaugcacucagaaggugugcagagguguuguggucccccgcagcuguauuuuaggugucacauccagcgcccaacagcaguaucacucucaguaguuaaugaauguguaaaagaugaagucaugcuaaugugacgagcuuucccacgggcauaggcgggagcauacacucaacagaccuccuguuaaccagagagccugucuuggagauuauaagcuggcaggacggggccuaaccuuucuuauuuuauggcuuguagaucaaauaauuauuuuaauuauuuuugcaauuaacugaggaacagcgucuuuauuaggguaugggugucuuuauuagagcuaggugggaagguugcgaggaaugauggcguuuagaacgccgacugggccagucaguccucccuggagagcaaccaacaucucugugucugcuuccaucggagauuugucuucguuugguacauggucuugucuaguucugucugguugggaauucacaguccuccugccucagucucacagauguugucuuuagugcuuugggaauggagaauauguuuuuuuuuuuuuuuuuuuuuuuuaacuuuugaaaacggguaugccucuguuuugaacuauuuugugaaacugaggcuggcccugaaacuccugauccuccuccuccuaccucuugcaugcugggauuacagauaugugccgccauguuugccugugcuuuagauuuuaaccuugagauuuuggucuuauguaugaguuaaaaaaaaaaaaaaagacugcuccaugaggaaggauccaaucgaugucuuucaaagcuuuaucucuacuuaaguguaugugucugcaugagugugagugugccaagggccugugggagcccuuggaagccagaagagagugugagagccccuggaaauguagauaccagcacuugugagcugccaucuauugaacucaaggccugugcauugagcugugaguggcuguauacuggcuagucccugucucaauggaugugaagacugaaagaaguggcccacguaacacacccugccuugucuaccuaaauggucaguguauaccguuucuuccuaagcccucacagcugggauaauuucccuguguugguaguccacagugcgugugugugugugugugugugugugugugugugugugugugucggcggccuuuauuuuugucuaacccugggugaucugggacuagagguggcugucugcugggcccagugcuaugcacuggaaaugacuggaaagugggcacugggcuucacucccauuaggccgucagcagaacggaagauuaccguggauugggguccuuucuguuacaaagcacuuuuuguagagggugggguauaaauuccaguguaaaaauguuaaucccaguaucagccacuugagcuuuauuagaucugcuggaggcagauuuacccacacaguaauccccucucuccucccagggaaugggcagaaggcaggugaaggcucucucuguguugaugcuagggccugggaccuucuuuagguucucaugagguggcuaaugagacaucuucuaggcagggggugcuccccuucccugccuucacuaagucuuuccuguccguuaaacuuccuauuccuuaggacacucucuagacagcccccauuucuacccuugcucucugcaagauugucccauguccuccugccuuugagguguccaugcuaggugacaguggaccugaggacaugucccuuggaccuugguuccuugccccuucuugccuugcucuggaagcugucccuaguuuagcacucagcugcugaucuucguuuucucucucacucuugagauucucucucuuuagccccaacaggcuuagaacuugcucugcggagcaggcuggccuugaacucagagagauccaccugccucugccucccgggugcugggcuuaaaggugugcaccacuggacugguuuucaucuuuguugagauugauacuuguuuccuacauagcaaacaggcuccuuaauuuuaauuuaaggacaaagggaaaaaaggagguuaaaaauaaccugguauguguccuucaauguuuuucuguucacaggcauaugcuaaaugguaugcuauucuuauuuuguuauuuagguacauaauuuuuuuuuguacacaagugugguauauuuuuaccgcaugccaauuuguauucaaaugauucccaaccacuguguguaauuugcucuuuagucuguuaggaguaacauuaaauuuauaacaauuauuacugaauuuuagguauugugauuaaaaauuguacuucaaguuuugaugaaugucuuccaaccauuaaacuucauuaaauuaacauaaaacgacuaaaucuauguagccuguuuaucuuuuuaauaaucugagcaaccucuguguucuagaacugagcugggugccaggcgagccccuucaggucuaagagucauagcauuaaggaccaggcagaacaugugugcacagcacucugguuagaguacacaugggagaauugaauauauucagaucacacaccaggaaguagcugucugugaggguaggguguguguagagaugcaggcuguaauggaagaguaaagcuauguuauuguaugacagugacacugaagauuuuggacacaaggccuagggacccaguucacuuugaagaaugguauuuuccaguauaaaucuaaagucaagaagaaagguaaacacauugcucuguaguuggccaaguuucuccugggguauggguuagcaauucuggaguuccauuguugcauacgcagggguuaagauggugugacguaagcaaaggagaaggcuuagauguuggagacccagguguggacuugggaugggcuaaauacugauccacauaagaguugauaaguaaguguguaaaugggcuggugcacacacgggagugauagggccgugcagccuugacucgcugucaguaauaaguauauacaucucuucccuccacuggugccggucuccggucuccagugagccggacuccuugggcagcauaauuauaguucuggagcaucuuguguggccagaaaaugaggaagugcuccgaaaaaaaacaaaggaugugggcauguugaagggaggaaggagccaaccucaaggagcucuuaacagccagagcuaacuuuagcaacaaaauaaauagugugguacugcauaauaauacaaagcauaauauauguauucacauggcauggauuuaugcgaagucaggaaacagcauucuuagaggagaauuucaaauacuuguugcagauaccuuuuucuccaggagccuaaggcugccguucccacccccucccgcucacagaggcuagacugaggccgaaguugcugaguccucuaaagguagaggucgagagggagaggcuaaccugggguuuagccauucugugacugugugggcagaaccuuaaccugcugucucccuaagcccauagcccacuacagucauuaaaaaugccagagacguccacuccuuugccacagcucugagcuugcuaaggagucaccaugagcugggcucacccuuccgagcugaagaaaugugucaacaagacuuuaucacugagguucagugguggcagauaugaacaaggaacacccgaggguuugggucccuuugugacucgugugauugguggguacguggaggugacaacuggugggcaaagagucacaggggagugguggucauacuuggaaacagcaucguguuagaagccuuggaagagucuaaaccauagccgaaaguucagcagaggacccaugucccuccccaaaggcaucguugacuaugguguaggauugggucacguacguuuucauaugaaacacuuuuccuaaauaaacucuuguuauauugaagggaaacaaaagccagacaaaccccauugagaaacauuuuacaaaaaccccgaccaguacucuuugacacuauuaaggucaugaaaaaaaagacaaggaaauaaagaaaaacuccaagauaccaaaggagaucaaggaggcagagggcaagaagcuacaaugugcgaaacucuacccuggacaaaaacucuaggacagaggguguuaguggaaaacuagaguaacccagaugacaucugauaauuacaaacgcuuaaauacucacccggaugcucuuguucugagagcauucaaugacggggaaacaugacauggggagacagagaugacuccucauccgcauucuacuacugagauuuuacucucuugacuuauuacacagcugcucaucaauccaucuuauuuuagaaaggacuuuaaaguugcaaacaucagugccaguugcgcaugccucccguaguaccaccccgccuguuuaaagaaugauuucuucuauaaaauguuuuuauuaguacauauuaauuauacauaauaguggguuucauuaugagauuuccauauauguaaugaaauguauucugucucauccagcucccauuuuguuccccucucccuguaccaccaguccccuuccucucuagacucccaagguggcugguuguucacgagguuccaggcccuucggaguggacgcuacaucuaugguuguacccuguggagggcggaggaugaagaguuggaggauguagguuuuguugcccuguccuggagugaugauagguguuguuuaugcucagcugagcauguuugacugacauguagcuguaucugugaacacgaggauguuccagggucuguggguguucagaaaauaauagcuauccuggagucgaggcuggagggugccauguaagaugggagcugaggcaguaggaugcccaaguuaggcugcgcugcgcuacaccauuuaucugaggagagcccgaggccuagcugcacccuucuucccuucucuggggucucccggggagaaggaugccaaggagagacgcuuuagcucuggaagggggcaggaagaugaaccaccagagacugcaguuauagagaaaggacagcagucacucccaaagcccacagagcuggggcugugcccagagggguggccuuccaguugccggacaguggcccuauucaguuuggaugcauaaugauuuuaaaacuaaucaggacccaaagcccgaggcuggagacaaacacaaauaucucguuggccgagcaaacaucuagguuuugucagauaggaaguuacugaggaaggucagggugauguaauggugugugcuaugcuuucauccuuagacagaugggcccccgggguaccaucugcagcucccugggcccuuugaaaucacuuccuauaaaugaaauugucauaagucacuauugagaguuuggugugguaggcauaccagaaguacagcuagacaaaggaaggaaauuuccacugcagcuagcggccuccucuuccucccugugccuuacaaacagcccugagauggauuauugugcucaguuuucucauauagcauguggguugauccaguagucauccaaaguaaacuucccuccccccuccccccuccuucacacaacuguucuuaccccaccuaagcuguaucagcuguucugcuguuuucaauuuuuauuggggaaguaguguuuuuguuucugguuuuuuuuuuuuuuuuuuuuuuuuuuuuuucccucuaucaaaggaaucuauuuguucugggaagucaagggcaggggauguuuccuaaucuaauucagggaaagaaaauguacagcaucuccuaugagugguugcuuuaugagucuuaauugaaauuucaaauaaaccaucucaauaaaccguuucagagcugaaagcagggacugcgguacccauggguuuauuuauggagcaguuauuggcacacugugccaggcguggcucugugcccuggaagagagacacaaucaggaggaaauagugagguguucuuggaggagugcagagggugacaggcaggaugaggagucaggacaggcuucuuggaggagguggguuuuguggagcaucucaggggaguguguaggugagggauggggguuuguuuggcagagggagacaccugagacccagagccagcccagugggagcccaggcaggcaugguguacuugucuaaguggggaaagguagggauguacaauggucaagaccuagaagagggucucaggaaaauuggcuuagaaucaaagcagaaaguuuggggcagugccuguggcuggauccugguaaggaacagagaggcagggagguggggcuagccgcaucaaaccugcuggcuuugugcuucuggguggaggggggcgugacaaguguggagcaggcaauuaaggggaccuguuuuugagucuuuuguugagggccuuucugggucugagaauuccagggcucuggcaucucugggcugcacacaccuucucucugaggucuuuuuuuuuuuuuuuuuuuuuuuuuuggcuugggacaguugagaagcugaguccugaucugguccccaaccuugugaccaguaaagagcaccguagaauaaggaaaucgaaggcuaggggacugagguguggaugacuguguggucugggugcaaagagcagaacacacucuagggccaccaaagagccaggacuugugggaagcacaagcuuggaaugacacuguugccugugcaguaugccugguaguggagcauagugguaggggagcuggggugggcaugguguggugaauggcagccgcugugacuucguggguuggacacagcaguaagugcuuucgagugucggcuaggucaacagcaccccgaaugguuuauccccaucuacauagaggcccagccaggggacaaaacugcuccagguuacauggugaguccaaaaauggaguugggaugguaauccagauuguccccugugcucuuguuccuugcaggagcugacuguugggcacagaggaaggacaggagagagagcugagacauaaggaccacuguaccgcguuucuuccuuccaugaaugagaagauaccagagauaggugggugucagcuucgcgucggguugaagggugaugugacugugcugugcguaggaaagcacugaaggagcaacaguuuucacguguggccugagguaaagcgggcuggagaaguuccuguuugagcuggugcuuccuuggcugagcgggcgagcucauguucagagagcaggguuccaguggccccuggaagaguucuguucggacauugcuggcagugauggccaagaaccgugcgagugugcacccaugccacucaaccaacuguaggcuuguuaacgguaaaguuuguuucugucuucgacaucaaaaggaagagaguggagggcggggaugacaguccaucuccugucacaaaaccaccguuuccuucgcaaagugggugcuuagcaaaugagugaaugaaugcuagccauuuugccaagugcucugugcguuguuuucaucuaauccuuauuuggagggcugaggucagcacugcuguacggacuguacagguccugacuuuaagggauuagacaaaucaccuaagguugcacauuuagaaaguggugaagcuagugcgguuggauccuccugcuccacuccgggagcugaaaagcagaagguucuggaaacucaguguguguguguguguguguguguguguguguguguuguuaauagaguaaggagaaugccuaauggggacaggaaggugggaggaggccuaguagugaggccacaugggucaaagugugauggcacagccuggccuccagugucucgacuggguacagcuguaauagaaccgucagagggcccaggagugcacgcacgguuacagagaggcuugagugugugugggagucugugcgaccuccagaucccaaguugcuaguggauuccuccgugacuggacaggauggagcugaggacugugcuaauaagcagccuagccuguuccccuuucccaugcuccuccuuucugccaccuucccuggggacagcuguggacccacugagucugcaggcaagaaccugauacuggggggagaugcauggauagaggacggaggaggccugaagguuucucugcugccaauagcaaagcgucugugugagggcacaucacagccacccuucccagcuugcagacggugacaaagggagaccucgugcccuaggguuucuuuccuuuugguagaaguguacgagaugggucucauaggaacugaagaguuaccggcucccugugaacacuuucgaggguuguaaccuacagugacuucaguggcgguccgugcuauuuguggucccccgguauaggugcaagcuugucucagguacuuggauuuaguaagguguuuauggugacaccuagucaguuuaugagggauguacucccuggggaguugcucuucucauauuccuucaugcguauucuuuggacccagcaggagucauuuauccuccugguuggagguuuuuuaaaauucugugcugugcugggucggggguggggcugucugaggggugcuuucugugaagugaagguggccguagcaguagcaaacaaagucuguaaucauauaaucauuuugaauaccuaagaagauggcuggcggcagguccugccagggcagccuggaaagaagggauugaguugcgcugcaguugaauucugcagccgucagauucuccgcaguacaguagucagcuguaaccuccagguguaaacagaccuucaucagcaucauugaaaagcgcuuugaggagccagacagagcucugugggacgccguccaucaaaaagucauuugccggagccuuguuucuggcugugacguuuuacccccgguggcuagcaggcucuguagagcuuugccucaaggagagguggaggguaucuccguucauuuggagucugcuuucuacagucuccuuugcuuuucgccagcugagacacauuuagaggccuggugaaaacuugccuuuaaaacaggacuaaaguagcaguuacuaaguagcccuucauuuuguaaaagaauuguggcuaauuugggggcuauuacucagugguaaaauacguauccuagcauggaugagccucuggguugacuccagcucccugcacccccagggcuaauguuauaaugacuuaaucuuggaauuaguuagugggcuuuugcaaaaggaccucuguuguugcugugaaucucagucuccucagccuggaucucucaucccugacacggagaauggauuuaauauagcugugacggcacaaggaggugacgcugccugaccuguucaaagaugcaaaacuggucgccgugaggguugguagacaaguagcagagauaauggcuugccugcagaagcuuuucauggaaaaugauaucaacggggcaggagagacaguucaggggcucagagcacaugcugaccuuaaaugucagugcuagguucucuacaccuccaugagcagcuuaugcaacugccugugguugcagcucccgggagucacacacugcacucuucuggacucuaaacauaauuaaaaaauaauaagaaucuuccuuucagaaagaaaaagauuuugaagaaaaaaaaaaaaaagaaaacccaauauugaguauaggagaauccuaaguuuuauaaaaguauaaaaauuuuauaaaaguauuuuucuggggcuaggguggugguucuuaacauauaggaggaaugaccccuucacagggguugucuaagaccauuggaaaacacagauuuuuuuuuuuagcauuaugauuuauaacaguacaaaguuacaguuaugaaguagcaacggauaugauuuuauggcugggaugucacauuaacaggagaacuguauugaagguacacagcauuaggaagguugagaaucacugggcuggcgagauggcucagugguuaagagcaccggcuguucuugcagagagaguacgugucuggaucccagcaccuaugucaggcagcucccaacugcuugaaacuccaauucuacagcauaaauacccucuccuggccucccaaguuugccugcaugccgauggcacacauccucaagcacccauacccauaacauaaaccuuuaauaaaaaguacuuuccuguuagcugggcagugggggcacacaccuuuaaugccagcacuugggaggcagaggcagggugaaucuuugaguucaaggccagccagggcuacacagagaaaccauagaacaaaauaaacaaaacgaaaaccuaaucuuucuagaaaaacgaacauaauuuuagauacuuuaagugucaaaagucaaaagcaauuagugaaaaaaaccgaacgauucauauauuuuuauaagcacuacuucaugaguuugaaaguuuuucuauuuuagucauuuauucuuaagaguuguuucauugauuguuuuaauuuuaaaauaacacaugcauacuucaaauauuuguauguguguguauguaccucugugugugugcaucacaugcaugcaggaacuguuggaggucagaagggacauuggguccccuagaacuagagucacaaaugauacagaugauuguuagccacugugugaguguugagaacugaccuggguccuggguacgaacaguaacugcucuucacugcugagucauuucuuuagccacccuguuugucuaucugucugucuugucugucuuaguguggcaaugucugucagaguaggccugaauaaaaguaauuuuaacuguguaauaggcaagccagaaaugagaugauuuuaggaauaagaagguuauguugcugucuaaacuacaugaauauaaaacaguuuaugaccccaacuauaauauauugauuuauuuggaauugucucuggagcacugugauaguuugaauaagaaaugccccucuuuggcuaggaauugaaacgcugaguccucagcuggcgguacuguuugggauagugguacagccuuccuggaggaagugugucccuggggugggcuuugggaauuuauagcucuuuucauuugcaguucccucucucuacuucaugcuugugguuggagaugugauuucuuugcuuccugcucugguuacuaugccugcaacuuacugucacgccauuccugugucaugacggaugggcucuuagcccucugaaacccuaagccggaauaaauuuggguuuuuuuuucccuuuaaguugcuguuggucauagugguuuuuuuuuugguuuuguuuuuguuucgagacaggguuucucuguauagcccuggcuguccuggaacucacuuuguagaucaggcuggccucgaacucagaaauccaccugccucugccucccgaggucaugguguuuuuuaauuucuuauuuuuaaaauuuauuuuauauguauggguauuuugcuugcauucucagauaugcgcaccacaugcauuccuggugugggauggaucccccugaacugggguugcagacaguugugagcuaucaugugggugcugggaauugaaccugggucuucuagaggagcagccagugcuuuuaacggaugagccaucuauccaacccccagucauggcauuuuaucagagcaacagaaaaguaacuaauacacucaccaaguaaauuuaggaacaaaaguguuacuacuuguccaguagcauuuauuuuauauuguugaggaaguaacaucuugcuauuuuguuugccugagguaacuuccaacugcuggguucaagcauccuucugcaucugcuuccugaguagcugggucugucggugcaugccacgaugacuggcaagagaguagucuuaaagcacucucaacaucaguaaaauccuugcucagacccacagcauuuguauagguauaaauuacagucaucuaucugcuggcaacaagcuguuugcauuuaagaucuacagaaauagcaacaaaagaaugaggcaagucaacacaauuagaaauuacaauauuuuuuggauacccuuggagauaccucccacccucuacuuuggagacaucugguugcgaaugacaguaauccagaagaaggaagcacacggcgcuuuuugagagaggguuugcuagguucgggagugguguguggaugagaaguugacagagagcugcacugucaagcagauugagaguaggcugggugggggguaaagcagaaagcugggguauagcuccccaccaucugugcaagaguguugcuaagguaccacgaaccaaacuccuaaggaucgaagcugucagaauggucagauugcuuucucauagcugggaaugcuggacacgggaccgcagaguauaguucauauacaaggcguugcagaauggucuuuaguuugggagaucuuucagcucuuugauaagaauagguuugaaaggagugauagagaggcccaaguuaaccaucaggaaguggaccucaggugaaaguacuaggcucaggcuuggugaauuuugaguggacggaggcugacgacgggggagucaggaaccuggcugaaggguauacuuaaucucuuaugggauauuugcugguccauugggacuagaggucuacagucuucuauaacaaacauuuuuugagauuguguguuuuaguuacuuuugugaaaaaaauauuaugaccuagacaaguuauauauagaaggaagguuugagcauacgguuccagaagguuagaguccgccaugacagggcaaaggcauguuggcagaaguggaaagcuuagacuggaacggcaggcguagugauuuaaaaccacaagccugcccccuuucuccaguaaggccacaccuccuaaguauauccaaacagugcuacugacuggggaccaaguagucaaaccuuuuagccucuggggaauauucucauucagaucaagccaccauaccgaaaauuacuugugucuggaauucagaagauggcgugaccagagacacuaaaagggaaacugucaccuccugugaguaacccuaucagccugcaguaccagaaacaaccucagaccaaucguggucaguguguggcuugguggaugucuccuuagcugauuaccggaaguuugcuuuuggggacugggugugacuugaaauaaguuggugauuucaggcagguuuggaauucagaguauuguuauuaaaaggaauaaaagcaggcagaggugguaaaugacagaugguccaaagccccgcucucauuugaaaggauuuagagcaguauacuuggaucugaaaagaaagagggcuuuugacagcauuucaguagcugugggguuuuagagacaguccacaaauaagguauauaagcauuauuucagucaguccgucuggcagaaguguuucacagacgaugagaaaaggaaaugaggguacagauagggacagauauucaauagucaauggcgguugcaaacacgccuaccuuuccuccaggaacuuccugaaggguggacugugagggcuguaguuuugccaggauaagagagaauuagcuaacguuauuacuaaguaguuaguugguguguuuguggcuuaggugggggaauauugacacaguaguugagaaaucucaaaggggacagaugucgaaacugauaaaauuagugugggauuguuagguggcccugagugaagaggccugccucacugaaagguugagucagggacaauuuaugcugauucccagugggacagggccagcacgcagagccagccucucauccuuugcaggggagggaggcccugagagccccgcaggggccuggccuucaugucuguacaguaaagaaagacuucaauuuacagauuauaaucugccaaauccuauuucaaggaaggggauggcauuagggcuugugugcuuguagaaaggaaggguuuaaggggagaucugugagugaugucuggcaggucauuuguuccuaccaggccuccauucuuucaugcccaaauggaagaaaggcuuauaggaauaaucuuggaacccccugcugguucugaguggauguauccauucugaauagaugaggggggaagaggacugagcuccgccugcuugcuuuagcugcccucucugugaguucccacugcuuuaugugcugcuguucugcagaucuguuucccucgcucucuaugauacccaugagguaaggcugucacuggccccauuccacaagcacagacaaguucacuacugacuggcugacuggggcacauucagauauggucaaacugcuuguaaugaggguaucagagauuccuuguccguauugacuaagagguuuuuguuucuuguuuuugguuuuuuuuuuuuuuaauucaguguuuuggggacuagaauuacucuaauuuuuuucuguuuuucucacagauggcuuugaaguaaaauaaauguaaaacuauuuauuuuuauucauguuugcagugcugggaugaauccugagcccuguucaucucuggagaguauucugccucugagauacccucucagaccaaagucagaauguuaaagacugcaagaucuugagugugucuuuauucucauuuuguggggugacgauagggggacaguaaagcccacuuuaguuuucccuuuugacuuucugaaccaguucugauauuaaaaaaaaaaaaggugugggagggaggcauauugaauuuaaauuguacuuuuaaaaguuucaaaugaauagaaauacaguuuaggaaugugccuuaauuuuugaagaagagggagaagaaggaggaagaagaagaaggaagaagaagagaagaagaagaaaaagaagaagaaaauaauaauauauaauauaaaaauaauaauauauaauaugacauaauauauaauauaaaaauacucaagacugggcaacccaugaauaaguuuauucgacuccuggucccuagaggugaguaacuaguagcauagcuuuaaggaucugcuaggcauuuggcgagggccccugugcagcaucagaacauagcuaaagauggggcuggagagauggcacaguagcuuaggacacugcugcucuugcagagcaccuggguuuuguccccagcuuccacaccaggcaguaccuagcugcagcuucacuuccaggagguccagugcucucuucuggucucucugcaggccauucucacauauggugcacauaagcaggcucauggaaaugcaugcaugcauaugaaucaaaacaaaccuuuuaagaaaauagugaagaguaucucguguuagauaaagcaaguuugccaguuugggugcuucucuuccccuugggacaagguuucucuguguagcccuggcuguccaggaacucacuuuguagaccaggcuggccuugaacucagagauccaccucccucuaccuuccaaaugcuugcaccaccaccacuagacuucucuucuuuauauaaggaucucucaagugcugucaugaaguccccacccugaggaccccaucucauccuauuuuaguuuccagaaccucuucuccaaguggcacuaggauauggauuuugggaugaaguguucaacauagccuuuagaggacauguguaaauucuguguauaccaguauugggcuuccccagccuggugaguucugcuagagggaggcugcucucuacccauuuuggacaucagugugccucucuguggaggccaugcucacagagccacaagcuguaccaggacucgcagugggugcuccaggagagagcuuggcagccaccgagggacaagcuuccucccaccucucuguuuuuguucccaagcuucaugaauuaauaaguucccgaggcuucuagaagucgggauccaagaaagagacccagauggugagcuggaggggugcucucucuaugaaagaaacaggaaccagacugacuccaguucccugugacaaauacucuucuauuucccaaaggcaacaacguucgggguaaacguugucuuguacuagagagacaggcuuuuuuguaaaagcaaagcuggauuaaaacaguggcauaaaccccucacccuaucgcugacgucaaggcuaacgcugcugcgguuuccucauuacaagacaaaaugaguacucugcuaugucuuacugaguaguuaggaaaguuaucagcgcugaggacgcaugccaccguggugucaugcuuaccuagcacgugcgggguccuggauuugagcucaggcacuguguauguuugugcugauaguaaugucucucuggaccugccugcaaaugcuugcuugaggacaugaaauuaccuugacguuuucugacgugauggcugacgaagucuccgcugugucagagacuccguuuuaaugugcuagugcuuucuuucuuucuuucuuucauuuuuccccccuaauaugaaugaaaaauaucaaaacuaaaauauauuauggacaaccggucugucaauuucugaagcaacauuuuuuauucagcagcaagcaaagcaaguuugcucaacuaaauuauucauaagaauuacaaaacuugucacuuagaauggauguuaggauauucaggucauuuagaagacugugguuaaaaauaaagugacccaaauauauagcucuaguuuuuuuuuuuuuuuuuuuuuuuuaggcaaguuuaaacuuuuaauuuuuauuugacauugguccuaacucuguuucaugaggaaugucauuggcuagccugccaguguuuaaauaaaaaccaauucuucggcuguuguugguuucucuguagccagguugugcgugccguagcuaggcuguaggcacgggaauuguguaugugaguaacagagaaaccagaggucacgagcaaaucacuccccaagaaaaacuggaaacaauuuauuacuuguucugaucacuccuuuuguacuuaaagcaagaagcaguugaaauaugaacuugucccagucugcuuucgggugguaacuggagcauaaaauguugaaaaucaauuauguauuuagggagaugaaacaggcugacauuuugaaggccuacuauauuguuuggugaacgaaucagggcauuacaucaucuuccugugcuaacagggugucccgagagagaaagacaggauaccccauccuagagugucuaaacuucacagacuugcaucuugggggaaaaaaaauccuguuuuaaaaauuggcuuaguuuucguugauguugcaaagcauuugguacuuuugauauaaucuauaauuugccaugguuuauaguaaugugguaaauagcaaagcucuguuuguuaucuaugguaaugagguggugagaucuuugcaggaacgagcagagcagagaguuugcaauuucuccuguagccccacagagucugaagcugcgcuuacaacugcguugaugcuuguggauuuggggugcucuguugccuuugucuucaccacccugugauggaagaagucccuggagucugggcugcaucgagccugugucaguacaggcauacacagcggcugcauagacucuguaucaguacaggcauacacaguggcugcauagacucuguaucaguacaggcauacacagcggcugcaucgagccuguaucaguacaggcauacacagcggcugcaucgacuguguccgugcagucauacacagcggcugcaucgacuguguccgugcagucauacacagcggcugcaucgagccuguaucaguacaggcauacacagcggcugcauagacucuguaucaguacaggcauacacagcggcugcauagacucuguaucaguacaggcauacacagcggcugcaucgagccuguaucaguacaggcauacacagcggcugcauagacucuguaucaguacaggcauacacagcggcugcauagacucuguaucaguacaggcauacacagcggcugcaucgagccuguaucaguacaggcauacacagcggcugcaucgacuguguccgugcagucauacacagugguucgccagcuggagcuaagauccaaggccugcaagcaggcagcuacggcuaaguggcacaaaacggugugccuucacaacacaguuacugucuuuguugugcaagacugagcuccaugaugaaggugugggcagagcuguuucucucugaggccuggagaaagaagaucuauuccaagccucucugguuuuuaggugaccaccuuguuucuuccugugccuaccccuauaucaaauccccuuuggauaaagauaccaaucacauuggaucaggccacuguaaugaccaccugaccacugccaguuauaucaauauucucucugucucucucucaggacuccagcauucaugguggguaggcgccaauggcagggcucugggcucacacuucuguuguucauugcuucuccucauuguuuagcaaacauucgaucauauuuacagcuugggcaagaaggccagauuuguccucaggaaaccugaaccccauuuuuuauuuuuguccaugcugacugguagauggugucagaucuuagaugccaauaauuuugcuugaagcuuuuuuuuuuuaaugaauuuuaaacauuugucuuuucuguguuugaucuguugagaagaaaaauacuuaucauucgauguccacauugguuuuaaagaggaugaauuggguccuuugugauuguuuuccuuuuagucuguuuguaauuuuuuagauuuuauucauucuaucuaucuaucuaucuaucuaucuaucuaucuaucuaucuaucuaucuaucuaugcuuugugcccucacaggggaaaaugauuacuguuucaagauuuuuccuauaaaaucugcagcuaccugagaucuuggugccuucaaacuaggcagccauggaauaagggugccaugugguccucaccaagauagauagguagguauucacugggcuauauuuagaagauggacgaggugccacaguauuuggauuuugcuaguauuuaaaggaaucguuuaugccgcaaaggcacuaauuuauuuaagaaauuccugugugcagagaaguguuuccuuggagucugccugaucagagauuuuaaagucaugggcagugauuucccuugucagugugaaggaauaaauguggcacaccaggcauguuggggcaccccuuuaauccagguacuccggaggcagaaggaagacagacuacaaagcaaguuccagaacagcuagagaaacaauaacuuggaaagagagagggggaggaagggggaggggacaggggaggaggagaaagaugaaugcuuucagagccugguauggugguauaugcuuuacucucagcaucauuugagagacaaaggcaggcaaugucugugaguucaagaccaaccuagucuacauagcuaguuucagaacagccaaaccuacaagugaaguccugccuauccuccacccccaccuccccagaacagauuugugguggauucagguuggaaaauuguggauauauauuauuguauauacaggcuauaacugguuuaugugugugagcaaacucuaguuuucaaaguaauuuuaaacuugcuuuuauuuaacuugcuuguuuguuuuuuagaaaggguagcauguagaaauuuaaagacuuugggcaugguagcauaccccuguaaucccagcgcuugggaggcugaggcaggagagucagaaauucuaagccagccugaguagaccuuguguaaggcaaaacagaaaacccuaauuuuggugauuugugacuguucuuguauuugcuuauaacugcuuuuugaacauuaucauagaaaagucauggaucgaaacuuuaugucuggcuugcccagaauccuaccguucagagcacccaguuaugcgguaccuggcagcaagcccuccuuuuuguguauuuguugagagaaaaugcugagacaagacaggcauugaaaguuggucuuucucaccuccuacagcguuugcuacagacuccuucccagggacaacuuggauccaacggaaagacuuuguugugagacacagcuguuaaaguacuuaguacugcuucccucaaaacuauuaugggauauguggcaugugguuuuugaaaccauaaauuuauaguucacuugagcgucuuaggaauuguaauaccuuaaugucagcaaauugcugcagaucaaauuauagaguccagaguuauucuuuuuuuuuucuuuuuaauuaugaggugugaugggacacaccuuuaauccuagcacucaagaggcagaggcaggaaaaucuuugugaacuggaggauaaccuaaucuauguagcaauuuccaggccagugaaggcuacacagcaagacccugucucaaaccaaaacaaacagaaaaaacuccaaagaaacaaaaaagcaaaucaaagagcaaaaugaauucucggugugguguggugugguguggugugguguggugugguucugccugccuggaacuuaucuuagaaaacaacaacaggaaaauaaagaaaugaagccaaagcauuaugguaaaauagauacaacacaggugcaugcuuuaaugcuuuccagguugguuuuuugauaucaugaaaugaauuguguuuucauaagcgccacaguccgucucuaggauuuucuccccagcuuaaagacaaagucucuguccuuuaaacaauagcuccucaccgcccugcccccagugcccuuagccuucuaucuacuuugaagcuguguggauuugcugagucuagcuaccucauauggcagagucaagcauuugucccuucgugucuggcgccccuaguuaucccuaaguuauaucuguacagcuuucaucauaggcaauugcuuuuuaaaucauaaaauaauuuggcaggucacuguggaauauuaaaguuuugagacagaaauuugaaacccaugccuucagggccagaagguaguaaguagcaucuaaaauuuauggagcaguuacugccuaucagacccagcuccaagcuuugcagguaauaacaucccuacccucaccccagccgggugaggacaauacagucaggaauauuccaguguuucauaagggacacugaaguuggagauaugaucaugucuuucagauagugaccuggcuugcaggugacaggugggggcuuuagcuccaaagccuguggugcugcaagcuccgcccuggucccagggguagagggagcuguguaggugccguacccuccaugcuguggagaggagaaacaggccuggugcugcugaaccuugcacauuugcaacagaagcuagaaacccuucccugcuucugaccuccuaauugcuaggcacagacagccuaauucagcuaaagacaaaacaaagcuugccgccagacagcauaucuggggcccacuagguugaggcuuuugcuccagaaguuucagauaaccuuuucuuauccagaaccuggggacaguuugcacccccagggagaguccuacugcuccucgcucccgcagcugcaccuuggauauagcaguuuccaguaaauguguugaaugaugauucuucacggcaaucaugguuucuucccaagugcugccaagaguucacugaaagucuaauuuaaaacaaaacaaagccgucgguuucgagaggcucauauccuuucauguagagcuucauaauuuauuguuucauuuugggcuuuuucgaagacagugcugauuaaaaacggacuuuaaagugcccccaccccccucgcgcuuuucucgaaaaagccugucucaccaaagaaacucaaauguaugcaguguguaacacaucuaaacugaacuguccuuauuuuacuaccagcugcuaguuuucauggcgugguuacugcaagccaaccacuaugcuaaggguuucacaugccuuucuuucauuguggacuccaccaguuaagagguuuugugaauuuauauugaauacuagaaugggaaggcuuuggggaugcguacuugaauuuauuaaccuugcacgugaaucuguucaggaccaacugaucuaaaagaccaguccaaggucauucagaugucgucuggccaucagaaccccuauugccuguauagccacauagacuuuguucaggugugauuacauguucucaugucaacagcuucagagcuucaggucaugucuagauauuuuaaagagcuauaucuugguccauccauguuacuauacaaaauaaagaagacugaguaauuuuuaagaguaaaauugaagaguuuauuguguaccauucugaggaucaguuaaucuauaacucuugugccaggcugcuuucugguuuuaagauggcagcuucuugcugcauuuucagauguugggaaauggaaaggcaagggggcacuaggguggugccccuucaccucuuuaauaagggcccuaugucagagccacaggcccaccuuuuaagguaguagccuccuuuauccuuguuuucaagagaagccuauucaugcgugacccccaggacugucugaggcuugagcaugccugaagcacaggagaauguugaacccugcguauaugcuaugcuuuccuccugcccaucgagaccuaaaguaacaguuacaugaacguguuaagcacaggagagauugacaguggcuagcaauaaagcagagcaaguaagcauaggcuagcagcguaaccucagcucugaguaugcagacaacuaccaaaagacuaacaggcagacagcauaugucuggaggauacacuggguagacuaauagguagacagcauauguuuugggcaugugcuggguaggggucauucacacucuggaagcacaguaaaugguuuuaucgugccacucaaugccgaugcaggccuuaugcacaccacucuaggcuaaaucuccagucccauuuuaaguggccaugguggcucauaucuguaacccuagcagucuggaaguuaagacaagaggacuagaaguucaaggucauccuuccuuaggaaaugaacuugaggcuagccugggcuauaagggacccugaugcacacacacacacucucucucucucauucucucucucucucucucucucucucucucucucucucuaauguaaaagccuaugaauuagaauuuuccauuuaauccuuuuggaucauaguugacaaaggauaaaugaaacuacugacuagaggggaugcuugugcucuccugggguguauauuguguguauacuguuuuugcaccaccaugugaguuuaagagagacacacauuaaaaccauguagacgugugacuugcuucucucucuuuuggcuaagauacgguguaguacucagguggccuuugacucugaacuguccccuaugagaaaugcuuuggauuuggcguuuacuguggguaagaauagagguccagccggguggugguggcgcacgccuucaauccuaggacuugggagauagaagcagguagaucucugaguucaaggccagccuagucuacagacugaguuccaggacaaccaaggugacacagagaaacccugucucaaccuaccugguccuacuccccccaaaaagagagauccaagcccacaucucauuaacauaggacucuaagguaauauuuaaaaugagacuauaaggauaauuucuaaccuaaaaacaagcaguucccauaguaacggaguagcaaucacuacauucaucggaaacuggauuuuggccuacauuuugguagaugugaguggguucaaagcucagcaauggugaggaagaaggcaaggcuugcaucuuuuccauucaagagauaaucacuuggcuuuuuaagaaguuaucuucccagagcugguuaugguagcaccugcuuuuaaucgcaucucuugggagcuagaggcaggagaaucugaaguauacggccaacaucagcuacacuuugaguuaagggcagccugggcuacggggcccugucucaaaaaaaacaaaaguagggggagcgaggauggggaggauagcuuagugaguaauaguagucucugccaaccgguaaccuaagcugaaucccccgggcccacgucgaggaaggagaggaguaaccucccccccccccccgcccccacuguccucuggcguccaugcacaguguaacccacacacacaugcacacgcacacacaguaaggaaauguaaaaaaaaaaauuauuuucuugaagacaagagcaaccuaccuuuuguagauacuuuuaaaaucauggaaagguaacuugauuugcaaacuuuauguagacauuuaaaacaagaucauuuuagaugaaaauuauugucacuauuacugugugugugugugcgcacacugcguguuuggaugugcaugcugugguaugcauacugaggacagaggacaaccaugguaagcguggauucuuuguuuuguuuuuuuguuuuuguuuuguuuuguuuuguuuuguuuuuuguaaccuggguuuuccaggcuugcauggcaagugccucuacccacugagccaucuccguggaccaagacaauuaauuuaaauuuagcagaauacaauugaauuuaaaguagaaggaauuuaaguagaaggaacuugagaagaauuucuuaucucagugucccuucacagauugcugggaaggucggaagaauuucuuaugccucucagcuuuuggcgggaucauagcccgauaagcccgugaugucauacagauauuguaauugugaucauugaguacagucgaccuaccaagguagcuuagccuggucugccuuugcugugcuguugcuuuucagcuagcaucuucauuauccugcucuaaccuccuaagagcugccuguacugggauuauauagcuccgguacgcuggcuccccaccgccuuuaacauccucagaauaccucaguaaccucuuggugaggagaaucaucuaacacaagcccguuuuguaaugaaaugucgagugucuccuguagacacgcaggugaguauuuuaguagauacagugggacgcaaaaauacaaaccacaguacccccaaacacuggcaacacugugugccucggagugcuugcuggccucaucagcaugugacaggggacugugggucucaacacugcccagccucgagagaacacaagcugugagccugggaaagaggccaaaucgaacuccaacuaugguuucuucucaauuuguaucgauuucacaccaucguguagugggacuguucccaaaucauauagucauaagucagcgacuguauauauagaaaaaaaauugaagcacccaggaccacuuugggaugauuugguacaaccugaaaggcccccuuauccauuggcaagacacuuaguguuugugauaacuccaggcuagcuaggccuuguuuguguuucaaauauuuaucaggugacaccacauccugggcaugugauaauaaaacaaacgaagcucccuuccuuguucacagucuaggaggacagauggcuuucugugcaaauagaagauagugucacgggagcugcagagugaggggacugggauuuggugagagcgcauggcaaaccgaagcaagccugcucucuguagcggaucgucuugguaguguaggcuugguaguacagcuuugguugucagagagugaacaggagcuguccaggaggaaugagaauauuccagguacaguacaaggaucugugaaguuuggugaaguggcuaggauugggguggcaaacuuaagccagagguuugaaaauccaggaguuaaccacaaauccguaaaucaugaggcauauaaccccgucuguguaaacagucacuggucagcuccaggcaucaacggcuuugcugagcuuauaugcaguuuuguaugcauguuuuggguaaucuauuuauuuauuuugcuugccuguuugucgugaacauugugaagcuugaucugcagucacuuucucugugacuauguuugguuuauagcugauugcauguucuacaguggucccguaacacuauaauggugguaaaaaguaguccuuuggcuuagugauucauccuagcugguaaguagcacagugcaccgcauaugcuuguggugauguugauguagaaauauaaaagcucauggggacucugcauaugugcagcauacuguuuuauaggaaacuuuaauauuaaaaaaagaaugugccaggcaugguggcgcaugccuuuaaucucagcacuugggaggcagaggcaggcggauuucugaguucgaggccagccuggucuacaaagugaguuccaggacagccagggcuacacagagaaacccugucucgaacccccccccccccccaaaaaaaaaagaauguucuacuuauaaagaaauuucuguaaugcaguaugcuguguccuggcuguagcaaccuucuauaccuugcauuuaacacaucucaugguugaauaauaugacuagguuucucuaaauacacccugcugauugcacagcuaugaaauugccuagcaaugcauuucucaggcugugaucuugcgauaagaguaccuaagaggugguccuuugaaaauuaccaguauauauuauauuauuauaagccuucgucuucaugcuguuuagguccugucuuaguuaggguguuauugcugugaagagacaucaugacuguagcagcucuuauaaaggacaacauuuaacuggggcuggcuuacaguuucagagcuucaguccauugucaucgugugggaagcaugagcgcccaggcagacauggugcuagagaaggagcugcgagcugugcaucuuagucugcaggcacccagaaagagacaggauguuuuacacuaggcauagcuccagcauuuauggccuuaaagacccgccuccauagugacacauuuccucugacaaggccaagccucccucagcauucaaacacgagugaaucuauuggggccagaccuauccaaaccaccacagauccccagacucacucauauuguauaacugcaacucuguaaccuuuggccuaugucuuuccuccuuauccaccccagcaauuuaaaacaaaucuuacacauuguugccaaucuuauacaucuuuuaccauuuacuuauaaaugguauucauuuccaauggcuaaagcuuccuauuccuaugcuaugggcaugguggaaugagaaugacucccuaguuaucauuugcuaccuagcccugguuuccauugcuguaaugaaauaccugggauaacccccuugaaggaaacaauggcuuauuuggcucaccauuuuguagguuccaggacaacgaguugcaaggcggcuugugaugaggcagcccacuauggcagaagcaagaauucuuaccucauggccaggaaggucuuccacaguucucgugggcaugcuaaagaguucccaguauggccucaccuuggaaagguuccaccaccucugucagcaccaucuuaaggacaaaugcuuuaacgcacaggccacugggacguuucagauucaaaguauaacaccucaucuaaaggauucauuuaguuuguaaaccagauuuucaggaauauagcuguggggguuugaauaugcuuggcuguuggaggaguggucuuauuggcggaagugugucacuguggaggugggcuuuaagaccuuccuccuagcugcuugcaagauagccuucuguuugccucugagauguagagauguagcaagaacucucagcuccuccaguaccaugcuuccugccugccaugaugauaauggacugaaccucagaaccuggaagccagccccaguuaaaugcugucuuuuauaagcauugccuuggucaugguuucucuucacagcaauggaaacccuaccugagaaaauggcuuuuauuuuaguagcacguuuguccgugacuguagucccuuuacaaguauuuuauaguuugccugguguuccagccuuggccuccccagaugacggacuguaagcgguaagccacguaaguggguucuuuccuaagcugguuuuguucaguguuucaucacagcacagaaauaagggcagugggggccggaaccuaugcuugggucgcagucgcccuuccugaugcucuaccuguccucuguguccuuuaucuacacucuaccuucagcugugugugaaucucugcugcuuugccuguaguuaggugcuguugaaggcguggagaagcugggcaugaagcucccucguuaaggauccugauuccguuauguuuuggauagcuagaucugaauucccaagccuauuucuuuucuuucuucuuucuuacuuauggcaaaacaauuaaacaaacaggcaaacaacacaacaaaaccguaaaaacaaaaacucacuguaaagcuaaaacaaacaaacaaacaaauguaacaggagcucuuuucucuugagcuuaaguggagcuguacuguuacacauaacacuagcacuuggcucuccuguaacugguguuuugcauuuagcagugcguacucaggguuuggucaugaugcauccuguaugaagaguuuucuccaugucccuccuccacacacucuuagauauaucggggucuuauucagcccaaacuggccuugugcucucaccucccagguacuggcguuagaggucauaucacaccuacugugugugugacuggagauggagccuagggccuccuacacacgugcaggccagcauucugccaacugaacuacgaucccuagcccagaauuuccuuccuuuuuaaggaugaauaguacuucauuguauagacacacgaauguauucuuugucauuauggguucuuaguuugcuucucuaccaugcuuauugugaaugcugcaugcagacacugcuuugccguccugauuucaguucucucuccaucccacuuuccuccccccuccugucccucugucacccuguuagguuugaaguagcuucauugugccuuacucauggcucgugguggugguaguggguucucuucugcccagagaacagccucuuagucucuguaaagcuuguauguauucacccuguuuaucacagguuggccguuugucuugcugaaccgggggccuuauuuuuggccaauaacuuagagaauuauuugggagagaacuugacaguaaaggaagcccuuccccgugucacgaggaaguguugguguacuuucacauuuuaaaugacuguauacuuuucaugccaggacugaaaaaaaauggaaagguuggguuuucuggauuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggguuuucuggauuuuuaaugagaucaaaagcagaguuauaaaacagagugaggaaagguauuucuacaggucaaaagcaguacauauauauacuauauauauauguguguguguguauauauaaauauauaauauguauuauauauauaauauauauuauauauuuagcuuugaacauggcaacuuuguugucuaggaaagaauaguccauuuagccuuuuucuuuuuuuuccuuuuuuggggugggguggggugggaugggguaguauggguggagcaaaggucacacucuguaacucaagcuuagccucaaaguuauggcaggccucagcaaccccccucuccaugcuguaguuauaguguuagccacuguacggguuguauauaagucugauacuguaauuuaaggaacaguuuugccuuuuuguuucucucuuguuugguuuugguuuugauacagguugucaaucccuagccuagacuggccugaaacuuuuaggaauucugcugccucagccaccuguggccaguaacuauuagcuuuggaacuguccacgggacuccuuuggccuucuuugcccacacagccguuguuaugucucugacuucagcuuuuuaccuuagagcuagcgggcugcuguggguacaguggcuucagcucaccccaggucagcgugagcacucagcuaggauuuuauuuuuccgcuccuccuccuucuuuuuuccuucucuuccuccucuucuucccuuuccuccuccucuuuguccuccucuuccuccucccucugauuggauagauagauccagaucuugugacuuacuuguaccauagccagaggccccuucggugcuuugcgaugagucauuuccuaaucagugccaagccuugggccuggagcucccugcccagggguggggacagcaggccugucugcagcugggaggaaguccuuguuccaaaagagcagggcaagggucuucgggaggaauaggaugaauggccugaacgguccugaggguucuacccauggggguggguagggcacacccuguguccccuaaccugcuguggccauguggauucagagugacugccagugucuuagacaaaacccaagagcaagguagcaucucagcccuaggggauuuaacagguuaucuggggagagucccggguuccuuaucagaacggagguagagggugggcuaggccugugcgcugcaggagaggaagcggacacagggucaggguugcuaacuagagugacugggccaggggcuauuuaaaucucuagugcagaaguucccacuggauugagccaggaagggacgggguggggccaaggguuaagaggcuuggcugugggaagagagggcuguggacacugaaaacagccgaccaggccuggaaauccuggcugccuggaccucagcugagagguucuuagugccuugggcagucguuugggccugcauugguuguaaaugacugggguuugagugaaagaaucguauuuaauaaguuugaaacaauaccgaggaugguguuuuuuggauauagacgcacauguggauuuuauuucccauuuugagauugggucuuaguagcccaggcuagacuacgccagagcucaugacccuccugccucagauuucuaagacccaggacuauagugugcauuguaacuccuugcuaguuaauagcuuuaauuguuuagugcacccacucccacauccucaaacuaaguaugcagccuuaucuuacacaacuaccagguuaagcuuauuacaguaauuucuucauuaaaccuaaaacaacucagugguuuugaaugcuguugccuaucaaguaggucuguucuaauauuuuugagcaagggaaccccccccccccccagugccuuuaugcaccgugcugaauuuauugcuugguucucuguuucauacagguuccaucccaagguaguuacugcuuaccucacugauugcagagcccuacuaugucaacucauuuuauuaaccucaaagcaggagaaaugauaaccuuuacagaguauggaagacugucuuaaaacacacccauuuaaaugcugccuuccccaggaguucuggaugauugaguugacugagcccacaggcuuuagcuguaauucagagaggaagggcguggcuuccaccccacacuggagcccuguacucugagaagcccguaaucuggugaaggggcuuuuaccaucaaaaagguaggugagggcaugacggcuguggugggagccaggggaaguuccacauccaaauggcagugccgaguggugcgcccugacuuccgagaagggcugccgggguccuggggguuaccaggagacagaacauugagguuggcugcagaccccauuguguguuagagaauacuugggucuuagagacaguucggccucgucaucuucgugcugcccagggucaucuuucugagccgguccucgugugucuugucuuguauuguuuugaugucccugggugcuuuggggaauugaaaggcuaaacuguguauuuucuucugucagacuuuacuucucagggcugucauugugccuugaucugacagucccuccacccucuuaauuaccaguggcaugggaaaccagauccucccuccugugagaguuguaucccaaaggaggugaauuggcuggaaggcuggaugugggaggagguggagguugggaccucucugcuggacuccggugagcuuagucccugguugugacaacuccaaacguguuacuagguuccuagcugucuucuggaugaguuuacagcuuguggccugucaggcugcccuagucuugucucaccaacaguguuuucucacccgugcccaauucaauuuuaucaugaaaaggaaaaaaaagaacauuuuaucggauggugaggacguggauagagggcagcccaggccugagggagaggccuuuucugauaguccaguguucuggaaauccaugggacuuucugagccauggcauggacuuuaccauuauguuuuuagcagguagaauuagcagaccugaaaccugcaguuagaaauagccuugcauccugggcgccuguugugugaugcauagagaggcugagauccaaggggcauuugaccuuaaaggggcagcagcacuggagacccagggaggaugucagaagauccaggaggagaagaggcaacaggccaugaaaccguccccgggaagucgucuguguuagggggaggcugaaccgcucauccggagaacucacuucaggggaauggaaggauuugugagggagacgcagacuccuggguuccagcuccgaggauuggcuguggggccugagaauggccacaucacucuggauacaagugaggaacacuaacagaagaugaugacucaggcaaaggucucccaccccaggagaaggaaauuaggaaagagauaaccaaguagaacagggucagggggaagguagagagcuaaaggaacccuuuagagugacagcaguuagcagugcccgguggccaucccuucccacauggcagccauaggcauaaucgcucuuccccucaccccccaagggcuuaggguggguguguuccuuacagaugcuuugaguugcugcuucucaccuuuaucuccugccugccagagcaaccagguuuagggacaguuuauucaggacuuaagcaauggccccuucugucucuagucuugucucccuggggccacagcuugcacuauucuagugaucaccugaugaaguuaccauucgcucugccuuucucacuucuuccucaggccuguuugcuuuuccucuucucaucuccucugagauguaaguuuccccaacccgcccucaaaaggacaaaguaaacacccaggcaaugggucaaggguagugguucucgauccuggcugccuaggagaaucaguaggucaggcugacgaaaugcuaauguuuaacccuguagcucuucauucuucugaacaucagaauuaugaaaacgcuccaggaaauucgaauggguguuggggauggaaagccaucuccuuguggggcuagcaaggugccugucucagagaaaagaaaguuuugcaagauuugaaauggaaacuaaugcccuuuguagcugggcuuggugacacaggccuguuuuccuggguacacaguaggcagaggcaggaggaucugugcccaagaguuugagagcaguaugggcaaugcaaugcaauaccuccccaaaaaagaguccuuugccaauccagcuucaaaagccagaggaauucccucaaaggucuccuccucccucccucccugcuagccaagccugguuucuauuaagcucaauuauucaagcccucaggguacaacauaaacccaggcuuguuugguuuguuuuaggucugggguacuguuccccuugguugcacuugagugugacuugaaccuccucaugaacuguggccucuguccuguuguugaaccucuggcuucuagucaguguuauucagagcuguagaccccccacguagcccuuggacugucccagggcccagugaugacaugauuugguucaugaacauguacaguacagaccuuguuuuauggucugagguggccgggcuuaggauacuucuugggaagaaaaaguaggauuuuggaucacuacuucuguuggauaaacaacuuugaaguguauucaguuuugaaagauaguggggagcaaagauaagcccuaguaauucuauucaacagcaguaaggcguaugugaaccuacgaccucacacaugcuaagcaggcacuaccauuaagcucuagccccaacccauuucccaguuuuuacuuagagaauaaguaaauauguuuguuguugugugguggaccguguguguguguguguguguguguguguguguguguguguguguguuccaggcaggccuuggaccugugaugcccuuugauacccuccagcugaguggcaucuucaggccuccuucuguuuucuaagaaguuaguuggaaagcugggugugguggguuguggguguaauucaaaccuuugagggacaaaggcgggagggucgcuacuagagguacaauggucuacacagugcauuucaggccggcuaggcauagagaugccggccugaaaaaccaaagcaaaaacaagcaaaaauggaagucaguuggaaauuaggucuggaaauuaaauguuagggaaguguggguagggcccucagguucccuagacuugaguuucaggguuccuaaaaauccuaucaggacugauccauuuuaucguacuauauauuguagagaaauauuauaugacacuugauuauauuggguauaaauacuguucuauguacugaaaagauuuuugaauggugaggauuugaaacagauuagcgaaaagcucuauguuuuuuuggcgaaucuaagguuuguuuuggggguagaagucucaaggcccagcuuuuguuggaguacauuaggcaguccgcuaucguuauaacuuccccaguaccacgcagagcuccucuggucuccucggccucuccuccuccuuaccauaauuauagcagagagccuuaagacccauguaggaccagacauagaaccugcucucugugaucgcaucgccacgaaaacaagcuguagggacugucagccgcuaaggaagcuccuuccccucuggccucugucauuucuacggcugccuuuguuguccucucaaauucagaagggauguuuucccuggccuugccggaaacagugguacaggccggcugcucuugguggggcagaggccagagaacaagugugcuguguacauaaccugcugcaggucucauugggagggugcaccagucugacggccucaggcccacgaucugucugguguggaacccagugggcauccuuugauguuugucugccaguaguggagggcacacacggggagugcgugugccuucucaauggaggugugcuaugcagagggauggauggaagggccugcagcugcugggagaugcucccuccgggcugauccccuuaaaagagcaggggaugcgggaggaacucacaccaggacaccuggccauacaaaccgccgcuguucaccagguggugcuguccugcaguggauaaggccuggugugggagcagcuggggugcccacaagcucugacguuugccuaacaugagcaugacgaguggaggccuuuuugaggcaacuuuaaagauuugguaugggagugaucaccugguccuggguguguguguguguguguguguguguguguguguguguguguguguauuccccuuguguuugcacuagcgaggucgcaguugguucugaaguggguggaggagacuggaccuuccucccagagaaccgcuccugugcuggguucucaucuuugaaguccuggugggcaugggggcggggccugguuuccagcuccucauuaaaccaauuuaaaggaagaggaaagucucuacaugcacagaccuauuaguacucgguggccugccaaggugauuugguuuggcccaguugugacuaccuacacacgaccuguccuuccuggccgggaagccuagcaggauggcccugagaguguugacuugggccugguugucauuguuugugaguguggaaaguacccugagggauuucacuuuuccuggacagguacaacaacaaggaaauaggccgagucaguccuggaagcccucuagaauccagugaggaagugccuuuagcugugucugacuagccuuuuuaaaaggaauaguccggugguggcaggucacacuagcccucuguaaccagugauccgggcaggauggcaccaguguuaaucagggcagggggugguggugguggugugguguugucuuugguucagaggaagcauuguggggguggggcaggcaugcaggaugacuaauaaccccgaguaggagaaaggcuguugagagugaggaaaagcaagaaagagcgcuaaggcccugagccaugagcucaggaauggucaggcuugaggaaagcuggaguuuaugaccgagauaagacaugugcggaggagaagucagaaggacucagauucacaagguugccuuaaauccugaaaccacuucacagcagacugggcuguaaaccucaugugguggaggugagccugcgguuuccagccuugcugguugguacuugcugcagggccuugaggcuaggccagaguggagcugggaaggaaguucugagccgcacugcucuuuccagugcaagcacccuugucuuuuccucucugucucuacugcucugggguucucagcaaucccagggcugcuuccagggcgugcgcguugcucgucucacaggguaagugugcugacguaggcuugcuggugccuuacaauuaaagcauucacacuuacaguguagaaacuuuaguacuuuauuuuaacauuuucuaauuuaauugauuuaugcuuauuucagaggguuuuuuuuuauuaguauauauaucuaguauaguacuuuucuucugaaaauauguaauauauguugauuaauguauuggcuuccauuuuguacacacagaauauaauugauuaaaaugucucagauuauuuguuuauaggcuaggcuucucauaucccagggugaccgaguauuccugauuguucugggaugcugagauucuaagcauguaucgcuguaccccgugugugguguuggagagcaaacuuaggacuuugcacaugcuaggcaagcacucuacugaguuacauccccaggcccuaguuauauauuuuuaagaaagugucuccuuuugucauugccuuagaauccugggcuccagugaccccuuuagccucagcuuccagagugacaggaacuacaggcacacacuacugugucuggcuucagauuuuuaauaaacguagaucgacugucucuuuuucuacugucauucuccugccccuggguccccaagaaaacugucagguuuaauuuccagcugcucccaggugacaaauaaagggauguuuacagcaaacacuccucauaggcuggcuuuuugggucaugucaguuggagcggcaaggccccugcccauucuucagacuaccguguucgcuucuuguguaucugcuuacuccgccggggucucauggagaguuuucuaggugguuuuaggaacuugggggauuuauacccgugguuuuccuguacuguagucuuauuguaaauugggaaacagaugccuauuucauggcuggggauguggcucaguguguagacuccuugucuagcauauacaaagcuuuggguuuguucugaaaucugggggaaaaaaagauaugauagcaaaugccuuuaaucccagugcucaggaggcauaggcugucggaucacggaguuaaaggccaggacagccagggcuacacaguaagccuguaucuuaaaaaauaaguugauguggccugagcuacaugagaaaaaggaagggcugguccuuggcuugaugguggcagacuugguggcgguuguggcugagagcgcguagaggccuucuauaggaguuagguugcaccucuauaggcgaaguccuucuccauggcuccccaugguggaucuccaugaaaagucauagucugugguugcaaacaguuuauugucauaguggaaaguggauucguaaaaccauaccccacuucucagggugggccugagauuaaaagacuuuugcagggaggaacucuaggaagggaagcuuguuggcuaagacuuccaggccucuaccuagagguagagcauggagaacucuguuuuugagccuacuugacugugcuuaagucucuuuuccuauuguuuuggucugagauguuaggaauccuucaucuacauguggaggagcauuguccuuacuugacugauggccacaaaucuaugggggcuauggcugcguugaccgggguggggggguggggaggugggggagugggguggggguggggggugcuggugcugggagcaggcgaagcuccuaacgaauccucagguucuuuggggcuucaagccuucggcucgaccuuaccaggcuuccucucacgguccaccaccccacacagaccaggaguuauuuuucuuccguuauguggauucugggauugaaccuaggucuuaaguuuggcucccuuucaccagcuauucuugccuuucuacuuguguuccuuaucuccauuacaaagcaugcagaaggcuuggagcaacccuucuuuucucucaaggagcaaauggugacuggggaugggucccucggcugauguugguugaguacgccuuggagcauugccaguuaggcucagaugcccucacagacacggacggcuauccacagaguguucaccggaggugguggguuagggacgucaaagacuggccuagauuucucucucuggguauuggugauacuuguccagaggggcugaggaucaagguuccagaagcuguucaugugucccugugaugugcacucugccaccuucuccguggagcuugcaguggggauucauuuucugcacucaccuuuccaucacacccugcuuauccaucacgaacaguggcugcacugcugccccgauuuggagagucuugccaaaagguagaucuucccagcaggagugugguaggaacugcaugcuauuagucuucagugaagguuaaacaugagaagucugggaugcagcccagcugugcugcugaguuaggauuugggcuagggugagacccugcuaacauuuuuguucuuuaaagccugacaaaaggugauguaugcuugcccucgaugagacucacaugucagguuaggagccagaacaucucagcaccugcuuagauucaggggcaucuucagagagcaugagcuguuguuaugguaacacaucucggaauuuucaaguagcccaacccucccuuugcgacauuaacauuugagacgcuuaacuuuuugaaaaauacucaugaguguucacuugaagacaggaaaaugccuucucacucuaaguguguuugaggguauuauuuugaaccucacuaacuaguuuaaccacuuuacacugccaagccaacauucccuucugccacacaugguacauaugccugaauugcgucacgaucuuaaccuaaaaccgcauggcaacaacguguucugcaacuuuagcugcacacagagugaggaaaaacaacacugaagaguaauuugcuaaauucagcaaaaguucggcuuguuucagaauccggguggggaucugcugguguugccuuccagagauuugcauguugaaauggagucucacgcuggacacuuuccccagggucauacugaaauagugauugaggcauacugggcugggaguguauguagagaguuaucaauuuuuccugcucagguuuggugugccgcgugcagaauuagcugaguguuuuccucugggaugagcucguguaugugcgugagcgugugcgugugcgugugcgugugugugugugugugggcgugugggcgugcacgcgcauugugcauacauggguauacucacaccuguggagaucagagcacagcuugugagaguugguucucuccuuccacgugggucacggggaugaaagccuaguugucagggcuggugggagguaccuuuuccuguccacagcuccguggcccuauuuuaugucuuuuaacgaugucccucuuuugcaaauccccuuuaucugaaagaagacuuugcaacccacuaauguuugaggcuuuauuaauuuuuuuuggguuuuggggacuggugagcuugaguuuugaaguuagaggauaucauggcuuaggccggaccuugcagcuagccugucgucugguucuuguugccucaacagaagcuaaucuuguugaggucacacauggccccugaugggagaccucuggucacuuuguagcccuugacaggacuucuccguugugaccacgaccaucucuuguuggagguguguuccucugcacguucauggcuguccuuccuccucugucggcccaucugugcucaugaucccugggucagguucaucuuugcuggguucccuuuuuacugcucagcccuuuuggggaaugcuaacccuuccggacuugcagcaaccuacaagaccccuccccccaaccaugucucuccgagaucauccucauaucagccucuuggacccuucuccaaggcaugacucauagggacuuuuaccucaggacaucugaccugagcucauuuccucccuaauuaucucuugcuuccugucccacucccgaucuuuaaucccagugcuucugucagcuuuuccauuuuggugguugguucuacagugacuuugucucuaaagccagaaaucugugacuccuccuccuccuccuccuccuccuccuccuccuuagcaagccucuugguuuggcuaguaauuaggcccugucacuuuaaaucuaauauuuuaauaauauaaauuaaacaagaaaaugguuuuauugaugcauuuugggaagcucuuuugggaggucagagccuugaucugucuguccucacggucauucuguaacuccagcaggccccagacucacagcaagcuuccugcuuuagccucccauguacugagauaacaagugugcuaccacacccaucugaaaaggaguuuaaagucauucgacaacacuuaacugcucuaggcuuugggacaugucggcagaucugaagaaaguauuauagagccaggugagaacauuucuugucauauuuccuaccggacauaugcaacaguuaaccuaguuaacuugucaaauaguacucuuuuaucucaugacauuuugggauuacauauuauacgagggauuuagguucagagaggauaggcacaggguuacaggccccuuacaguguauuggaguugggauucaaaucuauuggccaccuuuaucaaacuccaaggcauccuuuggcguccacccacacuggcuagcuuuguucccauaacaccaguguuuuagacuucugucagguaaaaugaguuugaguuagcagcuaggucauucucauguuuucauaugccaagauauaucuucuuucuuccaaaguugguauggcuuggaugugguuugcccucuccccaacugguacugaaacuuggccccccauguaacagcauggacaggcaauaggaaguuuaaucauuuaauaacuacauuguaaaaagcaguucagcaaaguucuuagaaacaggcucuguuccacaaggauguguuauaagucggacucuuguuagcuuguucuucugcuccgucuccuuggaugaugcuauacaacuggggucuucuggcuucuugaacucugaacucaauacgcuuguuccaguuguaaguuacugucuggguauucuguuagagcagcucagaaccgauaaaggugugacuuugggaaaaacuguggucugcguugcuuauggccuccuggauuccaacccugggcuucucagagcugugcaguaacgagcagcgugggaaaaggauggugggaccaggcuuuccucccuuccaggguucucugagaauuaaauggcuugagagacaggggcaguuugugggaggugguaguuggucagcucuucucuauaaauggcagugugugaagauaggaacccucccagauuuuuuuuuuuuuuuuggcauucauaaugauuccaucagucauguguaggcaggaaagacuuacacgaaagaccuuaauaaauuacgauaguauccacagagcugguuucuguuaguagugcuuaggaaacuguucuuagaacagaauaagguaugaacuacagacucagguuaggcagguaugggcaggcacauucaagccaaacccacucaaguuuucuuccguuugggaugcaccaaagugaauccuauucuguuugcuauuagcuuucucccgaccccauuauucugaggacauaucuuuuuuuuauccucucacucucacccccaaccccauacauuuugguaaaaacaguugaccaagaagagggccccagcuuguuacugugagauuucgaaauuagcuuuuuaaagucugcgccuuucagaaauuguccuauaaaucuggccgcaaugcuguauauucggcugguguuuugacagagcgugugccugauguucucuguagacccuuggugaaagacaacuugguuauuagaaaguuaggauuccagauuuaauaagggcugcacugcucugcgaugaaaugauccgggaauuucagugacagugaugggagggaggcgugucuacaucagugguccucagaggaccgggaagagcucagcauccuggucagcuugggaucauuagaguuggaaacucagcugcaccccagacggcggaaacagacgguccagggcuggaucccagcgucuggccuggcuuuaccuccaggugauucugacgcacucauuagcuuaaagcuagaagacucagcccagaggcuuugaggggccagggguggggaacuuuagagggaggugggaugagccaggaggaacuagagcugaggagcacuuguccugacuguuuaggagacaggcgaggaggccuugaagacauggggaacuuggagucugauggauaaaaacaacgggaacucugaacgggaaucggaauuccagggagugaaucuggagguguugggugagaggugggcaugaugcuggguugacauucccaggguuggugccagucgguuggccguggagugugguuguagugcuggcagaacaauggagaaguagaucugugagcugucuauacagaggcagcgguggcuucacucaggggacacaggagaacugcaagagcuuaagcuguuggggcugucugggguuguggcguuucguugacuuaugcagguaaugagugcagagguccugugauguagguuuacacugaccccgguuauaggagcagcucugcggucuugcacugaugcuaucuucaaccucccugcauauuacuagggccucgaugugcauguaugccuuuuaucuuuugcucuaaggccaugugcgaggcagaggucggucucagaggugaccuauccccaggacagaagagaugaggggguagagcaaagaugugaccugguguagguucugucuccgcuucccugcuugucuggagaggcucugucccuccagcuuuggcuuauggugcgaacugaagaugcuguguguguggguguuucuauggcggccguuuccaaagccguggcugggccuguggcaucaaguccuaucggcuuuacuacgguaccugugaagagacagucacagcagggucuguuaggacucuaaacgggagaugaaugcgguucgaugcuuuccgaagaaugaucagaaccuagaaauaugagcucgugagguuuaggagcaggccaaaaggauuugguuucacuccaccaagauuuggcuacuuaacagauuauucucuaucccagcuuuggggcagacauauuuugcuguaccagggggauguuccauugagacugaaaaccaaguacaucuguguagcaucuucauuuuaaguagaagaaccucggauugguggucccuaauucagagucgcucagaaacaugugcccuguuuuuuccacuggacgcuaacgggggcucuuuccuuaaaggaaggcauguggaccacacacugauacuuaggaagcuucuuuguuccacaugacaaauguguagagaacgcacuaauuguggaaauugguuucuggauauuccagucuccauacccauccaaugugaugugaugucugucugucucugucucuuucucucucucuguauaugugcaaguguguauucacacagugcucaguacaaggcacaccucauauguucagagacguggugacagagucaguggucagucucagugcaggcuuacuaagggcuucaguugaaucuuuaacugaguuuugaggaaaaacaacaaaacaaaacaaaacccccaaaacaaaaaaacaaaccaaaaaaaaaaaaaaaaaacaacccaaacaaaacaaaccaaaacauauauauguggacuggggaagggcacauagcuuuagauuuaaaacuugaacuacaucgguuuguuuuucuuacuuguauguuuuugagguacagucucauguaguccaggcugggcucaaacucccuauguagccaaguauaaccgcaaauuucugauuuauugucacuggugucccuagugcugggaucaggcuugugccauccacuguguuuguccagugcugggucucuguggguguucugcaagcacuuuaucaacugagcuacacuccuaggccccagauacauaagcuugauuaagauuuuuauaggacuccuaaaaauaauguuugcugucuccacacacagagaaauuuucucuuugauucagauuuaguuggggugguuuguacuguugaaugggguccgagugcccaguuauuucggagccaccacccaguguuuuaagcauaguccagggcuugcaucuuuucuggaaagcgcggcugguugcugcugcagcugacacugggacccagacuuagguaauauuauuaaucuucgaaaagcaccgugcgccagcagcagcuguugcuguaguucaagucucucgaacaaaagccgucucaguuaccagagagcaugagaacuuggcgcugcccagugugaguccgugaauuuuagacuuugagucauaguuaucuuucuucggggaucuccugauuuagggugugaagcuggggagcggcccaacuguaugcuccgcaguggugggcaggagaggcaggccuuggguaacccuuccugggaagcccaaugcaguuagcugaaagauggugguuaccagacuaaaugcgcuguuagaaaacagugagacucucagugugggggugcacucccugugcucagaaggcugaggcagguguauugcugcaaauucaaggucagucuggucuacucagaguucaagcucuguagagagauaccugccccucccucccacuccccuccugcaaacaguaagcacauagaaaacaguaaagccaacagugcgcuugaagaacauuuggcccacacaugaacuuguguuuacagguuugcguguugucuugcuacgcaaauagcagguucccuccugcaguccaggcugggugagugugguccgaucagugauuugccacggauggaccuuuugauaucaagaacuuuuguacuacuggaaaacuaguguucugaugcuagccuagcagaggugacgaugagaagcggccaaucaugugagcgugugcccuggcagauuacucuguaauuacuaaguuaucuuuugcuuaauuguaaguaccugagcugcuagcaaagcucuuuugggucuguaagcuuuggagccauuggauaaacuguaucuaaguggcuggagcaauggacguuauuucucuaucccucaucuuugcuucagucaugaaagccagcaacaauuucuaagguuuuaaugcggacuuuguacaauguugccagaugcagaguauuauuuuuaaucaucauugccuuaaaaacugccagauuuauaaggcuuccuacucaaauuauuuaaguguuaaggacauauuagugcuccuguugcuuuuuaaauaauuuuggaaauuauguuucaauauaauuaauuuucuuugcaaucauauuuucuacguaaacauucaagaucauuauuccaguagagagucuggagugcugaaauggccuaugauaccccaaaguuagaaauucccauuguggcugacacauaccuuucucauugaacuuagagacuggauuuguuaaauaauuugcuaauggauuucuuggcauuaaauaaaaccaagacaccuuauuauguuugaccuuugugucuugacaugacuuggcuuucuuuggcuuucaguuuucuggagcuuggguaccccccauuugggagcuguuggggucaguuaggaaauacagucaucuagcaucuaugucugugugaccucuguggcucuggugguagucccccuuaaaacugcucuuuuauguucuuauuuuuauuaucauuuuguguuuguuuguuuuucaagacagaauuucucuguguaucucuggcuguccugcaacuaauucuguagacuaggcuggccuuaaacucacagaaauccuccugacucccaacuucugaguucuguggauuaaaggugugcaucaccgccuccugguaaaaacugcuuuccaaaaauuaccuguauggguguuuuaccugcauaugugucuguguaccaugagucuuuggaggccagaagaggguguuggaucaccuaggacuggggucagagacagucaugguuguugggaauugaaccuggauccucuuaagccauugcucuuaaaacacugagccaucugcccagccccagacugcuuucuaugaccaaauguuuauggacguucuaaaagacugcccuauccuucaagcuaccaucacccuuaugagcgagaacagcugggccuauacuuaaaacagagucacaugggccagcuguuggcauuuccuccuagauucuaagaaagacugggagaggagggucauuggaaagucaccugagugaguagucagccaccccucccagccauuuguaugauauucugucuguccguggccucuuuuuguggccuggaagaggggcuaggauauauggguuagggacaacucagagaaggggguuccauuggaguggcccagaggaagccagcauccacgcagggugaagacuaucucugugugucuccuuacuggucaccuguacucauuggccaccccaguauucucauugguucccccagggugaaccugggauggauuuguacuuugguuugugguuggaaccuuagaaagaagccggagaugugaacaacauccagaggacaaauuuuagcaccaguggccaagaauagaauagaaaugacuccauacaugcaacacacuaagaacagagccuaacacauguguuaaguguugcuggcugcauauuagaaacacuuugggagagaucaggaaaaaaacccaaacuaucagguugagugugguggcacauaccuugaaugaguucaaguccauccugauucacauagcaaacucuaggauagccaggauugcauagagagacccugucucaaauaaaauccaaaagaagaaagaaacaaaacccccaaaacacgacuuaggcauucagaacucuaguccccaggacuggagagauggcucaaugguuaagaugacuagcuacucuuccagaaguccauuuucaccuagucaccaacaugguaguucacaaagcauuucuaacuccaguucggggagguacaacacccucuucuggucuccacaggcacuaggcacacacaugcaggcaaaacacugaugaacaacaaaaaaaaaacaaaacaaaacaaaacaaaaaaaaaccacugaugaacacaaaauaaacugaugaaaaaacaaaccaaacgagaacccccccccaauaaaauuagggcauguggggguuuuaagcucguuaguagucauugccaguuucuaaugaaggggaagagggauuuuugaggucuuuuauucuggggcauuaagugaaagauuccucugucagcuacauaagcaagagauuuuuccguaaugaauagcugccuuucaugggacaucuuugaaguugucugacccuuuucacuuugaggccagaugcagugcaauuuaaaaaauuuaauuucuuuagauuucuaauaccagccuucauccagcuggcguugauugauugagugccuuuuaacacuuuuugaagaaugucuucaaggucucuucccuuuucauacuaaaagcuuaucacccacaccacggccucccucugagauguuccucuuuuuaccacgaugguuugucaacuacugugauuuacagcgggaauguggacaagaaauaacuucuucucaaacauuguugcacccacuggugaaagugaccugaacuuagccagucaggguugucaggaagcaacguuacccccagcugggcgaaaggggccauggcucucucauuugucuaugggccucuucugcuguauucaagggaguugauugccacaggucagcacgggggcagcuggugcauugguuggagaucggagcucuuccguaccacuggagaugccgacggcagggaaagaggaacagcggguucagagaugacuuaaggggagacaagcugaagaagguugggaguuggaucuccggagacuucugugguccgggccccauccuuugcagagcucugugggaggugcugaggccucauucaagacucuaugguuccucuuuaagccccaggacuucuuugcagcuuuuggucuuugacacauugacauuggcacuccccaagaccacuguggcuggaucuccaacugcuacagcuccaucuuccuuucaaggcaucuuuucuucggcgugugcuaccugugcucucucgaaugaagucccuaucucucacuuucucauugggugaagauuuuugaagacaguucuggggucaaguuccagcucuaccuucaccaguccuguggguuuuaagcaucauuuggaauaguuacagauccaaacauuuuaggaucccuuuaaaacagcccgguucccuuuaacuuuccuaucugcuuguucuuacgguauuuguuuucugaccugugugauaugauuguuuuccuccucuguggcugacuucgucuuaguucuccauucucucccugugcagcuuugauugcaugcgggugcugcuguggagguguucccacuugaugcuuagccccuaugcuaugcuggggcuauugcuggggcugagcauccaaagcgggagugugguccccagccuggucuucugccuaugcugggugaccagagcucuucagugguccuuuggucucugcuugucuuccccucccccacagggccauucucgucccuuucuuacuuuauuuccuuauggauaaauagaguguuaagcuuccacacgugguugucagcauugcuguuuuuuuucuuccauucaaggggacuugacuuugucccugaagguugaugcagggcagauacuuagggauauguguuacuuaggguuauguuuaacuuauccuucaauaaaugagaaaguugggagauaggaacuuauagaagcccuuagggauaugaaaacgucacaauugcacuauaagagaaaaagagauaguucucugucauaaauaagguucuucagauuuacagucccccgaauucaguaagaucuauccauuuuuaugcuuaagucugaagaugaacugcagagcucuggauuggacaguaggggcugaucuacuggaaacagacugaggaggagcacccaggaggagcauccagaaggagcacccaaguggccuuuauguucacuuucuucuugggcucucuguguagcaguccuuucuuccagcuccagaugggcgagacccccuggaacauauauuuaauagauguugagacaguuagaccauacaaugggaauauggacaccaggcuuuaccgcuugccucaggccuuggcugcuuacuucagaguacucaucaugcccgacccaggcuacucagccccagcaucagcucaguguucugucuccugcugggaaaaucugguuggaaccccauuucugcaacuugcugaccucagagacccagggccaguucuuccauggcucaggauuuuugcauuuuaaaugagcauauucaauuuacuaacuucauuaaaaaaugauagucuuuaauuuuuuuaauuuuauuauuuauguguauauguguaugagcauguggcuaccuacugaaaccaaaagaggguguuggguccccuggaccuggaguuaagggcaguugugagaugccugauguguguguuagggacuaaaccuagguccucugcaagaguagguagugcucuuaaccacugagcuaucuuuccagccccacaagugauacucucucuuucaaaucaaacaaacaaaaacccaagaguuacagcaugcuccuucagaaguguuuguugaugaagugagaaaacuugugugcugcuugguugggaguaaggucugauaauguagguugucuuagccugcuggggaaggcagaccugugaauaaagugaaggacaguaucuaagagaaggagacucuaggauggaguuuguguuggcuuguuuucuguaauagaccuugauaucucuguggcaggucaagugauaaggcugcuguuggagguaggagcauccugcugccugggugaaggugagguuuguagagggaugacaucuugggagcaagcaggguuuucugcaggacaggaguuccaccuuugcacuggccucucaggaaugcaacccuuggcugucucuagggcugaacguguccugguucgaggaagaaugccuugauuucagacuuuggcuuuucugucguugcccuguucuguuuugugugcauauuugaaauaccaaaacaaagccuucuugcagccagugcuuuuaagggcugauggagaacagaucuguuuuucauguaugaacccgagaacucuggccauaaauuuggcaauuaguaccuggucccagaagaauuuuuaaauaaugagucaaaacuggggagagacuugccaaucauuguacuaucuguucucuaauaaccuuaauuauuugcuugaaaacauuugccuuccguaaaagaaccuugagugcggugggggaauuuguagaguugaguauuuuucucuuuaucaccaaaaauauaucaguggaaaugagauuugcagccauuguuggggaaaaguuggacugaacagauuccuucucaguuaauaggaaaaggcuauguauaccaaagaaagugaaauguucaccuuuaccuccccaaaugaaguuuccuuuggccaaguaaucuauaaggaugaaaugcaaacucucucuaagcaaagugaacguagucauuucccagcaacuuggaauucuaauaccgaggaggaucagauauuauaagguugaaggugauuuugcuguaauagagagugcauaugagugugugugugugcacguguacgcaggugcaagcacacagguugaugcuacagaagaaucuuggguguucugaucuauggcuuucucucuuacuccuuugagaacaggucucucgcugaagcuggagcucaccuggcagccagcagguuccagugaccccuguuucugacuccugaagcgcugugcuuaaauauagaaguauaggaucacaccagauuuuauauagggaugggggguuugaacucaggucccccugcuuaugcaucaagugcucuuagccacugaaccaucucuccaucccugguuugguuaaacauuugaguuuaaauucaugccuugaaacuuuaaaaacuucauaucaugacuauacauuugcuuagcuuuuaauggcauacauuuaaaauuuuuuuuucuuuuuaauuucuaaauuauagucaaguaaguaaugauaaaauuggacauucagucaguagaauaaaggugaaggucuuuguguuagagagaauacagcuuacuuugcauauuuuccaacugugcauguugaggaaaaaaccaaagccauuucuuucuuguccaaaaucuuuucugguugccauaaugcuuuuugugugaagucucugacucccagagaaguucucuuacuuguucauacuguguuauaaugaucguuggucccucuguuuggguggaggcggcaacuccggaauuuuaaguauucauucaucaagaguugaguuuccccagccuccugauacuucucaguuaaugucgaugguguucuugcuuucaggacacuuguuauggcggguuucucaagaauuccgagaccacuagcagaccucuucgcgugaccucucuucugcuuuguagucuccuguuugcauuauucugcauuuauuaucuuguagguugcugcuggucuacugcuaccuuuccuuuccuuugagaaacaccgaaucuggcuaaugcauagauaagcaaaggccuccccaacgccacucagaacugaaugggcuuuaaaaacccgaguuacuaacaugaaggauguuucugaugucucccuucucugaaguaaaaugguuccuaauacucacacacaaccaugauuugcuguauuucauuuguaaauaguauuaaucuuuuuaccuguuaugugagugaauguuuuaucugcauguauuuaugugcaccguuugcauaccuguuguucacaaguccagaagagggugucagauccccuacaacuggaguuccagcuagccaaacccaggucuucugcaagagcaauaagugcucccaaccacugagccaucucuucagcugcccuugauuuugaccaaagaaaggaaaggucuucagagaguuuugcuuugagcggguuagguggggcgggaggaggcgcuuccugaguuguaacguguacagcaugaguguuuagguguuggguuaacuggcuugacauucuuggauuaauuugaguguagaugugagggauguuaggaaaugcgccaggcucuucgcagauaucuaauugccugaugccguccagaauuucagugaauuuugaugcauuucucgugaucgagaguauuguggaauguucucuguccauuuuaaacugccauaaguguuggcuaauugcuugauuugagaggaaauagcugauguguucaucugagccugguuaaaucugucaacaaauacugagaacagagugggugcagagccugucuucuggcgucuguuuguaucugacauaaaguaaacacagucccugcccucugcuuggagguugucucaaugcugcauagacagccgcaugucccugcagaggcaagcccuuuagagcuuguguuaguccaugacuuguagugauugacaacugugaugaguuuuacuuuuugaaaauuucucuuugauuuccuaggauguucuguucuaugucaggugguagaauaccacgcacugaaaaauuucugggguaugagacaaggguguugugucuguucccaaagaugaugcauuaguggggaaauacgaaaagggagcccuuugacgauuaguuuagccuggagaggauugggguguguuuuguuuguuucuuuuucuuuuuuuagagauuuauuuauuuuauguauaugaguacacuguagccauacagaugguuuuaaguugucuugugguugcuaggaauugaacucaggaccucugcucgcucuggccccgcuugcuccagcccaaagauuuacuuauuuauuauaugcaaguacacuguaccugucuuaggacacaccaaaagaaggcuacagaucuuauuacagaugguugugagccaucacgugguugcugggauuugaacucaggaucuuuggaagagcaggcagugagccaucucucuagcccauguuuguuucuuguuauguguauuuguaugcauagauguugaacauguguaucugugguugugcaucuaugcugucgguugucaccuucugucuuguuugagauagaucuccuguuuauuaacacagacaacagacuagcuggccaugaccuuccagagaguccaacuccuaucauacaauagugucuuuguuaagguuuuauugcugugaagagacaucaugaccaaggcaacacuuacaaaggcaaauauuuaauuggggcuaucuuacaguuucagagguucaguccauuaucauuaugucaggaagcauggcagcauucaggaaggcuagaggagcuaagaguuuuacaucuuguucugaaggcauauagaagaagccugucuucuauguggcuaggaggagggucucgaaggcacacuuccaacaagugccauucccuggggccaagcauauacaaaccaccacauucuacuuccuggccccuauaggcuuguucaaacacgugagucuaugggggccauaccuaaacauagcauaaugcaagcuacauuuaguccaacuucaaaaagucuccauaguuuguagcaaucucaauaauguuaaaaguccgaaguucaaagucucuccugagauucauucagucacuuaacuguaauccccuauaaagccagaaugaaaaagcaggucccggacuucagauaucacaagcuauacauuacccuccaaaaugucacagugaggaaacacuggaccaaaugagacccaaagccagcugggcaaacuccaagcucugcaucuccaugucugaugucuucagaucuccagcuucuuucauccugguauugcagauauaugcugcuugucuggcuuuccuggauuucuguaauuucugaugacucaaacucaagucuuuaugcuuauauagcaagugcauuaucaacugcgccaucccaccagcccccaggauguuuaaaagaugacuuugcagugcccgagaaacucagauaucaagugauuguagcacacaaggggaucgaggugaccauaagccuaaagacuucccaaugccuuucuugggccuugaaacauguuaucuuaaccucuuaccaagugacaccagcaggaguaugaagggacagucaauggcuguccugcaagacacuccugcacggcuguaaaggaauuuucuaccuaacuuaccuuaaaguaggucacuaauauccccauugcagagaucuugcuccacagggggccaggaagacuggacaacgugcuuacucugguccccggaguuugcuguuaugggucaauaccaugucuaagcauuaaaaacucgauuuuucugacucuaggacuucauuugugaauacuuucaggucacccaagaccuuuucuccugucagucuguuacugagguaucagccaugacaccuuguaggaggcaaaaagaaaaaaaaaaagaucauacccuugccuuacauuuucuuccucaaaauaauuuauucauucaccuagucucucucucucucucucugucugccucucucucucucucucucucucucucucugucugccucucucucucucucucucucucucucucucucugucugccucucucucucucugucugucugucugucugucugucugucugucugucucucucucuccugaggugcuagggacggaauccagagccuugagcauaucgggccaauauucuaccacucugcuacaucccagaucaaaagugccugaauuaaacuggucgagaugguuucuguucucugaaaucucugugccucuccccccagggucucacuaugcagucuaggugggucucaaacuuacaguucucuugcuucaggcuuccagcuggauaacuuuuuaguugugaucugccaagcauaucuuuggaauaugucaccaucuccuuccucuucauuugagacaagaucucacucuuuagccuaggauggucucagacucauggugauccuucuaccucagccuugaucuucucaaaggaaucgggaaacucacuguuguaucaaauggagggacuuggcaaaguggcauccauuaaaacaaagcucaugagagcuuucaauccagagcacccacuuacuaauuuaugcccagaaucaugccugccagcuugucagaccauugugugacuggaccaguacccuuugcucacugauggugggcaaagaaaggagccccguuaggaggugcuuccggaugagagcaguaguggcaggauacuuauuuuguucucccauaucaucucuuucuccgaggcacugucugaacagcuuuuaucacuggguuugaacuuucccccaagucagcuguucaugagacagugggaaccuggaagagaaacuuacaguagauauuugauagccuuuuauaccuaacaccgcugacacagaagaugugaccauccuaaaaaacagcugugcucccgacacaggccagcaggaugucugggacgaggugccaaaacucaaugucaccuagaccuuguucuguagcaugguaguuuugcuguaaauuaagaaugaccugguggcccaauaagggcagcuuuguggacaaggcgaggccugagauggccgaagggucaagcucaggccucuccaagagccaccacagaguaugugggggccuaggacaagcucauggcugguguuguuuugguuuuuuccaauacagcauuucucuguguagcccuggcuguccuggaauucacucuguaggccacagacuggggugcuuguaccuccuguguuaauccuucuaguugccagaaaaaccaacucuacaauuugugccaaacuugaagcaagcauuuauuaaguuuuaaacacugacaaagagauggacuuuggucaggcccauuccccggacuuuccuaccuaagaauggucucaagccacgaguugcagaggcuucugaggacaaaucuguaggccacccuauuuucccaugaggcauuauuucucaagaacuacaauucccagcauuccaggaaguuaaccuaguuccugggcagguugaguuugcagguuaauuuuggacauuacacuugcgugcuagaccaaacuaugagccaccaugcauguuuucuuuuuucaaguguguggucuuuacugaauaauaacucuccacaguugauuugaaaaagauuugugugccuauuaggcaucucuuuguuuuauuuuugcuuucccuuucuuuacauucagacaaacgaaaaguccuuaggaaaacaaucuugcuggguaauccuagcuaaccugaaacuggugauuuccagccucggcuuccugaccaucacauguaugugccaccaugucuggccuuuguggccuuuuaagaauaccauaucccuuuacuuuuuuuuuaaaaaagcauggcugucaggagaaacuugugguuccaggggggccgucuggaaaguucuaugcagauucaagaagcauuucaaaggcagaauugggccugagccacaaucccuuuguguguaaaggcuuguuuguaaaaaagauuuaacucuaauaaccacuuuggcuuucuagauaguauccuccugauaucuuucaguuuuguuuguuugcccgacgcuuucauugaucugagaggagaggcuagucagccaccccgcagccuacugaggaugcugaggggggcggggcggcgggagggcggugcagcuggaacccugcauauuaggaaucagacccugcugcuaguuagcugagugacucguggguggagucaagucucccaaggucucuguuucuucguugauaaaacaaaggcuuggaaaaauaaauacgggcuuggaccacaugauaagaaaggucacucuguuugcugauguuguagcucugugaugguagcacagugaaacuccuuauccuucucuaagggccccccaaagcuacuucacucucagcauugagauguggcuugucacacgaggccaccugacacuuucaaguuagggaggcaggugugggauuccucuccugguggaaguuuccucccaccgccuccccuuaccccccucaccccccuuccccuauuccccccuccccccacccuuguugguuuuggagcugugugaaugcuuuugccuucucccuggcucaucagcgccaggaggaaacaauagucccauugucucuuguagagaagguuuccaguuucaccuuaauccggggccauuguguuguuuuaacaaacucgguaccacccccaugcaaaaugcaguugguucaguuuuuguuuuuuguuuuuuuuuuuuuuuuuuuugauuuuuguuuuuuaaaggacucagcagcaauccacagcccauuccccucaucuccuucccaaagucauaacuauauauaguaaaaaugcaccggaguguaugcacuguuuaauugggccaccuggcaucaggguuaaaaugugcuccaucuguauuuaguuugcagaugcuuuugaguuaugcuccaaaccaguaaccuuccagaaagguuuuugugguuuauaauuaguggcaccuguaaaacauuucuucuaaccacguagcuucuuucuuauuaaucuuugagauuucaugguuucuuuuaguuguuguuuuuuugugugugugugaaucagggcuggcaaaguauaucaccaugccaaaggucuuacuaccauaaccuaauuagauguggaaugcugggaacgcacugcacguggcuguugucaguuuuauaacaugacagugaacuucugaugucuucacugaacauuauaaagcauuccuugugucucuacugcuguuccccaccacaugucuauucauaggaaacuaacauagaucuauggcgcuucagguuauccuaagggaucuuuucugagccuggauuacacauucggucaauaugcaaacgacauuccccauuuuuuucccuacauuugacucuuuuucuuuucuccuuagagacaaaagacuguugaaaaugcugaaggcugugcugaagaagagccgagagggaggaaagggaagcaagaaggaagcagguacgugcaccgagcagguauuauggugggcagcgcagggcacccagaucccacugccucaggcuggguggugcagacaggcucagcacgaacagcauccuggaagccgugaagggucuguacucugagugguauguguguguguguguguagggguguuguguguuguguuuuuuuuuucgcuaauauuuacuccuauuucauguacauauguuugucuguaugaaggugucagauauucuggaacuggaguuacagacaguuguaagcaaccacgugggugcugggaauugaaccuggguccucuggaggagcagcuguacucuuaagcucugagagguaucucuuuagccaaucccucccccuuuaaaauuuuuuuaaaauuaauuuuuuuuuaaaaugagaaacaguguuggaaauuaaguuagaauuuugcacugaagaugaacaguucuuaauuuuaacaagucauugugauccugaaguaaaguauggcaguuguguuuaggaauuugauuucuagaaagcccuuucccuugucccacauggaguugaguuuuaugcuugaccaacuguugccugacggguucuuguguuuuugaguaucagauuuuauuccuaacagguguagacccacuucacgccagacugcucgcucagugugaggagaguggcuuaauuuggcuucaguuccucugccgcccgcagcguucuggugcacauuuggccaucgugacccuaguagcaccgcauuccauggucaccuccucugagguucaucagccagucuuacauuccaguuuccucagagagucugugcaccgugggcuuguauccacaguuaaaguguuaccuuuaggaacugcccugcaacgcacucuuuaaacucaguuuaaaucugcucuugcuagcaaauggcuccuuuaaaaauuaccuaaugucaaauaauguuuuagguuucccuucaacuauauauaaguacacacaguacugaccucugaauauuauggcugugcgggaccgagauaaaauuucuccuuauuacuaauuauuccuuaaaccaagccugcagaguggcaggcuuaccucagacucgaagccucugguaguguaagguugcuauuaggauuccauuuuacacuucucauuaaugccuagguaaacagaaagaauagaagaaagcagaucuaaugauauaaacagaaggcguaguuagcucauaaccuuagagaaccaaccccuagcuuugaauaauuaauuagaauuguuacuaugguaaaauuuuaguucacauaauuucuauccaggggcacuuucauucucugcugggucagggcuaaaaugucugucucguuauuauuuauuuauuuuuuugaaagcaguuuuggcucaucugauacuaauucuagagacuuucuuguugccuucgaagccuuuggaauuuuuagcaugaacuaagcugucuguugggguggagcagccaagcaaacagguaccccacucccucccaggaccagggucuucaagccagauucccuauagaguaacaaaaaucucucagcaaagacccuccucuuucacggugccaggaucaugggaaguagcaguuuaaaagauguuucacaccugugcaggcaggccaggcagcaagcacacuuggccuuugaaagguuuccaguuucaaaacacgggacuagggguuuaggucucccuuuggccuuuuaagaguaacuccugcuuugucuacgcucugucuuuauaauaggcuccacacuugcgggauuucacgagaguaaaccaacuugauaauguaauggcaauauuuuggguaaagcgucuguaugguuugggcccuuuucuuuucacuacaaccugguugucuuguguugggaagagagcaguuggaauuuuacauccagaugaaguuaugugaaaagaguuggguaaauacuuggaaucuggcaacuucuaugcugaguucagucacucaccuaagugagaccuugcugagccccucuguaaguuaaagcuggcgggguuaagacacuugagagacuggguaacaacuucuccuuccguauggaaaggguuugcaacacuguucccagucaacggcaaucuuuauugcaaagacagaaggaaguccuuugucgaauuuucucugauagguuuuguuuuguuuugauuuuaugcugaucauaguuugagaauuuggaaacagcuggggcuggagagauggcucagcgguuaagagcacugacugcucuuuucagagguccugaguucaguucccagcaaccacaugguggcucacaaccaucuguaaugggaucugaggccuuuuucuggugugucugaagauagcaacaguguacucacacacauaaaauaaauaaaaucuuaaaaaauuuuuuuuuggaaacagagcaacugaauucgaguuaggagaacucaaaauaagcuaauaaucuuuugcagaaaauuggaaagaagaguguuuuuuaauuuguuuguuucauuugugggguuguuucugaggcaggguuucuccaugcagcccagcuuggccuugaguuuaggcucuuccugccuccaccucccaauugcugggauuauagucuugugccaccacuucugucuaaauagcggugguucuuccucacacccacaaccaaggaguagccuagggcgauccacaacuggugagcauacuguagcugagcuguauccccagcccugucccagaaguauagaagagcuuugcuuccaacuucuguccacaaaauuuuagaacguauuauauguagcuaccucaaacugucuggaagaacguuagcaagugaugaaacacaaguuauauguaugucauagucugggagauugaaucccuuuuggguaaacucuuaacauuagcaaaauacuuuuuuuuuuuuuuuuuuuuuuuaagauuuauuuauuuauuauauguaaguacauuguagcugucuucagacacuccagaagagggcgccagaucucguuacggaugguugugagccaccaugugguugcugggauuugaacucuggaccuucggaagagcagucgggugcucuuuacccacugagccaucucaccagcccagcaaaauacuuuugaaaaaugauuacacauuuuuauuuaugcuuauaagauggguaaaaagugaguuucuggaauguagagaagcacauuggaaaaugaaauuucaaaaacuucaaaguguuuucuuuuuuuggggggggggguacauguucucuuuaccuugucgagguucuuucaguaaaaugugagccacaucuaucucuugacauugaacuaggucuaucugggcaaaaauaaauuaagggcuggcaagaugacucagcuggugaaguacuugcuacaaagccugaagagugacuugcauuugauccuuaggacacacaugcuggaaagagagaauuaacuuccaaagacuguccucuccucuccagaugugugaucccuguggacaugcacgugugugugcccucucauucuugagcacaugugcacauggacaugcacacacauacuacauagaaauguaacuuuaagagucaguaguuagccacaguagaaguguauguuagacuagccuuuugguuguuuguuuacaugcuagagucaugauuuaaaauaagcacacgaggugccaucuuuaucucaaagcucuucagagagguuugcaaccugcugcuauguuucuugauuucauuugaccuaucuuaccguaugauuuucauuuuucaucuuuccguaugauuuucaugagacuguauuaaacuguuauuaaaaugagguagcagcuauauucuauagucaggaguaucugaugcucgauaugaaccuaauaaaaguauagagugaacauuauuaaaccaucaggacaacaucagccucuuuucuguagagaaaaggaauaacguuccauguugucgcugcaaaagucuuuaauaagaugugcaaacuuuauaucaaaauaaaugauaaagcuuuauuuaaggacucaagacuugacugaauaaaaagcaauaucuuaugucugaguuggguauacacauacauauuuauuauuuuaagcaaacuaguccuccuaaaauuaucuguauaguuaucuaaucccuugugaaaucccaccuucguuauugauuuuuauaguccuggggaguaaacucuagggcuagaaauaugucucgaucacugaucuaaaccugugcucaccacaacuuuuugguuuugaggauauauauauauauauauuuuuaauuccugaaaaggguauuuuuagguugcagcaaaauugacuggaaauacagcggcuuccccuauacaugcaugguuucuccuguuaucaacaaccguaucaaagugcuucgugugacauacuugauugucacacugacagucacauuaaugcaaagacaguuuacauuagggcuccuucguugaugacuacaucccgugguucagagaaauaaauuguaguagcauaaagaacaccuugacuuccguaaacauccuguguuucuuuuuucuaacacaguauaaaguagauauaaaaauucaucugggagagaagaugcuuaggauuagguagggagaguuggaaaccggugagugcuuguaaaccggccaucccuggcucacguacauagguucuagccacaacagagccauaugaguguaugugaguuucuuagugucuacggggcagggugggcuuugcuucccaucaggauggacacaacugaggauucuuaacccagaaucucugggaaggacucuugccccuccaaacugauaagugcagaugcuuaguguaauucaugauaaugaccagcacugcacagcaagcagacggcucagaucaguuuuuguuguuuuucuucuugcugucaagaaaugaaacauacuuuuaucugaugucuaauauaauuaacauucacaguggauaaugugggcuuuuuguuuuugggguuguuuguuuguuuaacauagauuuuagccuccuauggaaguauuagacacgaucucuugccuuccacaggagaggaccaggcauucucccugccuauauuccuucccuaggcagugugucaaucuuucucucccucccucccucccucccucccucccucccucccucccucucucucucucucucucucucuuuccuuccuuccuuccuuccuuccuuccuuccuuccuuccuuccucucuuucucuuucucucucucucucucucucucuuucuuucuuucuuucuuucuuucuuucuuagauucauuuauuacuauaucuaaguacacuguaucugucuucagaugcaccagaagagggugucagaucucauuacggaugguugugagccaccaugugguugcugggauuugaacucaggaccucuagaagagcaguuggugcuccuaaccacugaaucaucucuccagcgccauuaugucuaucuugaaugcauagagucaugcuauaccuagcuuuccugguuaucagugccugugugaaguguguccaaguugagacagaauagcaaagauaaguggacuucuacuuguaguagucugugcacguguguguguguguguguguguguaaggaagugggcuuacuuuggagcaauuuauuaagaagcuuuggucuucaccuuucccaucaguaaaccccaggugguugguuaaauacacuugcaaugguguuaauuaaggcagagguaguuucuaagccuguguguauacugaauuaauuuuuuuguuuugcauuuguuucuucacuuugaauucgaagcaaaaggaagcuguuaucuucucuaaagucuaaaagcuauuggugugauuguuaaacgugguauuuuaagccauuccaggcugcgucccggcuuucagugguaccuucaaaaaaugccucaauauaaacgaugcuuuguuuuauccaaaaaauaggaagcugcuuuugauuagcccgugcuccgcugcccgcuuucggcgccuguggacuauuauuuaggaauuuggugcagagacuguauuguugagauguggcuauuugguaucuucuguugagagacuacaaaaauguuccucaagcaacccaauaacacaacgguuccuucuaucagaauguucggaguuuuguucaaaauaucagugucuaauuuacaaauaggauggagcugggaugcagccuguuccucagggcuugcuggguuccugccucagagguuuccuuuguugucuucagacacacacacagucuacaaagaaacaaaaacuagacacucaaauuagagaccacaaguccucagcuugaucaucucuggaauaacugacacucaggcacaacuuccuuacagagauaaugucagguuuaaauuagaaguucuuucuaccuugcuugcuacuuaguuucugcuagauauucauuacaucuguucuuucuugaggaaacuguggcagcuuaaagagcagaagagauucagaccagacugcccuuaaacuuguuagguaccucagcuugagaucuuccugucucugccccccaaacacuagaauucuagacgugggcuacugugcuggcuaguuuuaugucaacuugacauaaguuagagucauuuggaaagagggaaccuccauugagagaaugccccccucacccccguacuggccuauaggcaagucugugauuuuucuugauugaugauuggugagggagggccagagguccugugugugguaccaccucugggcugaugguccuauaaaguaugaaaaagcaggcugagcaaaccacggugaacaagccaauaggaagcauuccucuauggcuucugcuuugguuccagaccugacuuugcucaaugaagggcuguuaccuaaaauguaagaugaaacuaaucccuuccuccccagguuacuuuugguccuguagcuucauggccauggagaugcugauauguaagguaaccauuacacugggcuucaaacaaaagucuuguucccauccuaggaguucaagagaagucaggauggaccucaggugaagagugguauugaugaguuccuagauauggagucuacuacuguggguuaauaagugugucucccaucuuuauuucucuguaauauaacuggugagcucucaguugcuacuguauguaguuuaggcuuaggaguuaauuuuccuguaauuuuucaccuuuaaccuuuauuaaauacuuagguuguaacuuucucuguacaauuaaacugaaagacaucuucccuugcaaaagauguuucaggaggugccaagcagaucugaggauagauuucuaaauacaguuuauaaagacuuuauucuaacacauccucauucuugaaggucuauuuuuggaagaccuuugaccuccauccucuggucgcuuuccugugccuuccggaaacucgggaguccaccagaagaggauggagcaggugugggacauucaucauguguuggacacccgcacgcgugugccaugguggcuucacaaugggcuuccggucugcugugugaugcacucuuagagcaagcucugggcucggagggaaggggacuggaucacucagacccucccacucccagugaggcguccaggaagacgcuuccugcuagcgucaucacaaaggggaacacaaagcucucagcgcuuugcccugagcccccacuggauguguguauaugcaaaaggaagcuuaaccucaguagagaaaugauggauuagaaacucagucaaaaauauuuguuugucaggcgugguggcgcacgccuuuaaucccagcagaggcagguggauuucugaguucgaggccaaucuggucucuacagagugaguuccaggacagccagggcuacacagaggaacucugucucagaaaaccaaaaaaaaaaaaaaaaaaguuuuguuuaccaaauugaauuucauuucaguuuuuuuccccccucccauaaaaggugcuuuucugguuuguuuaaaaaaaaaaaaaaaagacugcagagagcuucaucagccucaucccauaaaaucuccauaauuuaguuuucaugugggcuguuugcauuuucgggagagaguuccaagggccuuauuucuauucuaugaacgugugcagaauaauucaccucacugucuaaacuacauacaguagcaacggagagcuuaccaguuacauuacagagaaauagauaaagaugggagacaaacgcuuguauuaacccacauuaguagacuccauaucuacucgccuccuuagcaguuucugagaggagaaucugaggagggccagcguucaacagaggauggccugagcucaccaguucucauuacaguccuaggagcaaagucaaaccagggccucaccaacucauuuuaauuuaauggccaagauuugcccauauuuaaggugaugugagaacauccaggcuguuagauuugacccacgaaggcugucccagggcaccagaagcgucacaugcccuggagcuagaguuacaggcuagagagcauccugacauaggugcuggaauuaucuggaguuucuguagaucacgggacuggcugaccagcaaggcuuggagcuugacugugaacucuagauuaaggcuggaagugggaguuacugcugauugauugauugugcugggcuccacuuacugcugauugacugugcugggcucugcuuacccacccugagcaguuuggaugagagccuugucuuuccagaaggacgguuuucagauaacuggaguuucuuuuagaaaauauuuuuccugaguaccagaugcgacaaaauauuuugguuuuugauaguguauuuccuuaucugcuucggccaccauaacagaguaucuuugaugggguggcuaaaaaaacagggauuauguucuuucaaugcugagagcugaaaaucugagcucagggacccagcaugugaggguauggcgagggcuuuucucgguugguggaaggcagccuucuagcugugccugcacgugguguagagaggcagcaagcucucaggggccccuuccuagccguguguucuacacugacaaggacuguacuccugugucacauggcuguugagccugaguugccuaccugauucucagagucucgucucuaaacacugccgcaugucacacgugugacagcuucagcugaagaguuucagagaggacaccaagugcccauaacauuugguuguucuuggaguguaaugccauaguucauugaugauaaaacacgcuacuauuuuguguacuauuaaagaaaaauaaaacugcuguccauuaaacuccuacaguacuucaucacuuaagauacuuuaaucaagguuuuaccuaaucgauuuuagagauaguuuuuaacacauaguacuguaaggaguucuuuugcguuuacuuguguuuguguaagguguaugccuguggcauggcuguggaagucagagggaaauuucugggaguugguucuuuuccaccguuggguaucgaacucgggucaccaggccuggcggcaagcgccuccaucagccugcccucacuuuauuuuuauuguuauacuuuucuaauuauaaaaaugaaacaaauugauuaagaucuuuuuaaaaaauugcgugcagagugcagccacuguuaauuuugcuuggcauuucuagguguggcgguacagguuugucaucccagcacucuagaggcuggggcgaaaggacggcugaguucaaggccagcuuggggugcacaaggaggcuuugucuuaacacaaacaccuuuuuaaaaaaaaaugacucucuaauaguaaaaucgagaguaaauaugggucuuuagagcaguguccagccugggagaagggagguucccagacugcagucaagaguuaggagaaauguauucauuuugagcucuuggcgcccauuguaaguuguuuccagaaauucucagcugguugucauguauuuaaggaucaagcgcaugcuauuugcuugauucucccucgccguaaguuuguugugaauuuuacuaacgugucaauucugcaaguagcgcuguaccuuccugcuuuaaguuaggaccuuuuugcaaucgagaccuuugucuguguguaucucuugcuuaccuuuuacuggccggugcuuucuuggugccccgugcuaaccuauguaauguuuuccuggucauccuggaaccugucuuaaaauaaaaguuuuauugucuuucuggucacauuacaaaucaguucugaagcgaaucucccuuaaaugugcuuaugcuuuggugagaagaauuuuuucaaaguagucuuaaaaauuuguauuuuuuuuucaauuuuuugcugaaacacccuucaaaugauaacacauuuaucuaggucuaccaacaauauauuagaaaauguguuuguuggaaucccuaccaacauugucauuaaaugauauaaucuuugauaguaucaggaaagccccauuuuaauguuuuaaauguguuuuuuuuuuuaagguaugaauucagcacuguuuguauguacaugguucaguuugaaaccaucugucuggggcuguauugugucugucuugugucuguguggcuuaccagcucugcggcccuagacaaaagacuugcaugcucuguguucagggcuggcucaugaggagccucaauuaauauuuuagaagcauuuaaucuggucuuugacacaguauuguaugacuuuuugucaauaauaaacauuuguuucucuguucugccuguugaccucuuuuucuuuuugguuucguagcugcuuuaauauuuugaugaguguuuaguuauugagagcucacuagcuaaaguuuuaagcaagacaaacaugucuuauguuuaauuuugaauuacaaagccuuaaaagauuuaucuaaggcauccuuuauauuugguaggauuaaguaaaggagucuauauuaauucucuaaguuccauguuaaaaacugcaguuacaaaucacuuuuugaggcaaccaacucucuuucccuguuuugugcaugaguucgcugcuguuguggguggauagaacugcauccaucucugacuugcaucugcagcucugugguucugaagccgagagccuuuagaggccuugcuccuuuguaggagucucuggagggcuugguccuucuuaggagcuccguuguuacaauggcugccugggucuccaagcaggagaucagguaucuuuugauguagggaaguaucauguugagaugaguuaagagcuuugagagcuugccuucuagccaggcugaaguaggauuguaaguuggaggccaguccgggcugugcagagagcaaaaccugaugagcaaaccuaaaacaaaaccaacgucccccgagguagccccucagucccaaguuugaaggcaccugaucguuuccucagaacagguugccuuauuucuuagaaccuuuaguuuucuugccuguacaauaaagauaauuugugucagcaguggcgggucaaacacaaugcauuugguuugaaaaugucaucaucaggugagguuaaaaggacccccacauagcaccuuugaccucagagagaugcugucagcaaagagaaagucuacccauccaagccuccaagcuuauaucaugcauguuggugugaagaugcugacgaagggggaggagaguucauauuuucaagguaauaaggaaaucggggagugagccacaguuagccagaaagcaaauucucuagagaacacaugaugguccuuaugaaaaacuuauucuucacugcacacuguuacaugaugucccgcaugccuacguuuacuaauguaauagauaguucauaaauagggaggcuaaggaacuacuguaagggcugggguauuguagugguagagggcuugcuaaacaugcucaaggucccggguuugauucccagauccacagagggaaauccauucugaaauacagaaagauggcccaguucuuaagcuggagagcuuaacccuguuucucugucccuaaaguuagugauugggugcuuggguuugguucccagcauaagcuguugagccucuuucugauuugugucuugaaauacauacacacacauguauguguauauauauguguguguguguguguguguguaucaggaaaaagcuacaugaacauugaccacaaacagacuucugccucguauuuccuaaauaauacagcaugcccuccaauuuacauagcauuuccauuguauuagguauugccuaacaucuggcugugauuuacaguaaacaagaggauguaugugggcuuuaugcaaauauugcgcgcuuucccaaaagggacuugaucaucccaagaucugauggggauauuggaaccaaucucccaccaauaccaagggcagguauucucuguacaugguugauucuuggaagaguacgucaguuaaaaguccuuauaacaacgucuuuaccagaguaagcauguuagaaauauuugcccuuaucauugauggcauguucgauaccguccugcguucuuugcuuuucugucucuugacacucuuccuucaaacuuugguaacuagcggcacuuuggacacauuguuagcucacuugccugcguggucaacccagcucuggccacuccaucuggugcagauggaggaaggagcugcuuaugaggcaugcccuuagcagacugcugcaggggcaguugcuguaaauagucugggaagacauguguuugcuaagagauuggggguuggggggaggacguuauagaggccuagaugcaaggaugggaaacaagagacuucuguguguacaaagaugucugugccucucaacugcugugccugagauucacagcucacuucaccguaacaggaacgggcucuaguuuaccugguuugcugugaguccuaacccuggcuaguccuucaccagaucuacucagugucaccuuggaaaugacuaggugaggaugacacauuugcaccguugugggaguuugugagugguuagagcugcgggucugcugccauuucuuccugugucacugcagggacaccccaacuaguuaugcaacauuuuguguaugugacuuugaaaacgcuuaggaaaaauacauucugccauuaucuagcaaacggcguucuuggcaguccuauaaagacaaauuuuaaauacagauacacaaguacagaagcuaagggauucuauuacagaauaacaaggcacaugauuugaucaaagcaauuugccugaguauuucauuugauuuuguguguaugcugauucugugugaacauucgcucggucacguacuuacgcucacaaguuagauacacaguaaggaauagcuacugaacauaauuuugcuguucaguuuacgugauguuagagggcuuucccccccagagacauacuucaagaacgaaugaagcaaaugacuugcaaugcauuuuauguuuugagaaaucaugauuacaguggaaugcuaauaugguuagcugcagagagacaacauugacauuguugcuaagauauuuuaccagacaugucauugaaacugcgguuuugaaaacggagcagugugugcgcgcgcgcgcgcgcgcgugugugugugugugugagugauggcagagcggggauauaguguauagaacauaaaagacacaaaacagaaaugcagaggcaucuucuucucuccucuaaucugcguaccucagaguaggccugaagagggcuuuguuaaauagcuacuuguacagucaauuuauauguucucuuucuggaaaaggaagggaguugccugugcugugccguuuuaaauguauauaauggagguauguauguguguguacguucauguggaggccagaggacaaccucagguaugugccacccaccuuggauucucucacugacuugggguucauuagguaggacgggcucaccauguagugagcucagggauauacccccccuccccaccccucugcccguccagugcuggcugggauugcugguauaccuccaugccuguggagcuuuuuaaauguagguuguauggagaaagcacagauccucauacuuggaaggcaagcacuuuacucuugaauggcuuuuauuguuguuugguuuugagaaacuugacaugcuaccuagaaacuuugagcucucccuuccaaccccuaacacccccccccccaccauguuuauagaucccauuguccauauaaggaaguuuccuuuuaguugaaggaagagagagagcagcucccuuuauucuuguccuuucucuuguggugagccugcuggcacacagcuucaccaccgggaaugccaggguuugagacugaguagugggugaggggugguguacagguuaugguauuguuccaaaagccuuucucccucuacuuauuuuuccacccccaaaaugucaucauguccaaugugacagaauguucccgaugauuauccuucagggaaacacgacuugcuaaaugagcugugggugauagaauuucuuaggcacugcacaguaaguucuccaugcucugugagcacugugguuagggcaucugcuacuugggccagcaagccagugugauacugugauagagucgugacuagaguuaggcagccuggguucuagucugugggcaacuuuguguucucaccugaaagaaggagaaguugaagcaucuauuuuaaauagauuaugaugaauaaacuaauguaaauaaaauguuuaauaaggugucuggcacacuuaguaaggacuuaaugaguaacuagcuuaaucaucguuaguagggagcuggcaagauggcucagcaguaacgguacuugcugccaagccugacgaccugaguuccauucccagaauguacauaacagaaggagaaaaccgaucacugcaaguugucuucugcaugcaacagccgcucccacacauauucaaucagcagucuuuauuagucuagauacacucaguaguauaauagcauuuauuauuaagacauaacuacaaauucugauguguacugugauacccacuugacgugaauuccaggagucagugagcuugggcuguaaucauagggcuaaggcauuuaaaugagauggaggaguagcuuaaggauggauaccccgaaggcacuggccgguccaggcucucuugcugcuugguuucaggacacuaaugacauaguugugagaucugugacacuguguuccucuuacuucucaugucaaccacaagacauagaggguuuggugagaaaaggcagguuguuuguguuacuacaaauuaagagggcguauuuggguuguguuuaaggaaauuuaacauuaagacaagaaagcaugcauucauuggcugagguuggaauaagacagccggguuaugguuaacacguguuaaucuuagcuuggggaguaguuugaggccacccuggucuucauggggagacccuaugucaacacggggaaaaauggcagccagacagaagccaguuuagaaugucacuggagaacaaucaggauuggaccaucuuauagcaagaaggccuggguuuaugggucagguaugcuagcugcacaaggacaagucugagccuguggauugaaguccauagugguuaugauuggaaguuucuagaaagaggaaaaguagcccucccuuuuggcaaguauccagugagauagcuuuacuggguagacccaggaaguaaaaagagauggguguuaaguuucugucugaaguaaguaugugcuagaaaaucaaguauacuuuaugaaacauucguguccugacauugccagaauacauggcagacugagagcagccaaggaagaggaaacccauccaggccucagccgugagaacagccaccaccaccaccacguuacuggacuccuucucugacacggguugugcaucccguuuugccaccaccaccaccacguuacuggacuccuucucugacacggguugugcaucccguuuugccguuacugucauacaguauauaaaacauuguguauacuggcuuggauguuuauuccacauaguuuaaaaaaagaccgaccauauggcaaacuguuuucuuuuucucucuuguaacuuguucauuggcaccaaaaccaggcuuuguaccucugccuuugcccaguguccugaccauuaaaaugcuagccgcugucagcgaguucuggcacgacagcuacaguuauuauuuuaagagaucagucagauucuuuuuuuuuuuuuuuuuuuuuuuucacuaagaggugaagugaaugguugaagaccacauuuccugaaagggaagggggugaaagggacaguuggcugaaguguuacaaggcguggguuauauauacagacuuuguaaaaccguagugucuccauuguaguugauguagguggcucucugaaguaauguuuucuucuucucuccagaaggauauauguacuguguguugauacugggaguaucucagaaugcuuucgcuugauaagacaaacaauugcaaacuugcuuuaugagccuuggucaugcuagcccuucucucuagauacagcuauuguuuugugacuucuggcuuuugauguuggagaggguaacguguugagcauugauuugcauuuccugccaaagauaaguugaagcugaaaccuuuaauaucauggcuguggaaaugacccaauuuggaaauacaguauuuacagacgugauuaauuuaagaucucgauagaauuagguugguccuaauuucaaauccugguguuccuaagaaagacugaaacaaugagugauguuuguaccuguaaucccaggaccugggagguugaggcaagccugagcuauagagugaguucugggccagccugagcuacagagggagacccuguuucaaacacacagauacacauggagagagaacauuguggauugaugaaggcaggguuggagugcugagucuccaaaccaagaaacaucagagauggcuggcuagagaugaagaaauagguauggacugacuagucuccugagagagcaugauccugccuccacucugacuguggacuguuaggucuggaaaugaaaggaauucacuugugguuguuuuuugaguugccugcuuugugguuccuuuguucacacagcucuagaacggcucaauagccaggcaccgcugggcucugcucuuugcagcauccuguuuaagcacauugaaaaacacauaccuuggucugugacaaucuuuucuuaagcuuucgauacagaguuuuuaccaggugacauuaggacugugucuuccuccagggaagcagcauagaaccuaaugggucuguuagacuguauuccuccugucagaacagaguuuugcuuuaaugacuuuauuuuccagguuucuucugagaaacaucuuuuguucuccaucuguaaucuuuucucacaucauuaagcuuucuugccauuuuccucuauggccuggggaaacucuccugagcucuuuaucagugcuggguaaugauaaaguagugguggacccaggacugugcugcaaacuaugugauccugaacagccuaggccaaccacuccauguuccaccagggugcccagcauuuaugaaugguguucucuguugucuuucucugagucuuaaagaugcucacuucccgaggggcuagaggggcggcucaguggguaagaguacuaccauuuguucuuccagaggaccuggaguucaauuuacaguacccauauuggaguuuacaacugucuguaauuccaguuccaggggauccaacacuuucacacagacauacagguaggcaaaacaccaaugcacauaaaauaaaauaaaccauuuuuuuaaagcuacuuacuuuccuuucauugauaaacuauauaauuuaucagcuccuuaccacugacgauuuuaggggaggccuguuguguaaggggaaccuguuuaauggagguccaggaaggguucaugcugggagacuuggggugaagcagccucaguggagggaauagggacucuauugcccagcugacuggaaugugguuaagucacgcauuguugcaacaacaaaggaugcuccagugucuucuuuuagauugcuaagguuuuucuagucaccuccuguuucucgggguuuugccucuuuguugacagacauuuuacugggcucuagggaggcuuugcauaacgccuggugcgguuuuacacacagucugggacucaugcuuuacccaccugcagccaccucaacccugcccacuccuccaucagcuggcuguccccugcuagugacagcccugguaguuggcgcuggcacagagacagugcaggcugagagagaaguaccugccauuggugauggccuucuguugcuccucucccuugucucagggcagccugccaagugcagauaggucaccucuggguggcagucacuugcaggugucccugagcacaaagccugugggauggcucuuccuuucacucacuucccaagggagagcagagcagguggcccacuuaacucaaaacccuucacauauacacauagcucuauccuugggaguauaaauguaaauauuuacaucacacaugcacauagagggugugagccauaugcaaggauuaaccucugcccauucucccaguuguuuacauccuauuugcagaggcaggccugauacaaacuccagagauccuccguucccaaacaguaggcguguuuacauguacacagcacacacagaguuguauauacauacgacaugaacaucgguauauacacauacacccccaggaaacauacauuuucaaauacugaaaacuuggucugcagggucauuuccaaugguuuuucuucuuucccuuucucuccuguuugucuuuuuauuuuuccccauguuugccuugaccucuggcuucucaccucagccuucugagcguuugggauuacagauaugcacuaacauucccaacugccauuucuuuucuuucuuuuucuuuuuuccuuuccuuuuuaaaaaucagaacacaagcgucucagauccugaccagcuucuuguuccaguggcgagagaaauccccgguacacguugcguucauuacguugcccucuccgggagagccuuaaagcccaugacuugagcugcagcaguggagacagcuacccuagcagcaauuguccuccucccugaacagaggagguggggccgcugcccugaucagauguagcaaugaaagccucagcaucuaaaaagugggagguccgugaggucagaaaacaucuaugcgaugcugaacauagauuaaggaauuugcaugcaucccacagaccuuuccaggcugcaguugguggcagcugacccacauuuuuauucuuccucugggcuaggcugggaggcuagacccgccagucucgcugcaggaacugcaggcccauaugcugcaagaguuaaugaauguacaguccugggugaaagggaaggacgcuauuuugagugcuugaugacuaaacaccuaugcuucagaugugcuugguuugugugacagcagcauaaggugcgacugaaggaaaauuaaugaucaggaggcccggccaccuccccaguggaacguucgagagugcuuggaucuaauuaagcagccggcacagaacuggaaaguagacaagggaacagcuuucuucugguggccugggacugcgugcagaccuauauauacacuauuuuugguuuucuccaucggguacacagaaugacguaauauugaaagcguaucucggcagccuucugaaaggggaguggcacuagggagaugggcaauguacaguugccugaguucacggucgacauugacuggugcccuuaggcccucaggcacgaugcucauuccugucuacuucuaggucuucucgucuagaagagaacuaggaacaguaacggcuugguagggaggcugugaagucgaagugagggagggggugcuccuagcacucagacuggggaccuaccugcaucccugagaacauuugcuuccaauuaugcuucuguagagucugagaauggaggguuuucugaggucauagguuuuuuaaaagcacuguagcucuugcauggugacuuguuuuaaaggaaaagcuuggacagucagggagaaaaaugacauucuguuuauguuucaggauagagagcaugaagugugaggacauuugcugaccccccaaugagaagguggacuggcuugucucauuagcuaguacuuuuuggacccuggggaauuagcuguuuugugugugugagugugugugagugugugugugugugugugugugugugugugaugguagugugguaaaguguuugagaauuagucaugauuguguggauauguuuugggaaguugucgacauggauccacuuauucuuucuuuuugaaaauguacacugcauauucaguggcugggccuagaagccagggcauuguguaagaugcuuugaaguguuuuccauugcagagagagccuucuacaagguuccagaaagacacugggucuugcagaggaaaucuuucccaacgugcuggguuucuguaaauauauaugaguuaugugguuauaaaaccuuaugauggaaaauauguuuaaaaagcagugcgcccagaggcgggaaccacauaagaugcuguaauacaucugaugcccuaguuaaauguaucacccgagucccguuuuccggagcuggauaaacagaacaucuuucuauucuaagccuccagccccaccuucccuggccacuuuauggcacgauaaauggaaaccuuauuuccugccucuguagaccuauuuaccugaaugugugagcucacccuugccacucucagggccacccguucucaaauaggcuucgcuuucauccaccugccuucucugcccuccuuugaaagccuucucuaauccugcgguccguguucuuuaauccgcagugcugacugccauucugcauggccaccuuuaaauguucgucuccuagauucacauuuuuuuuucuuccauuaugaauuuaaauucaaagucuuuaagagugugugggguguguguguuaaauaaagaacuauuaucaaaagccauuucuucugauuuacacggauuuauuggaugucuuacucucuuuggugaguccauuaucuuuuacauacggcuuucacucuuauacuuuauuauguguguauuuuaauuuugauuuauuauaaacacagaagaccuuacaaacauccauuuaucccccauguccuuccugaucuuuuauuuuuagaauuuaggaaauuggugauuuuaaaauaggaaaagguauguguguguguguguguauagacuguauauaacuaacagagccugagauacgauuagccccuuuuacagaaaacgugugauuaccccuuauauauuuagcucauuuagaauguguuucuuuggggauucuccauucuucccaacauccuuauaacaacugcagaguauguuaggaucugagauggcugguugggugaagguuccagcugcucccucugauccucccaguuaaugcugcucugcuuucuagccuaugggaggugugcuuggaucaggggacucucugagauggacucgugcugggugauacgauucucucugggguuuaaauguuccaugggaagcaccugccagcguuggaggggggccuggcaaauccugguccuugauaacauggcuuguguacccuggggaggaugcacuguccugcccaguuugggccuuucugcugccgcaacaggaagcgugauugacaugugcuuccuaguacuuaauuggaaugaggaauaaaagagauggcaguuaaaacaacaucuacucaaggccaaaagaaauggcccagucacgcuggcugcugccgugaaacaacuuuaauucuucugaaacccuuuuuagcgucugcugaggaauguugagggagccggggauuucugaugccuggcugcucggaacacccagucaucauaagugugccccuaccagaguucugcucuuggccucuggugucaugagaugcucugggcuaccuuugaacuuaaccugcugcucucugcgcuguaaaaguuaaagcuccaggacuccaggaugcuguccagccucugagcaggcuuaucuucccacuugguacucugugccuccugcucauccauagagcugcucucccugccugugccuucccuauaaaaggaagcuggaaguuuaauuguuucugggaagccaaacagaacagcauguuugggacagauaccgucaggagauggcaaagucaaagcuggaauggaagcccccucccccaaccccgucucuaaguuccauuuuuauugcagccuacauaaaaucaaagagcuggagcccagcuggucccaaggccgaggguccucauggcugccacaugccuuggaggcucugucuuacagacuugcaguuaaugaaaauauuugcuuugcucgauacaaacaaaguuuacgggcaggauuugugauuaggaaaugcuuuaaaucugcacuccagccccuaauuucucuuguucuguguuagagaauucugucucugagauagugacccuuuucucaggaacaagcuuaacuuuuuagaaaguuucuggcaaugguguguguauuuccauuucuuuguguuccaaucaaaaggaagggacugaaagucuggguuugcacguguaggucagaaaucuuuccaaguggguagggagacuauuccuuauggccuagcgggccaccucgcugccauuuacagaccaagucugugacuuagguaguacaugaggccauguagcucucuccucaaacacauggaaaaucagccuugccugcugcuccgcuauccucaguaacuguggggguguaacuacuuauauguucuuguccgacuccuguugccuaaaucuuguagaugcuguaucugcuuauagaaccgaaugguaguaggaucuggucauggaacuaguugugagacagagaaaguaagugccggaagcucucaugaaucucuucugaguauaagcauacagccccguugggaaaugugcucugguuguagccacagaagugguagucagggugccucaugcacuggcuauagaucucaagaggugguaucgucaagaguccaggggguguaacgguccaaggcagggaccucuccuguucaccuggacaauauaaggggccucuacuaacuaacuccuguuuacccuccccucuuagggguagaaugccuuggccaccugccuuuaguguguuuguaauucuagugagggcugucuaguaauuguguauuucuucccucuucaaaugaguggccugggcaauuagugauaacucaucagugucucagguuuauugaaaugccucgaguguaguuggcccaggugaggcugaagauucuuugcugacucugccagcuugcccacagcuuugcccuugacagcucugucaccuuugaguugcuugcgaagccaaggcuucaguguguucccccaggcuggggcaggguuaacagcccuucccaugugaaaagccagcacagcaguauagcaugaauaauggugguuugggucacaucccuuucuggccuuaugcacagagaucuggggggggaaaaaaaaagagugccugcuuggcuagacaucucagaggguucauccccccacccccaagggugguacauggguuucuuuuguagccaggaagucaugacaaagccuaguuggaaagagucuuugucagacagacagguuuugcuuauggaaaacuuacgugucuccuccgaauucuacugucuauaauuuagaacuuugaagaugguuuguaaucuauggagugaugacucaaguuucuuugcuguccuugguugcuucuuggugcauucugaggaaugugacuuggggugaggcggccaacuugggggaggggcaagauaggaggaaaguguaucaucugagugcauuuaaccagcuacgcuucuucucuaagaggcucgucccugcugaggccugugucccuguauuccuuguauacuauaauugcauccucuauguuggagaggccuguaucccuguaucuucuguacacuauaguugcauccuauaucccuguauucuuuguacacuauaguugcauccucuauauuggagaggccuguaucccuguauccuuuguauacuauaauugcauccuguaucccuguaucuuuuguacacuauaauugcauccucuauauuggagaggccuguaucccuguaucuucuguacacuauaguugcauccuguaucccuguauucuuuguacacuauaguugcauccucuauguuggagaggccuguaucccuguaucuuuuguacacuauaauugcauccuguaucccucccuguauccuuuguacacuauaggugcauccuguaucccuguauucuuuguacacuauaggugcauccuguaucccuguauucuuuguacacuauaggugcauccuguaucccuguauccuuuguacacuauagguacauccuauauauuggagaaucugcuuauucuugaaaguuugauuucauaauggugugcuaguuuguucccagguuccuuuggggguuagauccuaggggaaccugcucagaauugagcguugugauggguugggguuggccgggguucagugagggaagaguaggugggaucugaaaagagaaaagugaggccaggaagcccugugggugcaguccaggucuuccauugggauucccauauuggaggaagcagacucgggcuggaaguccagagaguuccuggcuuuggaccuuguguggcaguugagugguacagaaggccuccugacagaauuaacucaugcuuuugugguaaagcuugaguuccccugcaggcaguggaguucaagagugaucaggagaaauuguuuaaagaaguaugucugguauaugggaauuauauucuaagaauguagcucuuagaaauuaaagucuuaucaacuugucaugagugguauaaccuaaauaucaucuuuccacucuaggaggugacuuuggcucagagacgccugccuuguccuccaguggugacucuccugugaacaguuuguccacaacagaggacacuuaucgugugagcuuggccaaaggggucucuaugucucuuccuucaucaccuuugcugccucgacaaucucuccugacacagucaagaucgaacaaaaaaucuccagguaaaaaagcaucccaguaucaacauaagcuaucuuggucauuuaaauuauauaaaauaaaauuuaaauauauaaaauaaaauaaauuuuuuccacauauauaauugcaucacauaugaucuauaucauguauacaucauauacauguauauaucaagaugaguacauguaagaaaucuucugggagagccuguuguggugguguaugccuguauacguauaaucccagcaccuaagacaagaagcagaagcgcaugaacuuggaaguuccaggccagcuuaggcaacauagugagaucucaucucaaaaauaccaaaucuuuuaggagaauauuuuuucaauguuaaaauaacuuuuagaagaaggggguucgaaaauuauuucuagcuacauauauguuugugcgucuguguguaugugcacgcaugaauucaggugcccucagaguccagaaggaguuguugggucucuuggaacuggaguuuuaagugguugcaagccgccugauguggaugcugggaacugcacucagguucucuguaagaacagaaguuacucugaacugcugcugcccccagggcaaacaacucaaguauuucaaccugccagucuguccuuccaccuccaaguauacuaaugagcugcccaggauagacuuucauagagauucaagaagcccuuaaaguucuggauacaggcaagugccauugacaacaggcugccuguuuaucccuuccaagcauuauauagcggauguguuugcuugcugccauuauccagcauuggagcagcuguaagguuuagaaucugcugacgacucaggcuuguaacagggcaggagccaugggucacuuguguagggcauccugccucccucugucauuaccagcuucaugcacgcuugcccauacugagaacaaaacccagcagcgguuaacuaagagaggcugggauucagaugugaggaaagcccuuccuguccucaucccuggcguccuagcaggucuuugauauucuuuuaaauuggccaaauauuugcuuauaaaaggcaggauaauuuggguuccuacugaucaugugccaaugaaaauucuucucaauuacaugggaacauauucagaguucaucuaaauugugcccuggggcuaugaaauuaauuaguuucugguuuccuaaauauuugcguuaacuuggaaugacauaugcguuauuuuuugaguccugcagucgguguuugagauuuaugcgugguaaaaugaagaggggaaacccugcggcgcugcgugugagaaaugucgacgugaauuugguugagccuccagaaucucucauuguuccagaacuuucuuauuuuggacagcauuguuuacaguucagucauuagcuagaaauugguuuuugguaugaggugauuuccuguuuauuaguauuuagggaaauuccugggauggcauuugcuggccacacugcuguaucucuggguguuuuccuccugcaaaucgggguucucacagggccuuuccugcuaggcuccccugguugggcugacugacucuccuugggaucugcacacaucucuuuuuacucagcuguguugcuugucuguagguuagucaguuuaucagcagaaacucugcuuugccagauuccaguuagacgcaugaacccucucccagaccuaucugggccuucuuaucaaauccagauuuagucaagaaaccuguuuuaucaguuuaacaaggaagucucguccccacccccagcucugccaccaucucccccccuccgccccccuugccccccccugcccccuaucucauguccuaacugcaacaaaaauucugugagcucagugaauuccccuccugauuuaugaucucuuugugauuuuuuuuuuccuuuacugacugucacccuguaccuuggcaauacauuccuacuuggcugugcaccuuucacaguugagccuagucuuaccuugauugaaaaauucuacugcagugggguccaccaucuacuccugaaugaagugcaccuuccugaacuucuacaaguaucacuuaguaauguucuguuuuuguuuuuguuuuuguuuuuguuuucuucuuuaaccuuguguacuucacagaugugguacuuuagggcaagaaaaaugucuuagccaagcaugucaugaagaacggaugauucugagccuguaucuuaguaagaaccucagucgaagggaaugccaagcacagagguuggcauacugaaccauguucaguugcucugacuaugaaaugcuacugcuuuugccucagggcuagggaucaccugagacucuagggaaucuacauuuuagacauaaguuuauuacugauagcaaagucggugucuguucgguggggcuuucuguagaguuggcaggugagccugggcaaugugacugaucugaaaaguuucgagaggcgagcugggcagugguggugcacgccuuuaaucccagcacccgggaggcagaggcagguggauuucugaguucgaggccagccuagucuacagagugaguuccaagacagccagggcuauauagagaaacccugucucggaaaaacaaacaaacagaaaaaaaccaaaaacaacaaaaaaaagaguuuugaaaggacucucaauaugugggcagagaaacccugaccgacuuguccuauaugagauuuggcuuugagaaauaauucccauaaagaugaaauuuauuucuaaguucugugguuagucuuacagacagaaagauguagcagucuuuuuccaaauauucaaucuuuuaauggguucaagaaaaugcuuuccaguuuagaugcuuuucuucaacugagcauauccuugcuagcagaacaguuuuuugugcacugcccaaauccauguagcaaauuagugucucacaguggugauuuggcauuauuauaucaguaauuuuaaguuaaaaaaacuuaaggcaaaaauggcugcuuaaacauggcagugacucagaagaccuaaaauaauauuuucauggcuuuuaacauacauuuuucuuugaaccauaucaauggaaaagcauucagaaugcuaaugucuuaccuguccuuuuuuuuuuuuuuccauuuuuaagaaagguugacauauggcugugaacaugcaguggcuuuaaaaauacccaucuuuuuuaaaacuagcacuguugcuacuaacgauacaguaaauacaguguaucugcaguucccaagaauaacgacaagccaguccaucccagguacccauacucucucccuguggccugugcucccucacuguuguucaaauccagccuucaaauuaccuugcugacuuuuguuaugaguugugauguuuauaagauggcuuuuuaaaaaaaaauuaacauaaguuuuuauugauuccuugugaauuuuacacauguauaccaaucccacuaauucccuaguccucauuucugccccccccaaagaaauuaaacagccauaacaacaagcaaacaaauaagcaaaacaaaucauugcucucuggaagcuacagugugucuauguguccgugugucccacaguguuacccuuuugcccuaacagcuuuacuugcaaaugagucauuagucugguucgaggccccuuggcuucugauauaccaucaacacugaagccucacugagacucuucuuggguauccuguuguuacauugugucauggugauccuguagcuuggauccgcaggaccagccucuucaugugcaccagcagcguacagaugggguagaugucaagauggaccaacccaaaguccuggaucugagccuggguaguaacugaguuguuuaagccuuccagcucucccacaccccugccaccagggcuagcucucccacacccaugccaccagggccagcuccccacucccuauauaacugcuagugccaguggcagugaggggcaggaacagcuuagcaagacccuuagacaacaauacuucagguggcagcccagacuauggaggucugcauggccuuuggugauaacauggguacaggcauugucacagacccuugcugcauuagggcaauauggcccuuggaggcagcaugugccuagacaucacaugaccucagguggcaguggcuguuccucacccccauugcauccccaguuccuccucucuucauagcgcauaaacugcuccacuucucuuucccaucucucuagcacauacuugcucauuguaguacagccugcuggcccacacagcaagaccucuccaugucuucugucugcccaggcgugggccucucaugaaauuacuuuuaaaagacaccaaaccuuggaaucaagaccaggcuggcuacacauaacaagauuuuuuuuuucuccauaaacaaaacaaacaaaaaauguagaggccggccccccaccccaaauuacuaaucuguuuuauuugccuguauagaaacucuucacuaccugauguuuaucagacuuaaaggaggacauguaguugucuauuuugcuuggauggaggaauagccagauaugcaauucuuuacugauugauggacuguaaccaguggacuggguggauggucaagaacuuggaaagagcaugacuggaaaauuggugagaaagauauuugaggaauauggugguuugacugagaauggccucuguaggcucauauauuugaauguuugguccccaaugguuggaacuguuuggaaaggauuaggagguguggccuuguuggauuaggggugucacugaggaugggcuuugagguuucaacuuacacauucauauucccucucccucucccucucccucucccucucccucucccuccccuucucacucccccucucccucucucccuccccuucucacucccccucucccucucucccucucccucucccucucccucucccucucccucucccucucccucucuguaugugucugucuguguguuugugugucuguguguguuugugugugaaacaggguuucucuguguaguccuggcuauccuggaacuagcucuguaggcuggccucaaacuuggagauuugccugccucuuccucuuguacuugcuaccuuguugauaagugugugagcucucagguacugcuccagaacccgucugcuccucaccauuaugggucauaaaccucuacggcugagucccaaauuucaaccuuuuucuuucuuuuuuuuuuuuguuuuuuguuuuuuguuuuuuugagacaggguuucucuguauagcccuggcuguccuggaacucacuuuguagaccaggcuggccucgaacucagaaauccgccugccucugccuccccagugcugggauuaaaggcaugcgccaccacgcccggcccuuuuucuuuuauaaguugacuagacuuagucacgauauuuuucuacagcuguugaaaaggaauuaagacaaggaaguauguggauagauuucuuugagugggcaaagcaugggagaaugcucgugccccauaaaaaugcucaccaaaaggugacuucagcagaguagaguccaguaaucaaguagacagcaugacuguucugugggcaccucuuuccauggccagcucugucuuuguccaauggguucaugaacaaaguagccaugguggcagagauguaagucaugcaugggcgugacaacaugcacuuccacucacuaaggcuuaccuggcuacagcugcugccaacagcggagacgccagcagcuugguggugagcugaguacacuggacuacuuccuucuuagaaagagcagugcuuuguccuuacuggaguagcuagcuugaaaaagaaacaagaaacugucagguuggaacucuuauuccauuaugagucaacuucuauguccguaaugaagcgucuugaucaacacaacuuauauucaugaacguuuggauuaguacugcugguaacuacuuagauccuggaaccugugggccagggaucauauuaaagccagcuuggguagcucaugcuucuuaacugccacacauggaagucagagacaggaggacuggcacaaaaauucaagucuagcuuggucuacauagaguuccaggcuagccaaugcugcaaugcaagacucugucucagacagacagacagaggucauuaaccauguguuaauguaaauucuaugugauugaguuucuuguuuucaucacuuacuuuuggaaguacugaggauugaacucagggccuccuucgugcuaggcaaguguucucaccgcccagcuaucugugcagccccugcuuuguauucaauuguuuauauuuacccuucugcagccuuucucuguuugugcauauuuuauuccuguuugccagaacauuccauuuucuggguuucuccuuucgauauuauuuggauuagaugauccauuuuaugauaaccacaaacaaggacagacacucauuaagauaucucugugguuguuugugaucucaugggacuagggacucgccagugucuguccuguaucuuugcuuugucuuccagagaugagaaauggccuuuucccggggcuucuuccuaguaauaucauuagcucuuucaucuccgcaggcugcuuuggcuccauuaggauuaggcauggaugagaagcagccuuggaaaucuacagaaagugaugacagguggccguagagguugaacagccuucaucuggacaucugaaaugccccaguauuuaugacuuugagaauugauaggacaucacacucaaccccaugugauuggcaaaauucaggcacacuaaaagugugacauacauuuccuucuggcuaugccuacaggaugcacacagacaucaaccaauuccaugugggucccacuagcuucccccccccccccccgucagcagcuauguucacauauucugaaaccuggaacacuggcuucugcacaccuuggacuaaggauccuugugccagcuagggcagggcgacuagauaacacuggcuauuucuacuucuaucuuacauuugaccuagcugcuauggugguuguacaaacuagacuugccuucuguuuccuuuagagagaacucuggcgagcuaugaaguagaggucaucuucuuugggugauucuuggacagugaguuaaugucugccaaggcuucccuacuacucuauucugcaagaguguugcuuaauuuggaaauccuauccaugagcgagaaguacugcuggccuuuucauauguuuugcuugugugugcaugucuguguguguguguguuuguauguacauuuaugugugcauguggaagacagagacugauacuagaagucuuccccaauuucuuuuccaccuuauuuuaccguugagacaggaucucacaauauucauggcugcccugaaacuuagaucaggguggucucaaacuuuggagaucuacuugccuccaccuccugacugcuggguucaaagacauacccaccauacccaacugacccacauuuuguuguuuugagacagauucucucacuguaccccaagguuccccauucaucuaagacaaccaucaucuuagccauacaaaagccccaaggagucuccuuucucaacacagggacugcaggcacacacugcugugccuggcuuuuuaauaugggcacuggaacucaaauucauguccucauguuugaauagcagcuccaucauuggcugauccacacccccacugcccucaucuaccgcacguaaaccagagacccgcaugauagaacucuuuccugcucucuccuuuucccacuuuacaucauacuguauuccuaguuuuccugaggaacuugguguuuauugucagcuguuucauuauuuuauaauugauuuuaaaacuagcuuccaccuaaauauuuauauuguuuuucauuuaaagaaacuauagccauguauugugagacaugcauauaaucccagggcauggaagggcauguuuuguucgcauacaaaacaaaccuuguagcacgaccuaaaauguuugcugauuuguuuguaauuccuggugugauuuuuuuuuuaaacuguaguguaacauguaucacaauauguaucauuucccaucucaccaagaauccaugcaugcccauaagcccaguacuuaugaggcagagauagcaaggucagagguucaagacuagccugggcuacauaagacccugccuauaagcauaccauuuaucaguaagucauuaguguugauguguaaccuaucuccagaacuccuuagucuuuugucugguaaauuuuaugcacaucaaauaccucagucaaggauggcagcuucccagagugcaauuacucaacgaaauggacuguauuugugaagaaucuuguugcacacuggccaguugcuuuccagaaaguuguauugauuuugaugcucccuucagaguucacugagggguguucuuuuugaaguuaacaucuucuggaaaguaucuaaauggacggugcuuguaggcacucugucugggcuaguuguggacugcugagaccuuaaaagaggguggaagggucuuucugucacccuccucuuuugaacuccccaucugucugggcuucuuagacauuuccauuuucuuucuuuccaggguacaguguugggggcauuaucacagcugagucagaucaaguucauguuuagaaaaacauucagcuggcguccagucgcaucuguaacugcuugcugucuuugaugcuuggagaggcucucggagaucauggaggcuucuuagacuguuggacuugggggagggcacuuagaacagcuuguggcucagaauucuuugaagaaaaggaagcagagaucccacagucauuauggaacaugccugaaauuuguacaaguuacugaucugucgguaguacccaucugccuguacacugcggccgcaugagcggagaaugagagaauguuucacacauggaggagagcacaggcugaggugcaugucuggugagguaguuggugugucucugaggcuggcugcuucuggacacggagaauaaggcaggggacacauaggcccucuucgccuugcagaaacagcuacuuuuaacccugcuuucgguucgagcgccucagacuacaccuuagacucagccuucagcagggacacaucccucugcugcagugacuagagcagagcuucuucccuucgggaaggugagguaugauagccuuccuucuccaaggaguaggcagcagcuacccccuuuccuagacuaggugugacuguaacacaggcauuuucuguuguuauaaaaacauguguucacacacagagccaguguggguuccacuuuguuuuuguuuuuuaagauuuuuuuauuauaugaguacagaagagggcaucggaucccauuacagaugguugugagccaccguguaguugcugggaauugaacucagggccucuggaagaacagucagugcucuuaaccucugagccaucucuccagccccguguguuccacuuugaauucaagggccugaguccacuuauuucucugauuauaacuccuagcucccuaugugcugcauuuggcuauacccagaaacugcuccagggguauccaaagaauaccagcacaccgaguucucugcuagagcuugcgaguuaaggcaguugaggaguggcucagguuuuguuucuuuaguguccagacuaaugcuaauauauagcaaguugccagccacugaugaagaauauaugauuacuacauguaagucuuuuuuaaugagggcaaguguauguauauauguguguguguguguaucauuaacuuccaauauuagagaugauaguugacaaagaguuauucauucuaauaaucuugauaauaacuaauuaucacagaguuuaugauauuugccagacacagugacacacaucaguggucucagcuaucuaggaggcugagacaggaggauugcucaaggcaggucagguaauacugagaccuuaaacagugcgagugugugccugugugugugugugugugucugucugucuguccgucugucugucugucaaugucuaguccucugucccuccuaaugacuacucuugucuuuguuguuuguuuugucagggucuccuauggaguccaggcuggccuccagcucccugucuugccucagcccuucugugggacugccacugggcaccaccacacuuggucuccucccucuuuuccacauugcaccaaacagcagucacagguuuccacgguaccccucaugcugggcaagggaggggcucgguaaggagcaggaggagagcauuccugcuuggcugcuugagcugucagucacgaauguugcacgaagcauuuugguccauuuuucuacuuaauuaaguuauagcguuuuaugacucacagaaguuucuaauuuucuaaaguuaagucgacacauuuuuccauuguaauucauccuguugcauuuuuuuaaaaaacagguucauugagacauaauugcauaccacauaauucugcuauuuaacguuccuagugcaguuuuuauaagacauuuucacaggauugcaaccauugcuuaugggcuaauuuuagaacguuuuuuaaccucaccuaaaaauacccaaacaaacuucacuucaucacuaaucauucuacauccuucucuggcuuuccuucccacucccaagcccugagccgcuucccuuccacuuccugugucucuagauuaccuacgaugggcacgucacacaguuagcaucauaacaagauggggucuuccuugagugauuucagagcaugcuuugugguaugaaucuacaccauucgguugucuacuuaucacauuugcuucuccauuacggacaauagguuguuucuacuuugggcuguuaugaauacagccgcugugaacaucuuuguaguuuaacuuugacaugcauauauguuuuuauuuuguucuugccuauguauguaguauuaguaccaguggguccagcuaaugugccuugacccucgugaugucaugaauuaaucuagcuucucacucuccuucuccuaagagagagaaagagagagagagggagagagagagaucugccuaucucucugucauuuccacacccuaguauuuagaucugugguccauuuuggguuaaccuauguacagcguguaguauagacuaaauuauuucacauguggaauaauuuaauuuaauucacgucucuuacagugcauaaguuccucgaggacaggaguccugucuuuguucuuguuuguaucauuccccucccccagccccacccaggagcccugaaaacaggaucuugucauuuucuuuauguggacgaugggacccuggcaugaaacugucuggaggaggagaauucugguguucuauguuuaccagcuccgugcgauugguugaaaauaccaauggacacagaagcaauguagaaguagugguaccuugcauucauaaagcuuuuaccuuuuaccuuaccuauccagaccacacuggacgguuaauggcugggcuauacgucagcggggagcgcaggggcgugugcuccaguguggaucuguuggcagccccugugcucgcuuacccugcccacacucucauuuuccuaggcuuuucagguuuugcugccuguuuccugccuccugccugcaguuaaugacagcuggagguucuagccaggcacacguauagcagugucagcugcaccccguggcugugucagauggcggcuggaacaagcccagagccaugcucagaaaugaauguuuugccucaaagaaaauagguggggguggggacugugggaaucuuuuugauuauugcugauucacauugaaacccagaaaucacagaggcugguagaggcuguucucuaacauuaaugaguguuagcgugagguaggagcagacagagaaggcuggugcucuggcuugaauccucaaauuuguugugaaaugggaauguugguagggggucggaauggcuggcuguguugaaggcagaguagccaaagacgugcaaagcugggaacugggaaaugaagguaacagagugauuuuuuuuuuuuuuuuuaaaggaaauagacuguggagacuaaugugccuuuccuucucagggucuccucacguggcaauugcaaaaccagcucuagucucuuucccuagucauaaaaggacacauaagguuuucgcaggguuucugcucucagaagcccaccuauugugugguuuuugagacagaguuucucuguauagcuguccuggaacucacucugaagaucaggcugaccucaaacucuagaauagaauagaauagaauagaauagaauagaauagaauagaauagaauagagacccaccucccucugccucccaagugcugggauuaaaggugugcaccgggcugcccagcaaggcccaccuacguucacucaucuccccauagccucuuuacuaacggcaggccaucagggcuuaauacagacacagucuguguuccuacccucgccuccauuaacucaggcccugucauggccacuaagcuguaccuccagucccucucaggauacguuucuuuccucuuuguuuuugugcugaacacggaagccaggaccucaaacacauuaggcagaugcucugcccccgagcuauguaaccagccccauaaccuucauggucuagagcagugagcacugugcccaggaagccuugcugagaguagguacuuauccagaguacuuggcagggccacaccuggcaucccuucuuuaggaacugcuucuccaaggaaauuggauuuucucauuacuuccuucaucaaaaagccugccuugccgaucacaggugccgagugccggcaaacaugucaccuuggaaaggccugggggauaaaucccccacccgaagcccuggucugaguagagugauccuucuaccugagaggggaaaggccucccugguacagucugucugcaguuccuguagucacaggcaggccagacuuggggcgucacagcauggugugcaggggcugaccagagguguucccuuauggggagauggggcucuggugcccuucuuacaggugcgaucuugaagguguuuccuucaguucucaugcugaaauauuaagcugugaugaccugccauuaggggaugggcuuuggggaggagagaacagagagcccacagcaguacuaugugcucuuauauaaguaggcaaagaaacuaaagcuggcuauaccucagccaugcgaggacaccaugagaagaccaauccuuaucuugaauuuucuacucuccacacuauauaaaauaagcuguuuaagcuacuccguguuugguuguucuguugcagcagacuauacugagcugacuauaccacagggcaagccaaauuuaacuuagaggcugauguguagguaugguggcugcuauuuccuugggaaccauaccguauggagcucaucuccaucuuccuucguggcucaguggccaacacugaauucccacaggaucggucuuccagagccuucauccccagccagaugcccugcagugggauuccacccuuagaucuaugacuucuggcaagggugugucauccccuuggcucuguuccuuugacuagggcacaaaagcaguauagugcagccagauccaguuccagcucuacccuagcuccuggggucgcucauggccucuggcuuugcacgugacucaugugaauuggauaauaugcuauuuguggguaauugccuggugaaggaagcuggcuuucagaacuggugacuggaaugaagaggccaaagaaagagauggggcuuggcagaaagggggacauguagguaaggcagaagugccugaugauggccugccuugguauguaugacaguccccacauguucucagacaugagaggccaaugcuucagaaggugguggugacuacauacuccgucuuugcucacuaagcaaugggagcagaccuguggugcagucaagcugacaguaguagccuaguguuuggagcugugcauaggagaaagucacggugguguuccuuaaugcaguuaaaugaucaggucgguacuggaguggaagccuucaugugggauggcuucaacaucgauucucugcucacggcagcuagccccucacaaacaaacugucucuagaugacacugcuguuauuuuuccugucaucgaaacagauugauguuuacuuggguguauaccagauggaguagagaauuuguacaguguacauguagcagaaacaugugccuuguacaucacaauccugucauguacaggacaagugugggcggggccuggcugcggggccagcaaaugagacugccacaguuggcugcguguuuucucuuucuuuauggagaaggugcaguaagcuuugacaguccaagcucuagggacacugcuguuuugggcaggacaguguuucucgaggacucuggauaaaacacguguaugcugggaaguaccccauuguaccagucagaaaagugacagucaaccucaagcucuuuaguaaaaacacaauagggguuucuuuucuugaaaacauuuugcauauauauauacacacauauguguguguguguguauacacauacauauauauauauauauauauacacacacauaugcauagauauguguguauauauauguauaauuuagugauaacaguuuuuauuagagccagauguaaaugcucugagacuugaaugaauauuuaugcauucguuugaguguaugcaugcaaagaggugcuuggaacaagguagcugugaaaucugagcaggucuagccuguacuaggugaauaugagcuguuguauucuguccccgcuuuucuuuuacugcucuaauagaaauuuuuuuacacaggcuuuguaucaucccggcagacagaccuggguucaaguuccaaggccuugucuugguagugcuauaucuuugcaaguuacuagucugacuuccauauagaaaugacaaucaaucaccuaccauauacacuccucccuuccccucccuuugggaggauacagaugccgauuauaaagagcuguguucccagaacaugcuggagaaaagcagugaauguuacaucaaaccggugcuagagaucauacaguuugcucucucuggccauuguuggccucguagaugucauuuaaaaacaaacaaacaaaccuuugacuuucuaucucugacuaggaagccagugcuguugaaaggcggggacuucuaaacugccuuggauuuggguuugugaauguugaugaaucuguucaccucuggauuuguguuuagacauucuggccuuggcuuuaugagcgaguugggccauccauagcuucuguagaaagggucuugcuggauacugguuuccguuuccuguagcaugaguuguucauuccucaucccguggccacuuuuaucgaaagagaugaaggugaaccaugacaacauaagugagcaugcguggagaagugugagccccccugcaggagcaacaagcugaagggcgccucagauggcuaccugagcccuagaagauucugacaggggaaaugagugucaaauccaggaaaccuacccaguaccugaggacugauaugugcugucuuuggcuuucacagcacacucuauuuuguuguaagauuuagaaaaaaacguguguuuguaugcauuugcaugcacacacuuguauaugugcauaggcauacauacauacauacauacauacauacauacaugcaugcaugcaacauacauacggguaccugaagagaccagcagagggcauuggguauccuugagcuggagucacagacucuccugaauugcuugaagugggagcugggacuugaacuccugucuuaagaaagcagcaagcgggcuggugagauggcucaguggguaagaucacccgacugcucuuccgaagguucggaguucaaaucccagcaaccacaugguggcucacaaccauccuuaacaagaucugacucccucuucuggauugucugaagacagcuacaguguacuuacauauaauaaauaaaugaaucuuuaaaaaaaaaaaaagaaagaaagcagcaagcauucuuaacugcuaagucaucucucucgccuguuuucuauuuccuacacuuuguggugucuuacuaaucaauuuacuguugaagaagggaaaacagagucuuacuuguccccugaaagcugugacgaucguauugguggcccucagauuucugucauagacagaaggugaaaaaauaaaguguuccaugaauuugcucugaagcaaggaagagauuucucacagauuacuuaagaaaaccacacguuuauuuguguuuuugcaucuauauuuccaugggugacaucccauguuuucuuuuacccuggagauucucagucaccucggcuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauaucaccucggcuuuuauaugaggugcucaaaggucccuuucugcuccagcuuuccuggacucauuagacuguucagccaggaugccuuucgucacaagaggacacuguggagguggcucucugguggugauguuuauuuuucccaguggccucagaggcacucugaguuccuugagucagucuuucacucagugguggcuucgcaaacuuccauaaacauuuguuucauguggguuuucugaauguuagcugggugaguucugggcuagggaugagggggacauagagggaaauaaacacuuggcuccaagcucuagggaaaacccgcuugacugagggagacuggugauggcgaagucagagagucuauagagugcugacugcuggaaaaacgugagucgucuccucacuggggucacuggcuacugguccacaaggacaaaggaggcagaguuggugacaggguuccagacugacagcgaguacuaacugaaaggacaauguuccaggaccagcuucagggagacagaugaacuuuauucaggguaaaucagggggaaguucuggggaagguaguggggaugucuaggguggguacauguuccugacucaaggcuaagggacugacugagacgccucauuagcagggggaggcauuugaagaaugggcucuuaucagaagaaaggaaacugaaccuauaaucucaccaaggccaugagacauuccgcaggguguaagggguuucaggcucuucaggcaagggcagagaaggagaagcccugcugguaaagggaauauaccauuuuguucugagcgcauggcuuuccaguaaugucagacuuggaccuuaguuagcagggcucuacagaaaaagagugagaaucccuugguuggaagcucagacauuccugugugaugcuggaagggguccuuaguagaugaaguccaaggcagacaggagcuccuaaggggcuucuaguugaccauggaacagccccgcaucccccauggugagaaggaacuugaaaaagugagucagggccaggguggguggagccugagaauagcgagcaaggagcuuuagggaggaagauggaaacaguugcagcggguccauggagccugggaggauuuaaguguuuuguuacuuuguuuuugucaguaauguccuuuggguguuuuuauacagagggaugaaagagguuugagguuucgagcagugucuguuuucugcuugccagcugagaguugagaccgguuggaacuuuugcaguguugggggaugaagaacagcggcuucauucucggcagugacaagagaacgcagugaggcagaggucagccugagaaaauguuaggagaaagaaacucuggcuugcggugccguauuugcacaugagaacuugaggggauagaguauggagaguggcugggggcagggacauugcgucaucacacaugauguuggcguaguggugguuggggugucaguggaccaccauugaggcacugcccaugccucugcucagcagucagaguuuggggggcuaugucuuggcagagccaguugggaaauuugcuagaauuccaguuugcuuuuugggggugaaguuuuauuugaaaaaaaaaaaguuccuuguaccuuuauauuuuucccucaaauacaguuuuuauauuucuaaggugggcaggacuccuacauuuuuuuuaaacauaagagcuccaaggcacuaauugguccuuaggcucuaagucugaggaaugcuauuucugcuggaacccagguggagcuuggguguaauuuacuaccaugcauacuaauuugacuuagccugccagggacuucggaucucccagggaguccuguuugugcagagcacaagggagucagaaugcagaccccacacucaggucucaggccuugaggaagaagguaguucaggauguuaaaggucaaguaugauaaggcaugaaaaguagcuguuagcauuuggaaauacaccaauugaccagaguuggccaucuucugccauggucagacaggaacuacauuaggcuacugugaucucuguuguaaccauuggauuucagcuaccaugacacaaagcagccauggauaauauguagcuagauggucacgguuguagucuggcacacacuuacaaaaguacucgguagucucauucagccaagaccaugguuuuccuugacuuuuaccgcuuaggaagggagaguuagaauuucuugagugcuagacucaauacacacauuuuaaaucagauggcagauguaaguaccaaccccaacaacaguugguggggagcccugggaggcuaggugcuagcucuccuggcgguuacacacccagccaguaauuggcuaggacuugaauuucuccucugacuucaaagccuggcucauccuaccucauuggcuugccacccguugucaagaucauucacgggagcucugguuggcauagaagacacagaggcucacacugcugcuguuguccuuccuguggccagcaguaaaguugagauuuucugcuucuccugugucucuaagugugugggaccacaaggccacaugcaccaccuugagaauaggcgcuuccgaauucgacagcauuugccgauuacuguuugagccuugggugaucuucggggugugugugugugguguguguguguguauuaaagacuuuuuuauuuuaauuauaugaguacacuguugcucucuucagacacaccagaagagggcagcagaucccacuacagaugguugugagccaccaugugguugcugggaauugaauucaggaccucuggaagagcagucauugcucuuaaccucugagccaucucuccagcccuuugacuuuauuuuuuuuuuaauauauaaacauuuauuuuggaguauuuuaggcuuauagaagaggucaaaagaacaguacuaagaaguuccauauggucuauggucaaucucucauuaacacagacguugugugauacauuugauauaauuagugaaccaacagugauaccuacuaaagucuguauuugugggguuuuuuuuuuuuucccaccauuucuaauucacuuuuuuucuggcccacauuaucauaucacguucagagaucaugucuccauagauaccuuuuuguccguugguuugguuugguuuucugagacaggauuucuuucucuacagaucaggcugacuucgaauucagagaugagccugccucugcugggguuagaggcaucuccauauauucuugacugugacaguuucucagacauucuuuguuuuaaugacccugguggcuuggguaugauauuuuguagagugccugcuuauuggaacgugucugauguuuuucucaccaucagccaggacuuaggaguuuggggugaccucuuuaucccgcggagucgaagguguguaccaacaguguaguucgccucucuugguugaucuucgucauccagccaagguuguggcuguucacuuucuacacugaaccuacccugucuucuucucuccuugucuccguccaccacauaaagaagacacuuuauucucugcaugggcacugugcgaagcccacagguaaggcuuggagcaaagcccgucacuucugagcauggaguaucuauauaaauuguuggcgauuauucuguaucuugagagcugucucuuuccccguucauuuauuccaguacagauuuaagugugcacggacuuucagauuuuccccugaguaacgaggagcacucaggccuuugcauccgcuuuggugccuggguggcucuccgugaagcugggugugcugcggcuauccagggucuguucuguuaggccaaguguacaaugggcaggaaguuguugccucugagacugaacuccuuaguguaacugcuaagcauauacguguuaccuaaaaccuuaaaaacauccaggacuucauccugcuuaggguggcgaccauuucuugccuugauggugaagaaaccuuucccagcaagccucagagcuuuugucugaaacuggcaucggagcagcgccaccuugugguaaauacugagucuuccaggaacaaugccuucuaaauucugaaacucuuaacuguucaagcagcaaguuuuaaaaagaaaaauaguuuuguucuuuaaagggaggccgcuacuuugguauauauuguguuauuaccaaguuuagauaaaagauacaugaguuauaguuguucuaaaaacaaaaggaaguaaccugggauuaacagugguuucugcucagucacaaggacacaaggaguuuggauuccugcauucuugucuggcaagugccuguuaacucuagccccaacucugagggacccggugcccucuccuggccucugcgugaacacaggcauggcuauccugugcacacacguuuuugaaagcuucaaccuuaugucaaucucacucagcuuuaguaggauaaucagauacauuguagcagcuuucgcuaauaaaagccccgcaggcaccugggcugugguguguucaggguagaaagccgccuuucuguugucuugaacccagaacacugacagagucagccccacugcugaggagguugcagugaucugggucccugccaggggaauggugacuaaucgccccgcccagaacaucacugcauggugucugcagauguuucagcgcgcagaaggugugugcuuuucagagaucucacuaucaagccugugugucagacacaagcccagucugcucuuccacuuacugacccuguacaguaagguccugacugccgagauggcuuugugguugaggccagcgugcuuccucaagacagccaacacagcacagcagcgagcugccuuguacuuucaaggacaugggcaaugaugcaugauggguagccuugccaccuggguaggagcuggagaacaaggagggaccuggaguucaagaaucccuuuccuuccacuaauauuuugaaaggaaggcuugaccucaccaggucgagagacuauuuuaagaugagccuuucaucucuaaaaugaaucuuacauugcuuucaguguuuucuauuuacaauuuagagcauguuuuccauagcauuuaaacucaguuucugagccuugcauuuauuaauuaaucuaaaaucauauuuaacaugaauaucaccugagacugagacucacacaauucugguaggacgugaaggcuggcucagucuuuaccguuuacuacacuucuuuuuuuuuuuuuuuuaagacuaggaauucucuacuagacauacucugugguugugguagaagugacaagcaugcuccuaaauaacuaucguguugcugcucugaguuuauuucagcucuucauuuaguguaaacucugcuuagguuguaggacagcugauaaacucaacgcaggagaggugagauuagggacagaaaaugcguguuacuaugucaggauuaaaguuggcuucgaguacggagccccgucaaacauauaauaguugaaacaagauaccuacugcccuuucuuuuuagcagugcacauuaccuucaaguaccuuggugccaugaaguuccccucgugggggaggggcugggaggaguugggcaugguggugcucccauguugguauugaaguguagguguuuccuggggcuacgguggcguguuaucuccauuuggugguuucagcuguuugucucucugagccgcaggcaccguccauagaguacuugucugggaaaaugcuuaccuucuguagcuccugauggccacacccuccucucucuacuucuguggcagucuuauccccuccuuucucauacuaacacccaugugugugggaccugucuggaugauuccaguugguuccucaccuuagguuucuuauccuaaccccaguuucuguaagccucuagaaaucaagugacuugauuggggacgugucuuaccuuauuacacacuucuaacacaguguugccugaaggccucgugaaaacuuucuaaguuacucugcacacauguccacaucccuugccaaaggaaagggagaagaggaaauagggacauuucucagcacagagccucagcuucaacaaaugcauuggaauuguguaaaugcuggcacaaugaagacagagagcgguucugcgucccaguauauucauauguucuguuauagucggcugcaucccgaagcccuggaaaccuauggucuuucuccaaacccagaacuuugccuuuucaggaugugauguguagagccguuuaaugcacacccuuuugaggccagcuucuuggcugggugcacuucggacucaugcacgucacaguggguaucgauaaacuuuuacugccuguuucacaaguaguccacugcaugcauaugccacagcuuguccauuugccaguuggaagucacuuggguaguuuccaguuuggggugacgauaaaugaaauugcuuuaacugugagcacacugucuuuuguauaagcacaaguguccuuucccuuggggagggacuuaggggacuuaggaguggaauuggcaggaucauauaguauguacgauauaauuuguaugaaagcaucaacuauuuucgaaagcaguuaaacguuuuguagucucgccagcagaacgggagcuaggugguuccgcaucgucugcagcugcgccuuuuguguggucgaagguguucgcuguucuguaaggucugcgcacugucugagaggggcuuagguaaucuuugauggucucuguauccagcucagcugagagggcuuuguuaacuguaauugaugccaccaucuuuacacuggauuuucuguagcccagacaaaccuugagcccacuguguagccagggaugaccuugaacgcuccagccuccugcaucuaccaucaaagugcuaggaguacagacuugggccacugcaucucacuuuauguggugauggggauugaauucaggauguugugaacacuagccaggcacuuugccaauugagauacuuccccagcucucacacuguuaaaaaaaaaaaaacccaaaacccuauaauucaucuucauucuaaccuaauuauaccuguaagucuuuccacuuaacacuccuucauagauacgucucuguaagagugauuggagucugcaucucucaggcccucuucucccugaugucagugcccagagguuggguggauuugacacagaugagacacagaugauucugagggugaagaauaauauguguguuucuuugguguggccauuucucuguggugugggauaggaaggcuccuauacaugcugagagguggugggguaccugugcacacaugcacaucaaagguaaagccaagggcgaugggcuacuccuaccuuacacuggggacugagagugaggcucaggaguguucugcucugacccguuccuggaugcuggggaggaagaaugaagcaggaacucagcaccuucccacggggagggguccuuaggugggugagacaccugcucuucaucugccucuucaugucucuuagcugacauaagggcagaggguuuaaacuaggugugcuguagccauuguacuaaaugaaaguuugaggaaguauuugcaaauuuaauuuuuuuuccugagaacauauuacuucuuaauuaaguaaaaugcauuuuuuuuuaaagcccuuucuucuugggagucaauaucugugggaagacaagaccuucaaccucuuaagcauuuucuagcgugaccccgccccuuccccugcaagcauuuucuaacgugacuccgcccccucaccugcaagcauuuccuacugugacuccacccccucaccuguaagcauuuccuaccaugaccccgccccuucaccugcaagcauuuccuacugugacuccgcccccucaccucaagcauuuccuacugugacuccgcccccucaccucaagcauuuucuaccgugacucugccuuccuaccgugacuccuccccucaccuucaggugcaucccuggcagugcguuuuccuuucugaugcuuucccuagugacagcacugugccauggcagcucucucucuccuuuuuucacuugauuguaagcuuccucaggaaguaggcaaggucucaauaccuauggggggggggggcgcucaguaguuaagagagcuggcugcucuuccagaggaacuguguuguuuaauucccagcacccacauggcaacuccaguuccacucucacacagacauacauacaugcagucaaaacaccgauguacaugaaaugaaaauaaauuuuacaacccccccauggguggguaccccagaauugcccuuguaaggugggucugagaaugugcauucugacaaguauaggugaccacacucgggaauggagugcccagaacccgcaggggaagaagguucucaggauccugcuucucgcucuuuguauuuagcuacuucaaaggaugcaggcuuccuuuccugcccuaggaccaacggcagagccaucuccucacuggcuguuuccgucucuucggaaaacugggacaugacccuuccaggaaggguacagaucuuucucccagggccaccauaaaauuaauggcucucccuuuuacuuauaacugguucauaccaguugacuacaccuaagcugaagugccuugaagucagauuuuagugcuugcaguauuucuuaauauguacaguaagauaucauagaggugggacccaagucuaagcacaaaauuaauuuaugguuuauauacccuaaagacauggccuggagguaacuuuagacaguauuucagugugcuugugcucugacuguggcuugugacaugaaagcaggugggacauuuaccacuuguauaucaggucucugcucaagacccagguuuaagagauauucucauauucucuccucuccccucucccugcccccaccuuuuucccuuucccucccucccuccuucucuuccucucucucucccucccucucccuucucucccucccucucccuucucuccucuccccucuccucucccugcucccaccucuuucccucucucucuccuucucuuccucucucuccucucucccucccucucccuucugcccucuccccuuucccucucccugccccuaccccucucccuccuucuaucccucuuucucucuuauccucucucucccuuccucuuucucccccucuccgucucuccugugucccucuuucucucugucccccccccccacaucucugucucucuuuguguguuugucugccucucccugugugugugugugugugugugugugugugugugugugugugguguuugugugugugugugguguguguguguguguggugugugugugugugugugguauuugugugugugguauaugugugguaugugugugugugguguuugugugugugugguguuugugugugugugguaugugugugugucugugugugugguguuuguguguguggugugguguguauguguguguguguguguguguuauuuagccacagaagcaucagauugcccuggagcuauaguugcaggcaguuguggugccggaaacucaauguggguucucugcaagaguaacaaauguccuuaacuucugagcugucucucuagccaccacugacucccagcagcuuuuuuuuuuuuuugcggggggagggggaguugguuauuuuuaauuggaagaacaaagaauacuuuugucagggcuugcuugcccucggguggauuguuugacuuugcauuucucagaaugaauccucccgagaugcuagcucuggucuuuggcuauaucugugggcagccaccacugcuuuagccuuccccgagugcaggaugggcgggcugaaaagucccugucuguugcagccucuguugacucuagucuuccuuuuaccauauaccauguuuuuacagcucccacauucucuuuggaaguuguuuuaguuaggguuuuuauugcugugaacagaauccaugaccaagacaacucuuauaaaauuguggcuggcuuacagguucagagguuugguccauuguuaucauggcaugaagcauggcaccguccaggcaggcauggugcuggaggaacugagaguuccacaucuuguucugaaggcaaacagaagacugucuugcaagcagcuaggaggagggucucagagugacacaccccccacagugacacacuuccuccaaggcuccaccuccaaacaguacacucgcuaugggucaagcguauucaaaccaccacuggaauacaggaggaaagaggucaaacuuuagaagcucugucuguauauccuguucuucuuuaaaaaaaaaaaaucauuauggaucucugugaguuuacagucagucuggucuacacagugaguucgaagccagccagaguuacauagugagacccuguuuuaaaaacaaacaauaaaacuaaaccaacaacaacaaaaaagaaauccuuuaagaccggccaggugccaugucuggugcaugcuucuaauugcagcacuuaggaggggcacugagggugugauaccagcuuggccugcauagccagguccagacuacaagacucugcuucuaagaaaagguauaugcucugcugcacucugcacucugccuucuucuuuugugacgggaacugggcugaucucuaguaugccccagcauaccucccgugucugucccccacggugcugugguuacagaugcauaccgauggucauaccuguuuuuauuacugugagcauuggaaucagaacacagccucucguucuugcgugcagcaaguguccuguccacugagcccuuuccaccccuguccugagccaguuuuuguuuuuguuuuuguuguuguuuauuuugucuuuuauuuauugagaccaaaaaucucucacgacugagagcaucccacaauaguuugcccuuugaauuugcuaaugaaaaucauuggcucuagaaauaaagaacacucucccaucgagagaauccuuagccuguuugauuuuccuguccugugcccaucuuccaacaugaaaggugaaaccugagcccagagaaaauugaugggaccuuuacugcuaugcaguggguagccucaccccacccugauuauugcguacacagauacaggcacggaauuguuuuuacagaaaugcucugaaaugaggaguaacuucugcccuccccucuuuuacugccuggagauaaagcccagcuugcuuuaauucuaucauccuccuuaaaaacaucccuuauaaggcaguuucuaagcagcaaaauagcugugugaugaaaaagcccaaaagaguaggaaggccagccucugggaagugugugugcaugcagagauggaguacuagcggggacaaggcugagccuuccauuggcagaguacagcgacugggguggcuuuauaccagugucuuccaggcccuucucugggauuaaagcagcugagcgugucugcugggcucugaccacugaaacucugggacuguaucuucuguuuggcauguuuuucuuuguauccuuggauuuugaggguccuuuaucauuuugggagccccuucauuagcacguagagagcugaggaaagcagauugguauagggaaagagauuuaaaguuaguucacaggcaggguaguggugacauaggccuuuaaucccagcacuugggaggcagaggcaggcugaccucugagguagcccggaguacaaagugaguuccagaacagcccuacgaagagaaacccugucuuggaaagccaaaauaaauagauaaguaaaaccaauauggaauaaguuugauuuaugaucaagaaaaggccauuuaccauauacagcucggauaucuguaauccuagcccuuaacaggaggauugugcucuuaaggucagccuggguaaauuguauauucuauaauaugccauuuugggcuacauaugacuagccugggccaacugagacucuguuguuuguuguuguuguuuuuauuuuuuguuuuuuuuucuuuuuuuuuuuuuuuuuuuuuuuuuuuuuuuuugguuuuucgagacaggguuucucuguauagcccuggcuguccuggcacucacuuuguagaccaggcuggcccugaacucagaaauccaccugccucugccucccaagugcuagaauuaaaggcgugugccaccacgcccggcuuuuguuuuguuuuaaaucaaacaaaacacuguuaccuuaagcuucuuaaucuagaccaggcuuggacacagccauccgacccuuauuagccuacaggaguagggaggucacugguggucuuugugggucuucugucgacaccucagaccacacucuaucaagacuaccuggggacagcacuaaagguggacaacuucucgagcugggagaccacgauucaggagugaccgggaauagucaucuggccaacacguuaaacacguuagcucacacucagaacuggcagccuuguuuuucagagcucuugccggacagcagagauguagcggaagcgucauucucuuugggcaguugcuuugcagccuugccuucuuggauuguguaaggaggaaagcugucuugcuuuagucagugcugaggggauguguagugucuguuuuaaacagaagccgguguggacaggugcugggcaguaauuuuucuccgagugacaggacuuaagggaaaucggcucuucaguauuaaucuggguccauaguugucuggcuuuuguauuuggagugacuuuaagcauggacuuuaagcaauagauggccacuccaggugaagaccagcagaggaggugacugcaccaguacggucucggucguccucacuuugcagcugcagccugcuuggcugacacauuccugacugacacuccuggucaccguacacccuugcuuucuccuggggguguuccucccuguauuaccucaguccuuuuaugacucuguuucagucaagcgacuuauggggcaggaucuuuaguugauagaaaucaucuccccucccccccauaucuuuauuuagauaugacucugcugagguacuacuacugaagaacguucagacugugccacagugugcucaggggucugcuagcuaugggacuuggcaggucugagcuuccccagagaugugcccucugcaucacauccugccuuaguguccaccguuucuguccguauuaccacaguugaguagagaguaaggaugugugucucuuuggcccauuaguauacacauaacauuuuuauuuuaaacccaauuuuuuuuuuuuuaauuuuaacacuacauuucucggggacuuugaacucauccuuccuagaaauaaauucaccugccaggaucagggaagaaauauuccuggcucaggaagagaccuaacucuuuuuccaccccgcugggugggccucacuggucucgcuggguggccccugacucugacuggucugagacucucgggcucucugaccccuugguguuucuguucugcugcauccucugcugcacgaauuuucuucccuaccucaggaagaagccugguucucaccuguagccgucuccuuuccuuggcuguuucuguuuaaucccuuuacugcgacuuucaugguguuucagagggagagagggcagacgaaucuucaucugcuuugcuugauagaaggcgagcacgaauucucuaacgaucaauuggggcaagaauaaaaccucucugccuauaaauguaucuuguuuuacagcguuggagguuccgcuguucgugaaaagcaauuuaaauaaaagggucaugcuggagaacaguuguuuauauucgcuuuacuguuucugcugcuaguaaaaguuaggggacaugcgggacacacagcaugaauaaaaaagccuugcuaccugcucugaagcccucgcucuugcucagucuagaguuccccguggaggcucaauccugggcuucagaaaggcacagacagcucuguggauuccucagcgcuuggagcaaauuguuggauuuaaaucgaaccucaguuucuccgaccuaaaaauagcaaauacugugccuuucuccccagauuacuggcucuccccaggcugaaugcaugcaccugugcacuugggcggccagugggugauaaagguuuuauuuacuccccuguauucuagaucgccuuucauauccagcauuguuguuucugccugggaaccaaauuggucuggucuggguccucauggauuuugcccccacuguaagagcuuugucugcuuguuugucuccuaaccccgggggcauacugagauaggcauaagggggacaugggaaaggaggggguacggugauugaaccuagaugcauccagaucuucuuuuaacaucucagucccuccggauuggcaagcaugaacuuguaagcaagacucugaaggagggauugacccuaggcugugcgugugauaggcgagugcuuuccuagugagcucuguccuuaagcucuuuucacuugguguuuucagauagccucaguaaguggccugggcuggccgggaaguuccucugaagcucugguuggccuugaaccugcgacccuagcuuugcuucucccguaguggaguugagccuacuggacugcuguucuggguguggcuuaaacagauggguguggcuucugaaggcucugagugacagaaggcuccugugcccaccuuucacaguaaccgcuugcuaugccugggaaaugauccacauuuuaagaaagcgccgaacuguuaagagagggugcuuuugaggggauaauggguaaguucuuugaagcccggaacuagaucccuggauuugcugccguugcgcuuugaugaguucuggugaguggggcaggguuucaggagcaguggggaaggcuggaguuguaacagcuauacaucaucagacaguuguaaucagaggcuuugcugcuucuuugcucuuuaacuguaagagacaggauagcagcgcuccgaguugcuguuguagggagcuggggacaagccaaagccuguauaguuuucagcucucaugugccccacucuguuucuuuguccuguuguggccaccuugcuguuucuguccuuccugucaaaugcuuuagccucuuuguuuucccucuucugcaucuugaguguggacguguauguguauuagauacagucuggaugcuguuguguaggcagugguccccacuuagacugugagcauaguuccccauuucuguaaccauuauacuaaaacucaaaacagucuucugacagaguuagauaauuuuugaaaacaaccauguacuucaaugcuucuuuagucauuuguaaucaugccuucuaaaguuugaaguagcauccuuuucuaaaacgaagcuccuuugauaacagccuguuucagaugcaacauauuaccgccggcuggaauuggauuguuuuucuauaggugcuuuuacaguaaaccuuuagauggcagcaucucucaccguaagccauacuuugagcacacucuuuucagacguaugagauguacagacaggagguuguucagagucuguguguaucacccuuucacugugaggacaaggcaggagcacuggccuggucagggcacuggccuaggcugcuuagaggacaagcauugaagcuugccuggaguagugucuaccaccuuuucugugaccuuguguaagcuguaacaaggucgaacaggugauucuggaaaaaggaacgugauauuuagacgucgcaaauagacauuauuuuugcuuuucaagucacuguaggucuaguucauagaccaagcaauucaccuauccagauaugugcaguacugucggguuuuuuuagcauguuugcagacauguuaugaaugauuggugaaguuugauuuuagaacaucuuguuaccucucaaagaauucccucacucacuacccgacaagcuggcauaucuuuagcccuggcaagcauucaacccuuugguuucuguaggcucaccuacccuggaaguuacaugucgaaaggcgucauguaggauguggcuuagcauauuuaaaguugguucauguugcaacaugaauaggugcuucgccucuucuccucuccuaguaaccaguguguucugcucucuccacugaugggccuuugguuguggcagucgugcugcugugaacacagucuacccauuucuauguggauguacgccugcaugugcauagagcugcugggccccaugagaacucuguugaacuuuuugaacaacugcuuagcuguuuuccagagugacugcaucuuuguccccagcagcagggaacgggaguuccauuccgucucauuaggaauuccaagagcuuucucuggaggggaaaaaaagaaaucauaaaauuauaaagaaucccaauggaugugguaauauauaccuguauucacuccagaggcugcggcagaaggauggaugucaguuaggccugccugacucaaaaauaaaacaaaagugccagauccuucugauaaguuuugguugggagagggaaauaagacucagcauucccaguucccagaucugugucggacuguuggccacacccaacuugagggcagcuugugucugcucugaacugacagccuauguauucaagggagggaagagccagccuuuaggcguguuuggguccugguaaggacacacauuguauguucugaagcucuguuugcaucuggaaaaaauuagcuacacucagaucuuucccucugcaggucccgucaggaagcccaaguauguggaaagccccagggugccgggagauccaguuaugaucccguucggagaaggguccaagcccucagagcccagugcgacugguaagaguaccuuuuccaugaugucugcaucuuucccuaaagacuaugcauaguaaguagcauucuccauuucugaaagaaaccugagagucucuugcaagaaugcuucacugaaucaaauguauuugggagguuuuuuuccccuugggcaauugacagagguuuguuuagcuaaugugaauucuugaaauuguauacaaguggcagaaauaguugaguuggguguauuugcaguguuugaggcuugggucuuguauccucugaauucugaccucgcuggguuugggagacaugcaaugccagccaguugaccuugguuuuuuguuuuguuuuuguuuuauacaaacacauuaccccuccagaauaguuaagagcaggcuuuggcugagaaucggagacuuucacuagacaaacucacuuaagagcacauggugacuuuggaaagcuuuuuaaaaguuaaacaucugugauuuuucuauagagggagcuuuggauuagggacaaagaaaagaaaauccaaacugauugaagccucuuuucuuuuugccauaaaagucaaugcaucacaccccacacacuucuaagucaaaguauacguauaacauauguuaaugcuuguggcguucaauagaugcauuaauaguuugcguuuguuguuuauuuguugagacagaguuucucuguauagcuuuggcuguucuggaauucacucuguagaccaggcuggcuuugaacucauagagauccgcuugccucugccucccacgugcugggaucaaaugugugcaucgccgccaccaccuggcuagguuuugcuauuuuuuuaaucagccccaagacuuuguuuguucuugucugggauuugauugguccacagaauguucuaaacccgcaguguguuucccugcacaaacaugagaguaaaacucuuagccuguaaaagcuuguuuuuuccuccggguaagcauaagcgucuaauuacuuccaacacuguaagacacucauccauggaaagagcacucagucagauuuccacuguagaaugccuauggccggcucccuucugccucccccaugguggggauggagaaccccuuccuuucauaaccacugugugcauucugugucugcugaggcacaggaagaaguaggguaggcuggauagugggguguauaaugcuaacugaaaaugaacugaaaugcaaaagcugggauggguaaacgggagaugguuuugggaugcacuggacuggcauguggugcugaugcagucuuccuggcaugaggugaccacccuguaccguuuggguauagaagcagcgcacauugaagauuugugacuagggggacaaagugguugguauauagguauuaaagguuugugguacggaccacuuaggucagauggcuguaagugagggcuuggggacaccacugaacuggccacugcagggauagaaaggaaaguuuauuggggaucaaaccaagacuaucucuggguggggagggggaaacagagaagaguugaauggcagaaaggcaagcagcuuuuguaaauaacauuuucuuuuuuuuuuaagauuuauuuauuuuaugcauaugagcugucuucaggcauaccaggagagggcaucagaucucauuacagaugguugugagccaccaugugguugcucggaacugaacucaggaccucuggaagagcagccagugcucuuaaccucugagccaucucuccagccggaagcaagcagauuuuauauaacagucagcaggguggcaucuuugagcugauaguggcuuuucaauugaucgguaucaagaugcccuugucacuuugggguaaauuaaggaacuuccugguaaauaaaagcccuccuuuagccuucugucuaccuaauaaaaauccuucuauuuaccuggccaaaguucuucuguuuaggacuugucagagcacugccauucugggggccacuuuggaccuaacagaggcugugacauagagagagacagccucucccccuugucuuucuuuguugaagggaaaacagaaaaagucuucaaacgugaguacuggucaucauacucaauucagaugaauucugucaccccauaccagaaucucuacugaccaaaggcuucauaguccuggcuugauuaaaguccuggaguuuugacuauauuagacauggauaccauugggaggauucauggagcuucuaugaaggauucuacugaugugagaagaggagacagacuucaaauuuuuauuggacuaauaagaaaagugguuacaaauaauucucauugucaacuccucaggcuugaggcagauuuggacgccuuuccuggcaggagaagguguguguauacuugacugugggccaagcuaaacucaagagcagccauuggucuugcuagaguggccaaaacuugcaugugugcucauucccaaggucgcagcucucugauuuggcuuccccagaccccgugaggaugcauagguugcagaugcgagcucugagacauuuacaauuggcuaauuuuaagaaacaagguguguuccucuuugugggugugagacagggguaugguucguguuucuggguacauaaucauauguagagauagccacgauguggcacaagccccaggaguuacucuguuggcugauggagaggcaguugccuaacgaaauugaacuugacaauuagcaaaggguggcgugauuugcaauccucguggaaucuuuuaaguuucaacggaguuaauuaagccugccauagcaaaguguaaguguuacguccagaucauugaaccuaaaguggacgcugaugcugaguggaaccaaccgagcuuugaauaauaagccaagcaugcacagaagcacgauggguaaaugcuaacucccagaguuuaauaucagcaucgucacucaaauuccacuugaaaguuugaccuccucgccucccaugcuuccuucgggugcucuuauuuaugucccugugaccccccggcugcugucaguaguauguaacaggacagcauucggcagauuagcagucagucgagcacagcuccuccugagaugccuuggaaauuucccguagacuugugcaguaucaauuuauuccaaauguuuaaguuacuuucuccuccauuaacucuuaguguuuguuuguuuguuuugcccaguguuuggaauuuaaaucaaaagaaaauaagaccaaugagcauacauuuuguuuacuaagcuagccaucugggacguagguucaagcagaugaacuuuuuuucugguaagcaaaaaacuuguuuauuaaaguuuacacaagccuguaaacaucuguaaggaaagacguacuauauacuuuuuuaauauuuugaaauauuuuugaaacaugcauuuuuuuuaaacucuggcaaaaacagugacuuaguggauugagaaaauaauacuucucucauuccucccccugccccccgccucccucugucaaaugguccucauaaccuaugcaccaaagagaacaggcccuuuaugcauaagcauccugucauuaaaacucaguguguuccccccccccaaaaaaaaacaaacaaacaaaaaacaauaccucuuccucuacaggggaaaggaacucagaggaauuacaggugauuacuaaacugcaauaaauagcuuuauuucuucagauugggaacaaucauauuucaguuaugguuguuuuacuagaugauuuagcaaagugugcugugcuagggaggggugagaaagcucccuuaucuaaugaaucaucucucaauggcgacugauaucaagauaggaggaaggaacccuuuuccucagcaguuugguuuccagagaaaagcagcaaacaguacacacuagcuguguggucagugcaugacuguggccucagcacccuguagagaggaaguuuaaggcuagccugguuacauagugaguugcaagccaaccuaggcaacauagcaagaccgugucuuaaaaaccaggacaaagcaagaaugaaacaacaugcaugacgcggcagugucacugagcacaaaaugaucugagaagagcagagggcgucuucugagaucaauguggauggccguaucuuauugauuacuuuuauaaauuauuuauacauacauucgaaaugauguagggaagaaaggagacguaaagaguaauagcuucugucuauucccuaccuagcuuuagaaauaaaaaucacucuaucuccccugauuauguucuccuucguuuccuaagaagguaacccccagccuggcucaucuuuaguuuucagcuuuuuaggugcagugcacccuuuucuaaugguugguugggacucacucugauggaaguguugaaguggacgugccuagugcaaguucagaggaagcgagccugggaguagaggagcuguucauuuuguuucccucaguagauagucauuugugaaagcccuuugcuagggacuguuugagaugaguuaucaagcacgcaugggguccucucuucauugagcuuuggugucuaguaggggauugaagacccguguacaaaguaacugcgguucagagugggaaugguaaugaauacagaccguggggaacuggcaguucagcaggugaggaaaggcuugauggaugcagugugcuuuaggguuuacugguagucuaucuaggauucugugucagaaacacuacucaccucaguaguuuaccuaaaacagaaacggauucccuccgccgcaccccccccaacacacacacacacacacacacacacacacacacacacacacacacacagguuuuugaggacuagaagguaaaaaucaaggggcuugcggguuuguugugcaacaaaggcuccuuccuggcucucagggagccaucuuuuugcuaugaccucaugcugcuuagagugaucacaagguccuucuuucauaugugacaugaaucucaucauggagggccuuguguuucaguaaucaccuaccaaaggccccauauucuaucacacugagaguuggguuuuaacuuaggaugggaggggacuucaacguucaagccauagcaucuggcagaagaacagauggaaagagcagguaguggcuagcauucgggagaauguugagaaaaugguuuccauagugaaaugggugaauacagucuguagagcagagucaagagaggggaugggggaagggccugaaaggaagaggccccuaaucugugugugugugggggggaggggugaauaccucggaugaggagccccaacccuuugauucagcuuguuuuagagagguugucccuugaagaugguagaaaagcuaauaagucagagugcugaacugagagugagaaaaucauagugugaccugagcuauaaacugauaacccauagugggccccaagcuauaagcucagcagauaaaccagggacccuuugucuuagaagccaaaugaagugaguuagaaggagaaagaucauccuauuucgagaagacauggcuaagcagccuugugguuuuuuuguuuuuguuuuuuaaagauuuaucuauauuauuuauaugaguacacuguagcugucuucagacacaccagaagagugcauggaaucacauuacagauaguugugagccaccaugugguugcugagccaucucuccagccccagccuugagguuuuguuaagacacuguaacacauagagggugcucagggcgcaggcaggagaaaccaugcuuccucucuccaugaaucuccuagcauuuaccacucuccaccuugcaggacauagugugcaaaguuaauagaaauggaggaguacccuccagaugcagugaguagggcuaucaucucaggagcgugcuggggguugaaugagugagguuacaggugaguggagaaguaagcauuggugaggacagauggcuuuuaccccaggaaguugagaaaaugaagacuuggcuguagguuuuuuguuuuguuuuguuuuuucauuucuaagaaaugggcuuuucuugaauauaauaguagacuucauacugguucucauaauguggucucuagagccaacaugucucuaaguuucugucuguauuuauuaggucagauuuuucuuucuuaaguagauacuuauuucucgacaguuuuacacaugcauaugauaaauuuucaucguuuucacuucauuaccauuuuuugaggcccaucuccugcucaaacucuaagaaguccucuccugcuguuguguggugugugugugucucacacacacaugcgccucugucuuugcuaguuaacuuuuagugucaacuugacacagcuugcagucaccugagaaguaagucucaguugaggaacugcccagaucagauuggcccacgggccucucugcggaggcuugucuugauucuucaucgacuguaggauugccuagcccacuuugggcggcauccaucccuacgcagguaguccugggcuguaaguaagaaagguagcuaagcaggagcaagugaguaguguucccugucuuuucugcuuugaguucccauucuggcuuccgucucucagugguugauguaaccugaaagauagcauaaacccuucccuccacugaguuacuuuggcugguauugugucacagcaacagcaagaaaacuagaacagugacgcugggaacucucuguaacaguuacaacuguuccucaguagaacuucagcaccaauugucagagcaggguacugccucuugagcguacugauagccuucagugcugccugcuugccacaggacugaacagucacucaagcauucccccgauaagacacugaaaauaauuaguguuauuaaaucccgacccuugaguaccucucucuuuaguauucuggauggugcaguaggaggucugcacaacgcauuucccccgcccgcgcucucugauagcugucuucagguacagcguucugccaccauuugaauugcaagccagacuagcagcuuuucaaacgaaacauaacauuuauuugaaauaaugauuggcaaacuguggucguucacaguugagcauuuaucgcacacuuuauuccaaaggggugaaaugagcaggaaaugagccugucgcuucaauuaaagaaacaagcgugacaacagagagacaccucacggauuagucaccaugcugaagcucgaccuuuuaaaugaaaguuacuuuuuuggggaggaacuuggcguuugucacauugagcuugguagcaucucaggauuuuucaguuaagacucauguaauauuaaugauuacgaugguuugguauuguguaauaaaaugugccaacauuuuuaagauuugcaaaaccagcauuuucccaguugacccaauccacgauguuacaaaaucucgcauggcuaaaugauccuuuuaaagcaggaucaggcuggggguagcucucugguagagugccagcccguuuaguaugcacggugccuuggguugauucuccagcacaaaacagaacaaaacccauaaaacagaucauuggauuuuacaggaccagaguacagaaaguuaauugguacacauuaaagucugcgcuggaauuuaccuuuaagaaaucgcuauuugucaggcaucagugagggguaagagaauagccacacuaaaaggguccucuguuucugagguucuaguucuacaagacugcaucccaaggcugacugcuguagcucagaacugugaguccuugcuucugugcucaguccccagcacugagagagccagaaacaugucucagcaggcugaaugagggguaaaggagagggaaauacagagguaaacgaguugaagaacuuaaagcuaccguguauguagguguacuuuaauguuauggcuuagaaacagcgaauuagcacauagauaaucuguuagcaaaauacugguuuugggagauaaggagggaauugugguggcccagaauuaaccagaaagaaguuaaaaguauaacccaggcaugguggcacacaccuuuagucccagcacucaggagacaggcagaucucuugaguucgaggccagcuuggucuacagaguaaguucuaggacagccagggcuacacagagaaacucugucucagaaccaaagcaagcaagcaaacaaacaaacaaacaaaaagaaaaaacaaagaaguugacauguuuguagcagcagucauagagacaacaaguuaagcaagauguaggccaugaguagaagcgcccgagauaaggacaaagggccugaugucugguccagggcccaccucauccaacacaguugaucaacagauauauccuaggaucuuugugcgcuucagcuguucaaggccacauagcuagugaauggccaagaguuguucacgguaaccagugcgccguagagaacaaagaugagggagaggcuugcuucucauagaugagcuucagggaccguggaggagccccacaucacagagggcuuacauaugcaacuuaauaacggaccucaaaagucugggaugcaggaacagagcaaacccaaacccaguacacaggaaggaauaacagaaaucaaugcaacagaggccggaaagacaacaccaggacucaaccgagacaaggaguugguucuuaaagagacacccaaggcugacagaacagaaccuuagcugggugaaccaaaagacagagggagaagaucccguuagugaugaggcuccagucccagcaggcaucuaacagugucugcuuuaaggagugggggagauuaucugggaagggaacuuguaagugugggucuaagugagaacguuuggugugcgcaguaaagcagauuuuuuuuuuuccuggaauagugaguuuagaagacacuaucuggaccaugaaaaugauaaccaauuacauuuccgggaaagagaaauacaagcagauuugaaaauacaugugaauguggggaacaaaacucaaacgcuagcgaagaaguucagccuggcuggagaagcuggcggggcacuaaccauccugugguucggaagguauuucucacguguugcuggguuugagguucacaaccuacaggaaguggguauggccgcaucauuagucaggagauugaaguucugagagagggucaucccagaagaggugucugauagccuugguacgggggaauuaucuggcucccgagauggcagagaaggaaggaaaaggacugcgaaggacacccaagauuugcagugguggugguggcugugacagagagucagcguagagguuguucuuugauguuugcuuccaaugcauagcacucugugugugaaagagauccauggacuuccuucucacucuccuccgcaugggcuaacuucccacaguggcuccauccugaggauccuaugaggaugcuauugaugagagcaucacuguccauuugcucagcgggguuaccugaggccaguucucucaguucugcauccgugcaucauaaaucugggacacgugagcugaaauuagguacuuccccuuucugguccuuauuccacagauauugggcaaaguauccccaugauugaugaagaaauugauauuugcuguaagaugaggacagccuguuuguucugagaugcccaguggaguguaguuugaucauucugaagcacaaagcagcuucaagaaaaauccucaccuuagcaacauaguggagcagcccugggugggcuuccagacgccucugcucucccagccugcacuguuauucuucacucggggugggggugggguaacucugccagagggguaaagaagaugccgugagcuaggccagagagaugaacggcuuggugagcacuaagggggucagucugaaggggaccuucuaaggagucggucgcucagaugaaguuuagaaaaauuagugucccccaccgcaccccuucaaagaaauaaauagaacaguugggaagccuuuggaagaaaugaaauuuuggugauguuuauggauguaaaaugaaauaaagaaugugugucucuucaucuucaaccauagugggguuuuagagcuuugguaaucgccacaccgaggccgaacagggaacaguuaguucaucaugaauugugaugugucuuuuuaacucagccauuaagccuggaguuccgcaguuuuccagcucaucugaacauggagacugaaggagaaguuuuguuuggcagggguucauuuuuuuuuuuuuuugagacaaaugucuuccuguguagcccuugcuguccugcauuuccuauguagccuaggcuggucucaauccuauaacaacagucccuuuucuucagccuaagugcuauaggccuuuacugccaugccuggccaacugguuguuuuuagauucuuguagaucucucucucucgcucgcucgcucgcaugaaaacuugggguuucuaccugcagguucaguauagagguagcagugacaaggaacaguaaugccccucuuccguguacggauccugcacaggaucuagaacuuucaaacgagucccaagugagccauaggcuauguuugucaacaggguaaauuuuguagcagccaagcaugcauguacagcugcuuuuggccucuagaccagcugccaacaggguggaguuucuggcucuuuccccagaguguuucagguugaaccagaagcuagacuuucuggggcuggaacacagucccaguggcacagccguguggagacuguuuuggaaagagaggggcgggguguggaguagagaagcugcugaggucuguccccucacccacucauuucucucuccaucuucaucucaucccugccccccagucaucuugccaccugagauaaggagcugucugagccccgaagcacacugcaugcagaagggugagguuugcaggaugaagguugugugugggagugggggguggggaggaaccuauagaaccuguuuucccgacucagccuuugggugugucuggguuguguugauuugauuugguuuccccccuccuuucccaagugccaucucccuuaagaauuugugguuugaagucucuaguaggaagggacuuuuucuaggguuuugguaggggugugguucaccugcccugcgguguuucccuucgccuguguuggagugggcccauggauauaaugaguuuaacccaaaugaucuggaaacaucagggcucuagacacagagcggccucaccacuguuguucuagagugacugaaaaagaucuugcaaacaggcuucaugcccugaacagggagguuuuccagagcgagcaaguggugugugucuuuuguauuaugaagaugucaccagccuugucugucucacagcugccguucuggguacacggcauggcaaaacugcuguguaaccgaggaccgucauccauacgguuuucacaaagguuuugcccacuugcacuuugcagaugccguuagagcugagcauggcgguggugauguuagcucacagcauggcuguuauccacccucagucuccucgcucauuguugguuuccacauguuggcaaaagagguucaagcauguguuggcaaaagagguucaagcauguguaggucucgguguuuugacaagccuaagagcaaacagaaccuggcuuaauugucucgagacucacaaauugugcuuaaguuccagcuucaggaagcauggcuagcuucuguguuucaucgcaccccagugggugcuuuaaguugugacagaggaguuagaauaauguugaaaauaguuauuugucagccauaguugacaaaaucuaagugcccuuggguuugggguucaagauuagucucuagcugggcauguaaguaacuuucaacgugaacgcucucuuuaguacagaaauccagaugagcggccuuggaucaucccaccuuuaugugcaguguacccagaaccuuuggcguguggcaugaacagcaguacauuagguccuguccgugacuguuuucacugucucugauucagguggagucuuagauuggcaccugagugggaagugggcuuugagucucacugcucuggaguguauguccagcaaguuugccacccacguccuccugcaccugggucuuugcagcaugcgguuuggguuuuaaugcuggccuccuguggcacuggacagagugcucucugaggauaaggugaagcagaaacccuucucugugguauccuuuucacgugauguaggaauuggaaugcuaucagauaaugacauggaaaauauuccuuuuuucagaucaaauauuuccccuuuugcauuuggaguuucucugugauuguuuuucucaaccuuucacagccucuuaauuagagcguucugcugcuggaggacgggcagcaucgucaaacuuggugcaucuuauaagggggcauaagagcgucagacaggcagcuggagugccggcucguccagaugcggaagccagaacuccccauucgggaaucuucacuguugucuuucuuuguuccagaagcgaaggcugauaaugaaccgagcugcucuccagcagcucaagaacuguugacaaggcugggauuucuacugggagaggggaucccgagcgccacacacauaaccauugaagacaaaaaugaagccaugguaaugccagaggaagaagcugcauuuccuacaugcucagcaugcacccuaccggcacgugugggagaguggggcucucauuacuguuuggucaaaugaguucugggcacuuguguuuugaaauuuaauacaacaguuaguuucugggucucagcuggggauagugguggaaauuguuaaggacaaacagaagggaucagaacuuaagaaaauguccauauuaaccuuacagccauggcccagagaauaucagcuacaugucgucuuguaauaaggguacuucugucuugagagcaccguuacucucacgaacugcuuuggucugugguuuucugugcucucucagcuguugggauggggggugagggggaagucaguggggugaagagaauauugauaggagaugagguagagacaaaaugggagagaaucaaaugucucacccuucagggagacgcacuccgucucagggaacccagccaccaggcucccgccaccugugaaugugcaaguagcagugcaaggaguugggacuucugccucccuccacccagggucucugugaggaggcauggcuggggcggaggguggcgggggagggcguugauggagacugcaguggucaccagucuccuuuccugaacacacagcuuauaaaucuugaggaauaaagucaggcugccgugcuugugaaacauuauagaaacaugguccccagguuuccccgcacagaggucaaauaacccauuugucuucuugaggcuuuaaaugaaaggaagucugccuguuggccaucucuguuuuaugaauuuguguucccacugaagcauugcuaagacugcccuuuuaguugaaaccucaaaggaggcaaccagaacaaagaaagacacaucucuuuuaagcauuuuggaaaaucgugucugucccuauuuagcuacagaaguuaaaaaaaaaugucuccguuugucuuguguuuaaguuucaucauuuuggcguccaaaacaaaaacauguguugaagcacacauacuguguaagccguguuaaccccucccucccucucucccucccucccucccuuccccuugcagugcacagcccugagucaaggcaucagcccuuguuccacacucacaagcagcacugccucucccagcaccgacagccccugcucgaccuugaauagcugugucagcaagacggcagccagcaaaagucccugcgagaccauuagcagccccaguuccacccuggaaagcaaggacaguggaauuauagguaagaagcacacuaccuggcaauguaacggcccgaugcauggcagccggagcacuauagccaccucgugagaggguuccuuguggcccgugaaggucaaacuguagacacaccccccgccccccuuacugcugacaacucgggggcugccugcagccaagagaaugaauuuuagcuucucuauuccuugauguuuauuuuauaucacugcacccauaugcuuuuuuuuuuucuuaaaacaaaaacaaaaacaaaaccccucccaccuucccggucacuucauuccuuugcauuagguccccuuagggcaccacagcaggguaaugaaaugccugcaaauaaagcaguuuucacaaccagaucucaagguugcuuucccgccugaugaccuauggggcuuguguucucugaauguugcuuauaaugggaucuggucacuguuuugaggccaggguuuucuaagaaagccuuccugggccuccugguagaugcaguccugcugaguugaagacugaauucuaaugggcuugagcaauauugaauuaacuccuucacauacuuccuugucuagaaaaccaaggauuucagcuaauucguuagcccguagaccugugcgauauuagaauccagugacucugagaguguucauuuccguaccccagccuggacugauuguucguaugauccugcaggcgugcucagcgguggcagagcagugaucuagggugucugcuuuccaccagcagacggguacagucgggugggacccaaaggcgucacucgagccuucugcuguacaaucauguugauaucacagugggccucuucugaacaguucccggccuucccuuugcugggcuauggccaugucuuugaggagccguuaugugccaucuuucaucagcuccauagucacauuaauacguagucaaauagaccucugagcuccguguucucuggucacuugcgcuuucauccaaguauaauuuaaaaaccaaaucaugcguuuauccaguucagacuuugaagaugcuccugaaccccacacccgugaaaguacuggggucccgcuguagaucucugcauguauuggggaggacccagcuacagccaggaggcugaucucggugggaccgaacucuuacggauccguuucauguugcacucauuucgguuucaaaauguaaucuacgccgggcgugguggugcacgccuuuaauuccagcacucaggaggcagaggcagguggauuucugaguuugaggccagccuggucuacaaagugagcuccaggacagccaggguuauacagagaaacccugucucgggaaaaaaaaauguaaucuacacauaauagucauucccuuaaacuaucgguuaacuucuaguauguucaaaaucagguaccuguccuuacaagcuggucuuagaacacggucgccauugccacgagugacauuccagcagcuugaaauuguuguuugagcugauuuggggaauucuguaugaauggaggccuuaccgcaaauccuuauuuauuuauuuauuuauuuauuuauuuauuuauuuauuucccagccucaaggccuuugccugagcugauccagccaguuggcuuucucaucuucucuaccucuucugcuuugugaauucauuucagcaagcucuuccugcggagcagcuuuguuugugcucugugucugugcucuccuccauggacagaccuuugaugcuaauucagugguagccacacgagacuuccuuagcucuugaaaugccauguccuucugagaauuuaaucucccuucaaggauuuggccacugcuaccuuuuugggacagacuucucaucuuuacuguuagcuugagucuuggcguugagugugucucgauuuuaaaggugccauucaggcuggaggucagacgucugcaagcguguucaggagcagagccacccaucugccauuugcuuuucccuugcucaggugcagggcuggaauguugaaaccgacuuguuuugcaauacaagguaucagacuaaggcucaguaugugugaaccaagcaaaauacagcuaagcuccauccccagccccugcuagcauuuacacacaagaagcaaaggcacuggcuuagcuuucugcucugccagggaaggacuaaacugccaggaagcuccuaacuaacacuugauuuuuguaaucucccccaucucugcuaugagacucuguggucgaugcucccgcagcccacgguggucuccuucaguguacuuacuauuucauuuuggcuccauacggaugagagcuguguuuuaccaacucugggauccgagccgaguaccaggaaggcgauauuaaggagagaauugcugccagucugcaauggcccugaagcagccaccuucuaguugccuuauaaagaacuucuugagauuccuauuuugaguagguuuguuaaaacuuuuacuaucacggugucuuaaguucuuaggaccauuuaugucaucaacagugcuccuuggucgauauuuucccuuaacuuggcuaagcaugaagagcugaauaaauugacauaagaaugggaaagugaggggggggggguuuagcagucucuugagaugaaugggagaccccagcuucugggcaccaggcuugcacugcaucggucaaggcccuggguaggugagagaggcugugcuggugacccgugugccuccguucucucuccucugugaccuguggcacuaaagucuguugccaaggugugguagggaggagaaggaaaagaagcaagaauuuccucuccaggcugacuugagcugcaggugucugaagaggccagaggggaggagcauucuccugcugcaaucucugcaggcugugcagguucccaagcuggagcugacaggcauggaugcuguauuuguggcucugugauugccgggguaggacguguuucuguguucugaagaacuugcugaguuuaugaacugcagccuguggucccagcuauugggcaucauagguguuuaagaaaguaaaagauuuaagaaccccuugaucugacugggcggaaacaaaggucaaacacucugguuucccaccucagaagcccuggcagcgccuuuguagaauguguuggagaggcuuugaguuccaaugagacacggcuggaagagaggggacccagcuuuucuuuaacuuuccauuuuaaguagggguagccacuugaacugggggagccagcauugaauagcaaaggcccaggccuccuggguuuugugugcuuggggcagcaaaaggcucaaagcaguguucugagcacaguuuagucagggcauuaggggacauuucaaaaagugccaaccuguccuuggaaauuccucagucuccucuuacuucuuaggccgauuuccagcacgcugaucguguugaaucuaaaucacuccacccagcagaugcagggagaguagcuuguguugccacaugcccgggcagcuuccucagauaccacagguaccccggcugcauuggguuuccacaguuuagcaaggggccagugaccguuagaacauacuggaccaccuuccaauucuugcucugggagaccagggcuuaaggaacuucccugugccucuucacccuucucaugucaucuagaaggaagccccacuuuauccaagagguccagguucucccgacauucaagucuuuagaagcgcagugacucugucauguggaaguacuggcuaagcggcugggacuaacugcguucucugugagugucuuuauuuauuuuaaagaaaaguucuucuggugccugcucuuaacuuacugaaaccguugguauuaccuggaugcugauuuucagauuugcagugugaaaaccugcuaagugugaaccccagauguagcggucacuguaaaaacaacuugcagucacuugcuuuaaaagaaaagcuuuuauaaagaaauggcuuaaaagguguuuccucuaugccucaggaaauguuuucuuacugacaccccuucaaguugcuuccaacuguuacagguggaauuguaauuuguguuaaucccaguuuagggggaaaagccucucucucucucuauauauauauauagauagauagauagauagauagauagauuauauagauuauauauauauauauaaaaucuauuuacuaauaaaguaaaaaugaauaaaaaaucuauuacuauauggaauauauauucuauauaguaguagauuauauauguauauauguauauauauauauguguguauauauauauauauauguauacacacacacacacacacacacacacacacacacacacacacacuaaucugaccuuccaaauuuuucagaaauacuggguuuuaaggcaucuucugaauuauagcuguucaauuuuuauguccauaugaugauaaauauuuuaaauguguauacuuauuucaagaaaagagauguuuuucacugaggaagacaggguagacucauugaggagaagaaauacaaauuaauccuggccuuucuaccagaauuugauucauauaaauacguagcugugaauucgcuucucugcuuuagcucugcacccacuuuuauuuugacaugccuugaccagcucagugggcacuucuaaacgugccccccccccccaaaugccuaacacauaccucccccuccaguaaucuugaguuaacaucuuuuaaaaucuauauuucaugucugcuaccccagacccaaucagggcaucuuuccuggcaucuuacguguuggcaggcuuuaagucaguuuccucugcuccccugucauggcaauucucuucuccuuccccucucucccucagucccuugccccacaaaaucuaaaaguccugccuccaucucccugcccagccauuggcuguucugcaauucauuauuaccaauugaagccagcuaggggcagggacccucagcaucuggaagcaaggcucuugggguccaaauuaagacaaagcauuagaaccaauucccaacaugaauauauacauauguguauguaugugugugugaauguguauguguguguguaugcaugcaugccugugucuaugugugcauguguguauauauaugugugucuguauguaugaugugccuguggauauauaugcuauacuguucauguggcagucagaagacaauccagcagagucacuuuccuguuucugucuuuaugggguggcagggauccguuuuaggcugccaaguuuguguagcaagcaagcugucucacuugccccaagacuuaaaaaaaaaaacaaacaaaaccauaccaccacaguguguaaagauucuuccucuuuauuaacaauagauaucccaagcagaaggguuucaaguuaaccauuagccacucuggcugaggguggaacuguucaaagccucuucccuuccauugccuucuucaccgcuuacuucggccugcccagguucucacuugcagcauccugcaccuguugcuuuugagagauggugcuggggaaacuccaggaagacuggagggcucugugccauggcccugccccccaacucugaaucucucccagaugaugugucagcuccgugcaccacacacacacacccacacccacccccaucccguuuuuccucuggaccacagggucugccgccugccuccccccaggccgugcaguugcagguggugaaugccaaucuuagcucuuugucuguuucucuuccuuugccuuccuggggugcugauauuugucccccuucccucgcucauuuagagauggggagcaaauauaagcuuugaugggaacaccuucauggaaacauuucucucgcaagaauggcuccugcuaagcuguggggcccucaggccaucccuugcugccgccuggugagaugugcuaacauuggcuuccaugaccaguugcuuagaacauuuaagucauguucuuaucuucuguugauucucucugccuccucccgacuuaugaaaugaaagugguucuggaaguggcccuaagucuguucguuucugugacuuugugucucuaggaaggugaucagaugugguaauuuaauuguacuuucuuuucauuuuagaaucguaagucccacucuuucgauuuuauacuucugcugcccugcugccaccuguaucgccaucuccccucccaaauuagaaugcuuugaaauugauuugguaauaacuauuuagaacguuucaaaucuggguuaauagucauuuugcuacauugccugcaauuuaaaaaucauccuuaauuauagaagccuucuaaaaucucuuggguaaaggaggggaguuucucuuuacauuuaugaucugguaacacaguaaacauggggaaaaagccuugguggucccagccggcagcaucugcaccgacugcagccacugcggguguuuggguuuuaaaggcuguucuauuggaacaggcaagcauguguggguaccugcugugugcuaggacacacuuguucaguauugagacaauaaaaaguaaggcacaguaucuguuuucaaaauugucuccuuaugggacuaugaaaucauuuguccugacacuggcuuaaguggaccucucccauggaagguacuugcucuaggugcguaauaaugccaaccacuguuugcugagagcccuuuuccaaggagccuggagcucuggggcaucacuugagugugccaaaagcuccauuguggaugcaguccauguauagauuuucaaagcauuaccaaagcacugcuguguaacuuguagaaaaagucacauccaggucuucagacauuuuuuuccggagacuuuuauuaccaugccagauccaauuguggcaguguucucguugggagaggcggguccagucgccucccucccacauggcccugccugcaaccauuccuucagguauuuccacaguugaaaggccugaugaauguaucugagaacggcagcuggguccccggccucgcugcguguuguggcaaagcauaccuugcgcaaugcgggugaguacagagcuggagaucugguacagagaccuggcugucacaauccagugcacaggguucccagcacaacacccaaagggcagggcuagccagaagugccaggcucucauucuggggcugugcaagaggagaagccagacagucccuggagcugaggguuuccagggccccgucugggcauucccucuggcaggagggcuagcuugcauucuucccagggaaccuucuccuugcugagcuaauagauacuaggagcugagagcaggugagccaggaacuauuguguguggucugugcuaguguguagagggguuggccugggguuggggauucaagagauguacaguucggcauaccuggccggaaagaugaugucaugaagaauugagcuaugggaaucuauccugagcaacuguuggcaugaggugugguuucaauggagaggacugagaccuuuugucuguccggggaccuagagaacugcuacgguguugccuuugacucucagccucagaguuccuuugcuguguugaaguauaaccucagaagcagucagaggaccuuccuuuggucagggugaggaaggcacuaaaaaggcuggauguccccuuuuagccuauuucuuuccuucuuccacuuccguaagcagccgucauuuuccuuuccucuuugacuuuuaauccauugcucuaagguuuuaacuuugaagcucuucccggcauccauugaacagguguuucaaugcuacuuuguuugucuucaguugucugggaaggggaaagaacuguugugcuaauaauuuaagaggcacuuuaaccacaaccuccuauugaaauguuuccaaccccagggaagggcgugguucucuguagcuccuacugugaacuuggagaaugacugacacccuauucagugcucgaagaaaauuguaauuucuguuuucccuuauuuauaauguauauuuuggggguaugugcuucauaguaaauaaacuagagcaguguauguacauauuuuagcaauguaucaggguacauucugggacucguguggcaggaucagaacagcauucugaggcaugugacacuucaggagcugugggacuuuccugucaguaaggaugguaugggaagugagugaguuaagcuaugacaagggcuuaggccagagcugggcacaccguaaguaaggaagcccuguuaugccaggcgugucaaccacuguaguaggcauguuauuccuuaagaauacucauuacuuaauuuuugcuccuggggggauaaacagugcucauuuguagauauguagugaaccuggaguuuucuuugaggguacaagucaggcaaaggagaugagcgcagagagaagauggaagucaggaucaugaguuguacuugcucuccuaggaguggucagaaagugauguuaaguucccaguggggaaagggaaacacaguugcaugaguuuaugucuguaagauggacauguauccccugugccaugugccuggagaaucuacagugucaguucucaaaggguggagagcccagguuggaucccaaagcauuuguguuuaagauacuguucuaggugugugugcacacugugucuauauaccacccuuucucugcacccauccuuccugucuagcucaaguaagacccugcugcuaugugcagcugaaacuuggucagugcacuaggcauggauucaaguugaaaucugccuagcuugcuuaaugcucuuucaaaccuacagugugauuagguccuagugagauacuuggcucuggaccuacacuggguuuuuuguuuguuuguuuguuuguuuguuuuuucuuauuuuacguguacuuccaacauagaagcugagauaaggcaaagaugguagaggaaaagccaaggagggagcaguuacugucuacccuucucacuacauuauuuggugacugaguggaugacccgaugacagcaaacccucucguagccacagccccuccuacguccuaaacuugggcaagccagggaggucuggccaaugcauugcuugcacagagaagggagcugguguuggauaugccacuagcccucuccaggucugucccugccucuguaaaguggggugggcuccuggccuggacaccucuucccagaugccaugaggauccucauucugugugugccuuugcaucucaggaagguguuuagaaugugugaaugaguagcugacuaaaugugcagcuacuacacaggaagauugacaacuucuccaaguguguacaguaagacaaaaguguuuaccacacuguggggcacaaucuaacuugacagcuugauggaacgugggcucaugugccuuauguccgugguggaagaguggcucagacaaggugagugaugaagacagacauuugucaacaaaggcuggcaucccugccagcugccggguaaaaaugguagaauugugagugcuuacaugguuucagauuaucuuuugggggagaggggagaugucaaaccauauuuagaaauaacuuuaacauuuuguuuuuauuuugaauuuguauagaucuguguacaugucacagauaugccaguguccacagaggccagaaggcuucagauccuuagaacaugggaauuccaggcaguugugagcugcuugauaggggugcuggcaggggcacuuagcucagggccucuggaagagcagccaaugcucuuaacuacugagccaucucuccaaacuauacuuuaggggaggggauauuuucauauuuaauauugcucuagguguguguggcuguguaugcacacauauucuucaaagaauguuuauacuaauaaccuacaaaggaguuuaugcugcuguuagccuggaaucuuuugcagcaguauacuauuuauuaugagagccagauuucucucucucucucuagaagacaggaccugugcugcuugagugcaaggaaaacggaaucacuggccuuucccugccccacugguuugcuucggggccuuagugauagcugagcugagccagcaguccacuguauggcaaucccacugggauuaaagagucucuggacaccagcucucagugcccugcugaguguggccuguggacugccuuuccucauuacaaucugcugacaaugagucccaaccuuuucuagccucccuuccaaguggcuagcucagggcuaagggcuuagcucugcaguagaguacacaggguccugaauauagaaauggcuacacuccaguggagaauuccagcggcucagagcuaacuucuuucauccacuuuucuuucccucaucaccaagacuugaggguucccaccuaucaccuaucacauccuggacaccauggauaaaacguugucuaucccucucugagaauuaagccuucagccuguccugccaccaaggagcccaggccaggcucuuccggcuguucccagcugcuucuuaggacccugaggcugcaagucugcugugcugucacuuguaacaagaaguggggugaucugggucccuuguccuccucuuaggauauuaguuagaacugagguauuuauucaagagcacaugguacagagggauaucaccaugagguacacuuuuuucuuaaggccaggugaugcuaauaaaauagccaagacagggaagccaagcuaccacccccuaccgcacccucccgucuggacauuccauuccccuuuuaucucgccaucauuuagauguuggagcagccuugaaaacuuaacucauaacccgauggcucaggaaaagcacuggauuuaaaacaauuuguuuuaugggacugauuguauuuuuaugcuuuuaacuuauuaacagaguuacuauuaauaaugaauccccauaaauaaacaauaaacucauuaauaaguuaaaccauuccuguaaggcacucacagccucuggcguagagcagaccuccagugagugucagcugcugcugcuaauccgagacagcauucccacaaugggaagagucaccacgcuugcucuacuuccguguaaacggucccuuuccaaacacagugaaggcuggcucuguuccagaaagauggaggcuuggaguggugcugcuagcacaugcaggaauguuggagcuauaaucuugguuucccacaaguugaaacagaccccacucauacuggcuuucuuuuuuggauaggcacggggccgugguccugagcagguaacuguggggucagugggguauagugucugcugcagguggaauugaaauauuaauugcucauucacuuguucauucauucauucauucauucagcaaauauuaacugaguacuuaccaugcucccuucccccugccccucauugcacugucuagaaauggagaaggucaacuugagguucaacacuauaaagguucccacgugucgaaagggcuuauauauagaaagaaaccagagaacaguguguccaggcugcagcagcaagggcagccauagaauuguggcaagguguccuacggccgcagcaaggaaaucauuugucugcuaaaccuucaaaaucauuucaaaacuuaagccauucaguccuucugguccuagaugugagagacucucuccaagcuuaauuaccaguugcuaauucagugugcucuucauaguguguggauaaagcucucccuccaggcagcugggucugagugcacucuagccagcucucucccauuugccaggaucccgcucagaggccuggucugcugggauccaagcagggcauugggcuugguuccuauccucaaggacgcaaaccagcauuaggucaacaguuggggccguucgaguggccggggugaccuguguuacagggcauugaguacugcucagacagucuggaaauuaggagcaucuaccuguagcugcuguguaggguggguucugggcgucacuuucccaucugcucagugcuuuugccuagaugguuugcgguugguuuuuuuuuucccccuccacgguuuuccccaccccuauccccagcuccgguuugcuuuuguagaaguuaaaauuuaauucuaaaaccagagcagaccuucccguacugguccuuuccccaaacuggucauaccaaguuuuccaucugcauguuaugaaacgaggcaaguugaucucugcgcaccuugcugaaccugccuuacagcuguuagcuucaaggaucagauucucuggacuuuaaauugcaucuuuguuuccguauccugcaucuuuucugcgguagcucuuguguuaccagugucuuuucccagcaaguguuuggugggauuggguauuuaaagauucagaggaauuuaaugagauaugagcaauucaucuuagugguuaaagggaauauucauuaucuccaaauuacauagauucacuguuaaaucucagauaucuugacagcuuuuucauuaucuuccuaucaguuuuuuuccuuucccauagaagugauuuagcaguuuauuuccccugauaagcaacauucuuuuaauuuaccaaaauacauuguaugaaauauacuuugauaaaaaucucuguagaccagaaaacuuuccauuggugcuggggagggguguguguguguguguguguguguguguguguguaacucucagcagucccagcugugccuagacuccuucaaaguauuuucaaaguauuucgaucucucauuucagccacaaucacaaguucaucggaaaaugaugaccggaguggcuccagucuggaauggaacagagacggaagccuaagguuagggguucagaagggagugcuucaugaccgaagggcagauaacuguuccccaguggcagaagaggagacuacuggguccgcggagagcgugcugcccaaggcggaacccucagccggagaugguccggugcccuauccucagagcucuggcucgcucauaaugccacggcccaacucaguugcagguaagaccaugccucuccccaagccucaggucccgguuccguuuacuuaauccagacccaagccaggagugcgaucuucucccauaggccucagugcacucacuguacgcucccacggucuguuagugguccuuuuacucuguauugcuuugguaauguuggcucuuuguagccgaggcggggagaaguucccugaggcugcccuuccuguuucucuuaagcaugugugaauuacggcuucuuaauaucucuugacauagcggccguuauuuaaggugaaguugaugacgagaucaaaggauuucugauucaacuguaaaacuuuguuuuguguaguggaagcccgucacagcugggaggucaaauauuucuguaaaauucagcugucauugggaaagcgugugugguagugggagcgagagcaagcugcggcagcuagacacacacacacacacacgcgcacacacacacacacacacacacacacaccccgaagcaugggcugagaguugggugagcccguggagggugaggggagcagccccacucgugcacaucuugaagguccuuccuuucuauacuccugcucucuggcugaauucugaggagguccucauucagguaauucuuugucgccagccuagugcuuaaaaagggcgcucuugcuacugugcugacucuguccauccaaaagaucuuucuguaguuuaugcugcuccuucaguauguacuaggucauucugccuguugcuggcugguuuuuguuuuguuuuguuuuuugcuggagcucugaagcagcugguaaauaaauggccuuaauggaaaaguugugagguacaacucuaauucacuuucaaaggaagcaaaguggccuuguuccagaagagggauuuggccugucuggcagggagacauagaggagagcauuauacauacagauugaugauucuucccaaaguuccuccaccuccacccugcauccccacccccacucuuucacccccaucacuggcuuggaacauaaugcgugguacucaagauguuguagacuguaguuaccuaguuaugaugacugggucacuuguaagguaaccaaucuuuuuuagaauuaagaaacuuacuuuuuagcauguugacaguacucaguuggggggugaaguguccccucuagaagcucuuuguguugucucuggcugugcaaagggacagaggcggugagcugauguuuuuagaggcugcuuggaugaaggcgcagagcugacugguuucugcuguacucaccuguuaccaccugugugcccuugagccagaucuccuuacagcagugggauuuauuuuaccucuagguuggagcagacuccauggccuaauggcuuuguucuugaacugcacugcaaaccagaugcagacauagguagcuguccuaccuugugcuucuguuaccaagugaagagucugguagagucuucacugcccaccuuccugccacccaaacugaaccucagccgagggaacggcaccaugugucaagguuguggaaaagaauccugugcaguugugugaacuggacucagcauugcuuauccagcagauacgaggcaggcugcagacagggaacacucagcaucaguauugaaaucaaaugugaugggccauguaguaagaucuugugaaaguaccugcaugcuaucauucauguaaacaaggaguugucuuuuuuuuaaaucaaagacuaaaacucaguugacuaggauuagugauugggaagguguuuuucagaagguggauucaucugcaguguugccuauuacaucaaaaggaauaagacggacauuuuuuucuucacuaaaaauuaagccucaaagcacuuaaaauuguaucuuggcuagucuagaaguuggucaauagguuuuacuauauugaaaaugauguguguguguguguguguguguguguguguguguguguguguguguauuuugccugcauggaguucugugcaccaugugugugccuaguguccauggagaccauaaagggcuuugagaucucuuggaacuggagcuacggacaguugugagcugccaugugggugcugggaauugaaccuggaucuuuggaagagcagccagcguucuucaccacugagccaucucuccagcucgugggguuuuucuguuuuugacuacuugucuaaucuuuugaaacaauuucugaauggaucagagaccacuguguggaauucuccagaaaaccaacaaacacaauaaccaacugaguuccaguuuucuugaaauauggugauugcccagaacuuacgggcaaauaccguucguugguaguugacccacaguuuagggcaucaacacacacugcucuuuacccagccuaggagaagacucccuuaagcaguuuccuaugacgcacguuaaaaugagcuccucaugaagccguaagcacccggugugcacacacgggcucccgugugccuaugcacauggccuacucacagaggugguagcggcggguuuucuacaguaugagaucauuuaaccucugauuucucuuggcccagagugguuuuuagcauuuuagauguuuacuguguagacugaugugagccuggcucucuguggaagggugcagaauggcuucaucacuuggaggggggcaccuggguuuguggcugagcuuguuccucaucucagguguccuggcgacuucaaaagugcccuaagaaguagagcucacuacagcuggugcuuccugccauacugaagcuuugggcucagcauaaucguguuaguuuaucguuugaaaaagagucucaccuuguaggcucagucuaacaguauuucaagaccccuugccucagccgcccgagugcugcgauucaagaaugugccccacgccagcuuuuggcuauggucuaaguguagaaucagccacgugcaggggcguugaucagucugcccugccgaggacuuugguacagacacugguggcuggaauucugaaaacagagacacuugauguguccccaucuccuacauucaugucacacacacacacacacacauacacacacacacacacgggcucucccuaaccucaccagcgcuuugauuucaaucuuuuauagucuuuuauuguuuuuuuuuuuaagucuuuucaguugucacaaaauuacaaagugaaugucaugcuguaagggaccagggagaggggaaacagaagccuuuugaaacucagugcgucuuuguauuccuuagaagcaaagcccuggcucugaagugagcucuggaccauggcugugaaggcgccucugcuugagccccaaaggagcugggaucccaggccucaggcaugaaccuaggauuggguuucuaguuguguuucugucuggagccuggcgggcuggggguagccuguagucgcugcaggaaguuucucucugugugccaucuguagagaugcuugagccuaccacuggauuaaccugccagucugaaaauccugccugagggaauuacucccuuuauucucuugcuuauauuuccuugaggcagggccucuuguaguccaggcuaaugucauaccguguagguauccuauccuugcuuaaacuccccauccaccccucucuaucuccuaagcgcuagggucacaggcauauacugcaugccagcuuggcugaaucuuccaaaugugggagcuguacauagucucugaccaugagcagaagagcagaacacuuacuuaagccugcacaguauguaauuagacaguggacaugcaccaguaagaugcagaaacaguugcuugcugccugggagggacaguugguagaacacuugcuuggcuguuuuuggaggauaugcaagaggggacugggcaggccucaggcucuccucaaccuuuggugauuguugaauaaagagugaagaguguugaggacaaccagagggugaacaggaaggugaagggggcgcgaagguucaggauagaugcugcuccggggagcucggugcugcuaacagccugagaguuuucagagucucauagcccaguuugacuccuggaccuuguauccugguuuuccuagggacuucaaaaaccuuuggaauguaauuucuccuggaauuacuacuugugcuuaauggccccaauacuacuuaauagauaccuguaugcugugacccuuacugccuuggucagaaguaaacaugauaaugcauauuaaaaauaaauaaauaaauaaauaaauaaauaaauaucauagauaauauuacauauaauaugugauaauguauggcaugauauauuuuauaauuaaugauaaucaauauauuauuauauauacauauauuuuggguucuuuuuguuuuuguuuguuuguuuuguuuuugagacaaggucuuuccuagacugaaacucucuauguagaccagacuggccaggaauucauggugauccaccugccucuaucuuccaagugcuaggauuaaagaugugcagcaucaugccuggcuucauacacacacauuguauauauauauacauauauauuauauauauauauauauauauauauauauauauauauauauauauauuauacacaauauaugguauauguucauauauauauauauauauacacacauacauacauauauauauauauauauauauacacacacaacauauaccaagagcuagccuuuaauguucuaagugcuguggaauuguacaugcaggauccuccuuauuuaauuagaaaggcuggaguuccaaauagcacagagcuguagagaagaauggccugaugucauccauguauuagugguagguucuggucuguugcaagacacugguugucaaagguuuuuuuguuuuguuuugguuuaguuuuuuuccauuaaaaagaaauuauagugaagucaguuucuuuccaggaauaauggugaauccuggcaacuagaucagcauaacauuaagaaugaguagucuuaauuguucccauuuuucaaguuaacagucccgccggaaacaugagcuggcgaaaauaauuaucccgagguaaauuuuguugaacguggagcugagcugcuuaguaauuuagucauuuauaacuuacaguaguuuuagguguggacuuaaacucagcuuugcuuucauauugcagcgacaaguucuaccaaauuggaagacuugaguuauuuggacggacagagaaaugcuccucuucggacaucaauuagauugcccuggcacaauacggcuggagguagggcaccggaaguuaaagguacuuacucuggcaucccgugucacauugaugagcuaacacugaacaaggaaaguccaguaaccagcacccaagcugugccgcaagcaugaugugacgugugucugugcuguucucuaaaaacagugggaucuggagggucugugggagccagcucugagaacgcggggcuucuugcuuaaagcauguaauuaaauuaaaacuuccgaaauggaggaauaauucugugacaggauaguugccacucacaaagcauuuuuguuuuguuuuuuuuagccccuuagaccauaucagcuacauccuagugccgugugucaugcccagcuguguggucacaggcccuaccuguaucaugugggcaaggcacccuugcauucggauagggcuguacccccaaaucugggagucuguguuuggauuucaucugagcaggagcagaagaaaccagucuuccaugugcuuuuagauaaaccagccagacaugacuggggcuuuugcuuugcuuucucugugugcuugaaaauaacuugaaagugugaaaggacugggaguuacuguaacaggauaccugggggaacaaaaaaacaaugaauaaaguauuauagacaaauguauagaaccaaguuagacauguguuucuucuuaucguaaaugauacuaccuuccccuaacgauguuuguuuguuuguuuguuuugaagcacgguuugcucccuacaaaccucaggagauccuguugaagcccuugcuguuugaaguaccaagcaucacaacugacucuguguuugugggaagagauuggcucuuucaccagauagaggaaaacuugaggaacacagagcuggcagaaaacagaggagccguggucguggggagcguaggauuugggaagacagccaucauuucuaagcugguggcacugagcugucacggaagccgcaugagacagaucgcauccagcagucccaguuugucacccaaauguauguugcaugguugcuauuuucuggcuuauuacauuaauauaagauggauggcgggaacugcuguuugaauaagcaggaaugaacaguuuucuguaaguuguucuagcuauuguauugggucugaguucauagguuaagugaacugucugaauauuucuagucauaguauggugggauguuuuguuuuggcacuuuuucugaugggagagggagagagagggucucacauuguuaugggguguauuagcuacagucugggcugauggcagccuucuuguauccuucuaauacgggaacccuugucucccuuuuuccacaaaggggguuugcaugcaaggcuauguuacuacugggcguuuugaucaaguaaccaggggagauuuggaucauaaaaccaaguggucugacuacuggagaaacaaggcagauagaguuuaauguauuuccuuucuuuuuuuggugcgugcgugcgugcgugcgugcaugcaugcgugugcgugugugcgugugcacaugcgcacaugugcgugugcuuaguuuaccucccuuuaucccaugcagaauucuuuuagauccuguuugccacagccuuuucuucucugcuggcuuuaccaaaacuacaaagacuaauaauuuaaaugagagacacucacugugaacaaggacucucugcaucccaggcuaccuuugaaccugagguccucuugccucugccuccaccccugcuccaagugcugcgauccaggcgugccucgccaugccuggcuucccuguuucaggugcccugaaccuaggacaaagaaacuauucuugaaauuugaacaagaacaugagauuuacgugagauuucuguuuuguuuuguuuucgauuuuuugaggcaggguuuuucugcccuggccaaccuggagcccacuuugcagaagagacuggccucgaacucagagauuugccugccucugccucccaaauacugggauuaaagugugugccaccacuacccagcagauuuuuuuuuuaaaccagaagagaugugaccuaggaaggcaacucaccaggggaggagauagggugggaauugguaugcucauuccagaccucauuuugaguuaugcuaguucaucacuauucagauuugucugggacuaauugggaaguauacgccacacucguuauaccgcaugcugacguccagucuguggcucucucuccagccucagaucccacucaggaccuuccugguacuccauuacucucaccaaguucuucuacaagugcucucagugugaccagaacaccugcugggccugggacugcugacagccagagaccgagagaggaugcggugaaauaccucgcuucuaagguaaccugcgcuugauucacgggguccuucagauagagauuugcauguguggcauugaaaaaugaacaacugcuuggugcugaaguguaguguagcucuugauaaaguaugauugaguacuccaaaugaaaggcuuuagugagaauaaguccugacgucaacagcagaggguuuauguccaucugaaccgagcucaaaggguuccuuccuugaggcagcaggagaaaccuugugcucaccacacauccgagggcacaggcgcacgcccuuucauuugcuguguaagcaggagauaagagaagcuuucaucccggcuccaaccacugcggcugccuacacccuguucccuggggccuguaguccugugcuuccuccgugucucugucagagcuuucuugggagguuguaaaagaacccugacugacaucucuaaaugcuugaucaugaaggguuuucugaacuccuccuccuccugcucuguccgacacuggccaccucauggccaccuuucugcaugaaagcagucuugccuugcugagcugucacucagcccagcccccuccuacugucaccugcccccggagggcaguuguuugugacacaggguguccccauaugaccgcuaauucagagcagcccucuggucuugguuuucgaacauuguacuugugacccgcaguaagaggcucaucuuaugcguguacacauaaccacuuggguuauagaagcaaauguguuacugaauugucucuuacccuauguccuauagcguguccugugauuuaaaugaacuucauucaaauuuuuaaaaacuaccugugguuacaguugcauuugguggccugcuuuggguuaccaagaugcuuucgucaaacaugugcaagacaaugugguaccagauagcuuaccaugauuggcgugggcuugggggcccucauguagguuucugcucuucucuguuuauguagaaguugaagggcagugagccuuucucuaagggcuaaugguagauuuaaucuacacuagaaaauacaguucuaaauuagccuaagacauugggucacagcaaaccucaagcuccaaacaguagcagaauuacaguuaugaaguagcaaugaaaauaauuuuaugguugggggucagcacaacacgagaaacuguaugaaauggccacagcguuaagaaggcugagaaccacugcccuaagaaaagcugcuucguauguagauacucuugacucucucgcuaagaguuugccuucuuaggauuccuuggaaggucucagacugcauugucauguugauaugguuuaccuugcauccauggucucugucacacacugaagccucaguggucuguggccugucacugcagcuucugugggguuggcuggguuggucgguggagacucggaccccucuagaaagcccagcgugccucacccgagcaugcuguccuucaaaccccucccucacuucucacucacguucuugcuuucauccucauuuauuucuguagagcacaagagcucuguuacuggcacuacuggggcagaagugggagagguaucuagcaaacaaccugcugccgcugccagucugucuaacggagggagcuugcuuguuggcagcucuucccugccuccccucgugccccugcaauaggugcauaucuuguaauugcuucucuaucccuuugaaugucucuauaauaucccuugaaguguggaugaugggaggaggugagagccacuucugccaggaggaagcggcagcugcgacuuuacagcuuggcuuccuggcugccaacuugauccugugcuuuuuggauaggcagaggguucccucagggugcugcuguucuugagaacggaaacucagggcagauggcagcauugggaacauggcuggcuuggaagcgcucuaagcuaggcuaggcauuagguuuuauuuuuauuuuuuaagauuuauuuauuuauuuuauguauaugaguauacuguaguagcuguacagaauugaauuuuuaggaccucugcucacucuggucagccugcucacuccggcccaaagauuuauuuauuauuauacauaaguacacuguagcugucuugagacgcaccugaagagggcgucagauaucauuacagaugguuguaagcaaccaugugguugcugggauuugaacucaggacccucggaagagcagucagugcucuuacccacugagccaucucgccagcccagcauuagguuuuauaaaugacuuuuacuaaucuacauucaauacagaauacagucauccugaauuuuguguuagucaagguggauuugugccugcaacuaauccgcugcugagaacuuagcaaaucacaccaaugaagaacagaauaaaaguaucaauuaagcuagucaguaacacaguucuagggaccagacacacucugugucuuaucucgggaagaaucaguugcguuccuauuugaguucauggaaggagcuguggagaggugggagggugcuggugcugaugccucugccucuccacaggugguggccuaccauuacugccaggcugacaacacuuacacaugucugguaccugaguuugugcacagcauugcugcuuugcugugccggucccaccagcuggcugccuacagagaccuucugaucaaggaaccccagcugcagagcaugcugagccuccgcuccugugugcaggaucccguggcugcuuucaagaggggcguccuggagccacuuacaagccuaagaaacgguaccuaccagaagccuuggggugcuucccaguaaaggccgaugcccaagugguccucagaaggguggucagcuuagcccuggggugacucaauacacaucugaucccaccacauccguccgcugggggcggcauuuccagugcaacgucucuuguguggaugaaaucggcaaccgagcaguucuaaguaagccuuggaacuauagggaacuguagggaagaguagacuuacuguccuacaaagguuugacucuuggucuacgaaaugagccaaugguagacauaacagagccaggagagcuuauuaaucauguacuguaccuccaguacaugauuauggaugguuacuaagaagagagcuuuaaggcucuaccuucugaaggauccucaauaaagggcaguaacuuuugggagugguaagaugucaaaacaaaacagcaacagcuugggccuucagaggcaggacacugggaagaugaauccacgggaagauuaaugcuaguugcaaggaguucguaagcuuugauacccagacuucucugcuucuccagugccccggacccgcacucuucuucccuucuccuggcuguaagcuaaaagggugggcaaggggcugcccaaacguccuuccuuguuuuuuccaucacaguuguccacauuucaaagaggcauaaucuggucucccccaugacaguaacccguguagguaaugcacacagugaagagucuacacuccaggccucggaggaaacagugcaauguuaggaaucuuccaacguguucucccaccacaccccaucccccagcccccgauuagaugaguugaaaucuaaaccuaauacuguuucuaggaguuuacauuuaguuuuuccuccccacccccaccccucacuuuccccuucccaaguaggauugucaguggcaucauugauccauaaggccuccaucccuuacccugcuccuuuuuugaguuacccgucuacaaagcaucuucugcuaaaagauacugaaaaagagccugaaaugacugucaugcuugcucuguguccugagcagaagaaagcuguugcuguaaauagaaaacuagcuuuaggcugcuguaugaaggaccugcucugggcaucugugaagcagcacuucaccccugagagaguccaaccacacagucuuggugauagugggggagcguuggguuccagcaaagggccuggugucucuucagguuuaggcgaucugcaugucagugacuuuggcugcaggcuacccagguuuaugaaggacuaaccauauuauauauaagauugagauucugcuaaugucuguaaugcaauauguuucugaaaacuguuuuguaagaauugauuuuauuuuggcucaguucucuguuuuucauuauaaauuuaauagaaaauaugcuuuguugaaaacaugucuccugccauauguaaaccuuuuuagguuuugcuaacacuuuaagcuauguguuaaaaugcacuggguggugccauguuauagaaacguauaauuucuuaauauggaaaaauuauuucaucuuuuagagcaaaaaauuccagaagaggaguauaucauccuuauagauggcuugaaugaagcugaguuucauaagccugauuacggagauacgcugucuucguuuauuaccaaaauuauuccuaaguuccccaccuggcugaaguugaucgugaccgugagagcaaauuuucaggugacaaaauacuuccccccuucucuuuccaaguucccacauccgaaguauccagcggcaagcgcuuuuggccuagaguuaaaguccguuuggcuacugaauugaaaaccaauaucgagacuuugaaaaaguaguccagagagucccguagggacaaggacggucacagugucagcuaagcauccuagcagcauugagcugucccuguccuucugaaaugacaguguguaagccuggcuuacuguagugaggugugcgcuggccgagguuucuggccaagcaaucuacuggagcuucuagguguggggacagcuuguuauagcuaugacuuguuucauuucauggaacuggguggucaugcucauuuuuuuuuucuuauuaaaacuugugauuaucccaauggaggagcuagagaaaguacccaaggagcuaaagggaucugcaacccuauagguggaacaacaauaugaacuaaccaguuacccaccccccaccccacccccggcuugugucucuagcugcauauguaucagaagauggccuagucagccaucaguggaaagagaggcccauugguggugcaaacuuuauaugccucaguacaggggaacaccagggccaagaaguggguggggaggggaggggaggguauagggggcuuuugggauagcacuggaaauguaaaugaagaaaauaccuaauuuaaaaaaaaaaaacaaaacuugcgauuaaaccuuacauuuaaauggcacgcuuauuuuuaugacccuuugggucauccauuuucagucguauuucccucauuaagcauaaccuagcagcugggcuaaaacuugaacugguuccuguaucccucugcuguagugcuaagguuagcuuccgugcaaaauggaagcggcugcucacuaccguuuguuuuccugccauuacuaccuucaagggcaugggcuucagaaauguuagugagaaguuaaauuguuucuugggguuaggaccuuaucugggaugacccucacguccgugacccugugcaagucagagucaaccaacaguuugcuuggggcuggagagauggcuuggugaugaagaacaugggcugcucuuuuguaguacuuggguucaauuucuagcacccguauggcggcucacaaccaccguaacucuacuucccuggcauccaacacccuugucguggguaccaggcaugcauuugggacacagacaugcagacaaaacaaaauaauuuguuuuaaaaagaaugcuuaaaauucuuuuaagaugagaacaugccguacuggagcaggcagugauuuuugcugccugguguccggggacaccgggggaacgggaagucuccuguuuccugguaggguuacacagcccuggugucuggcgcagagagggcacuucuugucucagugucuggcugugcucuuagaugugcagugacgguuugugucuacccuuguucuggaaccagcugcucagggguuaugggcaucgggucaccugcagggucucgcugccccuuuguugguguggccugguugcugcugucuccuugggccccuuucccuugcucacuuggcucagaguccucagggggggcuuugggggagauccuaucucgcaucgggauuucuuucacuuaagcuuuuuaucuguaccucauccuguuacauguuuuaauacaaaacagcgaguccccguaauccaugaaaauccuccuugaaagggaacgagcgagccugcuuuaaagggaaaggggaaacucugcggacuaacacugcgagguuuuguuucccgcccccccccuaggaaaucaucagugcacugccauuugucaagcuuucccuagacgacuuuccagacaacaaggacauucacagugaccugcacgccuacguccagcacaggguccacagcagccaggacauccucagcaacaucucccugaauggcaaggccgacgccgcccucaucagcaaagucagcagccaucuggugcugcggagccucgguuccuaccuguaccucaagcucacgcuggaccucuuccagcggggccaccuggucauaaagagugccagcuacaagguggugccugugucucuguccgagcucuaucugcugcaguguaacaugaaguucaugacccagucugccuuugaccgggcccuucccauuuugaacguggcucuugcgucccuccaccccaugacggaugagcagauauuucaggcuaucaacgccggccacauccaaggcgagcagggcugggaggacuuccagcagaggauggaggcccucucuugcuuccucauuaagaggagggacaaaacccgcauguucugccacccguccuucagagaguggcugguguggagagcggauggcgaaagcacagccuuccugugugagcccagguauggcaggcgcuucccuccuuugaccugacuccucccaccaguauggcagggccauacguggguaauaugucucugcuuuagggaauagcaagcuugccugugaccagggaagggguggguguggggaaugugucugucuuagauccuuaauccccuaccauuuccugacuacccuuggccauauagcaccuuaucccuuggccauuuagcacagaugugugaggagaaaggggagcccuauaauccaguuagcugucuccucacagacaaggccaggcaggguacaguucucacaacucaaaccacaggaaggugggagacaagcuugcuugccuccuaguacaagguaggugagaggucaagaggcucgugccuuuggccuccgccauucucaagcccucugucugucuagccugcaucuuugcccucuugagcagcucuuugggucagguuugccuccuauucuagugaugggcuggcaagcugcuggaccgucuccucaggacuuuggugggcaccgggccagaugauugggucuggauacgaaguggccagugaguaccugggaggccacguggccaccacccucccggccuguagugauggguauagugcaggccuguggugcacuuucuuuagguaacacuggacucaggguuuauuaucguucagaccugguuuagcuacagguuggcuacucaaagcagaucaccagaggugccaaagugagagugaugacauugcucaccgaguuacagagaucauuucugagcaaggugagcugcaguuuggguuuguagagagaaagagagagagagacucacaggguguggacggcugguguuagagcaggaaguagcuggaggguagucaucaaugacgcugcauuuuaaacggaggugacaguucagcacaaagcauaucugagugugguggcugcuucaggaauaguaaccacagacacacaguagucaccaggaccucaggauagcgucucgugcauguacccauuucauaggcugucccugcgcugacuucgcucuccucaguacgacuucuguuuucuuuuguuuccaaccauuucgaagucuucuuccgggcaguccuuguucauucuaacgccgucaagguuugccuguuuuccuuauacucugcagcuuagucuuacaucauaagucuuuacuuuugagccaguuuuuuuuuuuuaaaguggugaaagauguguucaguuuuauacucuuuucuuuuaaagauuuauuuauuuuauguauaugagugcucggacugcccagaagagggcaucagaucccguuacaggugguugcgaaccaccacgugguggcuggggauugaacucaggaccucaggaagaacagacagugcucuuaaccacugagccaucucuccagccccaguuuugcuucuucuucugcucaacuaaagagaguucuuucuucguuguauguuagcaucacuuuuguugaaagucaguuggcuguaagaaugugaguuuacucuuguauuccaguggucucugggcuucuaggcuacuaccgugcugcuuugauaacuagagcuuuguguuaggguuugagaucaaguacauucaugcacucugcuuuguucuuuucagucacguguuuucugucuuucguuuugcaaggaugccucgaagauuguggcaaccauuucuaaaaggggauauacaggccagguagcucaaagugcacacccuuaauccuagcacuugggaggcagacgcagucagaucgcugugagcuugaggccagccuggucugcagggagaguuccaggacagccaggauuacauagagaaacuuauguccagaaaaacaaaaccaaaauaaacaaacaaaaaaggagauaugcaguuuuaaaucucggugugaugcuagaaucccugacccccguagccuggguuucucaccuccuuaaccuuucccaaggauuccugaucuagaacuguuugaucuagaacaguccuggcuauuuucuccgugcaguuaacaugaagaagaaaaggauauaagauuauuaauaggaagaacaagcuacugcagacagggagagccaucagaagcagcacaguguguguucuggcaauaauacaucuaguuugacuggagcucucucugucauggcguagaagaaugggacgagccaccagaagaauacgauagagaagaccucuuagcugucaucccuggagaacucuugaagguucuggagaauagggugccugagggaaggagugggaggguacagggcuuaggggcugcugagccggcagagggagaaaguggucggaagguaggagcuguggaucaggucuucucaugucagaaguggcgcugcuuuagagcaguuggagccuguggagaaccucucucaaggggcaggguuggagaagucgguagauugaacaucagugacagaaauguagcgugacuuggugaggccacuugacaugggaagggggaaagcucucugcgccucaggauguagaggaggguggcagggaaggggguuggagauacugagagagguuaagggcaaugaggguuuggaggagacuauuagaaacuagcccugcauccucaggagacuccaucuucuggguuguaaggaggcacaggggagaaaggggaaguuguggcuuggguucaauaaugcaggaaacggggauccuguagggaacaucacugagacuguauugcccaaggaaaaggaaccggacauucaaaggaagggaaguaggauuguuucaggccagggcugccuccuguuucucucaccacaucuccucuuuacaggguuuuucauuucaauauggugauauaugucccuuccaguuggguaccuccugaaggggguacccagugcuguucucccacaagcccaagcucuugagucuggcagacugcccacucuuggcuauuagucauuugaucuuggacaagucccuaaccuguugaggccauuuccucauguaagcagacgggcuaugauuacgcucacaaggucgugagggugaaggaaauagcuuaguuugguuucuggaucuaaaguggagcgcguggagcauggacagaccugguagcaugcaguguggggacugcacagaaacugugauaggacuucuucggacaggugggaagccaugugcuaugcugagagcccuggaaacccuugggcuggccacugaagucugugcuuguugcccacaguggggccaucuguaacugcguaauuaauuauacagaguacuaguuucaucguacgcuuucauauauguauuuaagguguuuucauuauaugcagucccucccaguacccaguuuugcccuucccuuacccccaagaggccuucuccccauuucaugcugguuucuucuagaugccacauaugacagaagccucauacacuuguccuucugagucgacuuacuuaacgugaugaacuccaguuccagccucuuuucuguaaauagcuugaguucuuucuucuuuguggccggacaguacuccacucuacguguuauacaccaugcuccuucauucauaagcuuauuaguaccucauguaggcugauucauuccauagcuuagcuauugggaaggguguggugguaagcacuggaucugaagguguauguugacuuugauucuuaaagguacacaugccggaaugcguuuucagaggaacccccaugcugcuuuguaugguggcuuguacagccuacauuguacaaccuccaaaauauguaagggcucucuucuuggccagcauuuauuguucuauuauugcuguuguuuuguuuggaacuaggucucagguaucuuaggucagcaggccuugaacucauuaaauaucaagaaugacuuugcuaucagauccuccuuaaccacagacgugugccccuccaucuccucugccacacugaggauugaacccaggaucuucacgcaugcuaggcauucauuauaccaagcaaaccuuagcagcagccuuguuucccugaugguaaaugccaucugacaugagauaguuucucaguauauuuuuauuugacuuucccuaguggcuaaaagugaacuuuuuuuuccguauugcuggccauuuaugcuccuuuugagaagugucuguucacuucgcugguuggauuuccuguucuuuuguggaauguuuuugaguucuugauacguucuggauguuaauccucucucgguugaguacccgguaaggaucaucccaugcugugggcugucuccucacacccaggaauccuuuccuuucucacaguccucucugucugcucuuugcuacuugcugcuguuucuggagacauuggacucugauucagaaagccauugccaauguagguaucugagaguguuuuucuuagaagauucaaauguucagaucuuacauugaucucuaaucaguuagauuaacuuuuguguaggaccagagacauguauauaguuccauuuuuuaaaaagauuuauuuauuuauuuuguaugacuacacuguagcuguacagaugguugugacccuucaugugguuguugggaauugaauuuaggaccucugcucacuccagucagccccgcucgcuccagcccaaagauuuauuauaaauaaguacacuguagcugucuucagacacaccagaagaggaugucagaucucaugacacguggugagccaccaugugguugcugggaauugaucucaggaccuuuggaagagcagucaguuauucuuacucgcugagccaucuugccagcacuauaguuccauuuuaaaaacgaaaaccacguggauguuuuccagcaucauaaauuaaggaaucugcuuuucuuugagcacacauuuuuggccuuuucuggaaaaucagguggccauagucacaguguuuauuccuagggucucugguuggguccaguggucuauugaucugguuuuauuccaaugucauccuggcuuuuguuacuaugacucucuaguauauuuuaaaaucaaauauuguaccuccaguauuguucguucuacucggaauuguauuuggauuuuccacauuuuuguuuuaucauaugaaucuuaaagauuacuuuuucuaguugugucaagaaugccauugguauuuuauagggaauuuugcauugacuauauagaucccuuucaauaauucgaccauuuaagcagugguauaucgccagucuuggaauguaggacauccauuuucuauuaucuucaagucucuuucuucaaugcuuuuuaauuuucauugcagagggcucucaccuccuaacugugaauggaauuguuuuuccuggguucuuagcagauuuguuacuaguaucuagaaaccuacugaguuuuguagccugguacaaacuggcuguugggugccuuuaaccccagucauaacuuaggaggcagaggcaggcaguucugugugaguuugagaugcauggcuuccaucuagucuucuacacuacuccucggaaacuguugcuaugcagagccugccuuuucuucccuucccccauaaggccagaccugucuccugcugguuaugcuccacuagggauaauggggugugaggugagguugggggaggccugaggccagaggaucguguuccauccuucccuauguucauccaguaaguucuuccuuguguaucugcuuagaauugggccccuugguaggcaucaugauucuggcugugacuuaaugccaugcaguuugcauuuuugugugacaggcuugagcagaaauccagguggugagagagugaaugugaugagcaggcagugauguuucuggaaagucaggcaucagggucaccuaccgauagggaaccccagaagaggcccugcaaaugacugcagaauaaucauuguuugcccucuuuauaaagaguuagcagccugaauguucucugagcucaugcugccucccacagaugacaguucaggggcacagugggauguccuuaucugagggccuguggugugaagggaugggaucuuuugucaugagcuuuuguguuucuuguccuaggaacggacacgcucuacuggcguucauguucucucgacaggagagcaagcugaaccgccagcagaccauggagcuuggccaccacauccugaaggcacacauuuucaaggugaguuguggggaguuugugguuugauuuuagacagucugugagccaucucagaagugucugugagcccugcauccauucccuacugugcauuacaagucagagaaccagagcuccauccaugggcauauaguuucauaucgccucuguucucugacucuccuugucucaaagugaugcgugauaugucccccuucccccuagauuuccuguguagagcagugguucgcaaccguccuaauaccgugacccuuuaauacaguuuuucauggagcggugacccccaaacauaaagugauuuuuguuacaacuuuauaacuauaauuuugcuacugguauaaguauaaaaauuuacauuuuuuauuuuaaauuuaugugaguacacuguagcugacuucagacacacuagaagagggcaucagaucuuauuacagaugguugugagccaccaugugguugcuggguaucgaacucaggaccucuggaagagcagucagugcucuuaaccacugagccaucucuccagcacaauaucugcauuuucugaugaucuuaggcaaccccuauaaaagggucauuccacauuuucucccccuccccccaaaggguugcaacccacagguugagaacugcuggucuaaagccuuuacugggugugaggaguuuuuguuuugguugguuguuuuguuuuguuuuuccacuugcuaaguaccaagauuugaauggugaaaauacucuacaucagcagacacagcgcuaagcuugugucuuauuuuggaaugccaccaaccuuuacaggccacugccuaggacuuauagauggugguucucucuaacuuuacuauuuauuauuccucugguuuucuucugcaaaaggaagcuuucuccuuaugcacacguucucucucucucuccccucccuccccuuuuccucaccucuuccucccucucccuccccgucucuccuucucucucccucucccucccucucucagguaugcauauaguugacagggccuguggucuccugaucuuccauuauagcucaccaaccaagguguccuuuuguauaguugcucucuguacagaggaguaucugcagugugcuggacagacucacuuucaaacugaugcucagcugggaugagacacucacaggugucuaucuuuggucguuucuagggccucaguaagaagacuggagucuccucaagccaucugcaggcucuguggaucgguuacagcacagaggggcugucugcugcccuggccucucucaggaaucucuauacucccaacgugaaggugagcagcccucugcacaggaaccuggccuauuccuccucugccaguccugccaccauggcuccugagagggcagagguucuccuggugaugucuucccauccucaucacacacacuucccccuagagguccggcuuugcugcugcaggaagaucuggguagauggggccuuugugugagcccaagaccauuucagaaagggagaugguucccaaaggucagagagagagcuuugcagggaaacuggauuuuuggugucccaaauuacuauagcaacucaacucuuccuggaucauaugaaauugagcauugaggacacaaaaggaugggucacaggaagcuaucugcagguuccuuccaggagcgcauaccauaugcuucuggcaauggaaagaguguuccguugguugcgugcagagcugagaacgucuuguucugugguuagugacuuuccaaucgggcuauuccugcuguacuuuugcagacagauuuuccuuccccauuuccagauuguacaauacagucuuagaaucaaaaucagaccguaggccaggucuuucugguuaaggccacacagcagugccgagccccagcuccugacacgcccugcugcagaaaccuggaacucuuucccaguggacugagugcugacaaccacugugaagugauaauuguacccacucccucacagcaacccagaggaagcuuagcauggucauccugugagaggaggggaggccuggcauucacuucaccucagaaaaggggcugcaugcaccagagauggagacaugggagcacuccugaacccuggcgugccugcuguuccucacagcacccucgacacaucccucagcuguggcucuggaguguggacuuguggagccuuccccauugcuuuggggugcucugccuucuuccugucccugaugaguuugaaaaguggggguaucacaugcauguccaaggaucggggguaccagggagaaccuagcagugggugagucuggaaggaucacccacuacacugcuggcauaggaucuugccaagagagucuauugccucucgguggauacagauaggguuuguagggauaaaaaggcuaccuguggccucccaaucucugcugugcagcuucagcauuguccuuaucuggguacccuggugugcugcaauauacccgugcuccuugggacccugcacacagucucucccuuuaggcucguagcuuucaaugccuuuuuccucacuaaaccuugcaugcagauucacacugcugucccuugucccagguaucccuugcuuuccagauggagguuuuccuaaaguggaugacucuaaauuuagacaucaagaaaagguuguuguguugugaauuuuuuuccacguggauuuuauaagaaaucagguuuaaagcaagauuuugcugaaaggacccugauauagcugucucgagugaggcuaugccagugccuggcaaauacagagguggaugcucacagucaucuaauguauggaacacagggcccucaauggagaagccagagaaaguacccaacagcugaaggggucugcaacccuauagguggaacaacaacaugaacuaaccaguaccccggagcucguaucucuagcugcauauguagcagaagauggccuaguuggcuaucauugggaagagaggcuccuuggucuugcaaacuuuauaugccccaguacaggggaaugucagggccaagaagugggaggggguggguaggggagcaggguguggggagaguauagggaacuuucgggauagcauuugaaauguaaauaaagaaaauaucuaauuaaaaaaaaagaaaucagguuuaagugacuauaacauugguccucuuucugagucuagcaagcuuuuggcuuaucuguaaaauuaguaaauuauaaaagaacagaaggaguaggcuggcagcaccugcccuccauacuuuaaugaauucauggggauagacauuuauuuacauaggcuguaaguguggagaaggguggaugggaaaugucacacucucuugaacacggguuuucaagacuggauuaaaaggccuuccucgcuaggcugccugcuuuccucggaacacacuagcuauuuugagguguucguuuuuaguuuauaagauuccaguguuaccuaccucugcaccauccccagauuuacccagcuuggcucugaaauucucaagucccuucauuaucuuccuguuuugucuuuguaagucuuugaugagggggaaaacgguuuucacagaauauugaacaaauuacaguaauuuaaaauuaugcaugcaauuaaggaacuguuuuuagagaguauuaacuguugucauacaggaaugaaugucauuuugaaaauaauugcaguuugccacuuuggcaaauuaaaaugacuugcuccgaaaugagggcuugguaauuucggaagcaugcuggugauggcuagcccuguggccagggucauggcagccugugccugcguggcccacugggauccuugccacacgagccuccaggcuccugcccagcugguucuugccucaaguguugucauauggcuggugccagccccugcccauagaucugggagcauuuggcuucugauguuuuucucuccugaaaggagaggagaccagguauaaaaaagcagcgacguggccugacuuuccuuggcugggcucagggagguuguaccucgggccacaaucaaggaggacagacuuuucaaugucccugcuucuguaagcuugaguuggcuggugcuucuccggguccucauugucaggggcgcuucacuacccuccugugucuccauaaguugcuagguggccuugccacuugggaguguuagcuaaagagagcuuccauggugaagacucugaagucuccugcagaugggcaggaguguauaggaugaguccucucccccuuuccuguaggccacauaguauggccacauaguaucugcuacaacccugcuguguguccuuguugcuccagggacagcaauuagcuuuguguccugagcuaucuuugcccuacccgcucagagccucuggguccucaccucugaaauggagacaacaaaacuggcaucucccaggggucagaagcuggcaggggaagcccuuggggacgugccuggcauggcucaugugcccaggugaguuguuuuuacugcugcuccccucagcucuggaaacugugaccgcaccaggcugcaggcacuggggaucuuugagacgguagcuguaacucauguaagggcugccagccugcugcucugggcuguggauagucuagggcugcacacaagacaguguaggugggagacgggucuccagggaccucccucugaagacuccacaaaauggugacggguaacaguagcuacauauauuuauuuaacucuugaaaugcuggguguagugcuaagucagucucugucuuucucucuccuuccuucacccucucuccuuccuucccucccccugccucccucucuccuugguggggaagggaguguuauuauuuugacacucauuuuuaaucuuuucagccaccuuggcaaugguacauuuguucucauuuuucagcugggaaguggagggcuggggacacagaggauggcgggagaucugauucuaagccugccccagugugucugugggugcauuugucaccugguaucuuuacagcccugccugccaaguccauucucuugggaagcuagguugccagaucuccaggcccuggaaaguccaaaucuccaccaaagguuuccaaagagaccaugcugagaggguggggagacacugcucacauccuagagggaccuggaacacuaaaaaaugaagacuguuugagagucacuuauucagaucauuuagccucucuuuuuuccccccuuagguucuuguauaucaggaaaggauagggagggaacguguaguuggccagcaaaaucgucacacgcuauuccugcuuguccuguggugggccuuaggaguuuguauuuauguguaugcauccuguuucaaacugauuucccaggccuuuauaaacacccacgcauuucuucagcauaauguuguuuguuuuuuccauacugaucuaguuauucagaagggauuuuuuuuuaaagaaaaaagucauuguuuuuauuuaaacuuacaguuuuuaaauaccuuugcacuuaauuguacuugagucaagugguguuguagggagugaugaaccuguuuaacuguauuguaagaaucagucagcuuguuugcuagauucucacauuucugaguaccuuuuccucuguucuacacacacacauauucacucauacacucacacagauacacacucucauacacacucacacacucacucucacacacacucacaugcacacacacacacacacucucacauucacacacucacacacacuaucacacaaacacacucucuuuccacauauacacacacucacacacacucucucacauucacacagacacacucacacaccucucauacagacacacucucuuucacauacacacauucacacacucacacacacacacucucagucacucucacacacacacacucacacacacuaugacacagacacacucucuuucacauacacacucacacacacacucacucucucucacauucacacagacacacucucuuucacauacacacacacauacacacucacacacacucucacacucucagucacucucacacacacucacacaugcacacacacacacacucucucacauucacacagucgcacagacacacacacacucucacacagacacacucuuucacauauacacacucacacucucacacacacauacacacucucacacacacucacacauauucucucucacacacacacacacacacacacacacacacagucacacacauacauagucacagugggagagacuggauugguguugaccugggucuggcuauacaauuaugaugauccuucuaaugagauaaacagucaggcugaugccuggguggccagauggcuugacagggcacccucauuacaaguguguagcuuaccauuucuugucacuaaguauuggccccagugaugagaaaagccuagcguauguguggucccugaccauggaagagcuuuuuccugcaucucuucucugugaacuucuguuccagggccaauguccauugagugcagugagcuaagaauacaagaacauguugagagaugaagagggcuuggagucuaugcccuaguggagugugcaugaaguaggucggggauuucacuuugcgggucuguguugaguagagacccauaauaaacagccuuugcugucuguggcacaagcauccaagacagcggggucuguucagaguugcuggggcagggggaccugcacuggagggauggcccugcaaacaguguaagagagaacacugggcggguguguguguguguguguguaugugaggcugucuuguggacuccaagcuuaagcagcaauggagacaucugaacauuucauacuuuagguucuaccauguccagaugccaucgagggcuguaguuucccuacugauaguaauaaucuccuguaauaauuuguaaauauuccaucugcugcucuauggacagggcacuaaacuacccagaauuuuuauguugcccaucucuugccuguaacuuaugauccccgaucgacuccagucagauccaggucucugagguuuccugcaucuaaccgucagccuugaggaucucccagggcaggguuggacggaugccgauuggaguggagcuguugaaagggacccgcuaggugugaaaguaccaugggauuuuuccucacaaucuggagaugggaaggagauuaguguggcuagaaauguccgucuguucagugauuucauuuuaauaugugcagaucagaaacgcccccugcuauccaaggccgugcugugugcagcagucagugugaguggcagagggcaugcugucagugugcugugcugucgucagugugcugugcugacgguccucaggacaugcgacauugcugugcuuucucucuuccuugucgagagaagggacuauucguguuuccuuuuggcuuuaucucauuaaggauuuaauccuugcuuaucauuucauuguuaaaaugaugaauuuuuucuauuugguggcuggucaggucuagccccuacaguaauaauaccaguguucgcuggaaaucauuaaaaaugugccacccaggggcuagagagagagcucagaggucaagagcacuuguuccccugguaaagucccuggguucaguucccagcaccuaugugguagcucauauaguccgguuauaggggaccugaugcgcucuucugaccugugugugcaccagaugugcaugucaugauggcacggacacacaugcaggcaaaacauccacacacguaaagucuaaauaaauaaauaaauacguuuaaaaaaaacccaccacccaguguaggggacgagggaggaggggguacugugcguauaaaaacauuuuguuggggcuggugagauggcucagugguuaagagugcucuuccaaaggucccgaguucaaaucccaacaaccacaugguggcuuacaaccaucuguaaugagaucugacgcccucuucugguaugucugaagacagcuacaguguacuuacauauaauaauaaauaaaucuuuuuaaaaacauuuguuuucacuugugaugaacuaagaguccauaguagaaaauauaacaccuaaaucauuuuuaaguguucaguucagugaaguauauucacauuuaauguuguaaaucucuaauacuuuucauuuggucaaucucguuagccauuagacacucuucuuuccacuguccauggucugggagcugugcucagcuuauguccuguuugaucacugaggcugcauccuuaauagucucaugugaccacuguggcuacauccuuaauagagucauguggucuuggucuuccuguuuauuuaacguauuuuuuuauauuaaucucugcuguagcaucccgcgggugaguuccuuucuaagccugaguucugcacugguggcauguccaucucugucuacgugucugcuguggggcccuagguuggcuucacgucucagcuuggugaaugguguugaugugaaugugucucacauuucuucaggauucugcuuucauuuuggauguagccccagaaguggguuugcugcgucacaaugauguucuguucuuucccaugauuuggagaaacuugucagguuccuacuagugaagaugcacgugugugagugugugugcauuuccugcuggucagguuuccacuagugaagaugcacgugugugagugugugugagugugugugcauuuccugcugguaugucucaagccugagguccaguaggauaaaacaggaagauugcagauacuuccugcuucuccgauguguuaaaacuaacauacauaugagauauuaaucuugccgggggaacauugcccaacaggugagccggcuccugauuuugggaggggccaacgugaacuacaggacagaaguguuaaacaaugcccccauccugugcguccagucucaccuuggccaugaagaaguugucacucuccuucuggaauuuggcgccugccuggaugggaugucggagaacgguaugaacgcacugugcuacgcagcugcugccggccacaugaagcuggugugucugcucaucaagaagggggcaaggguaagcagcagcgguuuugaccuggagggugacaacagggugucugagagggugggaaauaucuuccugucauuacugggauuguuggccccugggccaggcaggcuucaugggcuucaugcagugacuugagaaauuauagaaucaguguagaagauucagugucugacugggagccccaggagggaaugguggccacauaugccuaugccauugcuuuauuggauguuguacgaggcagauucccagcuacuggccacguguucuguuuuccaucacuuagaggaacuugagcaguuccuacuggugaagauacacauguguugcacuauccugaauuuauucuagaaucuaacauggcaucauaauuauuuggaagauguuuuuucaaaagucuuuuuccuacauuuugugugugcuugugcgugugugggauguguguguguguguguguguguguguguguauacacacacacacacacacacacacacacacacacacacucauacauacauacauauauaugcaugcgcuauguggcauaugaggaguucagaaaccagugcacuggagggaguugauucuuuccuucuacugcauggauucugggaaucaaaccuagcagcaggugccucucccugaugagcagucuugccugcccuggugaaauacuucauguuucauguccccuucuuguucuauuccauuucguuauuguuuuaaaacaauccugugaguucucugguucuuagagguccugagcuugaguuguggaagcugccuaaugucaucuuuccuuuucccuucuggaacacugggccucucucugucuguuggaaucccaugaccccaggagccuucuaccaaccucuugcuguuaccauuagauaacugucugcuacaaugaagugagaugaaugcugagcucagcauaagcccucuuuagcuuaauauaagcguuauaugcauuucacaggcaagcgagccuguugagugacagucgauaaagcacuguuuguugucuuuugccuaguuaguuaauuuaggcuuauaguagguacagaaauguuauaaguccagcauuugggacacaugaaccucagcucugguguuugaaauaaagccuuauugcuauguggcauuugccccaauuucuggauaccagcuaucucuuagcuuucuucugaguccagcaguucuuccucugucauaucugagagcuugcagcaagaggcuagcugucauguuggggacucuugcagaguccaaguuaugaggcagcaugccccuaauuuugcaaacaaacaugucagagcugggcuuugggcucuuuuucaguccugggacuccuuugcuuagauaaggaauucaggggugccugcaagcaucaggccuuuaggagacaugcggcacucacacauuucuucuaacucccuggcacccccaacuugugucuuuccuuuauaauaaaagccaagaugccucccuguauguuuuccuuucuguccuuccuauagaucaauguucuauucuauaagucccuuccuuucuuuggcucccugguuuagugaccaaccucccucccaucucaacaucugaaaauacuucaucuuagugucccacugggaagcauagggcuuugucugaggguucagucugugagcuuuauguagucugcugcgagaugccugagugaggagacugucuugugguuacuaguccugccaagggaaccugaggcauggauuaguguucuuaucccagugaaaggagucacagguucagagcuguccagaaagacaaguuggaaugugaacccuugcucuucugcaguagcgugaauuugcauguagccuucagggcacaugugugugcucccagaguaaaaggaugcucaccguuaccuuuccccgacuugugcccccagguggaccacuuggauaagaagggccagugugcacucguccacagcgcacugaggggccacagugacauucuccaguaccugcugaacugugaguggucggcaggcccuccccagccuggcacccugaggaagagccaagcccugcagcaggcacugacagccgccgccagcaugggccacagcucggugaguggggccguggggguuccuucccgagacaugaggcuuugcggcccaguuguuuggucacagccuucuaaguugagagccacaggcaacaaaagggaauggagauuucagaaaguugcuguugacccugaccaauggagugcuucuagugcugcuguccuggcugugaccaaggugggggaugaaaugcucuccucaggagcccugcuggcuguucagucucucccgcucucacuuccucuccuguuugcucuuccuuuaccuggcucuucccucccggucccuucaguuccuucuuuugucccuauauauauagccuuuagacuacaaucacauggaacccuaguucugaaaucauuccugaguauuugaaggguuuuuaaaacucaagcuuggguguuuuuagagcccgugagaaugaaugcucauuauuugaaguugcuacaccgaagcagagauuccaugcucuguuucuuccuggaugucacugcucuagguuuggagguuuaaucaucuucagcuggccugguucucugccuuggcugugaacauaauaacguuugcucccauuuugcggguguuuccucacucuuugugaucuuugagcaauuggaggugccaguguuuggaaauauucuuuccccaaaaugacugaaauuugaacgccaagcuggcuggcuggcacuuggcacuuacacaugauggcagauaaacauauaagcauguaucgcuggcuggcuaauauuuggcaugcauaaaugauagugcuaaguacacauaucugaaaacgcagacauuuuccucuuguauuugucuuaguuuuuuuuuuaaacaagaccucaaauagucuagucucuguaacucuggauauuccugcuucuaccucccaagugcuggagucacaggcaugggccaccaugcucucugucuuguucuccagucucaaucuguggcuucaacaugagaacagucaucucugggaggacaugagcacaugcacacccacacaugaugcgcgcacgugcacacacacacacacacacacgaugcacgcccacacacgguacacacacacacacgauacacaugaugcaugcccacacacggugcggugcacacacacaauacacacacacauacacacacggugcacacacacacacaugauacacacacauggugcacacccacacacagugcauacccacacaugauacacacacacacauacacacauacacauacacggugcacacccacacaugauacauacacacacacacgcucggugcacacccacacauggugcacacacacacaugauacacgcaugaugcacacacauacacgguacacacacacacccacacauggugcacaugcccuguguauggaauugauucuguuuuuaaguccugugccccacucaggagcuggccuggagaacacugagcagagccugccuuggcacaaccaauaaccaguucaagcagaagugcuagaggcuaggaauucuagaaucaaagucccgaagaggguacgauuuccuaucaccaucagaguaaaugcccaaauguucugcacacacuuaaucagaaaucuaaaacugagaugagcacaggucaggcuucucucugaacgcucccagaagggccuuuauggcuuugcuagcuucuagaagccacugccuuccagcuaaggcugcuuccuccaucuucgaguccacaaccucccuugcugccccucccucuuacucccuccuuagauccugaugccuccuguccaauccuaagaaugcugugguugugccagguaagcagcagacuguacacccacagaauugcuccauuucaaggccugugauuuccuccugcuauuuacggagcuuggcgcauccucggauuagacccagucagcauacuguaaacaguauggauugggagccuggagaauggcuuugucccagucgccugucacucgggaugcugcaggcucuggucuagcggguacagauacuucagcucuccugccuccagcuugggaccugcucugcuuuuuaacaggaagaugcucagaagggagaggaacagagcugucaggagaaaaaucaccuggacaguacugaaagaaaaauuucacuguuaaaagaaaaucgcacccuguuuucuuuccuugugaagaauggccuaauggugacuuaugcagaaacugcacuuuaugugaucugcuggguccuuuguugauuacauuggcauauuugggucauguuggaauucauuagaauucugaguaccugcuaauccugaacagaguugcugcaauucccugagauuguuguauuuuuuaauucuccccagugaaagugugaauggcauacgaauuaugccgggaaauggcuuucauuauguuuucuucacuugcacagcacaagauaauaaugguuaaaaaacaacacucuuuccuuugaucuaugggcuauaauaagcacccauugcuccgagagcucauuaaaucaccuugccacgucugacaggucguccaguccuugcugggaauggcagaggaacaugaaaucgaagucaacggcaccgacacguuguggggagaaacagguaauuaugcuuccaguguuuguagucagcagccgcgugcgugacgucccagccccgcuguggccugaucgccuuagaguggcuggugaugcauauacuccuguuuucguuuugucacgaggcauuugaagccuaaagccuuuucaacuugccaaaugaguaguggaacucuggaaguagugaaagggacuccuuuugaguuagacgggcuguuaccccgugcacuugagggcaaccggcacacguguuuaaucccagcacuugggagguagaggcaggcggauuucugaguucaaggccagccagcacuauacagagaaacccugucuugaaaaaccaaaaaaaaaaaaaagaaaaaaaaaaagaaaaaagaaaugccuuaguaaggcuucauguucacacacgucccaacccacccgauccuuccuugaagccuggcuaaggaauccaggcagcagguccaucaucaagcaaaucaaagauggcucaguagggaaagugugacucaaugugucuuguggaaugaggacagagcucaggucucacagacccgucuaaaauacuuaauacagucuggagucccucccaguuggucaagguaggagggcugccugacuuaguggggaaaaagauuaauauuaaaauuaaugaaguuacugcugcuuugaaauuuuccauucgacagauguaaccaaggugcuuucccggcuucauacgugaugcauuuggaugcuuuauuuauuuauuauuuauuuauuuauugcacagauuuguuucugacuucuucuagguuauuuucuuaacagaacagauggugguguggagaguuuauuagcuaguucacacuugagagaaaccuuagagauuuuccuggugggagagcaggccugcccuccagagccacauggccugcucuuggaagccaccaucagcuggcuuccuauggcuugcuauggacuggaggaggagugagccauggugugaguuacagagacaguguagauccagaugguguggaucagccccuuccccacugagauucugccaguugguugaugucugaagagacacuugaaaaauuaaagacuucucacuuaaaaaaagaaaaaagaaagguccacauuuauuaucucguagauucugagagccggaagucuaggcuaauggggcugagcucccagcuucaggaucucaucuagguauuggcuugagauguguucccaucagacucaccagauucuaagcacugagcuuggucacagauuucaucucuuuccaacuguccgggggucuggugaaaagacagacgcugugaccuggaaaacaguucuuaucaucaucaguagggauuuggguguauuuaaucagccaagagguuuuuuauuuuugggggggggguucuuucuuucauuuauuuuuugagaauuucauacaguaucuugaccauacucuccuucccugcccagaacucucccucaccaacuucaucauucucauucagucucucaagaaacaaaaagcaacacaaagcacacacacacacacacacacacacacacacacacacacacacauccaauaguguuggccaauggagacugugguugacaggcccagugucacuccacugaagaaaacagguuaucccucuuccagcagcuauugguugguugcaaauggcuccuuggugagaggugggcauuuguucccaccuccccuucuccaugcuaggguuuugucuagugaggaugccccagaguaggaaacacacuggcucuaggaaucucucaaguaggguuuggaucagugcaaaucuugccccagggcccagugguugguggauuggcugaaguucugguuggaacuuggggcucacacuccaagcagucccggaccuuugaaguuggagaggugggggauaggcaagaagcugagggcagggauugaccuguccucauuguuugagacagauuuggcuggccuggaauucacugugaaggacaagcuagccucugacuugugcagucuuccuaccucacccuuuaacugucagaauuauguaggcguucaccaccaggcccagaagucaagaguuuuauugauugagaggauuugaaaauacaacauuuaaaguaaguaaaggccgggccagcuguccaucgggcuuagagagccacagcagcccuccaagagucccgugcuuccuucaucccugaugaccgcagcccugaaccuuucugccugccacagcugcccaugucaggugaacagccugacaccucacaaggcacaacuuagaggagagaauaucagcagauuuugggccugacugcacgugugcuggcuggaugcugagagcuguacuucggauuugaccauuggggucuauuacuugacuccaaguguggaauugagagaaauguggguggugagcaggguucugacuuagcacacccugaagugacagugguucacaggccaucgggucacagccuucaucaccagcuucuucuaagcaucagggccuggccuuuccuuagcgacuguaggguagugcuccccacauguugucugguccucaucacaguaggaauucucagcagugagagugguugcuuggucaguggcuuugccugguucucauucuuuuuuguuuuuguuuuuaagaauuauuuauuuuauuuuauuuugguuuuucgagacaggguuucucuguauuagcccuggcuguccuggaacucacucuguagaccaggcuggccucgaacucagaaauccaccugccucugccucccaagugcugggauuaaaggcaugcgccaccacugcccggcuuauuuauuuuauguauaugaguacacuauagcugucuucagauacaccagaagaggguaucagauuccauuacagaugguugugagcuaccauguaauugcugggaauugaacucaggaccucuagaagagcagucagugcuuuuaaccacugagccauggcuccagccccugguccucauucuugaguguucucaacagugcuuuguguccagaacaucccagauccuuguguguuggccacaagauaggccaggguccagagaauggcuccuugugcagggugugggaagguagaggaacaacgggagcuuuauauggagaaugcacucauucuuucuccuggaacccuuguaucuaucuguuuacaagucuucuccguguagaucuagcuguaaacaacuuggcuuuaagauccuggcuggcugggggggggggggguugucaaggcgguuuccacaucuguuucaggcauacccacccagcuuugaagggugcagugucucugugcugucuggcacuccgcaucugccaucacuggcgugcgaugcugagaggcgagcaccagcuccugcacuagguacuuccucacugucgucgggacagacccaugcagggucugugcacccgcuucacagcauccacgucugggcaucaugacuccuacugauugaaagcaggaggaugucugaagugacgcccgcucucaaccagaaaggccagggagagaccugauggggagggguagccgagaggaggaggcauggaugauccuuagugcuugaacugauguguccucaugugucaucaggaagagcuggcucagaagagcaagagcuuuauugcagguuccagagacuuucaucuaaaaccguguuuagucugagcacugggaugaacccacauguuuuagaaaacuccuaaguaccugcugauuuggggagcagagggcuuuacuuagaaacccuuccuuuucacagagcugcugcugcugcuugucugggcgguguuuagagacaagcccuucaaagugaguuaguucugugguugcaauagcacugagccacugccuuccuuuccccacgccuccuuccuugucuccucuuccuuucucuccucuccucgucuucagaggagagugagucccgaccuguuagcagaaauggcaccgccagugaggccaccacuguaccacccacagacugucagaugaggaucaucccacaguucugggcagccugaaacauggcgggagcccaucagaugccuggauuaucugccucagcauuccacagccaugacgagucagccccggcucccacagagucccaacugaauugaguuacuguuuccacaucaguguuugauguggaucaacccaagccgagacaaccagggacacuucacuggcgaccuaauacgaugcugugggaacugacagaccauguucccagcaccaggcuucgguccagccugagucugcacccugcuucuguuuagauggaaauaggguucucacuuugcagccugcucucugagagcaaggacuucuccaccauggcucccaucugccuggucugcagagacuguuuccacagacugucgagcuguuucaucaggaucagcugugguguacacacugugggcuucccgagcccaggaauuccuguguuucucacucucgugugacugcuuugccuaaugcuguccugggaguuucuccaggguagagguguuggccacuugugcuaucaguucuaccuguggcuacugagcagaggaguggacaguauugggcucaucuaggacuugcuguguuggguauugaccaagugagaacgucgaaaacaaaagaaagcuuuacagcuuuaaggccgaggauguucauuuuguggaaugagaagcacuugguagauagggauagugcgagagagacaagugacacgauuuuguuuggugauaguccuggccugccauguuggauucauagcucuguguauguguguguggggggggggggcacaaggggugagugcugcugccagcugcugaguguaucgcucccugguguaguauagccauggucccugcacacuuucucccccuugucucuauaacaucgcccucuccugauccuugccugcccuccagcaagcuguuguauauugacuugguccugggcuuugugacuauaggaugauagaugccucugggggcugugcuuuccuaguuacugaaaaggggugucccagcaugucccaucaaaguagguuaagacugacugacugcucuguguaaagugucaggucuuuuguuuugaaucagugcuauuuuuguuggugaaaauuuacaagugaguuuggcuauuguaaguaauuggcucccaccgccaaagcuguuccuaaggugagccaaguuuucucuucugucaguggaaugagagauuuggguuggggagugugggcgggcacaagcuuccuaguccuacucacuguuggcucuuccugggcagaauguggccaccucuguccaaaguaucgcccugucagaggggugcuguguucuccaggccuccaguuguaggguaggcuggaugcguauaccuaccugcacacaaggucacagagcugagaaagcauuucauccuuuguaauuuaagugucccuccugacucuguggacucauuuuccuuucuguucuguggcuuuugaacuaauaucuaagguuuagggcgccauggaagucuagguuuacccauggcuaccucaggccucaaagaacggaguagagugccuuauuauuuacuaaugacugcuuguucauuuuuauuuuaucuuuggucuuuagguagauuggagagcuuuuaguaagaauuuauauuuuaaccuugcuguguucaauuugguccuuacgacauucaggguuugguuuuguuuuguuuuguuuuguuuuguuuuguuuaagacuuauuuauuuauuuuaugugaauacacuguuguucucuucagacacaccagaaaagugcaucagauccuacuacagaugguugugagccaccaugugguugcuggaaauugaacucaggaccucuggagagcagucaguguucuuaaccacugagccaucuuuccacucucuuacuucguggucccaggcaagcuggugagcuuuucugggaacagauaagacuagcuagcacgugccccccaggaguuguguaugaaaugguuucauggauacaaaaaaacacauucagguuuuuuaaauacacacauaaguguguguauuuacuuaaaaugcuugggaccaaaaaauuuuucaaacuugugaguuuuccagaguauauggguguuuucauaacuagcaauguucuaaguugaaaacuuggagcauaguuaagcaggcauuuuugaagaguuucacaguuuggcuuugaggauuugggacacucacccuuucuuuguuccccccauagcacaugaccaggugagagacuagagaaaaggcauguguccaguacucucuggggucuguugagaaugugaaacacugaccuagaaaugugacaugccuuccugccuuuccucggacacccacugugaugcccuccacaggacucuguccaccucaucuugugcugagauaucagggagagaaagacagaccaugauacuuguuuucauggccucggugaccuuaggcacgccuuuggugucuuggcagauagcugaaucuauccgaagugugaacacucucagcgugcuuugggagugacagcuguucagagcuguggucuucguucagguguuagaggagcaagguguuuaugagauaggaauaaugucaucugugccuuaggauguuauguucccgaugcucccaaggcauaguugaaauaauaucagaauagggucaaaaguggggcaggacucagauccagaugugcgugcaacacauugguacugaugugcucguaagauguucugcuguucuggucucaggagccccauggccagagugagaagggaacacagccauugcacgcuguucauacugucugugggagagcuugguagcccuuuggggggcacaggaucuuguucuggucuuuuccuucuaaagacauccacaugucguuguuugugaauucagugucuuuagaagagaccuccuagaggcagcagugaaggagccaggaacucagguggcauccacucucuaacuucguggucccaggcaagcuggugagcuuuucugggaacagauaagacuagcuagcacgugcacccccaggaguuguguauguggggcuggagggaugacauuuguuauauuacuuaauaucuuaguaguaguaauaacuuaucauaagucuagcugcauguaacagcucuugaacaucugucagccgcugagcacugcagaauaccacaggguagguucuauuuaaccucaaggagcacauaggagaccgcugucuaguacacuugcgugagguuaaaggaacugagcuacacaaaguucuaccucuugcccuagaucacaaaacaaauucuccuaaucuacuggcuucuaacccggccacaaugagguggccuuucugagaccccgcccccacuguuuacuucuaacugcugccuuccuuuuuauauauauauaaaugggaaaagccgacauaacauggaaauaaauugcacaaacaaacacacacaucuaaacaaaacugggcuguucugcugacgaugaccucauggccagaggaaguguguauagcagcaggugcaggcucuugcuuaagagcucagggguguucaugaagggcaguuggcauuuuccauagguaauauguaaaagguaguuaucuggcuuggaggaguggucucuaucaccuucccuccaagccuccacgucaggucugagaagcaaguaaggugcaucccugguucucacccucagggcagcaucccugguucucacccucagggcagcaucccugguucucacccucggggcagcaucccugguucucacccucagggcagcaucccugguucucacccucggggcagcaucccugguucuuacccucggggcagcaucccugguucucauccgcaagcccuggaccacugcaggggcccacccugugugugcuugagugacagcucuguuagaacacuucauaaacagccuugucugugaugagaugacuguguucccagcaagcugacaguugagaguuguuucuuuuuuuaaaaucaaaucuuugcccggagaacuucaauauguaaaggauucugccaaaugauccauuuuauggugccaaggaguguuucuccgugauguuuucagugagcucggauggcuaagugucaguuagguuuuuccuaaaaugaacaucugccgggacgaaucugcucgugcucagaagacagcgcugccaaggugaaaucacucaggauugucaggauagggaggggaugugcuugcuuuugguuuuuuuuuuuuguuuuuuuuguuuuuuuuuuaauucaaucacacagaugauaucuuguuaagcgauugccaaguaaaagcacuugugccuggcuucagugccucguguucacagggacuggggccuuuccuuucacguguccuuguguuuuauuggccaaacacaaagcagcaauguccucuuucccacccugguccugccuuucacaccccaccccugcccccacuccuuuuuugucugaugaagccaaguucacugacccucauuagagcuggggccaagguuggcuuucucagcaggaugguuggaauuccugagcauagcuuguuuugaguuuguuuguuguagcccuccaugcuuccgaauaugggaaugugguauccugaaauccucaccucuguggaaacuugagaugcauccucgccuggggaguuuggugauggagcuaaaaauacucacucuggguagaagaggaagccagugcuccagugucugucaucagcagugucuccuuaggaauuccuguauagaaccugaucugguuugaggcugagcagaguggaccugcgcugacagguucuuaaucgccccccccccccccacagcaggucugcacuaacaagcacacagcaaaucaaaucuggcuguggagaaagaagaaggugggaaucugaccccgucgccaggccuggcagggcgggcacgcuugucagcuugucagcugcuccaacguccggcuucucugcuggcuggugaaacacacgaauccuauuuuuagcgcagggcugucugauguguuacugucaagacuucagcagcagcugcagcagagauuccagauuccgacuuaaaggcaccccguuucucaguggugaagccccuucacuaaaugagaggggggaguguugaguagguggaccauccagucucaaaugcaagaccggacuugucucuuuccggggacuccuaggucucggugugcagacacaugugugcaccccugauuucuuucuccuccugcuuggguccagccauggaaagaggaggagagucccugaguggaggagaguuccagagcagcagcuggcacccaggucuuuuauggcccacuugagggcuccugcaagaucaguugagauaacguauauuauaggagaagaaaacaaaacaauuuuuauauccuucagaaccccuaggggagggacagacuuuuguaaugaaaggcacgucagcuggagccaugcacaccaguguugcucuccuugaggcagaggugcacaugacagagaaaugagcauggcucacagggacugcacaggcccaagcuucggacucagccucugcauaggcugugagacagagacagguaacaugggcgaggccacacgugugagguucuccagugaauccauaccugauccucccuaaacagaggagaugucuaucaagggaggguucccacagggacaucagcuucccacauaaagcggagcagcucguccauacucagcgcuucuuaggacaucugagcaucucaguauagcuucucuuucugccagaggcaggugugggugccguauacuugugcuagagccuguaguuccugccuggcuucuuacagggacugaggcuagcucuaccacuuccuuggagagcggaaaggguccagugcuacuuccuggagcagcguucuaccacugaugccgaaacagugcccuuagggugugcugugcuuuguuuguggaacacguugacagccagcagaugucagccuaugcguccucauggucaggccugaaaaggcuggugucagcuuucaaucugcugccuccuccgguccccugacuugcuccuucugugcuguccgcugcaaaaucaagagacuugaggucaguuagaacagagucccuugaacacguuuuccuggagaggugugcugaccuacuuccugagagagaagaagguguugucacugagugaggaggaacucacacugagcgagaguggucuggugggaccaggccagcagaaugccccucaccuccccagcgagaggggaagcuacugaaagauggacagugccgacuguaggguccacauucaugcucaggggcuugggaccagaaauaccaugagaaccggcuugucuuucuggaaagaggggcugccuguuccugcugucuuccugggcuuuagaugcuaggcccccgagaugagucuuccugguaaucugcuccgucccacggcuccugccuugcuccuuacucccugcacaaggcugggaugggacucgggugauauuagcacucucagaaccagcugucuggucugcagugucugugucucugucuucugucugccugucugucguuaguccaucugucugugucaugguuaaccucagucaccagggccauguauaagggaagcuggaguaguuaugggcagagguuuaggagccaacccugguggcauaguauuuauagaaggccccaggaggagcaggcaucaggcagcugugugggaggggccuggagagacagguccacgcaugcaaguguaugggaagcagccuccuugaucacagguguccgagguucucgucaccauaucccuagcucugaugaggaggcagaucuugggucccacucucuccaaaaggagcguucaaggucccuucuccagacugcucuugcagugugggcuuuuacucacugagucaagcauguaagaugggucuguuguguugucaaguuguguuuagguguggggcauguauuuucauagaugugugaauuucccacccuaugauaacauuguucgcuggcgucucccacuacugacagcaguguggguaguguccggcuugaggccucgugaggaacacugccacacaagugugcauucacccgaucugacucccaacugcugucuccugccgucauucccaccagugaggagugggugaccccucgugcaucucucaguugcaucggcugcugaggaggccgggcacuuucauaugaucacgggcaccgccuugcuuuugugaaggguuuguuucugcuguuucccauuuguagcugagaaguccaccucuuccccaaccgccccaccccccgaucguggggauacugcugucuucuggaagcuggaaauuaaggauauauuuaaaaacagucuuccaaggaggcacgggaauggcaccacaggcuuaagcugcuuccuccuccuggcagcaggucacucccuucuagggagcaucuauccugugcggcucagagccaugcugcccuacagggcuugacauuaguguacugccgcugugcucaauggaucccagcgaucacagaacccacccugauuaaaagggcaaggguugucacuggcaccugcuauugucuuuucuuggacacgugacaaggcaaaagccaggauggaggugaggggaggggaggcacugacagucacgugagcacucuuucccgcuggagcugcacuccacaccacacccaagaggcauccaccccgcaccuuauuuuuuucucuuaugauaugggauuuuaacuuguuaaaagagguuuuaugggcuagagagaugacucagugguuaagagcacugacugcucuuccagagguccugaguucaaaucccagcaaccacaugguggcucacaaccaucugugaugggaucugauguccucuucuggugugucugaggggagugacagugaacucacuauaauuuaaaaaaaaaaaauuuuuuuuuaagaaaaaguuuuacauuccggcaaagcaggaaugaugggugcuuuugauugucucaguaauuuuuuuuauuugaaaaagcuuuugauuuuuguuuauguuuuuauaugugcauaccacaggaaugagggggcucuggaggccagggaaggguguuagguccucuggagcuggaguuacagguaguuggugagcagcuuaauguaugugcugggaacugaacuggggggcauaucuccagccccucgauaauugcauuucacugaguggacuugcacuuaaggcuaagaggccagcuuucaguauagcacuagucugccagugauauacuuagugaaucugugguuuaaacagagcaugguacggccugcuaaggugucuuugcccucauggcucuagcugguauagcuugacuugaguuggaggccuaccuaggacagcugacacauggcuggcccaacagugcuggcuguccacuaggcugucaaguccagguggccucagcuugguccucgugggucucaccccagagaucuucagucuuccucacaacuuaggggcuggcuuccagcgcagugcaaacugcccauuuccagagacccagggcuugacauuaguguacugccgcugugcucaauggaucccggcgaucacagaacccacccugauuaaaagggcaagggcacaagcacuggaggugauaaggcacucgaggcccuacugacaguccccucuuccgucccugucuagcccugacggccgcugcugggagaggaaagguggagaucugcgagcugcugcuggagcguggagcugccgugucucgggccaacaggagagggguucccccucuguuuugugccgcccgccaaggccauuggcagguacccaggggccccuggaugcuucaggagcgguggguggggaugggguucacuguugagaccaccuguggcccaugaggcucuuucuccucccugccuuccucccauguccuugugacugcuucucagaggccagcaugacagacauguacagccagcaagauggacugaaagccgugccagaggcacagugguucccuuaacuccaagaggacuagacugcagugguagaggguucacuguggcagcgugucugccgcuguuauuuuuguaguguguucguacacugaaagagggcugccaugggaguucuucuuggacuagccauucuuacaccaucuugaauucaagggaacagggcaucauuguccagcagcuucuuccuuuguuuugaaacaaugaccacaucucugcccgcacucaguacccugugacgcuuggaucgugcacacaaacaacuucaagaccacucacucauuauagaauagcgucuguaauagcaucuaacccucugccugucucaguguuuccuaacucacggggaaggugggaggaguuugcuggugaauaaugugagaaccugggauggugccaccucugccacucuggcaauguaacaugcagggaaugugcccaggcaaccuccaggcugacccagcggauaaaauggcucccuccagcacaaggaguacaucggacuccuuccugaguuucugaucuuucuccccaacuguuaguagcauguguggcauaagcacauugcugaugcuggaauuuugcugacaguuguccucugaggacaagccaccccucgugcugcaucuuagcaaagcauguaaccaaggguucagagucacucuccagccuuagacccuucucucguaacgguaguuccccucucagcauuaccugcagaugucaagucugaggaagcucgauucucuuagaacggcacaguauuugcauuccaucuacagacugaguguaacugguuggaucuaucgcugcagaaccccagauacucagggcgcugugcuucuccucaggaccaauuuggaacauuccucucccccaguggcuguccugucaucaccuguugugacuggcaugucucacuacuguuucucccugauacgugauucucguacacuuaauaacugaaagauacauagaagaagguuuuguugaagugaaugcaguagaaagaucgcuugagccccacgcaucacgccgcuggugggagagauggagaaagcggcugugguguggagacgggcuucucagugcugauuauucucggugcuucuucagguuguccgauugcuuuuggaucgcggcugcgacgugaaccugagugacaagcagggucgaacaccucucaugguggcuuccugugagggacaccugagcaccguggaauuccuccucucaaaagguauggcaugcugcagugcgcuggcuucucuugcaggaagaacuuuguacuuuuggcuccccgguuagauguuuucuaagguaugaugcagcccaggggcugaugguccaacuuuggugaggacccucugccaucagcucugcagaccugcucagguuaacacgugggacccucagcagcccagguuuauucauguucugugaauguguuauuagucuuggggcaacguacaccccucuucaguaugccguuuaaaagaaccgaauuaaaaguagaaaggcaagggagauuuacucaaugggaagagggacgaagaucuggaagcuucaaguccaucuuuggaguccugaagugaaauauauuugacucaagggcaaggauaagugcaucuaagcaguacuguuaaagguguggucccaccugccuuugauccaucagagucuggacuuccaucuuguccuguuaggagcuccaacaaguuguuaaaacuccgaaaucucuuuugggagacaaguucucccccugccuggugcuuuuuguucucugggcaugagauucuuggauaaauuucuauucuuuaggaucuacuguucagcagucugagaguagauugggagacccaagugucucuuuaaggcaucuucaugucugccaaccaguuauaaauggacucuucccuucccucaggugcugcucuuucuucccuggacaaagagggccugucagcauugagcugggcuugucugaagggucacagggcagugguccaguaccuggucgaagaaggagcagagauagaccagacagacaaaaacggccguacucccuuggaccuggccgcuuucuauggugaugcagagacugugaguacugauggauguucgcuucuggugugugcacuuccuccugugugcaggaugggucagcauggaaguugguucauagcgcccugcaaaguugugucugacauggacuguguguguguauauacucuugcccacaugguauaugggaucuuuucaauuaucuauaauucuguaggugcaguucaguccaagacuauuagucaagauuuuaaugugcucuuuuuuaaagacguaguuauuuauuauguauacaacguucugccugcaugugugcauaugccugcgugccagaagagggcaucagaucucauuacagaugguuuugauucaccauauggguaguaggaauugaacucaggaccucuaaaagagcagccagugcucuuaaccucugagccaucucuccagccuucauguacucuuaaaagccuaaaaguacuacccuacauauacugcagacauggaaggaggcauguuugcccuguucguggucuuaucuuaucaugagcugcauauaaauaaaauuccuccauaggucauucagaaaccacuuucaccuaagaaaaugcauuauuuaagcaaaaagauagauuauaauauacuaauuguuuuaaauuauuuuuaguuaugauuuuaauugauaaauuaggauuuucagggcagacaccaugccuuuaucaggcugcacaucccagaccugagugaccggcauuguagagcuacuagggacucugcuuuuauaguggcaugugucuugacaagaggauggcccggagagacacaugcugugucguggaaaggcagugaccugggcuggggcuuuauuugucuguccauccaucaguagaaauaccacuggacaaauaaauaucucuuaaaagauaccacucaaucuuuuucgcuaugaaaaugcucagaaaugcacuugccagaucauaugguaauccuuuggguuuuuaaaaauaaggucucacauagcccaggcuguagagacuguagccaagguuggccuugcucuccuaaucuuccugccuccaccucccaaauacucugauggcaggcagguguauaccacgguccuuggcuguuguucuguuuuuaacuuccuaaggacaccccaccagcacacaaccucagacuguguggaucugugugucuggaacaagccagagcucaugguagaagccauugcuaacugcaggugaacaggcggaagaggcacagaucgugcaccucagcauacaccugucugccugugggcgucuucaucaccgacauuugccacugacaucacugacugaugacagcagagagauguucgccauuguagugccuuucuuuuggugucacauugguuuuauuuccacauguccccaaaccccccaccaugaccagagcuaucucaaguggguauaaagcuaauaccgguaccccacagucagaagacagaacuggacaggugccugcuccugccagggacugcuucucagguuucugcuggcccugcugcuguaggugcuguaucugguggagaagggagccgugauagaacauguggaccacagugggaugcgcccccuggacagagccaucggcugucgaaacacugcuguagugguuacccugcuuagaaaaggagccaaacuaggucagugaaacccgcuuccauuuggcagagccagaggguuggcuucuaacaucuuaccugaaagaccuaaagaguaccugcuaaggggccagagaaugcacaagcucucucucucucucucucucucucucucucucucucucucucucucucucucucucucucucucucucucucucccucucuccccucccacuucccacuccuucacuucugucucauuuaaucacagacauccagaaaaccgaagcugccuaugauuuuccucuuuuaaaaaauuagauauuauuugugugcaugaauacaaguuacacacagagguccaaggacaguucacaggaguuaguucuuuacuucugucucauggauccccagccuuggagacaaaggcuuccagcugaugagccauauugcuggccuuuagcuuauagcauucuuuccagguagguagagagcagaggccaagggggagggacagucuggggucaugaauggacacucacaucaggaaguauuagugucuuaaguuuugacugucgugaugagagcugaggcagccugcagaagaaagaguuuacuggggaguugcaguucagagggugaggccguggccagggcagggaguguggcagcagcaggcaggcaggcauggugcuagagcaguaacugagagcuuagaucuaccgcagaagcacgaaacuucggauagaacuuauccucuaacaaggccauaccuccuaauccuucccaaacaguuccaccaacuggagcccaaccaaucaaaugcacgagccuaugaagauuauucucauccaaaacccacuuaggcucugcuuuaagugcagauggacugagcaucaguagcucagagagcccuggaugguuuucugaagagcagcugcuguccuggaauugucagugacagcuuguugagaaagucaugacuccaguacacgcaauuucugagaaggaggcaccgaggagguccuuggagcaggagugggcauauaugggggugguguggaggcccacaugugcggcuagcagagcaucacacagauucugcucagaugcagagacugccaaagugccccugguuuuguuugcucuccaggcccuuugaccaugaguaguuguggguauagggggcuacacagagaacaagcugucccgguauuaagcaguuucccauuuuuaccuugauccuguacauaaguaguggggaugccaucuuuuuacacaaaaaacaacaggaacaaacaaacaaaacacgggagcugaguggccuagcagugucccaaggcuaugucaggggcgagagagaaggcuguagccaguguagaccaaaagagaagcuggacaggggacccaagcuagggccucagaagagugcaggggaccucaggacaguggccucccacccugccauacugggugcgucaggaaaugaggaagccuuugaggguuuaaugcuguccauagaaggcaagcaccuucauuucuguuagcagaacuagguaaggaaagugauugugggcauuggugauuccuccugggggcugguguggauaaaauaguugagacgcuuuaaccagcuugccggugcccugcugccagaagcaccgagacccagaccagcacuggccuugcuaugaguuccugcaccauguacugugggauggcgugggggggcugcagaagagagcugcucccucugggcugaggaagcaccccugacagcguguuuauuuugcaggaaaugccgcuugggcgauggccacuuccaagccugauauuuugauuauacuuuugcagaaauugguagaggaaggaaaugugauguacaagguacguggcuugucucccgugcugcugcugcuguugaccuggggccgccccucaguuagguauugggugcuguagccaugcagggcaggaacucugcaagaauggaagucccaaaacauuccagcaugaccucuugucuagaugccuguuaaucuccaaacagccggaccuuaaugggaaagaacucuguguuugaggacaguuguuacugauacuccaggcgguggcuaagguaugagagagccacugcugugucagcuggcauagccaagucccuuggcuuuuccgccuuucaaagauccaauuauggcccuggaccuagucgggagguacaugacaaaagcauuuacggaaggaaaggauguugaagagaggauggcacgguaacggcaguugcuggcugcuaagcuuggcagcccaacucugaauccuaggcccugcugguagaaggagggcacugagucuuauaaguuguccucagaauucuacacuauucuguggcaugugugugccuaccucauacaaauguauacaaaauaaauaaaucuuuaaaaagaaaauuaaaaccauccaaugucaccaugacccccccccaaccuuuuaccuuucagaucuuaauucuacaaauguggacauuuuaaguauuuuuacugauauuuuuuacuuaauauagacaaguaauaaauucucacucaagagauaguucauuuuuuccaguucuuccacgguccccccaaaauggaaauaagacccacaacuucauacauuugacuuuaaauuuucuccaaagagcugccaguuuaucuccaugguggguagugugugcuucaggcucugagguaugugcaggcuagccugcucacugcugguucagagguagucauggguuauagaugcacaggcaagggaguguggcugugccccaggaaaacuguaaauacacgccugugagugguggguggccacaccuggguuagguagcuggguaggucauuugcauagaugacuauucuuucaagaaccuguaauuagguagaauuaagaguaugggggagggacccaagcuuaugacugcuuuaauccuuuucacuccuggggagauuuauuugcuaugcucuuguuucuuuuuuguuguugguuuuuuuuuucauaguaacaaauaacuaggcauauagcaugacccagcaggguuccuggcuugaagucgguuggaaauugaguucaggguguauucuguuguggcuuugaagugguuuuaauauggauucugcuagguaauuaugucagaaauauuaagccguuuccagcaggcagcaguuccugcugugcaaggaggcugacagagcaaauggauuccuuuggccuugagaguggugugcuguguguggcucucauuuguaaagccaauucuucggugcuucuaaaagaaaaauuacuauucuacgucaagcugcagguuuauccaugagguucuggcugccuuagaaacuacaacauuuuuuuuucaauccagugucuauuauacuugaaauuaaaauguauuucagagaaacaugguucuugaaauaacagugaaauuagaugugauaagauaacuggaugcagaagguggagacuuagugauuuuuuuuugcaguucgcaaauaccuucuugcugagccaucuuuuuccuugcugugugacaaccugugagggcgauguagucugagaucguucagacugcucaguggccuggguccuacuaaaaagacaccuagccauccggguccuuuucaugcacugugaagauuuuuacagggauggccuucagaauggugguucaucuuagagcccccugggaaagaauaacuuugugugauuuuugauucguagaaagggaagaugaaggaggcagcccagagguaccaguaugccuugcggaaguucccucgggaaggacucggagaagacaugaggccguucaaugaacugagagucucccucuaucucaaucugucgcgaugccgaaggaaaacaaacguaagcugggagcuguugucugucccaguucuuuggcaguaggugagggccaggcccucgacccagucuggcgacugacugaggugcugugggggcugcugcucucagggaccucucauaggucacagccacuguccaccucaccagaugcugauggaaagcacucggguugauagaaugugcuuagguugcguuuccuuugcuucagcaaaagcagcaaaggccagcuguguccgguccccgccagcugggucugccaggguuuucaacagucgaggacgcuuccuuuccacauucaagaaaaguccaagacaaguguccacacaguugaccugucuugugguccuuggguuugcuuaguaaauacucccaguuuacaaccaguaguggucaacuuguacuuuguuaguaguagacauuuuguaguucuuccuacugauguuuugaacuucgccccacucccugucccacccccagcuccaccccuacccuuagccccaccccuagcccgcucccagccccucccagccccacuccuagcccuagccccacccccaaccugcucccagccccaccccuaccccagccccgcccccagccccacucguagcccuagccccacccccagccugcucccagccccaccccuaccccagcccugcuccuagccccagggccuucugugugcagcugugcugcuuucuccugagccauaauugcugcuucugaacugggugcuuaaggauagucauaagcucugauuauguaucuuaaacaagugugggggagucggguaagggaaugugccugcccugcccccaggaccccgcaggguccccaugcucugcuacccuuagggcagcgcucuuagaagacagcccuuucucucagcgcugcuucugacuuuucaacuguugcuaccaggacuuugguuuggcagaagaauuugcuucaaaggcucuggaauugaaacccaaauccuacgaagccuuuuaugcccgggcgagagcaaaaaggaacagcagguacugucuggggucacccacgugacuacuggggcauuucucugggaggucaaaccugcuaguugaguuugaggguguuucccuucaucagaguuauuacacacuucuccuuccuuucaauaaaauccaguggcuuccaagaggcacggccaugggcguuacuuuuagcggcuaacguucauuuucuugacauucugguaucuugcccaccguaccagaacacccucugagcucuugucucauaugagacagacaaagaggggugacagaggagcagaagaguuagaaagggacaugaggagggccagagagggccucaagcagaaaccagugcuuagagggacaggauucuggcacccucugcccuggugucuuuauagauagaucagaggcccagagucaccaagcccuggguuagaguacagcacuguucuguuggcucagcaacucugggccaaccaggacuuacccagcaagucccuggaccuccccccuuucccuuugaggacagcuagcuuaaggacagugcacccagagccugcucagauguguccucuaaucuuaucuuauacuuucauaugaaggcaguuccuggcagcucuggcugaccugcaagaggcugugaaacucugucccaacaaucaggaaaucaagaggcuccuggcccguguugaagaagagugcaagcaacuccagaggaaccagcagcaaaagcagcagggucccccaccagcuccagccaaugacucggauaaugaggaggaugcgccagccucuaguuuaaaggaccacuuccccauugaggaggcggaagaggaagacaccucuucacaggaagaguccauuuccccgacucccagaucccagccaccaccgucugucccuuccccauacauccgcaaccuucaagagggauuacaguccaaaggcaggucagcauccccacagagcagggcaggaaucagcaagucccugagagagacuguagcccagucaggcuugguuaugcagccuaccaaacaggcacagauagugaagaccaaccaacaucuggguuccgggcaaucuagcaugagaaacaguagcacaaaaauacaaguuucuucucagaacccucccccgaguccgaugccggguagaguaucugcagccccugccgugagcagaaaccagcauuuagagggaaccggucccuucacugcaggaacugguuguggccacuucggggaucggcugggcgccagccagagccuccagcugcagcgcagugagagcggcacugcguauccucuaccgagcaaagucaaagcugccgagaggcuccuggcucaugccuccguggccguggacauggcuccuccaaaccagggcggaccagugagcuguagcgaugugcggcacccggcuucccucucuagcucaggcuccucuggcucuccaucgagcagcauaaagaugucaaguuccaccaguaguuugacuucaagcaguagcguuucagacggauucaagguccaaggaccagacucucggaucagagacaaagguacaacccaggugcaggguggcacugccgaacacaggccccgcaacacuccauuuaugggcaucauggacaagaccgccagguuccagcagcaaagcaauccuccgaaccgcuccuggcacugcccgguggcagaggggcuacugacaaacacagccacugcagcuggccugcagucuaacucugagaaacccacucucaagccaggaggauacuguagccaagccaaaccguguucaguuccuccccugagcauggguguccacaauggggcucaggugaaggagcuggaagagaacaagugccaaaucccagcccucugucaagauaacaggauaacuaaggggguuccucaucucuacccagagggcgucucuaagcagccacuucaugucaguacggaagcccacaggagccaccucacuucagcaaaaccaaagcgaucguucauagaguccaaugugugagccuuaagcaaccccuguguagaaucuggaggcagucuguuggcucgugguaauaaaugaugucucuuuuucuuuucauaauaaaaauuacauguuagccauauuuuccaccucuuggguggaucugaugccauugacauauuaaaacuguaggauaaaacuauaauuaguagcuagaaaucagccauaaacagaaguacuaaacagcauugaacacuguugucagcuuauaucuggcgauuuaaaggcugccaagaagacaucaacugaugccguucucuuaggagauuauuuggcuugcucuguguaaaagcacacguacuuagagaaggaaaaaaaaauccacugguaaaaguuaacuccugacauaauaucuggaaaauucuggaaaagauggggagggaggguguuuaaguuacagaucccuaagucaaaccuguccuuacauguguguaaaaaucgcaaccugagugauuucuagcuggauauaaaugugacuuuuaucugcaaaauacaagcgcagccaaguaucuuguugguuccucgagaggaucaaacaccuacuuccaugauauggugaauugaagaguauuuuuauagcccccuuuuuggaacuauacuuagguuucaccguguugcugauaagacgagaacaggcuagcuagaauuuggauugguguccaggucagaguugugcaaaaguaccaagagaagcacucuuagugacggccacaaauuagcucuaacugguuccgaaaguguucuggacagugacgguccccaaaacaagccucuaauguccucuagggaaaguguucagacaggacccuugaggucuggguggcaguuuugauuuccuuacacagcccguuguuucauagucaugugucauauauauauauaaauagcuagcccauuuuauucagacuuguaaauaacucaaaggaaguuaaucuaaagacaaauaacagaaccccgccaucucucugcauguucucuguacgcuccaucaugcugguugccgcacugaacgaugcguuaucacggcuuguaacaguauacccgcaauggcacuuuaucuccuguguauggacaccucugaggugcuacuuaaauccgagugacauauuuuucaccuguaaagauaagguacagggaugaaccuuggcuuaagguauuuuuauaugaaaaugguguuauuggaagauguucaaaugcugguuugagagaggugggagaaguauuuuauauguugagaugugaaauguauuuucuagaaucggggagaaggaaguucuauauuugcagaauguuuuaaacgugaguacccacgaugcuccuaugaacaucauuaagguuuuguacgaaaaggaaccuugccgcggcgucauuuagugugucuguuccugugugcagagggcuuuguacaaacagcuaggccguuuuuauaagcucucucugaguucugcuccaguuacuauggcuuauuuauuguuuuccuuaauauuugugacagucuuacucuuucguuauguaguuuguuucugcacaacuacuguacuuuuuccacauggaauaaaaaccauuacuccaaguggguuggcauucauugcucagcggguaagaaggcagggacaccucucguggcucucugccuugauuugucacccuaaggaguaaaaagcacuuugaauacaccaacagcacggguuuuauuuuaauuucagaauaaggugggagcuucuagaaauuccaaaguacucuagucucaugauuuuuuuugccuuaaauaggaaaaaugcacgggacgagcaguguggacuaaugggucucgcuggucacagauacuuguacccuguaaccgccagugcaccgugcccucucaggacagcugcgucuuccagcacauuugcagugucuucucauugaaacugucugucuuuaugaccacagauuugucucaaacuguguaagaauagagauuguuuugguuguaucaugauaaaauucuuacuugaaguauuuuauauuuauauauuuuucauuuaaaagauuucgaaacuucccaaaugcauacuguauucacccugu

SEQ ID NO: 828 - RNA, 2636 nt, Mus musculus
ugagacaaaugucuuccuguguagcccuugcuguccugcauuuccuauguagccuaggcuggucucaauccuauaacaacagucccuuuucuucagccuaagugcuauaggccuuuacugccaugccuggccaacugguuguuuuuagauucuuguagaucucucucucucgcucgcucgcucgcaugaaaacuugggguuucuaccugcagguucaguauagagguagcagugacaaggaacaguaaugccccucuuccguguacggauccugcacaggaucuagaacuuucaaacgagucccaagugagccauaggcuauguuugucaacaggguaaauuuuguagcagccaagcaugcauguacagcugcuuuuggccucuagaccagcugccaacaggguggaguuucuggcucuuuccccagaguguuucagguugaaccagaagcuagacuuucuggggcuggaacacagucccaguggcacagccguguggagacuguuuuggaaagagaggggcgggguguggaguagagaagcugcugaggucuguccccucacccacucauuucucucuccaucuucaucucaucccugccccccagucaucuugccaccugagauaaggagcugucugagccccgaagcacacugcaugcagaagggugagguuugcaggaugaagguugugugugggagugggggguggggaggaaccuauagaaccuguuuucccgacucagccuuugggugugucuggguuguguugauuugauuugguuuccccccuccuuucccaagugccaucucccuuaagaauuugugguuugaagucucuaguaggaagggacuuuuucuaggguuuugguaggggugugguucaccugcccugcgguguuucccuucgccuguguuggagugggcccauggauauaaugaguuuaacccaaaugaucuggaaacaucagggcucuagacacagagcggccucaccacuguuguucuagagugacugaaaaagaucuugcaaacaggcuucaugcccugaacagggagguuuuccagagcgagcaaguggugugugucuuuuguauuaugaagaugucaccagccuugucugucucacagcugccguucuggguacacggcauggcaaaacugcuguguaaccgaggaccgucauccauacgguuuucacaaagguuuugcccacuugcacuuugcagaugccguuagagcugagcauggcgguggugauguuagcucacagcauggcuguuauccacccucagucuccucgcucauuguugguuuccacauguuggcaaaagagguucaagcauguguuggcaaaagagguucaagcauguguaggucucgguguuuugacaagccuaagagcaaacagaaccuggcuuaauugucucgagacucacaaauugugcuuaaguuccagcuucaggaagcauggcuagcuucuguguuucaucgcaccccagugggugcuuuaaguugugacagaggaguuagaauaauguugaaaauaguuauuugucagccauaguugacaaaaucuaagugcccuuggguuugggguucaagauuagucucuagcugggcauguaaguaacuuucaacgugaacgcucucuuuaguacagaaauccagaugagcggccuuggaucaucccaccuuuaugugcaguguacccagaaccuuuggcguguggcaugaacagcaguacauuagguccuguccgugacuguuuucacugucucugauucagguggagucuuagauuggcaccugagugggaagugggcuuugagucucacugcucuggaguguauguccagcaaguuugccacccacguccuccugcaccugggucuuugcagcaugcgguuuggguuuuaaugcuggccuccuguggcacuggacagagugcucucugaggauaaggugaagcagaaacccuucucugugguauccuuuucacgugauguaggaauuggaaugcuaucagauaaugacauggaaaauauuccuuuuuucagaucaaauauuuccccuuuugcauuuggaguuucucugugauuguuuuucucaaccuuucacagccucuuaauuagagcguucugcugcuggaggacgggcagcaucgucaaacuuggugcaucuuauaagggggcauaagagcgucagacaggcagcuggagugccggcucguccagaugcggaagccagaacuccccauucgggaaucuucacuguugucuuucuuuguuccagaagcgaaggcugauaaugaaccgagcugcucuccagcagcucaagaacuguugacaaggcugggauuucuacugggagaggggaucccgagcgccacacacauaaccauugaagacaaaaaugaagccaugguaaugccagaggaagaagcugcauuuccuacaugcucagcaugcacccuaccggcacgugugggagaguggggcucucauuacuguuuggucaaaugaguucugggcacuuguguuuugaaauuuaauacaacaguuaguuucugggucucagcuggggauagugguggaaauuguuaaggacaaacagaagggaucagaacuuaagaaa

SEQ ID NO: 829 - RNA, 1704 nt, Mus musculus
auuuucuguuucucuucaacguuuuauuuguuuaaaugugaacuguugugggaccuaacacagucgugcauacacuuuugaaauaguugaaauaauaguuuugucuugacauacgucuguguggcaggaauuccauucaccauuuucucugacgacauaaggaccauguuugcaugcugugugaaaauaggauaucaauguuacugaaucugaccacaaacuugagcuggagcucuuagcucccuagucguccuguuccagaaauucaguuucauuguaguuaaaagcauuagugauguuagcaacugcugugcuaaugggauucaguaccucauagaaauaacacagaccucugagagucugucuguccauucggcccagaguucucuguccaggugguuuuggcuuuuuucuuauugcuuuuguuuucauucugguuuuucuauuuuguacauaaaauuuuuauuuuguaaaaugaguuaauguaagcuuaaucaacaugacuuuaaugcuuacuaugcuuauaucguuguaaaauggucuuuaaucacucuuuguaguaaaaauauugaauauuauauucaugagugcaaaaacauauguaguaaauaucagauuuuuaaguauaaacuuuacagauuuaaaaaaaaucgccuagacacuuugaaaauaguaacuucuucauuuugaugaaguuaaguauuucggauuuuguugugauaauuuaggcgauaaauuuuuacgaauuucagagaaacggggaaaaggaaaauugggaggaaaaaucuaagaacaugcaguuuucaaauuaacaauauuuuuuaugcucaggugaauaaauuuuauuuuuaaaaaaguuuaaaauguaggcaaucacucucucaugcaaacuuuugauacacacgauauuuuucaacaaaugcuguauauuuauaguagucuaaucaaauugcaucguacuuugcaaaaaaaaaauuuuaaccuuuuauucuaacucagacuucuuguaacuacuuucuaaaagcauuugaaauuuaaaggucauucuuuagcagauucaugaacaguuauuuauuuuacuauuguucauuuauaaagaaccuuauuaguggugccuuauuuuuacaauuuguuugccaaaaccaauuuugaaaccugcuuaagacuuguuagcauucuuuauuguaagcucgagaucaugcgcgucagaaauaaacccuucuuucaaaaggaaggaagaggauccuucucuuuauugcagguuuuaaucuuaacaaaauuaagaaagaacaauuaccugagccggccccuuaccuggcgcgguguggucacgugagcucucucgguuaccggcgcaccaagugcuccaccugccucucaguuuguuuaccaggaaaucaagauguguaaacugcaggaaguacuauuugacccucuccgacaguaucucauuacaauaauugcuaaucucugaauaagacagccauguuuugugagggagagguuguguuagguagauuuuagguguuucuacaaacagagcauugcaaaugcuugcuuggcuuguguuuucauuauagcgcuugauaaaagacauauugugaccucuggggucagcagagcuaggauacaauaguaaguauucuuucaagccuuucaacagaaaacaccguggcuggcugugcagugcugccucugcucuga

SEQ ID NO: 830 - RNA, 91200 nt, Mus musculus
cguggugaggccggcggggcucaccgcugaagccggugcgggcaggagaggcuugggacuggagaugcggacgggccgggugaccccgggccuggcggcggggcuacuccugcuguugcugcgguccuucgggcuuguggagccuucugagagcucagguaaccgggcgaccucgacgcugcugcucugagcauuugccuccuucgggucgggucgcgaucgcuuugcucucugugucucuggagcagacaaguagggaggucuggccuaggagagcagcgggcaaggccauguggugcggagggacccucugccuagaagaggcccacagcucuuucccagagacuuuucugccccuugguccuccacuguccccugaaaucaugcuuuccugagguucaccaccuccuuuuacaucccugucgccccuuggucgucuuggaaccuccgggacaaugaugagccuucacccaacaccacaaggacucccagccaucacgacuuuacugugcccacuuaacgcaaggaaaaggaaaucagguucaaccauuguccccagaagucagccaggaaggaguauuaggaugcccuucccaguccccaugagcagaggcucaucuaaucugguuauuauuuccaaaugcuccccaacucagcuggccccuaacagaagugcaggucacuuccugucaguggggaaaggaugccuucuguaaagcucacguagugccagcagcaccaucccacuuagcaguuagaguuuugcuuuuacuuucucuuuuugcuucaacgaaaggugugccaaggaccuuuuuauuuaacuggacuauauaaauggcagccuauaggcugcaaacauucaccagcuacuucugcuaucucaccggugugaagaaggaaaagguggucaagauguguuuuaggaaguucugagugugccucuggcuuucuuuggagcuacgcuuacuuacuuucugauguagaugguguccagaguuauggaaagagugcucugcaagacuaggugucaucaaccuacccuuuaaugaguccugucuugaccgacucuucucaaugguccuuugaccuucugcacuggaacaaccaaaggaaguaauauaguagaaucuuuuagugauaugagagcucaauucugucuguugcauaauccgaggagaaaacucuaccugcagcaguuuacagcagagagcaugcuaacuuccaaucacuucucucuugguuucuaccuacaucugggaguccuguuuugcuuccuucacaaauuuuaagauucccuuaauauccaaaugucccuguugguuuuuuguuuguuuguuuguuuguuugucaucaaccugacacaagcuacugucaucugguagaggaaccuugauugggaaaauucuuccaucagauuggccuauaggcaagucuguagagggcccagcagacugugggcgaggccacccagggacaggugggccuggauggucuaagaaagcagacuggccaagccaugggaagcaaggcaauccucuauggccucuguuuccguuccugccuugaguuucugcccuaacuucuugaugacagagucugcugugaaacuguaaauugaagcaaacucucuccuccucaagcugcuuuggguugugguguuuaucacagcaaugggaacucugacugaagcaccacagucuccacagaccccauccugucucagggacccaaagcagagaauguuaggcuuaaguguguucccauaccaauguuccccacaggcauuuccaucccuucuucugcacuucuuuuuauuuuuuuaaauuuaauuauuuuuauuuauaugagugcacuguagcugucuucagacacacacacacacacacacacacacacacacacacaccagaauagugcaucagauuccauuauagaugguugugagccaccauguuguugcugggaauugaacucagcaccucuggaagagcaaucagugcucuuaaccgcugagccaccucuccagcccuucuacugcacuucuaacagcuguccuggguggcuuucucucauccucaggccaggcuuguagccucauauuggggugaacacaaggagagauuugaggguuuuauucuguguguguguguguguguguguguguguguguguguguguguguguaagccagagaaaggagaccuaucuccuccuccaucacucuccacuuuauacucuugagacagggucucucacugaaucccaaauucaccauuuugucuaggcuagcugccauggagcuccugggaucuaucugccugucguugccucacaagugugggguugcaggaauuuggagucauaccccuacccuaaccccucucuuucuuuuaauuuaaugugggugcuuggguuucaaacucaaguccucaagcuugauugacaagcacucuuaccaaugagucaucucucuaccccagaacuggaguuugagcuucuaucuaucuauucuauuagcuuguguagcuguggaucagauucaggaugcuagauucacugugucauguguaugcagggagcuugggcaagccaguccuggccacccaaaugcugaaaauguaucuuucuguuccuggggagaggccaagcuuacuuuuuuugcuuccuuggagaucuaacagcguggagcaaugugauccuuuagggcagcauuuuuuucaacaugggguuugggggggucaaaugacccuuucacagggguugcugaagaccauugaaaacagauauuuauauuaugauucauaacaauagcaaaaugacaguuaugaaguugcaacgaaaauagcuuuaugguuggggucaguacacuaugaggaacuguaucagagggucauaggagaaccacuacucgggaauuucugagcaucucacccuuaccauccaaucuggaauuauuugcucucugauaccuaguuuacugccaugacucaauugucucuucaagacuuguuugaguagcaagcucacacugcugugucucuccuccuacaucucuauguucuuuacacuugaaagagacuacacaacacuuaacaacguaagcugugaggauucccugggaaugaucggugccagcaucucugcuucccggcaccuuuucccuuccucugcaguuauaauugauagagaugcucauauccagugucccucccaagauaugcagaguucuuugugcaggccuaaaauuuggcccuagagauuggaaaauaagaaaauguuaaaagagaugauuuucuuugaucuaaauaagaaugauuaaaaaaaaaaucauuuccaagccagacagugguggcacacgccuuuagucccagcacuugggaggcagaugcagacagaucucugugaguucgaggccagccuggucuacagagcaaguuccaggacugccagggcuacacagagaaacucugucucaacaaacaaauaaaauguaauuaugacagugcucuuuggcuauuccccuaagccucacuaaaaucucuauauaauaugaagcauauaaaaaggacuccaaguuauguuuggcuucuuaccaucgaccacugcccuuuagaguuguccuaaacacaaauuuggagaugaaugugaaaacuccauugaagagcagcgcaaagauggaaaguggacaggaugugauauaaagcuagggauggaauccaguuugggccuuggaaagaucucagugcgagaaugcuugucucgcaggcuuaagcugcugguuguggugcccagaaccacagaaacagucacuacaauuuguaguuaccuuuccaaaaugcaauacauuucucagauggcuuauaggccuuauaaaauaauuuuucuaaauaagaaauuauuucgaguuuaucaguuuuccuccccacucuucaaucuacagucccauaaugccacaaaguagguagacugaacagcuacugcucagggcuaagaaugauagagaaaacuaguuaugaacaaauaaagcucuccugcagcaaauauauuauuuauuaaugcuuacacauacauuauauaugaaagcuaaugacaaguuccuucaaucauuaauuaugaaugguuguccugagaagucucauuugguguaaguaccaagcacugauacugauuacauacucaguucaagcacggguuuagucugacacgcacaccuacauucaaaagcacaaaucacuuaagacacuuagccucuccuccuuuaccacuccaugugacgccacauuucacugcaguccggcuccaacggagaugcuaaguccacacguguccugaaaguaccguaaguguagaaaugaaaaguaaaacuuucuuccgaugaguguugauaaacgaggccuucuugacuaacuccacauguucguuauaagugaaauuagaaugacuucagaugcuacuagcaguagagugguaugagcuaauaaugugggugucugcaagaacaugcaaugacuugagcaaagguucguaagaccuggggagcuaggacacuguuaccuagagaaagcaugggaugcuagcucuggaauggcuuaccuguuucucuguguggcccuggcuguccuggaacuugcucuguagagcaggcuggccucgaacucacggagauccaucuguaucugucucccagguucugggauuaaaggugugugccacuacugccuggcuuggaaaugauuuuuuuuuaaucauuccacaguuucaucugaauuagggauucgagggacacacacuaucgcuauggaggucagcaaacaacuuugggcgaggaccacaugcaacagacuucccuuaucuucuguaguuugugauacuuuggagauguggaagauaguaagucagguauuugaggggcaagugaauauguuggaggagcacacuaggagaauuuuccuuuugauucauuguccccucuacaugugaccaucaaagaaagagugacagaagaugucaaagaagaaaggacagcagcugcucugccaaccugccuaacagcagcuccgugcaaugguuuuugugugugugugugucuaugugcacauacacacugcucaccaacacacugucucuguggaggacagugaucaacuuuggguguuggucccaacuuucaaccucauaugagauaggauuaucuugguuguuuucuuuguguggcguuuuguuguuugcuuguuuguauguuuguugguugguugguuuguugguuuguuuuuaccauuuaugccaggcuagcugacccaagagccccuggggccuccugcccugccuuaggauuauaaaauuuuuaaaaaauuaggauuauaaauccucaggcuucacauccagcuucuaguggguucuggagauucgaaaugaguuccccaugcuugcaaggcgagugcuuucacccagugacccaacacccuguagucccuuuaaauuagaauuugaaagcagaaauaaauagcuacugcuuuaagguuuucucuguuguuccuuauuguuuugucuuacugcugcuacuugaaacagaacaagaaaacaaaacaaaaauuccauccaaaguucacacgaucagauagaauuuuguagcuaugacuuacauugugaaauuucccgucuagccaacggugccuggcaugacaaucuuuaacucuuuaacccaugacuugagaaaauuuccccagcgacaguaaagcugaacucaaaaugaaaacaccuuuugggaaccaaaccuugccugcuguucugcugaagucugguucguugacaaugacuguuaaacuugucuaaaauaguccagcuuucugcucaucaacaugaccaucuaggccauuuuuuuuuucuuucuugguaaaagagcugacuaaaguguuucauugugguuuacuguaauauauguaaauccugguccucagacucagguguauaagaaacaccaaaucacuuugguuucaggaacucaauuaaaucugauuccgagaucccauccuauuaagguguccgugcuuuuaucuccaccucuguccagaucuuccccagccccuucagagugccgggaguucagcugaagaggccucaucucuagucuuuagcuuccacggguuaauucccauuuucucuugcucacacaugcgagacaugagaccugguagugcagguuauuccuggaacccaggguuuggccuccuuugggugauuuacuuggugaauccccagccuccgacucucuuggcggugcugccguggggcuggccacagguucccugcccucagagcccagauccucuauuuucucccauuacuuaccccaguuuuucuaccccugccuucucggaaguguucccuccauuuauguacagcuuccacggaaggcucaggagaagugguuuguauguagacucccacccccacccccacccccguugcauggccacaggaaccuguacuaagcccgggaacuuagagccuuggccuucgccauugguaagggggaagaagcugaagugagagcagguucugauggccugaccacugugcuguggaaaccaaaacagcaagacagagcugugacucaggaugcguuuucccuggccacagaccacuuguggaagaaaagggaaaacgaagucguugcuuucugagcaaggcagggaaccuuuuauggacuaaaaaaagucacguacacacucuacucucuacugacguggaucugcgcaugucaguauccuugcauccacagugugaaguacguacagccuuacucaagagaaaacugaagcacaaaaguuaaauaauuugcucugaucucauagguagcacagcagaggcaaagucugagcccaggcagacuggcuuuagggcacacugugacccucacuucuugugggauucgugaguuuaccaagcccaaggggggggaugcagucuaguguuaaucaggcuccucagcaaacaagcaggagcaaggugcguucgucacgugacuccgagucccaaagugucuucccuuacugucucgacccagguaaugauccauucaccaucguccaugaaaacacuggcaagugcauccagccgcugucugacuggguaguggcccaggacuguagcggaacuaacaacauguuguggaagugggugucccagcaccgccucuuucaccuggaaucccagaagugccucggccucgauauuaccaaagccacggacaaccugcgaauguucagcugugacuccaccgucaugcugugguggaaaugugagcaccauucgcuguacaccgcugcccaguacaggcuagcucugaaagauggauaugccguagccaauacgaauacaucugaugucuggaagaagggaggcuccgaggaaaaccuuugugcccagccuuaucauggugaguuaccagagagggacuuugacucuuuugccguaauguuuguuucauuuaaaugccauacccagcacagcuuuguccuagaaaccugacuggggugaaagggagccgagugcagucugauggaguggcaccaacuacugaaguaucccagacgcccagugcauuuaugagggguagugcagggagagcgguuagcuaguccugguggucucuguggacuagccauaucaggcuguaaacauccaggagaagggagcugaagguuuugcacacaccggucacugguugguaaucacucguacuuggaccuaucuuucugagccugauccauuauggagacggcuuugccaacuuuccgugguucugaggcauugguucuagacauggcugugcccuugucaguaacagacauucauucacuggguacuauuuccucagcucccacaacugaacacgcacaacucaguuuaaauaaagucacaaugaggagucacugugagcuacagucuuaccacacguaacgguaccccacccuuccccuuuguagacagggcuagaaaagcugaggugugguaggucacacagccuuuuggugugguaaacuuagaacuugaauuccuaugccuuguuuauuucccuccugcgacgcuauuaggaaaugcuaugcugacaggaaauauuucauauaggcuaaaggcacauaaucuaauaauauuaaccgaacucuaaauuuaaaaauaaaauaaaggaaaggaggugguuuacuuuucaugccuaggaauuuuaauauaauagaacuauuuugagugccucacaaguguuuguaauacuuucaucuuuggcuuaggugucccauguugcucuuuguauuucugauuugucauucuaacuuucaagauuuuuuuggccauuuccaaaaucaaguauaucaauauuuucaugaucuuugcucuagauugcaaagagucuucaaguuaaaaaaaaaaaaguuacuuuacucuaagaauuuagugccauauauuuugaucauuuuuacucccaacuccuucuccuaauuccugccaggcccacccacccccaccuucugagcuuccaauuuuauuuuauuuuauuuuauuuuauuuuauuauuuuaauaacaugcugacucuacuuuguguuguucguguagaccuagcugugggaccucccucuggaauguggucagccuaccaacacauucuuaaagaaaacccacucuccccuccauugaugucacagguccucaguuagggauggggguucaaggacuccuucccaggccaagcuagaauguuggcuggcuugauugugcgcacaucuuaugcagacuuccacagcugcuaggagaucaugagggcaguaguccugucauauccagaaaacaaaggucacuccccaucucccagaccucuggcucuuuuacaacuuucccagucgcucuccugagaugguuccugggccuugggaaaguggugugcuauggauguucugcuugugucagagcacucuacuuguugugcuuggccacuuugugagguuuuguguucacccaaaagacuuuuggggagguugcggggggggggggugucugagaugaagucugagagcugaacuagucaacagguagagagauauaaauuuagacagugguuuuauaucauguccauuuugcagaugauaguaguaaauucauuccucgggccuuugagaucucuaacuauaggucuugacuguauuuacauaccaggcauguauuuccuccuguggagugggccuucaaugcaacugggagucgguugguugguugccccguuaccuuuaugccaccaucccacccauaggcaauucuugccacuucuuaucacuguagcucacagcauucauagcuggguaauacugucgcugacucccucccagucccggcagacuggauagcauuuuccaguacuucuggucaacccaaacuuucuggucaauaccacuugauuucuacauguccugugaccaguauguguaguaucuucaauaauagggucucacuguuaaguucugaugggcaaccaagagcagugucaauagccugauugugugggggaucuuugggacaccucugaccaaucgcuugaggggacauauaccacauucuagcuuagugaagguuacuuuuauuuggcaaccuauggcuucuggaagguacauuaucccuguguaggguaacuccaaguaaauucuuaaauauaaaaauauguagauauucauuuacauaaaaaauuuaaaaguagguuuucauauuucuuuaaacuuccuaagugguagucuucuccuaucucccuccucugcccuacccucccacuccucaccccacccaaaccuccuucccaugacuccuccauaccaccuguguucuaccauccucccuuuuuugagagcuuucuugccucuuucugagucuagucaacuuaccgaguuugaagggaagauaaggacuuccuccuaaaucugaccauagacuccggaagacaguuuaaguuccacccuaaccauuaucugcugagaguuuucugcuuaaagaaucucauucuauuucuugugaagaccaaaaaaauaaaaauaaaauccaggagugucugguucugcucuuaaugaagaaauauuggaaacuuggagauggggguuuucuuuuccuucaggucaugaccauugaaucguucaagugugucuauuggccagccuccucugaacuucagaauuguuaccugagggucaaggagcuggcuuuguggggaaauggcuugcucugcaugcugugcaugaggaucugaguucaaauccuaagcauccauggaaauccuaguuggacaugguagccuguuuauaugcccuggagauagagacaagaccccuggcuagcauuggagagcaaucuaggaagaaaaccuaugucaacaucuggccucauacgcauguacacaagaggacauacacauacaaacaugcaugcacugcagagaaagaaaugggugacagaggaagagagaggagagagagacagagacaggcagggacagacagagagcacagggaaaagacagaguuguugcuugaacuuaaagugauugccaucuggauaccccuuaaggacaagcuuaaauacugugcaacaugauucucuaacauggcaacuagaaggagacacuguacccaaaagaauggcucagaaugcauuugugugugugugugcgcaugcaucaggggcgauccuccccuggggauuugcuuuucugcccucgguccuucugagagaauaauuguuaucuuugacucccucgguccuuagagugucuucauuucagcaaaacuugucuuauuuuauguuuucuuauuuauaugucaauauauaagugaucagcagcacagaaauggggagagagacucagagcccugcacaucaguacccaggagagcgacagagaccagagcacagccaacagggcugaauuuaauacucgaaaugcuaaaguccuuuuagacacauagaguucugccuaauaaggauuuacaucugaggucaggaccgcuauugaaggggaaggacuaagggaacugaaggggauggcaaccccauaggaagaccaacacucucaacuaaccuggaccccugggagcuccuagagacgaagccaccaaccaaagagcauacacggacugguccaaggccccuggcacacauguagcagaggacugcuuugucugcccucaguggaaaaggaugugccuaauccuguagagacgggaugccccagggaacagguaugccucagggagaggggagcacccucucagaggcaagggggaggaugaaugggaugaagaccugugggagaaggacugggggggcagcaacaucuggaguguaaauaaauaaaaugaugaauauuaaaaagagagagagaaaauuuauacccgauuuuaauucgcacagaggccaaggccaaagcuaucuccaugcccugaggcugucuggguaacugacaccucuugcucucugccaucagagagcugcaggucccuugugaguaguugucccucuucuccucccaccuucagccuuaaccacauacuaauccugccaauccuaacuugcaaauuugcacgugccccuuccuauucuaaagcuaagaaccuucucugggcccgcucucucuaacuccugauacugguccaugcccaaccccgcugucuaucuuuacaaggauaaagaaagcaggauauucaagcccccaccacauaaaguccaaaguuacccagccuguuguugaaaagcuggggaucaaagugaagauucauuuccccuacauaacaguuucuauuccucccuuagcuuuugcuaccuguguguguguguguguguguguguguguguguguauacauauacauacacacacacacacacauauauauauauauacauauguauauauauacuuuaacaauacuagcauuuauuuaacauuuauuuugggcucccucaaacuucaccguaagaaucgucuuuauacaaaaauacuuuaacuguaaaaaaaaaaaaaaaaguuuaugaaugaauugcuuuuaauuagauccaauauauacaguuauauccuaagauaucuuggcucagcuggcaucuuaaaaugacagauguuuauugacuccuguagagaauggacagaagcuuugugcgcuugguggcucuuuggagccugccaaaccccaauuacuaacgugauucguuuuccacguaagcaccugaccucacaagucuguuacaguggcaucuucaguuguugguuuaaagauguugucagccuaaauccacacagugagagaggauucuugucaggaugccuguaguaauaaagacauccacaggguccaggcaggccaacaccagcaaaggacaauugagaacaaaacgcuuauguuaacagagagcauaguuagcugccugcauccagcuugccucuuguuugcuuguugguuugcagugggcuaugugacacagagaacugugacaaccaucuuugagccauggguaccuggagaccugcagaagcaguuacugguguaaaguuguuggugugugucagugacuacuccaagaagcuguccuuaucccugugguccgugaugauugggacccgaugugugaaaguaguuauacuucucaaaaguggaaaucucaccaacagcucugaucucacaggcuuguggugagacacaaggacagaaaugugucugaaagcacuuugcacacagaaauaaaagguuuuagaaaacccugaaggucccagcagcagcguugcgucaggcucagggauuguccucucgguacugucauaaggaagggagauuggucaugugccuuggggacuuuuuggugcagucauauuugaaacauaugugaugagcaggcuccuuauaaaacaaaaggucacaccacccucuuuagcagaauccuucccuugaaagccacuugugugucauagggaaacaaaacaaagauguuuuuucuacagaggagcauccggaugguucuuacgucuucuguacugcuguguaauaccuuccaaacucaagucucucacuugggcaagucucucacuugggcauaugaacacuggaggaugaggaagggcauagauagaauuauaugcuaguucaagcauccuuuaaaacacaucugcgagucuuucugagggacuccaaaagcccaaugaagguuaaugagauccgaugacugcgcucucccgaauggccauucuuucauuggauaauaaccaguuuugaagaaauugaagcuauagacaaaaggugacagaaauagauacgugguuagcugcccuauaaagcauguuuccaagaagacaguuauugacauaguauugagcacuuccucugggguucccaggcauaucugcuuugugauaauuucccagugccucucuggggaccagaaaaaaacaccaaauaaaaguuaccccauuggucaccaacuucucccaugacugcccuuuuaaggccaguuuuuuuucauaaccugaauuacuauauccugacucacuccacgcaucuacucaggaaucuagcagcccucuuccuucacuuccucaaagccacagcuucaauucuguugggcaacaauagccuuuguccaucuuucuaaucccauaaguguuuccuaagccgacacauaggucagcgaugccagccucacacucacuaaagaaauggaggugagucuagcugggcugccuugucuggccucuggaagaggaugcgccuagccccacagagacuugaugugccaggguggagggaaacccagggggaucccccaccugcucaguggagaaggagaggggaaagggaggaaugagugugggugacagggagggggaagagagcaggauguaaagugaauaaaaaaggaaagaaauggaggugaauuggaucucugucaagauacccauuugauggaaguaccugugucugcccaccccccacccccaccccaccuccauucuggaaucagucuccucucacuugaucaagccagggucuuucauugcuuccuuacaucacagaaaagaaaccuuacauuuugcuaaauacacagugggcaacccuggaguuaagcacugauagucccaguucgaaaugcagaaacuacaggagacuccagcauucaaaggacagaugagagcagucagucucugugcucuuuccacaguauauggccugcucagauauuguaggcucauaaguaaaaucaacacucuuccuucaaauguuuuagaaauuagcuacccugagaugguugcucagcucugaacucuacucuucuuccuccccaucccacagagauauacaccagagaugggaauuccuacgggagaccuugugaauucccuuucuugauuggugagacaugguaccaugacugcauucaugaugaagaucauagugggccauggugugccacuacccuaaguuaugaauaugaucaaaaguggggcaucugccuacuaccagguauguaugggcuggugaacucucuaauagcaagaagagaguagcguuuguaggaggcaaagggaggaaggaggaguuuaagaggacuuaacaugucugcagcagauauuauccaagauacggaaugugcguuugcaguaaggggaggaaguuggguacaguuuuaauuuugccuucagaaucugcucaagaagagaagcaggaccguuuguggaagaugaaauugggggagggcauuggggaagcucagcuacaucgggagaaaaguggaaagggcacagcaggugggaagucacagcuucaggagaaaguggggcaugggacacaggagcuuggcuagaaggagaucgccucugugaguuuccugaagcaaaccagagcaacagguacagaugggcugagccaaauuuaggauugugacuacuuaaagaagaucugugcccugaagccaaggcuggaagagaaagagauaccuuuggcccucucccaauuagugacgguguuugcucgccaugcuauguguugauaaggguaugcuuucaaguuguuucucauuagaagaaaccuauccagggugcuaaagcauucauuccucuuuauagaaauggacaaaucaaagaagugcucauguuacugucugguauauaacagagacaguuucuuagccaaugggcgagagcuacaauaaaucacaguaacuggcgugugugcuuaagaaacauugaaugccaagugugagagcuaacucucgcaaccucagcacucacaagacugauccuggagaacgauaaguuucuggucagccugagcuguagaagugugggaauacucucucaaagaaaaugaacgacaauagcuugaaagagucuauuaaaaggagagaaagaacuucggauguaaauaauaauaauaauagugaauaauuaaaugaccucuugucuuaguuuggguuucuacugaugugacaaaacaccaggaccaaaaggcaaguuagagaggaaaggguucauucggcuuacacuucugugucucuguucaccguugaaggaaaccaggacaggaacucaaacagggcaggaaccuggaggcacaggcugaugcagaggucauacgguggucaucuugcuggcuugcucccuauggccugcucaguuugcuuucuuauagauuccaagaccaccagcccagcauagcaccacccacauaaacuaggcccucccccaucaaucacuaaguaagacagugccuuacagcucugucuuaugacagaucuuacagcaguguuucucaauugaggaaccucccaucugauaaaucuaucaugugucaaguuggcauaaggcugucaguaccucauucccagcaucaggcacuguucuaagccuucaaaaucuauuauaaccauucaggccccauaacaacuacagaaaagcacagugaggccaagguggcccacguaguugcauaaggucuugaagguccaagaaaccugucugugaagccuuugccccaaauggcucuacuuuccugcccagagaaaaggcagccuggcgguagcguaugcugaucccuucuuaagagaccccaagcuucugaucaacuugaagaaguuagacagggccagcaauuccauacauuagggggcaccaauaccaguuggaguguuuguuagaacagagagccaccucacaagguucugagucaguggauuugagguggggucguuucacaaguucccaggucauggugaugaugcuggccugaggaccucucuaugagaguugcucuucuagaccaaggaccgggcuuuuuaaacaccuggaauauuuuuaaaagugcacaguguuugcuucuuaucauuuauaacaagugaauuguggcuacguguucuguuuaacucccacuauugcuugggucagagauuucaggugagaggaagaagcccugguugauggaaaguccugccagagucagaccacacuuaugugaagccugguagagaagccagcaagaugcccauucugcagcauguuugccugguccaccuuguugucuugacugaacucugccuguguaccuagcugccuucuuggccagaggguguucgugcauuuguguaucuaccagaguugcuuuuuuuuauaaaagaaagcuacauucucaaaucugaggcuugcuaagccauggagguagcguggaauagcaaacacacucugugcagucagcaguggaucucugagagccucuccaguguauagaaccacgaguguacuauuugggguauaacugguacuauuugguguguaacuaguaguggaaagccccuuugaaacucccuggguggagcauuaagucacgugauccagccugaguugguuuucccucucucugggaucacauaggaaaaugaguauauuuugaaccaguuaucucaauaucuauauaauuuaaucaugguacaacuugaagauucuuuauuugaaacacacauuucuauaucuauaucuauaucuaucucuaucucuaucucuaucuauaucuauaucuauaucuauaucuauaucuauaucuauuacauagcuuggagagggaggguauuuaagugaauaagagugcuugcuaugcaaacaugagaacuugaauucaaauucuuggcacccaaauuuagaaagagaaagcuauacauaguucaggacgccugccaguaaccccagugcaguggaggucaaagauaagaggauugcugggguuugcuggcugccaacauagcuccagguuaacugauauauucugucucaggggaaggugaagagaguauagcagaacaccugaugucucccuccugucucugcuugcacauacacacaccagcacaggcaccugccagcacaaacaugggcacaaacccaugcuugcacaaaccacacauacacaccgagaauacacuauaaaccuucuguauugcacacucauguuuuuaugccuauaugugcacauguaaugugaguucuacaucauuaauuguauucauguagucaaucaucuguccaaauauuaaggagaaauuugggcucaaguucugaaauaaagacgucacuaugcucugugucuuagccauuuuccacuauguacugugucuuagccauuuuccacuaugcacugugucuuagccauuuuaauagcaucucuaugcauaugguacuuucuaggcaggcugcagacaacaaucuuugccaaguucaagugagcuuauuuuccauuggcccagugagccacaccuucauauacugaagccuccaucaucaggcaaagggcuugaaggaacacugguacaaacauggcacuguagcugacaggacauagagggaaaguggaagaguuagcccgcuugagucauuugguaugcucugacuuucauuucagugaauaaugaaaagacccagauacguuccauguggugacagccuccguuuuggcacguccuaagagaauguaaauugacuugccaucuuguaagcacgccaaguaacagaaaacacuauuuccuuauuuuacgaucacuaauuuaucucuuuaucaacagaaaguggcugugaagguaacugggaaaagaaugagcagauuggaaguugcuaccaauuuaauaaucaggaaauucugucuuggaaagaagcuuauguuuccugucagaaccaaggagcugacuuacugagcauccacagugcugccgaauuagccuacauuacggguagguuuaacuugcaugugguagagcagacaucuggaauuguaaagaugcuuucuucuucuacacugaauaaccaggcaugcucuuuugaugauauccuuucuggccucucuuaaaaucuaaaccuuaacauugaagcguacaacgaaaaaaggaagggggauugaauguaagcauaucccauguguugaaaugcaccucgugauagaaacuagaggggaaacugcuguuuagaaagcaaguuagaguacaggauacaguuagugaccuaauccuaaauggauagaauggagaggagagggcaaacacuagaccccuggacaccacaaaacagagaauucgaggaagacagagcugggagugaaucaugcuagcugaccucaguggagagucuucauaugggagaggaaggcacaaggacaaggagagguuuaggauuuucuuucaauauuuuuaaaauauugugcguaugcacacaugugcaugccuguguaugcguguguuuucaugugugaaugucaguacacugggaagccauaaacgggcgucaaauccuuuggagcuagaguugcagacugucgugagugcuggaaccugaaggagcggagccuccgccucgggaaggagugcuaaagacgugcuuaaauggacaggggaacgcacacccagccucaacgcuucacaaagaauuacaagcaacuaaaaaaucuugagaguaggaggagcaguccuccccgaggaagagcacacugacugguuauccaguaccaaauggucaacccugagagcauccguacaagcgacauuguacacacagagcaggguguguuuguauuucgguguauauacauagcauauacauauaugcauguaguggcaaucaaugaaaaaagaggcugugaauuuagaagagagcagggagagguguauagggcaguguagagggaggaaaggaaagggggaaaugaugucauugcacuauuauaaucucagaaaauaaaaggaguccuaaagcggaugaauaacaaggauaugcagaguggaguuuguuuggucuuguuuugucuucaggguaguagaaauuuaaaauauuauauacauacauaaauucauauacacauguauauaauauaugauauaguauguauuuaguuauauacaauauauuaugauauauauuuuguauauaaugaaaauaucauuccccaaaagccuuucauuuuuagcaaucagugauugauugacacugggaaucuauuuccagaaacaagaggugaccccuuuagugagucccucgaaauccuaaaggguuuucuuuuucuuucuaccugucuugcaucuacuuaguuauuucuuuugagguuuauuguuguugucaauacauagauguggugauagauuuggguuguuuggacucaucauauuuccuauauaacugcccuucucaggaccuacaaccaaccaagucccccuaaaacuccaaagagaaccccauaugccccaggcaggaacacuuccuaauuugucuucacccugagaauuuuuccaccuugagcugcuugagcugcuugaccugcaccccaacgcuaggacaaucccaaggcuaggauaguucccaggcuaggacagucccaaggcuaggacagucccaaggcuagggcagucccaaggcuaggauaguucccaggcuagaacagucccaaguccaggacaguuccaaggcuaggacaguuccagguuagggugauuauagccuuucugaaggagcuguagaguucuucuguggcucaauuuaggcauaaguuaucaggcuugucaucgcucacuguggaaggaggaagagaaauacgcagucagaccugaacagaaaccucaggggcaccaaaugugucuuaggaaaguauuugcaaauuauguuucuggcaugagguuacuauucagaauuuguaaggaacucaaauaacucaauagcaaaauuugaccaagcaagagcuauagaccuaaauagaaaguuguaaaaaccccacaaaacuagucaacagauagguucgaguuuuaaaugcucaaaauaacuaaccacuggauaaauacaaacuaaugucacaguaagauaucacuucuuuacauuauaguggcuauuaaaaauaaauaaauaaauaaauaaauaaauaaauaauaguaauaauaauaaaugcaaaugagggcaggaagaaaggagaccguuuacacacagucuggaaaacugaaaaguagugcaaccauugaggaagugaguauaagguuccccagaauauugaaaauaggacugucuggcagcuccugggcuagguacacagccuaggaaggaaaagagcacgcuagggagaugcccacuauugcacguugauggcagcacuacucacggugaccaacauaaauaaccaacagcaaucgacaaggauuucuaccacccagugagagaaagaaaaacuggcauauacucgguggaagaaaucccuggcauuugugauaguucagacauuaugguaggugaaguaaggggaggcacggaaaggggaccaccacaggcugucagucauaagagccaucuaaacuccugaucuccuaagagcugagaggacugggaagggaaagcuucagggagcagcaggaaggaaagccaggggcauggggagaggucggucagcagguacaaaguaacauuuacaacggaguggugguguccccuugcacagugagguaggugaugguaguuguuggucauacacuguauauuucaaaauaacuggagagaauucggacugcuuuuaucacaaagaaaagauaaguguuuaaagugauaagugugcccauuucccugguucgaucgcacaguacgucaaaaguuucacacagacccacagacacauauaguuccuaugugccaauuaaaagcagacaaaaggaggaaacagaguaaacgacuugccuguuccuucaguccaaggcucucugcuggcaagcaucugcaagacaguccaaguguccugggcuguaaguaaagaaaaagcccagcucuugauggucuacauaagcugucucuguccuacgugucuacccgacaaguacauuuaggacgacguacccauuucucacuuacauccgcuggcuuagcagcaugguagaaaacuuaaauuuuauaacuccagugacgucaauacaaauuaaaaagacaguaaggagacgaaucagggacuuuaguucaaaaagaucccauuauguuagucuguccuugcugccuacagguacgcaccaggguuaugcagcaguaguugcguccuguggggggguggggggguuaucugaaaaaccuucguaggaaggauguggcugaaucuguacuggauaggaaggugcuccuaguauccugcuugaaccauggcaggaagguggaagugaauacaaacagcauucgaaauaucaggggacaugguuacgucuggagcaccagaaauacuucuuaguuugcaggacuucuuuuggaauguuggaaaaccaacugcuuuuuacuaacaaggggagccaugcauuagauuucaucuucaagugugcucaguaaugguucuagcagcuguugcaggagcuugugggggaaaggagaaggaagaauucacaguucuugcccaaccucaaggcuucuaaccaaacaccugcccucucuuuacucaauaaagcaucgcugccgucuacuuccuugggaaaggugggcaaacuuucucacccccuuacuucuagcuguaucuagacuguggucccuccagcuccuccaaaacuccuccuuucccccaagaccuuugugacuuaccggcuguucucccaugcucccaucccgaucacgaugcugacucuuucauuugccaacauccugcguaaacauccaccauuggagauaugcuuaugucuggguccugggagccucccuccuucuuucuuaacgaagcuccuuuguaagcccccaaaaggccuacuuuacacguuuggcuucuagagucgucagggaggcaaagauuagguauagucaaaguugcucuugaaagguucucauagucugaauaugauuuuucucugugaaaucccuauagucuauaauacauacacauaggcaccuuauagggcgauagauagggacaugcuguaauaauacacauauuccccugugaguaauuaggaaacuguuaaguaauuaucagcugaaaauacccaacaaguuuauaaagaucccaucccagccuccccugucauucauagaccgucucaucuguugcucugucucuucuaccuggccuucaauuaauuuuucaaauucuucccucauggucuugauaaagucuuucuuuccagguucauggccuccuagaugaugguaaaugucuuaguuuuuucuuuucuuuuuccuuuuuccuucucuuuccuuuccuuuucuuuucuuuuucuuuuuucucuuucuuuuugauauuuucuuuauuuacauuucaaauguuuuccccuuuccaugucuccccuucggaaccccccaucccauucccccucccccugccucuaugagggugcuccaccacccacccacuccugcccuggcauucuccuacacuggggcauugaacacccucaggcccaagggccucuccucccacugauguccaacaaggcuaucuucugccacauauguggccagcaccaugggucgcuccauguguauucuuugguugguggucuagucccugggagcuccagggggggucuggccuguugacacuguugcucccuccagucugcaaacauccucagcuccuucagucccuucuccaacuccuccaaaaagacaacauuuaauugggacuggcuuacagucuaacagguucuguccauugucgucauggugggaagcauggcaggaugcaggcagacauggugcuggaggaggagacgagagcucuacaucuugauuuagaggcagccaagaggagacugucuuccauacuggguagaacuuaugcacaagaaaccccaaagcccaugcccagagucacacauguauuccaccaaggcuacaucuacuccaacaaggucacgccuccuaauagugccacucccugugggccaagcauucaaacacaugagucuaugggggccaaacuuauucaaaccaccacaguaaaaauccuuacaaucauccuuauguucuuuauguucuuucuucaugauauaaggauucaugcaagcaugggcacauccauauuuuguauccacaucagguagcauaugggcaacuagucucaccguugacauuauuuauacuucccuguccccuucccuucuuuucccgacgguuuugauuaugaaauaauaagauuguaugauaugucuuccuaacaacaaguguguguguguguguguguguguguguguguguguguauaaaacucucauaucuacuuugaacacacaacauaauagagucaugaaacgguucccacacauauuuguaacccagaaaugcuuuucuguuugaggggucaccagcuguuccccuccacgaaacugaacuuucuaugugguaaauacuuuuugguuuugauuuuuauauucauaagccuggcaaauaauaugggcuuuauggcuuugaccugucaguuugggauacaaucagaucuucaacaucugggcagaggauggaaacugcuuuucaguaagccuucucuguaaggacugaaaauacauagugaaacugccacucagaacauucuuuuaccgcagaggagggagaacuggacauugggaaagcagaauugaacaaauuuauuagacugugaccuucucaaaaaaaugaaguuuucuugucucuuaacauggccugccuuuguugccuagacaguccuagugagauuccuguuucaguuaagacuuugggguuuuuuuugucuaucaauaaaaaccuacuuugauuuauauaauuuugucauuguuagaaauuauguaauucuaugugucucugcauauauguguguguaugcauguguguguaucuugugcuuuuucuuuggcccuuuaucuucuauuuguuaucuuugucuuauucugguuucuucauuuugauuuuaugaucauuauuauuuuauaugcuuauuuuugugaacuugggugcguggggaaguggggaggcucugugaggagcuaggggaggaaaaaccauaaccagaauauauuguauaaaggaugugcuuucuccgggcgugguggugcacgccuuucaucccagcacucgggaaucagaggcaggcggauuucugaguucaaggccagccugaucuacaaagugaguuccaggacagaaaaaaaaaaaaaaaaaaaaaaagaugugcuuucaauuaacacauuuuguaauuccuacaggaaaagaggacauugcuagacuuguuuggcuuggacugaaucagcucuauucugcgagagguugggaauggucagacuucaggccacucaaauuucuuaacugggauccagguaaaugcucguccccagcaaugugaacagaguaaaagcuucaaaagcuaggaccuuuuuacucauccagagcuuauaaaauuuccuguacagucagaucucaugcuugcuucgucagaauuuuuuucagaccuccuuaacugugguguuauuucagccaaguuagccaugccaugggcaauggagcauuggcaccugggcuuuagggcaucccugcguuuuuaaaguaaaaacagaaugaacccuacggcauggccaggaaucguucuauaucccauagggucuugacucccaauguuguacuuagucuucagcuugcccuuaauggagaaaaaucccugacuuccacacaauagcaccuaaacacuaagaacacaacagauguaguuuauuacacaaguaaauacaucaacaaaaauaaccuccuguuuagccagaagcucuuuaucuacaaagaaaagaugaggaaccuuuugaaaccuaaaaccugaaugauauaacaugaauaacaguguuccaccuacauagaagagaaauggauugaauauuauaaaacaaccaugaugcugucgucaacuaaguauuuuuauuaguaaacagagugacucuauugagucaaaaauagacuaugcuaggcaagugcucuacuacugagauaacagucccacuccuuaaauugauauuuaaggucuucaaggcaguuaauguuucugucugguuguaaguauuugccuuaagguaaauuuaauacacacuaagaggcucuggccacaggugugugugguggaagcagcucuagggcagagauagguuuguuuuucugcugugaguuagcucucauggaucagaacgugccccuccaucucguguuucagaagagggacaagugagcgugcuguugcucacugcggccuauaacuuuucaguuuaguugaaaguuuuaaccauaccgugagccuccauuagacagaaacuuaugaacuuggauaauuuuaaguccacucuaucccuaaccuccuucuaccuccuuggaaaucugucuuuuuuaaggcacgcccguugcaccugugauuggugggucaagcugugccagaauggacacagaguccgggcuguggcaaaguguuuccugugaaucucagcagccuuacgucugcaagaagccacugaacaacacgcuggagcucccaggugugcccccacuuccucacguguacaaaugaggccagaguucugugaacucaaguaaaugugugccagauaacugcucuccuuuccuucccuggauacugccaaugguuguuuguuuguuauccccagaacccaugcuaaagugccaugguuguguauguucguaauccuggugcuggaggugggggaugggcagagcaggagaauccauaggguugacuauccaaauagucuacauuaauugauaagcuuuggguuaaugaaagacucuaucucacuuccucaaaggaagcugaugacuuuccugaggguggcaccuaagguuguccuuuggacacacacacacacacacacacacaggauccaccuuucucauucucaaguccuagggauuggaacucagauuccuaggucucugugccugcagagcgagggcucuuacccacugagccaucuccccagcgcugaauucuuauccaaaaaggaauaucgagcaauuuaaaaaguaguugcauagaguaacguaggggaaugucuuaugauaguaggaagaaaugaacauuugucuuucaaguuaccaaauauagcccauacaacagaaaacauaauagagaugccgcacaagggagaauguacgagaacggaugauagaauaaauaaauaucuugaaguugccaucauuaaauaaauugugccauuuccauaguaugugccuaguacaacugugccggcaggaaaauuccaagagcagaacaaaaugauaugccuaccuaucauuguaacuuuguggagauaaaggcuagagugugcggaugauuguuugaguucauuuacaugugguuuuucucucuguuucuuucuauaauugaauaucccauaguaauaaugaaugccauuuagaaccuaaguuaauugaguuauuaucuugcaaaaaaaaaacuucacauuuuuaagaugacuguguuugcuuguuaaaaaaaaacaaaacaaaacaaaauaaauguugcaaaaagaucuggauaaauggaacaacgaaagugcuuucugguuuugcuacgaaaagcaauagcccuuugccucugaaagguuagaugcgcuucaucauggucugaaacucacuggucuuucagagaggaugaaggggucuaaagaagccauucugucccccccccccuuugcugccaucucccgagggugcacuaaacaaauuccacguccugcuccuuaaaucucuaccugcccuuuauugaacaguaaguauuagcaagcauccacuuaccaagccggucacauuagaaaagaaggcuugagucuuccuagucucagagacaugggugggggugacccuccaaaucuccgaccuggaaaagguugucagcaucuggccuacuccacaacugucuuccacuuauuacaacuaaagucguuuccuuucccgaccgugucuauaccccuuaaauauucuuguccugccacauaccuuaugugucucagaauagggacaguucgugccugaaucuccucaggaguucuuauaaugccagauacauaggaagcacagcauaacauucaugucacugauagcugacaucacaucucccaguuuuccagaagugugugacucaaggaugaaccauuugagggcuguggauucaaaauauaucugucuuuacuggaauauaaaucgaugcuucucccccccaccccccaccccagauguuuggacuuacacagauacccacugccaugugggcuggcugccaaauaauggguuuugcuaucugcuggcgaaugaaaguaguuccugggaugcagcacauuugaaaugcaaagccuucggugcagaccucaucagcaugcacuccuuagcagauguggaggugguugucacgaaacuccauaaugggggugaguuuguuugucuuguuuuaaacauccuguuuuaaaugcuuuaaagcaucucacguuccccauuuucagugagaaggaaaggcuuucagcccgcccaguaggaggagcauauccgggggccuuucagugggaaugggcgugacccgggcccugccuuauccagugcuguagcuacuauguggcuuuugagcuccugaaagguagcugggaaaaaugaggaacuggaguaucaguuuuguuucaucuucauuucucugcaucacggccacuauuuaaucagccacucucccucuguccagaauuaugccaaauccucuuuaaguucuucuaaaaaccuacuugaugauccuuuugcuuuugugauuaucuggaauuggacugaaaaacaaagacauccuagacuccgcccucuuccuagaggcagacagcggagguaccuguuaugugccagcacggcgcucauugcuguccgugugaagacaguagucauuucagcacaacaguggacagggaacauuucugacuaggguaucuaugacuguguuuauagaguuucacuaauuacaaagcagaguuuaugcacagcagaugugagggacacugagcuggcacauccuagagcagcucuucucccugugugcaguaugaggggcauuacaggccuggcgacccacccugucugcucaucaacacccuuagucagcgacuaaggaauaccgcuuaucagcgcguaaaagucaguaccaugccuauuauaacauacaacggagcaaaaccaaacaaagaaaacacuuuucuuuuagaugucaaaaaagaaauauggacaggccuuaaaaacacaaacagcccugcuuuguuccaguggucggacggaacggaaguuacucuaacguacuggaaugagaaugagccgaguguucccuucaacaagacucccaacuguguuuccuauuuaggaaagguaggacaccuccuguaguuuauuuauagucuuuuguuguuguuguuagcgcuaauaauaauauuaccauugugcuagggacgggaguugggugcaagcugagaaggaaaagguaacaucccguagguugucauccugagagcugaucgcugagugagcagucugcucccugucuaagcacccacugcagucuggaaaagacacacagacuccuuagaacucuggugucaaauggccugcuuucuucaaggguccaaguccccaucagccuuucugcucauuacgguugauguuuggcagguaaccauggcucagccugaaagagucuucuuuuuaugcucugacuaaguuuugaauuagucaugauuugaggcuaacuggaaaaugcuuuuuaauaguucaacuuuuaauaaaaaaauuuuaaguaguuuuuaauauuuauauuaaaaauuggguuagauuuguucagaaaauuaucuuuuccugagauauagcuugcuaaacacucuuugagcaugcucuggcuagaagccuaaaauaggcuauaucaugcacagaaggauuuaaacaccucuuuuaguuuuguuuguaucucuuuccuauaggcagcugucccuccugguaaucagggugacugucacccagacaucuagaaagacuguaaauggaagugucaaacugugugcauauuuagaaguguccgaucgcaaagaaguguuuuagaagugucacacuuggugcccuacuuuaaaagccaagaugucucagcacgucauccgaagugaaagugaaaagugaagggcaggccuagcuacacagccugccugaauucaaacgugacccuggguacagucaagccaccaacauuuaguuucaagaagcaaugcaacuaggccaauuaagcaaaaucaaguuuauguagcauauuugaaagagacaguuuugaugucuagacuggaguagaguugaaagaaaccuucgaccauacacuucuugagcaguagcucucucaucuccaccaccauccuuaugcagaugaggaaacgugacuagccuuuaguugcugugucccaaagauuuuaaucgcugaacaaacuucagacaggucacagggaagcgacuagaauccuggcagcuuuaggaggguucuucugucuuggacuucuuaucuaaauguccuuuggcuguuuuauuguuaagcuuauaagaaaaggaacuuugugcauaguguguuguggagauggcaggcucaagcacuaccuuucccugcgcaccccccgccccaugcccucuccauaguuaccgugacuucauucuaaauguuuggcaaauaauuuguuugauaaggauuuauuuuuucccucuuuaaaaguuaggucaguggaaaguccaguccugugagaagaaacucagauauguaugcaagaaaaagggagaaauaacuaaggaugcagagucggauaagcuguguccgccagacgagguaggugaagugccucugugcguuccugaagcggaauuaucccucugugguuaaagacgaucucugaagcuuaaacaauucaaacauggaaaguaaaaguacugguuucuauuccuacauuuaagaaaaauugagaaugacgagaaucauaaaacacuaguguucuuguggaaagaaaaagcuuaccuauaaauauguaaauaugacgaugucgauaguuagauuuccuccaagacaguacucuuccugaaaacuaauccaaccaacagcugcaauagugugggucagggagaaaaggcaaagaacacuaugccacaccucagucguguagaagugaccugugaaaccgagcugcauccuucccaggugaggacagccauguccucugcuuccucaggguagacgauuuugucagagucuggggccaggggcugucauuaagucucaaacugugugaugguauuccucuucugacuuagggcuggaagagacauggagaaaccuguuacaagauuuaugagaaagaggccccuuucggaacgaacugcaaccugaccaucacuagcaggugugaccaucaguacacaguaguaggaaacuuuuaacugacuuugccuaaacagucuccuaggaaaaaaaaaccaggggugaagggcuuuuuauuucaaaaacucugagccaguucguccuuuguagguucgagcaggaauucuugaauuauaugaugaagaacuaugauaagucccuucggaaguacuucuggacuggccugagagacccugacucucgaggagaauacaguugggccguugcucagggaguaaagcaggcugugaccuuuuccaacuggaauuuucuugaaccgggugagugcuuucugaagggcuggcaaugcuuuaggaaagagcagacaaggagagcguugggguagcgcugagccucacacuuucacagagcaccagauuuacagcugccuuaaccuggucugcaaagcuugcuugugucugccuagucagguuucucccggagacauagacagcuagaaggcccuguggcacuagggacagaaacaagcagccacagaaagagugagucacagggggcuaugacuuaccaucgugccaagucuaccugugguucugauuuuaugauuuuuuuucccaaaagcuuguucaugcuaaggugaaagguggaguugggagcuugggcaagcagaaacuauucucuugcuucagauugaauaaguauucuaaaugcuaacucauuggagauuaauguccucaugccaacugguugcaguggugaaguggggguagaacauggcuagagaaggauaaaauagagaggaagauaagaaggcacaggcucagcugggccugguggcauacaccuuuaaucccaguacucagaaugaaaaggcaaguggagcucugugaguucgaggccaaccuggucuacauagugaguuccggauagccagagcugcauaaccuauagagaaaaacaaaagggcacaggcucaguaaagcacagaagcccuugcuauccagaugcuucacaccaaaacaaacaaacaaaacaaaacaaaaaacccaaaacaaacaaauaaaacaacaacaaaacaaaaaacccacaaacacaaacaaacaaaaaccacaugugaaauccaagguuaaaacaagaguggcauuagugaguucugcaugaagcgcugucgacacccacuuccugacaaggucugagggaagaagggguaccaccccuucuaguuuagcuuucagagacuuaaaggagguggcauaggguaaugccaccaaauugcgcuacgagaaagcucucauuuguauaauaaagauaaugccuaauuuuuaagaagcagccaugagugugaggguuggguuuuuuuuuuguuggauugguuucuuuagaauggguguuucucccccucuuuuaauguaagucucaaauacaaauuaaacauuucuuaugaaguauuuugcauuuuaucucucugucuccugacuucauccugcaggauuaaacauguauugauauuagucucugugagaauaaauuagggaggcaguguaagauagcauuuauuucuaaaguuaguucaucuuucuucaaacagccccaaacauugaucauacuucaccauggaaaccagaagaacuaauguagaaguuccaccugauuuuagaucugggaaaauacagguuucaaugauucacuuauaccuggugauugaucaguaaaaauccauaucuccugacuuccaagccagugcuguguagauuggcuuauucaaauaagucauuuuacuuuccucuuuucagaugucugauauugucuuguguugauauaaugugaucauuaugguauuuuucuauagcauggaaacuggacuguguuaucuuaauaauaaaacacaauauuugaaauacucuucacaaacuuggugacucaugaucaugacuaucaguguggguagcacuaauaauagcaaaauuaucucuuuauguagauaagguagaauauagcugcgaauccugguuaaauaucauuuaaauuagaaauauucuaauagguaagacauagaguucuuaaaauauaaucccugcacuuaggaggcagaggcaggaggaucucugugauugaggccagccuacagaaccagggcuacacaaagaaacaccugucucaaaaaacaaaacaacaacaaccacuaucuuggcacaaacagaguagauguuuaaacuuggaaaguuuucauuuuugucuguggccuuguaccacccugauugcaccugaucuccucuuaaaguucuaacguuuaauuaaccuuucugacccaaccccagcgucuccaggcgggugcguggcuaugucuacuggaaagacucuuggcaagugggaagugaagaacugcagaagcuuccgugcucuuucaauaugcaagaaagugagcgaaccccaggagccugaagaagcagcccccaagcccgacgaccccuguccugaaggcuggcacacuuuccccuccagccuuucuuguuauaagguaaaguaggggucucauuuggucauugcucuacuauccuuguucaugccuuuguacaaauuaugccccucccuguaagcacacagugccucacaccaauguuugggagcacagcauccuuagcaaagcuucaugggucucugguaucagacaacucaacucuacccaugucuugccuucaaaagcaagacuaaagccagagugacccaugguuccuucccucugagaaguugagugaccugcagcaugcugacauuguauauaggauucuccuaagccccuaauucuucuuauuggauuaaaauuccuucguguauaaugaaagccaguucuuauuguauuauaaacaagacaauuuggggucuauaucauugauuguaguuccacaaacagaccuuucaauaccacuuuccaacuccaaggcaaucacauguauguaucucuggcucacuuaggguuugacggacgggcugcgaauucuuccagauuuuggucagcugucuggacuguaaucuagugucuguuacccuucacucuagggcucaggcuaaaggguggcagcugucagauuguuuuccucauaguaaauuacugaagcccaggaaaggcugcccaaccaaguuggugcaguucaggccucuagcuucagcauacuacauggcgaggucccgugugaagguggagagaagcauguuacucccaccaggagucauggcuagaguguauguggauacaugacagggaacugaagagucaggaccaguaaucugacagcgguguuuugucuucucugccugcuccuccacuccccuuucuucuuugaaauagcuaggcucuuucgguguagaguuaaucgucacaaaucaaagaaacagucaaaagugcuagguuuugauuuggcaccaucugucaauguucucacgcauagaauauagauagcucuuugauuguuccugaucagaaggcgagccuuguucuucugcaagcuucguguuugaugcucagaauuacacuguuggcacauuucuuugcagaagacuacuuccagaauguuccuggguacucucucagccuugacccuuggggcacuuucucuccaggguccuagguaugcagaugcuugugggagcgguucuccagccuggcuagagaaggcuacucaccugaugaugcagccgucacugugugggccucuggcuuacccugggcaggacuugucuuguuugcuguauguacauuuacuugugcuuccauuuccccugaaggaauucauaucggagacccacacauuugacugcaguugauaaaucuaugaacauuuuaugauuauuccagaagaacaauauucuguuuuuugcuaagguguuccauauagaaagaaucguaagaaagaggaacugggaagaagccgaaagguucugccaagcccuuggagcucaccuacccagcuucagucguagagaggaaauuaaggacuuugugcauuuguuaaaggaccaguucagguaagguugcuagaguaaguguuuuugcccuaagccugaugucaucuugguguucaaguuguugugauuuagcaucuaaagagccauuccaugcuucacagucaagcagcaucaaguaccuuacugccaaauaccauagagauucaaagccaaccgaggcauaguccuggcgcuauguguagcacauaccaacagccggguuaagaaaaguauggcaaagaugugggcaaagacaaggagagccugagcagaagccagaaggggaaggagugucucugguguaaucagggcaaaugccacgaaggaggcggauucuuagaagguacacaguguuuugaaagguaagagaggagaaaggagccagaggccacaaaacaggaaaggaguuaugagaacuaugugggcugcugaggagcaaacaaccacaggaagugggaauggagacgaaaacggaauggcuugcuaaucagggaagacaucugauccuaaggggacgagagucaaacgagguagucuccaaauuauuucaguugugaaaaggcuagucguuauaaaccaccuauggaccuguaaacacacacgaugcauguguaauugcacagacagagccagggugcggaucaguggugccaugcucgccuaccaucugugagguucgauguucuaucccaggaaugcaaaaacagccaagagugggucugaagguacucuggggggcgacuaguuagaaaacuaccacaacacccuccuggaagccacaugaagugaggacaguaagaaaggaagcuaucaaaguggcuacagucauuguaaugucagcggggaaggcuuuucugaccugauuucucuguugucucucaggauaccauagagaaauauaggucagcugacacuuuccaaacugucacagggauuaggggcuucaacaccacaaaauuacuuuuucuucacuuuucugaacacuaaaagguguuuguuuguugaaucaagguguacuaggauaaauggcuuuaaaaaaaugaacguauucuagugaauauuuucucuaugauugugaauccaacaaaagcccuuuccccucgaaauaaaaguuuacuaaaaaaaugaacaaucuaaccagccuuguucuuuugcacaucauuuaacuauaaaagaugugugaagaucgguauauaaagcauauuaagguggaagacgcuugcgauguguuuaguucccaguuaacuucauuuuugaagagacugaucuaaacaguguauauugcauccuuugaaaaaagcauaccaaagacauacacgagcuuggguguaagucuaaaaaaucaagaacacacaaaaauaaguaauuuauuauaaaaggauuuaaaacaagaauauaguauaaccccaagacuugauagucaauguaugucauuauaagaacagaacagaacuauccuaaacguuaaaaggaaaaaaaaaagcacaauaaaugaagguuuuagaggcuguggagauggcucagcaggugaaagcacuugucaugcaugcccgaugaccccagaagccauuuauaaaagccagaugcaguggcucacauucacagaucuccuguggugagaugggaggcggaaacaggagaaauagcugggagcucgugggcugcccaguccagaauaugcaaugugccaggaacaagagaaauccugccuugagagggucaaaggagagaacugagccuugaaaguuguccuuugacguacacacaugcacacacacauuugcacgcaugcauauacacauaugugugcacacaaacacgacacacaugcgugcauacacacaaacacacacacaauggcacagauaugcccccauauauauuuuuuuaauuuuaaaaggaauacuucaauaaauaacagguuuuuaacacucuuucuaaauaaaaaccuggaauguagagacauaaaauaguuguggaauaugaaaauauaauaaauuauucauuuucucuggaaaccauauuuuagagacauuuaacaugcaguagauuuuaaaaguacgugcccguaggucagauguaugaggggagggaagcugugugauguucauguagagaauuauaagaaaugaaauaacaaaagauuaaucuagcauaaaauaaguuggcaaacacccaauuuguacauuaucagcuuugauuaaguccaagucuacaaauuuguucaauaaugaaauccgauucuguuuugcuagaaaaugcauaaaacaaauguggccauuagugcuuguccaggcccgagauuauggugucgccauucuuuguggauggaaacacagaauguuuuaaagcggugcguuucaguagaguccuucucuuuaaaagcugagggggguggugaugcuuuguguacagaguguaaggggcuugcgcacaugguggcacucaguugcuacuucccuggcuuauuacauuuugauacauuuugcuggccuuugcugucugcgcugugcugggguuguccuuuguuaacucaaauagcaaaggaauuaacagccacaagcuacauauugugugauccgauuauaauaggcacugaaacugcaccuagaaagaugccuuacccauuucuggcuuaacauauaaauauaccauauauuugauauguuuaauugauauauaaauuuguauuauaaacauagcacugaagucaguaucugucaugauuaaugauagagcacuuuacaaugcuuucucauaaaggacagaaauggguaagaauaucugacuguuacuguuguugagcuauuuuguaauuuaauauauauuaagauaggaaauauuauuauguguaacauauugucuucacugaagaaaaaaggagauuauaaaagcuguaaaaauaugcuguucacauuggaaacaagucugcaaaaaauagaaauaaucaauggguauuacaucuagcaagcaagaucuaaaacauuucauuagaaauuuggguuuuuuuuuuuuuacaggcuugcuuuaucguacguagccacuauauauggggggaggggggugcaugacaacauacuccugcaaucaauucuagcauuagggguauuguagcaagacaaucaggaauucagaguugcuacguagggaguuuaaggauugaacccuaacuuucgugagcacuaggcaagcaaucuaccauugagcuaugcccagcccucucauuuuucuuuugagacaaaagucucauguagcucaggaugaccuuauugauuaucuaaaacccauuucugagaucauacugauuaucaaacuucuaaauuuuaccgaucaaccuguucaugacauugagcagaaaaagcaaagcuuugguaucccauagguucggagagguccuugugguagcugccucuggaauauagccccuuaaauacgcugccaaucuuaccugaaguuuggauuuugaacaagguaaccuaauaagaucacaagcuuugaacacacaugagcuccuauacacacgcgugugcacacgcauacacucauacacaaacagacacauacacacugucacaccaucauacucucuaggugaagcauuuuuagaagauauuuacagaacaaacucucaguucuauucgaggaguuacuaucuccuuggaacaggaagccauggauacaugcugagcaaucgaucuaucugcagauauuugaagggaucaauuaauagaaaauuaucauaaucuuacaugguagaaauagccauucagaacaucuaugggcagaggggaucauacagggagacaaaccuguguaaaagaggcuacuuuuauugauuuguuuccuuuuuaacacuauugaauacccgccuuaaaaauugauaugaauucauguguaaaacuuagaaaggauaaaaaguaaugaagaaaaugaaaaucauuucaaauauaauuuauauaagacaacauuuuuguggaaauccucuccauuuccuucuauuuguauacacauuuucauaaaagugucugaaaaauacaccaauuaaaauguuuuuuccaucuacaaaaguaaugcauacugaaguuggaaaagaugaacguguagagcaaaacaaacaaacaaacaaaacaaaaaggcgaccuaauaccaucaccuguaggaucauaguuuauuuguacacucgggccagcaggccagcaaaggccauauuauuuguacauucgggccagcaggccagcaaaggccauauuaagcaggccgugcuuucugccuaauaagagcuucauucuaaagcaauggcuugcgugggccuuguuuugaaaaagcccaugcuuuaaaaucaagauggccacaacaguucaaaggaaaggaaggaagcugggccauuuacccuagaaagugauugugaaguucgcuccuugaauguguuagcuuuuauuacuggaauugaccuucccagcaagaagccugcugcccaccccaaaucuguaucacuugccacggaguuaagacugaugacuguuuuauuucucagucuagguucuauaucgcuguuuggauuucaguuaaaaaaaaaaaagauucaugauacacccacuuauuaaggcucuuagaccauugugacucuugacggcaucccagugggaaaccauuguggagccuaaauagcccugggcuuagagaagaaaaccuuguuugcagccauugcuguugugugcguucccuccugugcagaggcauaaauggcuuuagauauaaaucuaggcuuugcagacuaagagcccucaucaaauaguauuuauuggggguugugggccagauacaguuuuccuuaguaaccaaaugcuacuggaaauuggauugacagucagaauuuuaacacacuuacacuugcuagccuuuuaugcagcauccccaaauagauuugaaacuauaugcuuagcguguggaguaaagacaguuuagaaagaaaaugggacuauuucaucugucuccugcuuucuugaaaccugcauuagcaguaugcagugaauaauguaguguccagcuuuuuuucccuuuaucuggcagcagcuaagggagguaaaacucuaaacaaguugaaauucagaaacuacuuucuccucuaacccuccuccuccaagcaugccccccccacacacacacaccaugaguaccuacuguucucuguauuuaugacgcucuaggcaagcccuucaaaugaagcugaaaacuaaauucaggauugaauuuaguucauucucugaaaguggugaugauuagagauauuuugaacaaccgagcaaacucuuucuguaagaaaccaccuucuggucuucagccaaggacucagaaauaaacuuaaaguggagaaguucgucaguuagagaauggggacugcuggcuaggagacuggugagagacccaggggcccuggaaggauaggcagagaccauggcaaagccuagggguauuggguagcuguuugaaucuaggcaacaugugagcuuuggucuuucuuccuaaaugaggaacacacuguuacuaaauaagauaaauacucuaaaggauaccuuagggaauuucccaggccaaaguauauaauaagcaaagacuuggaagcaauaguuacauugucauaugaguuugaggaagaaaacuuagccccacugccuuugccgccuguugacaggugaccuguguguggucacugucuagacccugugguuuggggacuugugauacagcaggaagacugugagagagcugagagacagcugagaauuggaaacuccuuauagcugcugaauuuaaacuggacuuaaucaucuccacuagauuucaucuggucugugaacuaaugauuauuuuccacaaauauaacagcauagcaaaugcugucauauaauucuccuauucucuaaguuaaacaaguugaaaacaugagaaaauacugacuguuguuaaacuauuggggaacguugagaaaaggaaagaaagcaugugggguuuuguuguugguuuuugcuguuuuguuuuaucuuuucuugucuugucacaagguccugcugugcagcucagaguaagcuggagcaggcugccuaacccacauuggcuucaugccaguccuccuuccggcucuguaccuaaaaccuaaggcuauaggugugugugaccauggccagcugcaguuaucuaauuaaaaaguaagaaggagcuauaacguuagguugguacuuuagcucacugaaaaaaaauucauaaaaauauucaggcuuauacuucucaguaacuuuauagcugugccuucuauauaguuuguauauucuucaaagcuaaacaguucugauuauuuuugcauuuggguccuacauucucugaaauauauauucauauuauauuuauguauauauuaugcauaugugucuauauuuauauauucauauauguauaguauauuuauaucgcauuuauguauauguuauguaugcauguauaugugugcugagcuuauaccauugauuccaugucccaacacaaaguuaaguuaaaggaauagaauuuggcuacuuauuuaagccugaggagucuagguuuuaaggaaugguaagcgcucggauuucuugcuccaaagaaauauuaaccauccuuugaagacucuuuccuccaaccucaggaaauguuuguacacugcaguccuuugugaccucucuaugugcuguaguuugauaauguguagacuuuacacacuucauuugguaacucccgugggcucauguguaucauguuuccuuggcugggauaucuucuguuugacaggaggcaucacuguacccagcucagugcuauuacacagacauagaaagcuaaugguauuaaauauaaugccauuauauuuaaauguuuucuauuuagacuuuaaaaaaugacuacuugcuuacuuuaaaauuacuggacagugggaauuaaaguauuuuaaauuuuucuuuaauaaaauuuuaaccaaauagcuuauuuagcaucagaaaaaaagacauuugguagugcuauaaagugugugugugugugugugugugugugugugugugugugugugugaugggaccuaggaccaugaacauuauaggcaagugcuccaccuuugagcuauaccuguaacuccuagacacuguuuuuaaaaugccauuguuggucuggggagguaggucaccucaucaaguacccacacaaagcccagaauccaagugccagccucacauaagacaugcugucuucaugccucuaaucccaacacuuaggagauggcgacaagaggaugagaagugcagggucacucuugacugcacacggggagcugagguccauugucagccacaugacccccaccucaccccaucucaaaaacaagacaagcagcuggaguggcgacucgugguuuagagcacuugucgcucuuacagaagacccggcuuugauuuccagcacccacaucauggcucacaacaucuguaauuccaagucuagaaaaagaagacagaggcagacggccauuguugccacugacucuaucugaaaauauugccugacaugaaacauuaccguaagaacuuagaacgaucauaguuucuauguaaaaauccaaagcagaauaggguuuuuguuuguuugguugguuuuuuuuguuuuuuguuuguuuuuuguuuuugccuuucauacacagacgacaacuuaaaauuuaguuuuaaacauaugauaucuuguggggagggauuuguaaggguggggcuggcaggagaggagaaagagaguguugcaaucaggaugaaugaaugaauaaauaaauaaauaaauaaauaaauaaauaaauagauagauaaauagauaaauagauaaauaaauaaauaaaagaaguaaaaagcauaugauaccauaucuauggcugcuccgggcuaagagcuuuauuuuguuucuuucuuuguauagcuuaugguugcccuuucuguuggugucaaacuccugaauacacacaggugacucagucacuuuaaaacaugugagugcuaaguauguuuaccagauaguguccuaaacuucuaauacugccuccuuuuuuguuuuuguuuuuguuuuuuaacauagugggcagcguugguuguggauuggucugaauaagagaagcccugauuuacaaggguccuggcaguggagugaccggacaccaguaaguuacaacuuucauauuggaaaaaaaccauggaaguaguguuucuuuuaaaaacaaguaaauucauuguuaaauaagacauccacaucuaaaauuuguauggaacuacggaagacccugguuagucaaagaagucuccaccaacucuggggauguaauuccaccaaaguauaucauucuaccagagaaagcuacagcauauugauacuagcaugcugggacgugauacugggacagauugaggaaggggaaagguuugucaaaagauacagaauuuuauuuagauaaucaauaaguucaagagauccaucgaugugccaugugggaccauaguuaacaaccgcacauuguucucaccacguuguggucacugucaaaggaaaugcauaugcuaccugacuagauucaguggcucgacguguguacucuuuaaaacaucguaaggagauuagcaauuuuaccucgauuaaaaaggcaaauauccauccacaaaccauaacagccuuauuuacacacauuuugaaauagaaacaaauuuacuuaaaggaugugagaaggaagacacaaaguauucaucuuucuuuauuuauuuauuuuuacuuuuuuagugugugugugugugugugcacacgcgcgccuugggggcggggcagcggaggccaguggacaacuuuccggagucagaucuuuccuuccgccaugcugauuuggggacucgaauucagcucaucagcuuuggccacaagcaccuucacccacugagccaucucacguacuccacuuacuguuacuuuuaaaaaauguguauauuuuagugucucuauauagaguuuuaaaaacggagauauucugacauccuggccaucuuuggagaguacaaauuauuuuccaaagcuuucaucugugcuacucuguguuuauuucuauuaucaauuaauagugggaaauauuuauuuguaucaucuaaaagcauuaauuauauagugaaaaaaugucuguauuagccauaauagucgaaccuaaaauguaauagucgaaccuugaauaauacuugacuguugacuguuuaucucaucuaaagagguuuuacgugacaguguguguguguguguguguguguguguguuuaacauacuggacuuuuacauauugacaagcuggcauuuugaaauaucccuugguaucaaaacucuuacaggaaaaaauagggacaagauucaguauccuagggauaagaauuucuuagcuauucuuauagauuuucuuuuuuccuuuuuucauuauuuauuuacuuuccaucuugaucacagcuuccucccccuguucuccucccaguccuucucccucacacccccaucuacucccuccuucucucuccccuuucaugagcagccuccugugaauaucaaucagccaagggaguuuuauauaccacaucucaaaauacuaaaaaaggcucuuugagcuguugauucuggcccugggggugauuuaaugccccaccaaccccacuucugagacuguggcuuaaugggaaacuaagggcucuucugcaguccccgaggccucgcaugacucggcauccagaucguucacaaaguaugaaauguuuauauauauauauauauauauauauauauauauauauauacacauacauacauuauauauguauauauauauauacauuauauauguauauguauaauauugaagcugccuaaacuauauggaaguugcaaauguugugccagcccacguucucaaggcugacuuaccuucucaggugucugcugugaugauggagccggaguuucaacaggauuuugacaucagagacugugcugccaucaagguuaguaccaacucuaaaaucaguauuaaaaauaaaaucccaggacugacaccagggcuccgagacagaguucaugcuuaaccuaugugaagccucgagcucaccccucucacugcacccaaaucuggcaucacguaagcucaggcaaaacauuccuagaauaccuucugugcguggagcguggugauggcaggagcgguggaaagcaaacccaagcaguuuacacuuaauuuaagaaccaagccagcucagucagucaacggggucuggagcgcaggagugaggauugcagagaaaaagacaauuagacaaacauuauaaccugacuccagccagggcugaggcggaagcagcuuuaauuuuucccagccagcuuuuacaccauucucgguacuagcagaaaauagagucaguccuuaaaucaaacacaaagugauuaaacaaggguaaagaacaaagagaucacaccagguaguaaucaaacaaagcaguaagcaaaagucccagagacacugggucugggggcuuagcaggauugccaagacaaaggggaagucacacauuccuuggcuguguccaccuugauccuuguaguagcccagauaugaauauucuuaucugauccugcuuccuccuccagagcccagugacaaguauuugccaaauuucuauaagcagcaaauugcuauaagggggcaacaaaagcucuccacauuuauauuaaaaaccacagcuuuaucaucauucuauaguaaggcaccucaagagugggcagaagauagccgaggagaaaucgaaaggggaagugaucgcucaggucuguccagaaagaguugggauuuggccuuggucucuaaggaugaccagaguuugcgcaggagcaacaggacaaggcuuucuaaugggcaguggugcaagaauacaaguggaggucuuaucgacagugagaagagcaggauguauccaguuuuauuuggaauuacuaaagacaguccuuaaaggauggggagguggcgggguggcuuagagugcucuuccagugcuguggaccuggguuuccuccugaugucucaucacuccaguacaggagauccaugguccucuucugaccuccaccagcaccaggcacuccgguggugcagaaaggacccuuguaugcauauaaucaaauuaauuuuuaaaaacaguguugucaaaucagguugcugucaaaucaaggugcuugcacuuccgcgggaguuuuuguuuggaugguuugcuuugguuuauuuucaauaggcaacaaggauguuuuuuaaaacugagaaaggauaaaaugagccaagauggugacugugagccaagagugugaggaagauuuaucuugacauuuccgaggcacagcagcuaggacugggaauuaucacagacacacgaggcaugucuugcaggguccauuuguuuauccauuuuaucagugaugugccugggaggcccaucaagacgguagaaggugucagagguaggguucuucacaagacuccagcauagcaagagauagacagcucaguaagcucugaugccauuggcuaagggcuccaauaggugaacaagaaggcauaggcaaugagggcuuauuguaagaauaaaaauguaauggucuuacgaggguaguaucgauuaguuauagauccguuaugagccaggcacugggguaggcacuuaaauaaauauacacaaucuugugaaguaggugcaguuaccguaaccaucaaguugagaaugaaauuccagcuuagaugugucagaagucaaacuuaaacccacacauguccagauccaugacauuuuaccccugagcuauuuuaccacauccuagcacaucuaccuccaaggcuggaccuggccaggguggugaaggaaugaagaaaagacagacacauagacgugcagacacacauacaggcugggaacuggaggacuggagucucugcuggaggaaccacaggacuucugaaguuuacauuguuuauuauauagacuugaccggagaggcuggguuuuuugcacauggcugaacaaggagacaggcucagcuaauccaguaggagcggucucuaggcgagcaauccucaggcuguaaauuuccaagggaaaaaacuaugauagacauuuucugcacacucaacaucuacauucuuaucccuggugaaggcuuugggauccacaacugccgagucaacagcacacacuuccucaggacuuuacucacucggggcuuccucugccccuuauucugcuggcaagguauucauagaaacagggagaaagcugggugccauagugcacaccuugaaucccagcacucaggaggcagaggcaggcagaucucuguugaauucgaggccagccuggucuaucuacaaagugagucccaggacagccaggacuguaacccagagaaacccuguuucagaaaaggaaggaaggaaggaaggaaggaaggaaggaaggaaggaaggaaggaagggagggagggagggagggagggagggagggaggaaggagagggagggagggaggaaggagagggagggagggaggaaggaaggaaggaaagaggcagaagaagcaauguuuuucaaaggguaugauauauugugguuaacuaguucaaaugcagcauggguauaagacauacgcgacagaaaguugaaaucuggagaacagggcugaaagggggaaaaugaaugaaaaaaaaaaaagccacggaguaguuuuuaggaaaucauagaaaguaaaagaaggcaagggaugaagagauauguguguggcaccuucacgucauaacccaggaaagggucagaaaagcaugauggaugcaaaugaaaccggaaagaaggcugccuucagagaaacucuucucgugggcagcugucacugcacggguccacauuauaggauuuacaacucagcacagguacgagccucagagaaguuaaugugcuguucagaauuuucuagaacacugaugcaaugaacuggacuugaaagguacguaggcuuccacguguggagagauuuuaaaccuaccaaaaauaaaauaaaucaccaggagagguguccagagauucaugccuuucucugcacaauacucauaaaccuggccuuaagagaaaaagaaucacaauagugauggcggcuccucccagcucgugccuucaacguuccuuucccguccugaucacguauccuacaaguagaacagcaacacuaaagccggagccugcgcugcugggcccaggaguugcugucacuuucugggaugcucuguuauagucuggcuuggauacuacuuuagucucucccaaacuugaaaagugcaggaugcucagcauguauuguauacaaacauaaaacuguccuucugcaacacggaguacaaugaaugcauacgaggaaaagguuuuguugcaaaaagaaaugggaaaaaugcaaaauagagugucaugucaucaaaaaagaggacaacuaguauuguggacauaaauucaaccuuuguuuccuuugucacuuggaaaacccuugcccgagcugcugaguuacuguucaaugucccauuucuucauaaguaugguagguguuguaacuaaagaagagguggaggccguggcuuccagcauuugggaaggaaugcaaccacuucagaauaucccaccauccuuuucacaccauccuuuucaccccuuagguccuugauguaccuuggcgaagagucuggcaucucuaugaggacaaggacuaugcuuacuggaaaccuuuugcuugugaugccaagcuugagugggugugccagauuccaaaaggcaagucacugcuucccccagccucaaacgcugcaaaugcuggccuagaagguguucugggaagaacgaagcagcagugcagaggucaaaauugggcagguccuuguaaaauuuagaaguaauuuucagugaaugcuaauaguuuauguaaauucgaauucaagaaaccaguuaaaaaaugacaguagaaccugcaaugacaagagaaaggggagggauggagggagagagggagggagggagggaaagaaggacgaaggguaagagggggaggaaggaagucaggcauagugguacacaccuguagacucuagcacguaggagccaagacaagauugcccgacuuggaugucagccugggcuccaaagagaugcuuuaucuuugacaagauuauaaauaagaagccauguacaguuuuaacugucuuccagugcuauugguaaaaacuauccaaaaugaagagagcugucucaaagaggaaaacugagcauacuugauauauguaggcagugcucugaggaaaacccaaugcuuugggucccaagaccacaugaauuuagggccgacacauuuacccuaugcgcucuaagauuaagcaaaguacguauuuauuugaaaucaguguggcugcagcuggauugaaauggggugggaagccacuggaguucugugagaaccaaugcccaggugccucuuaggugugauccucacagucuuugugaguagagacucucuuucacagaguagaaacuggaggcucuggugucagggaucugauccaggguaugacagaggcaaagcguguguggacaucuggccacccaaugccaaagcccagaauuuacugagcaugccgucuuucccauuucaauucagaacucccgagugacuuucuuauuuuccucucagcuuuguuuagucuucauuaagaagucacuacuaugccauuguacguuucccagcuccaucuuggcaacuggugaaaauccauuccacuuuuauaggcuagagucucaggcuccuuucgauguaauuuugcuccuugcuggaguucccuuggugcgugugugugacggcuacagaaucucacuauuuuugcuucccaucugauggcuauauuuugugugugugugugcgacuuccuuaauacaaacuaaaagucaaaaaguuuuucuuucuguucucaucguggggauugaacccauggccuugcauauucaaggcuagugcuuuaccauugaacugcguacccagacuacuagcaauacuuaauuaacauuuaauagguaugccuuuuuaaaaggucaguacuaaagcaagcauuaguauaaacccugagaaaucccacuuugguguuuucaacuggacaugaaccaguuugauccaaaaugaacgagccuccucgccaucaccuaaguuucuccauuuauaggaugcuugguuugugauccaggacuaaccauaagccacugcucucuucucgccuagguagcacuccccagaugccagacugguauaauccagguaagcugagcaucaaaauguagccaucucaguuuggaccuuuuuggauaaugcaugucauuugcuguuaauugcuacuuucuucucgugcucucuuguaaaaugccggcaggcugcagaggugguaugugggugggaugggaugagguagcagagacagagcuuccuuuuugucuuaacaacugauguuuccgcugguagccugcuacaggcaccaggggcacaguccagcauaaccagacuuccgacuaggcccucuccauuaaugguucuuccaccugccaauagaaucuugggcagggaagcagcaggccuuuggggggccacuuacuuaugugguggugguuacuauguaucauucauuuugaacaccccaugcuuagccguuuguguuugauuaucacagcuguaacucuguuuucuucuuuagagcgcacuggaauucaugggcccccaguuauaauugaaggaagugaauacugguuuguugcugauccccacuuaaacuacgaagaagccgucuuauacugugcuagcaaucacagcuuucuugccacgauaacaucguucacaggacuaaaagcuaucaaaaacaaacuagcaaauguaauauagacagauguauuuugagauuuuuauuuauuuuuauuuuauguauaugaguauuugccuaaaauguguuuaugcagugccuguagaggcccgaagagggcacccccuagaacuguccucuagagcuguagucacagcuagucgugagcuccagugugugguugcugggaauugaaugaaccuggaucuuuuggaagagcugccagugcucuuaaccacugaaccacuucuccagccgaacaaauggauuuuaauucuuuauguuuauauuuaguucacuuauuacuucacauauuauuuauacaacauuucacuuaauauuucuaaagacuauaaaacccaaacuugaccaugcaagguaguauauauaaucucagcccuuggaaggcugggacagcaaaguugugaauuugaggccagaucauccugaacuguagacaagacagaagagggguuggggugaguggguaagggaggagggaagaauacagggagagagagagagagagagagagagagagagagagagagagagagagagagagagagauuuuaaauccucauacaaaauaugaugggcuucacagcauccaaaaucaugcuagaaaggcuaaagagaauugcuuacaugacugauauuaaauaucaacuugauagguauguaucgguagagaauauaaauaauccuuauucauuaucauguuuuuuuuuaacuuuuuaacuuucuguuucuacuaguagaaaauaaaauuaaauugcagaauagccuuugggugggaaauuaguauuguuuaaaguuuauaauuaaccauaauaagacacuauaugcacaauuaauauauugguccaauuauauauucucuauauauguauauauaacuuauauauguauauguguauauauauguauauauauauguguguguguguguguguguguguguguaugauuauagcagcaauuuucuguauccaaaauaggaccuauggcuauauaaaguaagauaugucugauuauuuuugaugaaauaucccaguguauauuauuuuuugaaaccaaguaauagaguuuugggagauuuuugugguuuugugguuacgauaaaacaaaauauuuaaaugaaaaguguccuagaguauccagcacauguaugugguuucuuuucagauuucuggcgaggaacagaaguggugggugaaaacgagugagaauccaauugaucguuacuuucuaggguauguaacaccuuagauaccaacuggaucaauuuacuacaaaagaggcaguccucauuccccugugcgagauuacgacuccuaaaguuuuaaacauuaguccauacauuugagaaaccagauuucucugcauguuugggaucaaaggaguggcuuaaaaaaacgauaacguuaacauuaaguugauaauuaagaugauuuaggguaaggaagauguagaggacgaauaauugcacuacaaguucucaccccgcccccuuccuuucagcucgcgccgccgccuguggcaccauuuccccaugacguuuggagaugaauguuugcacaugucagccaagacguggcuuguugguaaacuucauucugacucuuccauguugacuguguaaucugaacuucauauucaguuacugccuaaaucugucuuccuucugagugaacguccaguggcuucuucuuaauuuaccauugauaauaguagcucaaauugccaagagaagcucuuuccaauauggauauguucaguucuuuuacccucaguucucuuaucuuuuauuacuuuuagacuacgcuuagugcuuguauaauugauaagcagacagacacguuugcaggggcgagcagacaguagcucugcauccccucguuagacaucccugccagcucucucuuccuguuucaccccgccuuuuucuggcuuaacauaugguugcuuuaucaaauguguaauuuuuacaggcaauaucauuauuauauaaaccucuugacaugaaaaauaguagaggcagaaaugaccaguaaagaccaagcauauauuuuaacuaucaggaaugucuucagacugucccuagcaccaaaaacuguaugauaaaguaggaccuugucuuuuuuagccuuuuuuuuuuuuaaaugcucucaaugaaaaguuuucaucaucacaauuccggcucucccguuucagacuuaaguaaacgagcggacuguaaugccaaguugcccuucaucugugaaagauacaaugucucuucauuagagaaauacagcccagauccugcagccaaaguacagugcacugagaaguggauuccuuuucaaaauaaggugagaagagaaucguucacugugccaaccauggucgcuuuggugcugcuuggauagccugugguagaagggcagccucucagaccccucucugagagcacuucccacguggccucugcuuccagaaacacaagcaacaucaaacucauuucucaagcugucaugccuaccggccuuuguauucauuguucccagcacccacgaugacuuucgauccacuggcugguuccuaaccccacagccugaggaaagugacuccauuucagggcgcugcuuucuuucccccuuaaaagagaaaaaucuaaguagccucugucaaucagcuuaggucagagaccccauaagugcuacaaaguacuuaaccuugauguuguccccaugggagaccgaugaugcaauaggucuggugaauggcgaguucugugcuugccucucggggaugcuugagccuuacuguugcuguauguguguaucgcagauucacugggaugcuaggaagaaacugucaccucauguuagcauguugguucucucacuuggaagauguguagagggcuguagucuagacuggugugaagaccccacaaagccuucaagagcagcaagccccuuguuucugcccugccauagucaacacagggcaucucccaugggguucagggugguccuucugggacuguuucuggaaaucacccagugacuuuccuuguggcucagcuuccuuuaaccauccagccuauaagaaggcugaacaaaaauuguagaauggaacacggcuugagacaaacuauuccacccugaucugugcuccuaaucacauagaaaggaagagauagauggauuugccagcagaagggcccgcagugaagcaggggccaucuugauuucuggauucggggaggggcagcucuaucacugaccuacgaucucagccauguuuugacuugggggaaaaaaacccacaggauaauuuuuuuaauuccucaaaggugcuguaucuaugcugauuugcacagugacauaaacuugaauuaaaauguccuacccaaaagaaaagauaugugucagagaauaggagcgaugacuaagaaagagcccagacuugcucuccgauagaacaggcucgagauaaccacuucaccacucagcgguugcuuugcaucugagucaaguugcuugacuugacucagcuuucucguuuguucugagaguuaaaugagauaaggauaugacuguccgaauacaaaagccgcagggcaagcaggagacacacucgacaagugagacauuuuaaagauacguguaauaaauaacaugaaaacagcucgucacauguuuuuauugaaaguaugaauuugaagucacgucguucauuugcacaucucacagguagacggcagcgcgcuaaaggugagguguugcugcuucggugguuuucuugugucuggggcugaggcuuccucugugucucuguuuacagugcuuccuaaaggucaacucugggcccguuacguuuucucaagcaagcggcauuugucauuccuacggcggcacccuuccuuccgugcugagccggggugaacaagguaccagaaucucugggaaagggugccguuuguuuguuuguuuguuuguuuguuuguuuguaauggggauaaacuagggccuccgcacagcuuggaaagugcuauaugcuggaaaccuugcuuugguaugauuugggagccaaguuaguuuugagaagcuaaaaucauacagcuaaucgacuuuccguuagagaaggcaaaaggcuaucuugauaaucuaaaugcuuuuuuacuuuuuaugcauuuauguguguguguguguguguguguguguguguguguguguguguuuacacacucauaugugacgaucagagaaugacaugcaagaaggacucuguccguccuuuccaccguguggguucugaaaacccagcucagguccucagggccgucuagcucucugacccuaacugcuuuccuaaaaauuucuuuauaacagauuucauuauauccuugcuuccugaaauggaagcuagucuauggauuggucugcgcuggacugccuacgaaaggauaaacagauggacagacaacagagagcugaccuacagcaacuuucacccacugcuggucggucggaggcugagcauaccaacgaaugugagugagucguaugccagucaucuuacucagugcugggaaacgauugaaucuccaaaaauuacuagauacagagugguagccuagggacugaggcuauagcucaguagaguacuuucgaagcaugcucagaucccugcgucuggucuccagcaaacguauaaaccaggaagcacggcacaagccuguaauccuacacuugggagacagggccaggagggucagcagcucaggcacccuuaucuauaucguagguuugagaccagucugggauauaggaaacccugucucaaaacauuuuaaauaacaauaaaggaguggcccaaugcacaguuccauuuauaacacauauucaaacaggcagauuaagaaagcuagaguucccccauuuuacaaaguauagaauguuaauagaauauaauccaaaacuguucauauacauagaaaauuguaaccuuauuuaauauguaaauagaugcaagcucucuaaggaaggaguguguacuacuuauggcgacuaccugaggauuggacaaucauagcagucaagaacuuaagucagucacaagcuguuaaguacucagacaugcccaaauuaggccaauaucgaguguuacuaggcuauuucuguauacugcuuccuuuuuucugucuuuaaauacuggcuagccacaacacuagguggaguuuuugaaucuuaacuggaucggggaaugacccaaaauguaaaucguuucuuuguucaaguaaacucugccaaaauuaagcuagaguuaagagugguuuccgaaggcugaggaggcugcaagggagguucugaugccgugaagugcgaggcuucuuuuuagaaaagagaaagucaucuaacccugacuggagugauagcuguccacuuugcgcauacacucaaaacuccacacugcacacauuaaauaggugaguugucgcucaauaaagcucugagaaccacagccuccaggucggugggccuggcuuuuacggcagcagguuccuagcacuuacuucaaaugucuuaccugaugugagccauccacuucgcucucucaagacaaaaaggcagaacagugaugggugauuucucugucagcacacaucuuuaaucccagcaguagagaggcagaggcagguggaucucugaguucaaggccauccuggucuacaaagugaguuccaggacagccagggcuacggaaagaaaccccgucuaaaacaaacaaagcaaagcaaagcaaaacaaaacaaaacaaaacaaaaaaaauccuacaugugaaauggcacagauuuuauuucugggugauagucucauuaaugggaaauaaggcacuagggaaggagaagggcacuguauuggaagcaguuauacagacaucuugagauugccacaacaaauuaaauuccuggugagauucuguccagauauuagaggaaauacgacccuucuaucagucaccuaauuuggagaugugguguacagcaucuccucacucaugccauucuagcuuccuccuguccgucuuacucacaccuagaaagcuguggccuggggacuuguauacggauuuuccuuuucccaauaggcaucugugucgguuacuuuugggucaagguaacugcauggucugaacucuucagggcggaacaucuacugugagccgugguuucaggagguuucuguccaggguauuacggaguuuuucccaucaggcugacaggguaaaucgcaggacacugagagauuacguuucaagcaccaaaucuacuuguucugaggagauuauuuuuuguuguuguuccaagguugacuugacagccuuucauuugggaauguuugugucccugcucaucggcugguuuuuuaaagcucuguuacaacgcuuucuuccagucaugcugccauaacaaaacgaagcgugcagcuuucugucuuguccauguucgggaauuacaaccccaccggcgcuaaggacggaacugcguacacaaugcuagacuccucuuuagagauaaggagucaccucaaccggccucuggaugccuuuggaaguugacuuagaucuuucugagaucaacuucccacucuaagucccagugcuacuuuagggucaauauaauaauuggauaaaaaucauucauuucuaguuuuaguccaguacacaugaguguuuuucgauauccaccagugucaauauccaguuuucuccaggcguacuggcccauuuagaggguuuaauguugaaggaaggaacuuguccauuccacugacauucugaaguccauuauaauaaacaugcauaugguuuugcuuucuaauccccaucauuuagugauugugcaaaacaaaaucagaugcaugucuuugguucuuugcacugucuccaaccuccagugcaguccuuuacguauagugaucaauaguacgucuauauuuuccuauucuguuuuccuuagaauuauccagucucucauguugaauucuucauucauuucucccccuuuuaaauauauugaauaaugccuauuuucucuauauaaguuuugaucauaccccccuuuggauauuucucauuauuuucuauaacuacuuuauuucuauuuucauuuaacacuuauuuagugauuuaauuuuuuaaccugucacuccugguauaugucuacuuauuuugcaugcauguguacauacccguuugcauguggguucaugccccuguacaugugaggauaucagaagacagccggugugagcuggcuuucucucuccaccacgcggaauccagguguggaacucagguggucaggcuuggcugcaagcaccuuuaccuacugagccaucucgcagccccuuuucuuagcuucaccugcugaauaauacuaauaguagaacuacaccucgguguuuuuguuuuaauauaaagguuccauaaugaguaauguagacgaugaacuccaaggcaaauuuucuaguaugcacuauaauuuauuauuauaaaauguuuauaaaggggcuggaaagaugucucaguggguaauacaaacaggaggacaugaauugguccccaagccuacaaaaaagacagguguguagcacaagcccauaucccagcacugggggugcggggggcagacagagaagaaauucccuagucuugcucuccugcuagucggguugagucagagagcagcagcugagagaccuuugucucaaaaauuaguggaaacaauugagaaaaaaaauaaaccaacccacauacugcaaauaugcauccacacacaugcuugagagcauacacccaaacacguccacacacacaaaguagccacagcuauuaaucgaauuacuuaauuguauuuuguuuacuuggaucaucaagacugacuucagagcaucuagaauaccuguaguugguuuugcccuauuccuaagaggcuuucuuuaucugcuuuaacuaugugaacacuuuuuaauuccuaaaguuaacugccauuuucuaggucucaaauguccgucauguuucuguugucguucuuuagaaauuccaugauaaguucuuucgugaguuguuuugggucuuucauuauuguuguuuugguuuuagguuuuuguuuuguguggguuuuuuuguuguuguuguuguuguuuuuguugguuuggguuuuuggggguggggauuguuuuguuuuauuuuugguugguugguugguugguugguugguuugugugggguaaaaaaaaaccaccaacuuaaaauccaaauuuuucuuucaaggaccuucagaguguuagugccaucaccacacuaauacuugccuuucuuuguaguucuuugaugaugagucccacuuccacugcgccuugauucuuaaucucaaaaagucaccgcuuacugggaccuggaauuuuacuuccuguucagaacgacacucucugucucucugucaaaaauacucagguauuauuaaucucaccgggcaacaauaagaucacuaccaccguuuuguuuguuuguuuguuuucgagccaaauuugaaguaagcuuuauuaaauacuggccaggaagaugagcacuggccaggucuauacaugggauuucuagacaauagucccaaaauaagaauauguacuuccuugcuuuguccaguagggggccagcacacauccuaagguacuuccugccuacguaucccccaccuacaugugaucaaggccauccugugcaguugggacaaccaacuuuguuuauaaaagugagcauauauggcucgcuaucuuacaggagcagccccagcauucaggaaguuaucuugagcaaguggggcuuacuggguauuacagguuagaggcauuguuuguuuguuuguuuguuuuauaaaucucuuaagcacaguaauuaaaacuuaaaacauaaccguagcccucacaguauaaacuuucaccuagauauuuaccauacuuuaugcuguuagauacauaggguuccuuuuugccaaaagucuuacaaauaaauucauguaauuuuauagcuacauagcuuacauuuugagcauagacaaguucauauuaacauagugaaguagauuaucucauaaagacugugggguuuuuuccccaaguauuauugccacaguuaaauauaaaaauuaaaucuaugguagaagacauuaauaguugucuaaugaaagucauaagcuggacagugguggcacacgccuuuaaucccagcacuugggaggcagaggcaggcggauuuaugaguucaaggccagccuggucuacaaagugaguuccaggacagccagggcuauacagagaaacccugucucaaaaaaaagaaagaaagaaagaaagaaagaaagaaagaaagaaagaaagaaagaaagaaagaaagaaagaaagaaagaaagaaagagacagagagagaaaggagggagggagggaggggggaggagggagggagggagggagggagggagggagggagggagggagggagggaaagaagaaaggaagaaaaggggauugacaagaaaugaaagucauuguucaguacucuaauaaacuaggguucaauguucuuuccauucagacacuuugcagauuugaguuuugauacaagcacuguuaaauuuagcagacagaaaugauaggaaacacugugaaugacgcagucuguaccuucccauagucaaaauaagguaaaacuuguacuucaaaaguagaaaccacccccacugguggcacacuccuuaaucccagcacuugggaggaagcggaagacgaaucuguaaauucaaggccagccugauauacauagugaauuccaggacagccagggcuccauaguaagaggggaaaaagaugaaauagcaaccacccaguuguuguuuuuuuuauaauauauugcauuauuuuuaauugaccaugauaagguuuuaaugaguguuuaaauagacgguuugauuacauaaugagagccugaagcauauuugucauguaccuuagcaaagcuuuucuugcugaguuaaucuuugcccuuuaucccacucacucuaaugacuuccuuauuuagauacgaacccuaaagcaaaacauaccucccauguggcuuucuccucccggaugaaagcaccuaaccaagaguguccugguuucagaaaugggaagucccaagucaguuauuuuaccuaagccauucagcaagauaugucuaagucacucaacaaaaagcuaaaauaaguagucaggggauauaugaaguaaaccaggaaggcgugaaaccuggcagaccugcaugccuuugcacagugugugggaggaguuauuggucugguuuucuuuuuaaauagagacugaagacggacagcccugggagaacacuucaaaaacagugaaguaucuaaauaaccuauacaaaaucaucucgaagccccugacguggcacggcgcucugaaggagugcaugaaagagaagaugagguuggugagcaucacagacccuuaccagcaggccuuccucgcagugcaggccacccugcgcaacagcuccuucuggaucggacucuccagucaagauguacguuuuccauccuucccgacagccccucucguagacuaagaagaaagcaguaucuuaaaauuguaugcaguuaacuccaugaaugucuauuucuaugucuuuugacauauagugagagauuugagguuuuaaaaacauucaagugggugugacucaaugaccacuucuuuuuauauuucucuguugacugagcuagaaucagaaguugccgggucuccaacaccaguaggguguggugugguuaaguguggaggauuuuccauuauuuucagaguuagcagaaagaaguuaaaacacacaggcaaacaagagguccucgucucagacaaaaucaaagguaaagacuggcaccuaacauugcucuuagaccgccacaccugagcuauggcccaugugugccaguacaugaacccaugcgcacauagacacauggacaucacaacacacacacacacagacaugcacacaucacacacacagagacgugcacauucacaauacauacacacacagugcacaucacacaaagacacauguauaucacacacauacaccuagacacaugugcacaucacaaaaacacacuuggacaucacacacacaugcacacauuacacacacgaugacaugugcacaucauacacacacauacguauacaacuuuaaauuuuaaaauauaauaaguuaaaagaagaaaaauuaaaaucacuuguauuauaguuacuaucaucaaaguguguugccuucauaucugcccaacacuugggagccugaagcaggaggauugucauacguucagugcuagccugggcuauagaacgaguuccaggugagcccuagcuguagaguaaaauuuucacuguuuaauggaaagucgcuguuaucaaagaaucagaaguuuacacauggguuaguguuuuacuguguaaggauuuaucuuuaaagcauuagagugaugucucauaauuuuccucauuucccacuucaugauuguaacauuuucuuuagucuauuuucuauuauuauuauuauuauuauuauuaauuauuacugguggugguugugaggguaugagagagaagagggugggggagagagagagagaaagagagaggguggggagagagagagaggugggggcacacauguggagaucagaggacaacuuuguggcaucugucucuccuuccaccuuuaugcggguugcugggagggaccucagguuaucaggccugugcaacaaguguuccucccccugagccaucuugcuagccucucucucuuuucagucuugacaggugguucucuuucccuucuuccuuauguuaauuauucugggugacuguugucuauguuuucauaagcugccuuaagucuuugcaacauaacaugauuguaacauuguauauuggaaacaauugaagguuuuuaaacagaacagaaacaauguaacuuuccuuuauuugaguaacaggucacuagggaaguauagaaagacaggagcauagagccuggagcugugaggacaguuguuuuuauauacguucauaaagaaaauaacauuggccugaaauaaagcaugcucacuggaucucaaaaaauugugagcugcaugagaacagggucacagcauaggucacagaaguauguaagacaucucaaagucaacgguugggacaggaugaggcgacucaggacacugcagugucuaucaggaaggagcagggggaacaaggccucaagugagaggccugucagagagaaacaaggauccuguccguuugcuuguacgugaaaggacagcaaaggagauucugcccccugccccuccuuacugcccuuugggucuaagaacagaaaaaugaacaggguucccuugugcagcuaaaagcguaguguuggcauggaaaagccagguucaaaucaagaugaaugaaagaguagauguuaaaagcuuagguaguuauagucuugaugagggaauucacauucaauacggagagguggggcaggaggauguaucugugguggaagaaagcaccaaaggccauugccagaggcugguggcaaauggagcccagaggaagaguguaggagagugucagcaaagcguagguacagcuguuuccuagggggcaaguuuaaagcugcacauuggcuuagaaauucauggauagaacauuuaccuagcauccaugagggccuggauccaaccucuaaccuuaccaaaauaaugaagcauuugguagugcuggguuuggccauuuccuaguuuggacccucccuugggccucaggaaggcuuaacccuuuaaugcaauugggccagcauugguuauuaaggccuagugcccucauaguaccaggggaaaacuuuagaacuauccuagaacuccuaugucaacuacauaaagccauucucaagacaggugggugaucuggucuugucaaguucuaaaggcaaguguuuagagacuucuggacugaucuauaauacugaaaaggaagcugccucgucucagagaccagugugaaaacaguaagaugcauugucuugaagaguugagacuaaggcaaugagcauuucuguagcucugggugccagccugcuccugauucugcauuugacacuagucuagucuugugucucagccucuucacagacagagggcaggaaaguuggagggacagucucacaaaucaaaugcucacaagagauuggacgaugauugacaaccacacagguuccuuccuuucuguucuuucggguaugccauguugucuccagaguccucccuacacagagugguccucacuccguuuuagccauguugucuccagaguccucccuacacagagugauccucgcuccguuuuagcuuucugguuuccaaaaaacaguucugaugucugugagcagcauuagaguuagggccacagagucuaggguuuaaucacaugaacgggguuucagccacacucacucagucucagugaccuguggaaaggacacgagggcccucucaaaugguugucacaaggauucaaacauuuaagacaaugcuuaacacaguacaaaaugcaacuaauaaacauuugaucucauggguuaaaguaauauagagaaauaaugcaacuaauaaacauuugaucucauggguuaaaguaauauagagaaauaaugucaauguugucucugaaaugaauuucuacaccucauaggaugaacucaacuuugguuggucagaugggaaacgucuucaauuuaguaacugggcuggaagcaaugagcaacuugaugacugcgugauauuagacacagauggauucuggaaaacagcugacugugaugauaaccagccuggcgccauuugcuacuauccaggaaguauguggauugcaacuguuuccauccccuuacccauccggaguaguaaaacugugucuguuugguuuugcaaacucuuauuuuguauuaggggauuauaagaaagucauuaucauaguguaucauuauugcguguuuggguaguacacguggcugugcaccucgugcaugccuaguguccaucaagccagaagaggacgucacaauccuagaacuggagucacacguguugugagccacgauauaggugcugggaaucaaaucagguccucggugagagcagacaucucuuaaccacagagcuacccccaguucccaccauagucauuuuuuuccccaacagaacuggugcaaggauuuguauucauaauuguugauuauggauugcuuuguccuuaguucuuacuuuggaguuugucuuuuguauaccagcugacuauguuaauugacauugauggacauauacagucccguucugccucaugucacauauaguuuuacuuuuauauacuuacaaagcuaacuuauggaaacucuuuauuaauuaauucuguuuuguuuuguuuuguuuucgagacaggguuucucuguguagcccuagcuguccuggaacucacuuuguagagcaggguggccucgaacucagaaauccgccugccucugccucccgagugcugggauuaaaggcgugcgccacuaccaccgccuggccuuaauuaauccuuaacaucaaugacuaacaucgugagccacuguuaaaauuccaggcaugguggcacauaccuuuaaggacaacacucagagguggagcagaagaccaggcaaagcucagccaagccugggcugccaggcaagccccugucucagaaacaaacaaaggcucaguugauuauggggagcugcacucacuugaggcagcuucagucagaagggaauuuagaaaaccacccugcaaacaaagauggaacucaaccacccggaaaugggcuucagacacccagcacuagggagccucaggcaagcagcucucuaugagcgugaggccagccuggucuacaaaggaaauuccaggccagucaaggcuagauagcaagacgcuaucucaaaacacaaaauaaaacaaaccaaaaaaaucuccugacaccaacaagaaaacagaaacccagagauguaccaugugugcgccuguccuuucugccucucucugugucugcacucugccccuugugaacuuucugcccuuucugcccaguagcagaacauggcugcucugcaacucucucuucugccuaucaaugaggugaguguaugacaucugaauccaaccuuucaagcuccuagaauccauuggccucagccugagaauaugcaauccccagcccugucaggggcccacauucuuggguuugugguaaaaagaacacacuguuucugagacaaagggguuugcugcuaaaugggaggaaaaugccagauagucucuaagacauaaugaaucugaauuauuuugacuuuagcguaucuauacuugcauccucuugaauauauuacuuucauagaauaaaaaaaaugagauauucuaaaggccauuuucuaaaugauauuucuguuuaauuuuguuaaaagaauaacuauuucauugaaguuauuucauuaaaauuagagaaaucaguaagcagaaaugugagagugaaucucacgguugcaguuagaugccuauuguuaauuaauauguuuauagagucccucugaggaggcuccuggcacuugacauuuaauaaaacaggaagacagaaacucauguaaccuaaaaacgccucuuuuuuuuucacauuccuccacuccacagcaggaguaagaaaauuaugucagauaauuuccucaccacagagagccagcaugcuucaugcuauauucaaguguaaacagaacaaggcugucacuuccucacuuccuucauauuucccacaaaucaagucuaaugacugugaacaggauuuaacauuuacauccgaaauuagaguucuuaccauuaacuuuucuucccccagaugagacugaggaggaggucagagcacuggacacugcuaaaugcccgucuccuguacagagcaccccauggauaccauuccagaacuccugcuacaauuucaugauuaccaacaacaggcauaagacagucacaccggaggaagugcaguccacgugcgagaagcugcguaaguaaugucccacugccaucguguaucgggacgauacacucaucaccugguaugaagauccauccccaggguagcacuggugaugaccucuccuaguucucacaguagagaacagagaaguggucccaaagcagccuagacugaccgaagacgaacaggucaccccguguggcaggaaacucaguuacaccacuaauuggagccaaggucaaagagauggaccuuggucucagaccuggagcgauucccaguaaaacccugagggucuguaacuugugaauaaugggacagaagggaccaggagcuaugugcagagguccuaugagaagcauuaugucauuauccuccaaaaugugcugugccuuaggaaacacuuguuuccuuauuuaaaagaagaagaaaaaaaaaaaaagauaggguaagguuugagagacacuaaccuguguauccucuguaucaaaguacauugagagaaauuuaaaaaaugcuggcauaacauuugagcucacagagacugagguggcagacacagggccugauggcguccuagagccaaaaggaaaagcagauacacacucccaucccuaacgcaggagcuaucuaauugauaaccacuuacagaugaaaacuuagauuucuccaagggagucucacuggggaaaccagcuaacucuuaaaggcagacugcagguccagcaguagaugccaacagaaaaugaaccaacaggaucuuuggagcauccuugucacuuaaugucaugcagggcuuuuuccuuuaacuguuuuuuuuaauuauuguuuauuuauuuuuauuuuuaccguuuacugucuuuuguauauagauuguggcuucugguuuugauuuuuauggggauuccuaagcaugugaaugugugggucucugcauuuguaucucuuuccugugucuuuucuuggguucuuuuccuucucuugguuuuuguccugucuuauuauguuuuauuuuauuacuaucccuuagaugccugcucauuuucuaaugagagacagaaggggguuguaugcagaugggaggggagguggggagaaaccagggagaguagaaggaggggaaacugcaaucaggauauauuguauaaagaaaaaaaucuauuuucaauaauaaaaaauaaaauaaaaacaagaacacuggcauaaaugaacuagcuuaacuuuguaucuagugcuuccaaauguuuuauccauguguacuuuuuuuucugggaaaccccuuuaauuuuuuucugagcaacucauuuuggaaaaaauaacuuucuuuaauuguaauguugcaguaaugucuaaggaaguaggccugacuuacuauagcccauuaagagguuuagaaggaaaugauauaaucguauuuuaauuuaaaauuauaauaaaguuuugucuauuacaggguagucuuuaacugcaucccauuaauagcauguagauuuguaccagcggaaagugagcuuuauaugaaggaaacauaaagugggcgccucaaguucucugcucagcuaccaaacuccccgcgucccauggggccagauauacaguagaauguuugaacacuguauagccugucgucuguguaagcgcauauaguuucagugugugugugugugugugugugugugugugugugugugugugugugugagugugugugaguguguguuucuagcacuccaauacuaaguuugaaaggaacaaaacuggggaguagaacuuccugacucaagcaaagcagaguauucuguacgaagcaaucauuaaaauggaccuuuuugauuuugacagauucgaaagcacacagucugagcauucggaaugaggaggagaauaccuuuguuguggaacagcuucuguacuucaauuauauugccucaugggucauguuaggaauaaccuaugaaaguaagucauaacugcagguugcucgguuagcaccucaucauaaccuauuuaucaaauuacaaaauacagcccuggggcuggagagguggcucagcaaguuaagagcaccgacuccucuuccagagguccugaguucaauucccagcaaccacaugguggcucacaaccgucuuuaauggggccuggugcccucuuuugguguaucugaagagagcaacggugguguauucauauacauaaaauaaauaaauaaaucuuuaaaaaaaaaacaaaaccaaaauacaguccuuuagagcacauguuuaauggugcaucaacauguguuauguauuugaccccgcauguaauaacaccaguaagguuuccgugucucugcccugucacuaguacagccuuagccccaaucuuagauuuagauaguggagaguaauuuugcaucuccacucuuccuucuggcaacucaagacuaauuaaaaauuaccacauuccuauauaaguccccaauuugugugagaaggacaaacacaggguuauuucuauugaugcugccccuuuggguuuauagcauuaucuuaggggaugugcaagcaacagaagaguaagauucguagucugauggugggguaggauauuugaaauugggauuaaauaccauguuuccaaaacaucacugauauggacaaaccuuaaaacccugugccuaauggaguaaaugagaccaauuuagaagggaaaucagagguccugaaguuggugaaagucuugauauuagggagggaagucagucuguaggcauguucuggggggggucuggcauuucuucucuacccuagcauuagucauggcucuugagcuccggaaagagaaaaguccaaauggacacagugguagaccgagcugcagagcugcguuagaacaaggaaggaagcaaugcacccuuuagaggaagaacagauucaggccuggucccagaaugccgugugcuccuggcccuccuugcccucucuucugcguccccuaggguaggcacuuucagagcugugcugucccaagaagcccuuuucaccagagcagucaguguagguagaugcauaagaugugggacuguguauaagaauuuauauauucucagaguugacaaguuuucuaggguacagugcucagugcuuguuccccuggaaaggauugcacagaggcagaagaggucaaacucaggcauaaauacuugaauuuuacccucugggaauggagcgcauaugacacaaaaacagaaagggacggucagucauauggggagggagagcaacgggaauggcacaggggacagaaugcaugaagacggcaucaggaagccauugccuucuaugcuaacuuacaaacuuagugaaauaaguuauauccucuuguguacuuugucaugguauuaucagaaacaacugaaaauguauucuguauaaaaacaucuucagaucuaaaggcuucuauuacguugcccuaacuauauauaacuaacaauuucuuuuauuaaaauauauggacaucugaggaauguaaagaaaguucuuuuaagcaaguggaguuuaaauguaauucuuacugaucuaauuuauaccuaggaaucacuauuuuuaguuauuccaaaauauguauagaauaugcaaagaguuuggagucuuaaagccuuuuuuuuuuaaagauuuauuuauuuauauguaaguacacuguagcugucuucagacacuccagaagagggagucagaucucguugcagaugguugugagccaccaugugguugcugggauuugaacucuggaccuucggaagaacagucaggugcucuuacccacugagccaucucaccagcccuuaaagccuucuuuuuuuuuuuuuuuuuuuuuuuuugagacagagucucaguguaacucuggcuguucucugcauuaaaaugaaauauauuaaaaauguuucacuuuugaguaugcacaauuguauccagaggaaauaauuuauuaauuuuauaagaaauggaaauuuuuaaaaauguuauggucauuuauguuacaguuuaaaaguauauguaagaaggaagaauggauauuugaugaagaguaacaggcuacuaaagaguggaauuacaguuaaaauguucacauuuauaauuuauauuuucaaguuaaaaaaagaacacaguuuacuguuacauuagaagacacuuuuuaaacauauaguuaaucagacaaccuuuuagaugguauggaaaggagaaaauaagucagugauuugaaauauuaaaaucgaaacugaaauuuugauuuaaucucuuaaguauagaacaauguguuucuuuccuagacaauucuuugaugugguuugauaaaacugcauuguccuacacacacuggagaacgggaagaccaacugugaaaaauggcaaauuuuuggcuggucuaaguacugauggauucugggauauucagucuuucaauguuauugaagaaacacuucauuuuuaccagcacaguauuucugcuuguaaaauugaaauggguaagagucuuagucaccuuuauguugcugugauaaaauacccugucuuguggggcuuccgaggauccuggcugcaguuuuaauuaacacacgggggcuucucuauaguuuguaugccuuuugcuagagcagucucucagcuagcucauuuauacuuauccuaaggucuccaccaccccaucuccgcaccagguucaagcugccugcuuaaagcuccguucugucucuguucggcuccuucccaaaucucacuucaccucccugagucucuugcauccuucucugaccggaagucccaccgcuauacuuccugugccagcucugagcagucaguucuucauuacacaaaaagccacauucuagcuugaagccaucggcagcaagacaacacuugauccuugucuuaagucauggagagcuaccugagcuucaucuuuugggcaggugaaaaaggacaagcauuuacaaauagaaaaccggugauggaccauagaaauuacaaauuucaaaauccugccagcacuuagcucucugucaguacaguaaucaacaacugaacaugugggggagacaccuuuauacaguauaagggaauuucaacccaacagcacugacaaaaacaacuuaagagagaacggauuuauuuuggguuauaguucuaggggauauggucaaucgugguggagaacacaugacagcaugcaggagucgggcaugauggcaggagcagaaggcugucacauagccacauacucaugaaacagaaaguuaacagguaguacagaaggacuauguagccucaaacccaccccagcgacccacuuuuuccaaggaggcucugccugaagguuccacaacauccccacagugucaucagcucagcccagcagggacauuucauauucaaaccauagccguaaauaugaggcuauguggugucauuccagaaaaaggaggguguaagaucauuagucccacuagggacaugcauguaacagcauguaugucugcagagcuugcucuucauuagucccacaugugaaacggcagaagauaaaaagaaaccaaaauaaauaaauaaauaaguaaauaaaacgcugaccuuugcaauccuggucucagaccccagggaagcauugcuggugagacaguguguguuaacuuuuuauccuuuggaggcaagccuuagauuguuugguaaacagagcucugugaguauuaggagguagcacuucauaacugaaucuugaaagagggauagaacuuuuauaacaacguauguguggauagaauuuucacauuccagacaaaaugcaugucuuacagucuugucuaauccuuaaacaaaccuauuuugaaguguaaguuauguaaaauucaucaucaucaucaacuguauuaugaucagccuucuuucuaagcccucugcugagguggggcccacggcagggcccacggacagucucugcuccaggugcugcaguguaaugugugagagacagaccugccucuccagcguucucgucucgucagucgcucugaguucuuauaagcuuuuaagauguuagacaccagccucucugccuaaugucuaagcuucucccaccuucccccuucuuugucauugaacaucuuuuucucaacuuuguuauuuucuguauguacagcuacuuauugguagguuuguuuguuuucuucucaccaaaaugguuucugucuuuuaaaaauacacuuuaauagaauauacauuuuauacuagauuuagauuugcagggaaguugcaguuagaacugaaaauucucacuaccccacaaacaauuucccugacaucuuuagucugucauuaguguacauaagaauuagccaaagccugugcauuagucaugucucccuagguugguuuguuguuuguuuguuuguuuguuugguugguugguugguugguugguugguuaguugauugauugguugguugguuuugguuuuugagacaagguuucuuuguguagcucuggcugcucuggaacuugcucuguagaccaggcugaccucaaacucagauauccgacugccucugccucccaaguauugggauuaaaggcgugugccaccaagcccaggcuuguauccccauaguuuuuacuuagugcacuuuucuauucagauauucauucagaauacugcaucaggcucagccacggugccccccgugagaacaucucuuuuuuugggugacuugacaguuuugaaguuaucuguugucuuauuuuucccaugauuaugauuuugaguuuggaagaaggcuuuuuguuguuguggggguuuugguuuuuuuguuuuugguuuuuuuuuuuuuuuuuuugguuuuuugguuuuuuugguuauuugguuauuugagacaggguuucucuguguagcccuagcuauccuggaacucaaucuguagaccaggcuggccuugaacucagaaauucuccugccucugccucccaagugcuaggauuaaaggcgugugccaccacugcccugugagaaggugucauuuuugccauaggcugugaauggugaauucugucagcaucacugcugauuucagcauugaucucucuggucaaggcuuugauguuaauuucucaguaguaaaguuagccuuugucuucucucuaugcuauacucucuguaaagauguuaugugcucagcccucaguuacaggaggggagcacuauccuccaucuuuggaguuggauagggaaucuaugugauuaguuggaauccuguacaagauauuuguccucauuuuaaauucauucagucuuuuuauuuguaccuucauuacuguagcuuuguugcuguucaguuacugguuuuauuuuuagaagugugugugugugcacacuugugugugcacaugcgcaagcacaugcauaucuaggaaaggacaacuuuguggaguucauucucuccuuccauguuuuuuugucaagcaauauuucugacccccuccccaaaugcagguaacugccuccuuuacagucagccucacauguccaagugguuaauaacuuugccaucaugucaaacauuuuuuuuuuaagucaacaagacaacuauaguauuuaggagacuuucauaugugcugugaagacaggaaaugcaguguuggcauuugagcucuuguguuguuguuuuuguguguuugaagcccuuugcacuuaccggcccuuuuauuuucgauguuacaguugacuaugaggacaaacacaauggcacccugccacaguucauuccauauaaggacggcgucuacagcguuauucagaagaaggugacgugguaugaagcauugaacgcgugcucucaaagugggggagaguuggccaguguucacaacccaaaugggaagcucuuucuggaagacauugugaaccgugacggauucccucucuggguugggcucucaagucaugauguaagucccauuugcuuccagaaauuucccaaagcuguagcuuugaaaauuggagauuuuuggcauaagguacuaacucgaaauauaauaguggguuaauuccuacuaguuucuuaccuuuuauagcauggaauaaauagaauuauagaaugcaacugacccagccaucucggguucacaggauuaauaacucaacagaaugucuuguaagcuguuugauuugggguuauuuuguuguggauuuagugaucaauauccugugcucuaucuggucccugaaguuugucugggaggaccaguuagaaagcuccuaaauagcauagagccagagaauccuaaauuucagcauuaaugguucaucugccauuuaugcaauagcugauaguuaaugaguuguuuaaacuuuacagaaaaaucagcuaauaguguuuucuuucaaauuuuaacacaaaaacacauauaacaggcaaagacaauucuuaauauggucaggaccuauagggugagaagggcuuggguuugggaggggaggacacaggaggaguuagagaggagauuggcagggcgggaaaugauauaaaugcagcacccagcuuugaaauucuuuuuaagaaagauuaauaaugugauaacacauuuuugguaccauuauuugaauucuguaucuauuauguauguacuuuuaauaauguuugccaugccaaaauagucauccauugaguucugugggccucguuaaauagucuuuagaaaagaauggcaaaaaauuaaaggaacaaaagaaggauagagggagggaaggaaggauagaggaaaggaaggaaggagagagggaggaagggggagggagggagggaagaaaagaggaaggaaggagagaaggaaggauugauagagggagggggagggaaggaaaaaaggaaggagggagggagcaaggaaaggaaggaaggaaggaaggaaggaaggaaggaaggaaggaagagaggaaggaagggugcuguaaguucauaguuucaagcaaaacuugaaaguagucuccucaugucuuccuccuuagggagaguuucccuuuuuagccucugcuguaugauggccucuguaacagacccagacacaaaccacaaaacugugaagcucaagaaacagguuuccaggccaggauacagcuccauaaaugacaguacuugccuaacaugugagcccuagguucaauucccagcaccgccaauaacaaaaaaaaaaaaaaaaaaaaaaaaaaaaaaaaaaaaacaguguuuaacaggauauggcaauguuugagagcaguguuuaagaacaacuugaaaauuuucaggacaacaauaccauguuggaguucucaaucuuuaguuaugcuaaaaggguaaauagaagccauuugcaugcguuucauaaauuuaccuuucugucucuaaauggaaaguccuguuuguguucggccagagcacaugccccagacugcucuaucagaagcacguccccgacacugcagauagcccucuacuuacaguacuaugagcaggucaugagcagucccuuccuaccgugugugcacucuucuuacauccuuucucaacucgcacaucugagcucaggguguccacacuguucccaaacagggaagcgaaucgaguuucgaaugguccgauggcagagcauuugacuaugucccauggcagagccuacaaucucccggagacugugucgucuuauauccaaaaggaauuuggagacgugaaaaaugccugucuguuaaggauggugcuauuuguuacaagccuacaaaagguaagacuugacuuggaaguacgguguauuuacugaaauaugaucauuuaaucauuuagugaacauguuuauagauguaaauaaggcuuguccgcaaauuuuauaaaaacacuuccugauuuuuuugugguggguguacaauugguauaucaugucagagaauucguucucaaggauauuuaucauaucacaaguuacauuuuacuuuagaguuugaagauuuuguuugcuuguuugguugguugguugguuuuuguuuuuuuucaaaacaggguuucucuguguagccuugguuguucuggaacucacucuauagaccaggcuggccuggaacucauagagaucugccugccucugccuucuugacgugugugccacuaccaccuggcaaaccugaagauucuugcuuuacauagaaaugaauccuagaagcuguggcguucccuaagugguaucaucaguucaucacacagaaggaaaagaaacgguagagaaaacuguuggaacacaugacauacaauaaagcacacagaaacagaaaacuauacauccaagaaaacaggcuucacagaaugaggcaugacaguucaaaaugcaaggcauaguguuacuaccauaugacccaagucuacuucuagguauagccugagaagaacuaaaaacagacacucaagcugguauuuguacaaccacauuuauagcagcauaauucauaacagcuaaaugcagagagaacgcaagaaucuuccaauaaaugaauggauauguagaaugguguguguguguguguguguaaaacauacucaggagaacuacuuaagcuuaaaaaggaaggaaaugcuaacaugagccacuauauggcaaaauaauaauaaaauaauaauaaaagggaaaguucugcauaauucuccuuauaugugguaccuagaacucucaaguucacagaaacaggauaucuaaugcugguccaucggggucuagagaaggugagguuagacaguuacugcugauggaugcggggguuucaguuuugcaauauggaaaaccucuauagaugagcugcaguguuggcuguaguaugugugugcuuagugccacugaggagcacacuaaaacauggccaagauggugcugugagugcuaacacccacauguaaucccagcacccagagagugaaugcagagccagucagggcugcguaguguguuccagagcggccuuaaccuacagaagcaaaacccuguuccaaaucaaaacagaaaaacaaacagaaaagguuacggugauaaaguguauauuauauauauuuuucuaguaguagcuaaauucguagauugucuagcuagcauacgggaagccuggguccucucugagcagcucuuaggucagccugaaccagccugagcugcaugagacaauguuucgaaauccgcccacccaucccacccacccccaagcaagaaucugacagggcuggaauguagcucaguguaaaaguguucguauacacuugggagguccuguauuggauuuccagcaccaaacaacaacaaaaagacuguaaugaacguaucacaauguacgcccuuaaaaauaaaaauaaaaguaaaaaaauacaagaguuggaaacacaacuucauaaggguuggaaagggaagggacgacugcagacaguucuagauacccacaagguucccagggcgagauggcuguguguccccuggagugcagugguggcuauggguugaacccacuuucacaccuacugaagcagcacacagcaauaucccuucagcucaucaccuacuuucacaaagugguaaaggcaagaacuugcggguaucagcuccuuccuccagaaucaccaugaggaauuuaguggaugcauuuggucagaagcgguugggaaacucacccacuucuccaccuguugaacugacagggccuggggcaggcggagcucaaacagguagcauuggcuuggccaggccaaggcaaacaucugaaauuugaaagaauugagccugaacugacuucuaacagaagacagaagcagaaggaacuagucaacaaaagguucuugauggaggaaaugucagaggccgguuuuguuguuguuguuguuguuuuauuuugguuuuguuuuguuuuguuguuuuuuuucuggaaucacagaaguaacauauaagaaaacucccucccaccagugauguacagaaagcccagggaguuuuaagguuguauacaaugcacaacagagccgaagucugggcugagcucccaccugggacaaggccagaaauuggacuccgaugaucuguacuuagcugcccacaaguuuuaugcucuugaaaggaauuaaucaugagccuuaagggacccaaccuucacuuccuaggcuucuagucuuacucagugaaaacacaaaacaggcugaguagaaaccagaagaauuuuuaagagcuuaaaaaaagauaccaucuuucgauuugcgagggaauuacaaauugccaacuuuuuaacuugugguugagacguucaugucagucuuuauguaacuagguaaauguugguuuacauuuucacacauuuuuuucacagauaaaaagcugaucuuucauguaaaaucaucaaaauguccaguggcaaagagggaugguccccaguggguccaguaugggggccacuguuacgcuucggaccagguacugcacagcuucucagaggccaaacaagugugucaagagcuugguaaguuaaaacccacuucuuuccucguggugagauaauuuaacucuucacaauguuuuuuuccuuaagaaaauaaugguguggggcaggggggguggguguuugggaggggggaggaaugaccauaucuugcaaagugcuuuaagagcacgucuauuuuauaguagcauuaccaccuuauuguccaguaaauaguuaaguauuuuaugcauaagaucucaaugggacuuggcuauaaucauuuaaaaggaucgguguugaccgaagauauugcucaguugguagagcuacgcuugccuaacaccugggucuguucccagggccacaguacugagcugguaguaaaucccuauugucccaauacucaagaugucucaaaggcaggagaaucagaaacucaaggccauccuuagcaaugucauuucagguuagccugggcuaccugagaccaggucauucccauacauauagguaaaggcuuaaaaauaauaaaaaugagaguaaauaucaaaaugagaguaaacauauugaaaguaaaaauggaaagaaguaaaaaugcuaagugaucuauuaauauuaaggagaagcaauaacaaaugaaaaaaauuuagauauacuuugagauguuuagaaaaggggagucaagaggcaaaauauaacugacucuguaguccacuacuuaguuuuuaauauuaagcugacacugaacaggguaauuaaaacaacugaucgugaguuguccauccauucuggauaggauugcucacaucccaaaaaccuaaaugagaggcaagacauuaggcuucagauguagccauuucagaaaaaaagcucagugauugacuaccuucugugagggacccagucauugccuucagugagaauguaaagugacuucuaagaaagccacccaaacuaucuaaaaaaucagagcuauuuuguuucuucccuaugcagcacagcaguuggcauuucacucauuuauuuugcuaacuacuguauggcaguuggcuacuuagaaagcauuuuaaacaagugcauaacaggaauuaugugugagaaccuugguguggugucuguguuuacacaugagaagaacuauuauaaaauaugcccaugugcuuacauauguggucugccucuuugucugagagagaagauaagaaccacuguuguagauguagcgugugagcgguugguucaugcucucacaggcucucccuaagcgaugcuguagaaagcccagagucguuucucuucuuagacaaacacaaacaguacccaggagucaggacaugugggagcaucguaggaaugaaugagguggcauaaaguuugcacuuguagcacagcgcuuugaagauggugaacucaaaaccacucuucuuucaaagguuuugauccccuucuuaaauucucuaguuggcugccucuguaagcccgaagaaaucacuacaucuucuugacucucgguuucccucucuauaagaggugaugauaccucuggcauuaucuccuagguugcauaauauuaaacauauucaauacaaggcaaagccuuucuuuccucuuaggauggauuucccagcuacuuauuauuuauuccuguucuaucugacguuauuuauaacacguguuuaggaacauauuaacucauucaauccucuaucacuuuggggaacucgggcugguuaugagcauccacauuuuggguggcauaccauggaaggauggcaggugcuuccucaggucucaagcgaggcuucuuuagauucuauuuugaacagaaacaaauucaaaucuaaguuauacagaaaugcgguuuuugaggcaaguccuagaaauacauagauggcauuuuagucaugcugucacaaaccccaguugucacagucagccgcucaaacacaaaggccuuacugauuugacacuucccggacaaaacaaaacaaaacaagacaaaaaaaaaaaaaaacccugcagauacauguuucuaaauuuugaaacuucuuuaugcaaauuuucaauuuaaaaauauuucuaacuuuuuugaaacuuuauuuguggaaacacuuuuaauuuuuuuaaagauuuauuuauuuacuucauguuauuucauguaugugaguacacugucgcuguccucagacacaccagaagagggcaucaguucccauuacagaugguugugagccaccaugugguugcugggaauugaacugaggaccucuggaagagcagucagugcucuuaacugcugagccaucucuccagccuggcacuuuuaauuauuaacacaaaugccagaaguuuaaagguacucucuggaugaagcuugaauuucccaaguggucuuguucacaacagauacugguuuguuuuuggguuuguuuuguuuuguuuuuuccaaacguuccaguucagagucaaucacuuggaguuacauucuuuauaugcuuagcauggagguaguuagguauaauuuguuucccuccaacagaucauucggcaacuguugucaccauagcagaugaaaaugagaauaaguuugugagcagacugaugagggagaacuauaauauuacuaugagaguuuggcuuggccugucucagcauucacucgguaagugacacgucugugagcucagugugcagaguucugagguugggcgugguggcccacaccuguacucuaacacucugaacgguuuuaccauaguucaaaauuaagucuuaccagugacauuuuuuucagacacgcugaguuaaaucuaaagagaauuuguggaagaacuuuucaguaaagaauugaugcaggguuugaaagaugaagcuggaauugauaaagauaagcuacguacauaauauuugaucauuuguuucacacuuuacauagaaucaaguauuaaauaaaauaaauggcaaaucuaaaauaucaaguaauuuucaaaaaaaaaugaguggacucaauaccagcugucuaaauggauuguaaauggcauuuucacacuuaucacacuauggaaaaacaaaaaggcgugagggugguccugaggccucuuaacccuuccucccccaguagcauaguuuuaaugacacauuuacuuaaggaauggaggguacggaucccugcagaugaaguuaucacacaauaaaugcacaagcaagcauucuguaccuuuaucaaaacucauguaccacucucuaauagaaugcucuauaaagaugaaaaugggggagagagaaauggcugaguggcuaagguuacucgaugcucuuacagaggacccuaagguuuuguuuuguuuucuccuguacccacaucagguagcucaccuccugucuauaccuccagcucccagaggucugcauccauagacaccugugcugacacauuacaaaaacauacaccgacacauaauuuaaaguaauagcaguacaucuuuuaaaaccgaaauauuauuucucauuguccaagacagcaguuacuagccacauugaucaguucaccuguggggagugcaacuaaaggcuuaacggcuuuugauuauuuuuagugcauuucacuguauguguacauggucauuuguaugugcauuuaugugcacauguauaugcagguuagaggucaguguuggguagcugccugaauuuccucuccaccuuauuuaugugugcacauguucauguguauguacauauauauaggucagaggucggcaucagauauccuucucagucaccuuauuauuggagauagaaguucucauuggccccagagcucacugauucagccagaguagcuggcaaacaaagcgcagagauccccacucuguaccucacuagugcuggguucacaggcaugguccaugugcccagguacuuuacauggguuuacaagggaucagauucauacccuggugcaagcacuguacugagugagccaucucuacagccuguaagguuuggguuuuuaaauaauaacaucauauaaaacagugguucucaaccuuccuaaugcugcaacccuuuaauacaguuccucauauuguggugauccccaaccauaaaauuaucuugugacucuaauuuuacuacuguuaugagucauaauguaaauaccugauaugcagauagccgauauucagcccccaaagcaguugcaauucucggguugauaaccacuaauauaaaauaacaaucuucuaagaaaauggguuaucugagccucaugaguuuuuauuguuguuguuguuguuguuguuguuguuguuguuguuguuguuguuguuuugguuugggguuuuuuuuagcacugugauuaguagcaauaaauauaacuguacuuaucauuugccuucagaucagucuuggaguuggcucgauggauuagaugugacauuugucaaaugggaaaauaaaacuaaggauggugaugggaaauguagcauuuuaauagcuucaaaugaaaccuggagaaaaguccauugcucacguggcuaugcaagagcugucugcaaaauuccucugaguaaguaggcaaccuguccuuacaggcauccggucaagaaguaaguguagggaugauccugaagcucagugggagagcccuugguucaaccagcacuuccaguaaauaaauagcacaucuguguacuugguuuuuacccacaugaccuuacguuuuuauaaagcauaucucaaaucuuccuuaaaucagagauuuuuuuuaaaugauaaauaaauaauaugucuagaauucccaaaugaaacuguuaaacagccaaauucuguauaaagcucuucuaacuaaaaaugggagcugccagagaaugggggaagacauugcuuugaggauacccucccagugugguuuauuuuacgguuucccuguguagaagugugaaggucuauuucccaugguugcuuagagaagcaacuuguggacaaaagacugucccuucggcuugagcagaaggaaagaucuccccugauguuggggaaggcauggccacaggcaggcagagcagcaggaaguugccuggucacauuuccauccacacacacaaagcagagaacaggaggaaauggucuaaggccacgcccuccaagccucccaaaggccagcuccuccagcaaggcccugccuauuaaagguuacuuaacuuccccaaaggggcucagacugagauaguguguccaaauccuccagccuuuaggggaagcgucucauucaaaccagcacagcuaccuugcugccuuucucucagguccuauaaaacuuuaauagugaaauuuguuuuguuuuuguuuuuuccuuuggggguaggggggguugagguagggucucacuauguugcccuguguguccuggaacuaccacuauguagaccaggcuugcccugaacucagagauuugccugccucugccucccaaggacugggguuaaaggcacgugccacucgcuacaccuggcuauaaagacuuuuaaaaccaccuaaaacuagaucuaacuauuuuaaauguucuugguauccgugugaaauugcaguaugaacuuuaguuuugucaugaacugauauguaaaacaacuguaaaaauaguauugagcuucguuuacagagaaaggcugugucuuagucaggguuucuauuccugcacaaacaucaugaccaagaaacaaguuggggaggaaaggguuuauucagcuuacacuuccauacugcuguucaucaccaaaggaagucaggacugaaacucaagcaggucaggaagcaggagcugaugcagggccauggagggauguucuguacuggcuugccuucccuggauugcucagccugcucucuuauagaacccaagacuaccaguccagagaugguccuacccacaaggggccuuucccccuugaucacuaauaucucuuuaaaauauccaucucuuuuaaaauccaaagucuuuuuacaauuaaaagucucuuaacugugggcuccacuaaagcaguuucuuccuucaagagggaaaauaucagggcacagucacaaucaaaagcaaaaaucaaucuccaaccguccaagugucugggauccaacucaugaucuucugggcuccuccaagggcuugggucacuucuccagccaugcccuuuguagcacacacgucauccucuaggcuccagaugccuguacuccacugcugcugcugcucuugguguucaucucaugguacuggcaucuccaaaacacugcaugaccccuucaguccugggccuucaauugcaacugaggcugcaccuucaccaauggccuuccauggccucucacagugccgagccucaguugcuuugcgugaccccuucaugccuucaaaaccaguaccaccuggaugacccuuacauauuaccaagucccgcugcagcaggaguacaaccuuggccaucucuggaacacagccucuuugugcuuucagaaaacacuucccagaagaugucaccucaaugaugcuggucucuucuuaaucaccacuaauuucuuagcuccagcuaaccagcaucaauagucccaggaaugcaaaguuuuugcuuugguaguucugguaucuuguuaaucacagcugauucuucagccccagcuaaccagaacuacagaaucuucacaaucaaaacagcaauggcccugaaaagagucuuuaauuuucccucugaaauuucacaaaccagaccuccaucuucugcaguguucucaacauuaucuuccaagcuccuacacaacauccaacagagcucuuaacaacggauggaucuucaagcccaaaguuccaaaguccucccacaguccuccccaaaacauggugagguugucauaggaacaccccacuccugguaccaauuugucuuaaucaggguuucuauuccugcacaaacaucaugaccaagaaacaaguuggggaggaaagggcuuauucggcuuacacuuccauacugcuguucaucaccaaaggaagucaggacugaaacucaagcaggucaggaagcaggagcugaugcagaggccauggagggauguuccuuacuggcuugccuucucuggauugcucagccugcucucuuauagaacccaagacuaccaguccagagaugguccuacccacaaggggccuuucccccuugaucacuaauugagaaaauaccuuacaguuggaucucauggaagcauuuccucauccucuaggcucauuuccucaacugaagcuccuuucucugugauaacuccagcugugucaaguugacacaaaacuugccaguacaggcuguaaaccuuuuacauuaacauuugaaaacaacuaacguuuaaguuuuccauuuugguauauaaauauuacagauaaagcuccaauggcaguaaaugguuuccaucuaugcaugcauugccuugcuccauccuguuuccccaugccgaaaugcaucugaacgaaucagaucagcuacaaguuaucaaacucuccaguucagggaggugauggauuagugacaaacaggucacauuuuucuuugaagagaaggaaacaaguaguuagaaacucugugugguaaaaaacaagguggugguuuuuauauaugugcuaggagagggucuacuaguggagaugccgaggcuaagguuuuaaagaucagcacagccuccucagagacaggcauagcagaggagccagguggagagacuccaaugacaaaaggagccacugaagcucaaagaacuggaugguagacaggcagagcccuuaguagggcugcaaacaaugguccaggaguccuggcucuuuuccgaauggaguggaaagcaauuugugcauuuggaggacagcaaacagcacuggugugguaaaaauuacaggaaaauugcaguucugguuuuggccauuuugaguuagcaauaauggaaauccauuaugggaaaguacagucugcagcugaauauaugagaaagucagauaaccagcauagggguagcauuugaaauccugagcgagugguauggauguagcuucguggggugcuugccaaagguccaaccucauuagguaggggauggaaaguacaauaacauauguuaggcugaucuccuaggaaggugguagaagggaaaaucuguccuggcuauggaacggucuguaauuuguacaggacuuuguauuuuuuauuaaguauugucuucauuuauauuuccagugcuaucccaaaagucccccauaccacccccccacuccccuacccacccacucccacuucuuggcccuggcguuccccuguacugaggcauauaaaguuugcaugaccaaugggccucucuuuucacugauggcugacuaggccaucuucugauacauaugcagcuagagucaagagcuccgggguacugguuaguucauaauguuguuccaccuauaggguugcagaucccuuuagcuccuuggguacuuucucuagcuccuccauuggggccccugugauccauccaauagcugacugugagcauccauccacuucuguguuugcuaggccccggcauagccucacaagagacagcuauaucaggguccuuucagcaaaaucuugcuaguguaugcaauggugucagcguuuggagccugauuaugggauggauccccggauauggcagucucuacaugguccauccuuccgucucagcuccaaacuuggucucuguaacuccuuccauggguguuuuguucccaauucuaagaaggggcaaaguguucacacuuuggucuucguucuucuugaguuucauguguuuugaaaauuguaucuuauaucuuggguauucuaaguuucugggcuaauauccacuuaucagugagcacauaucgugugaguucuuuugugauuggauuaccucacucaggaugauacccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguugggacaucuucuggauauauacccaggagagguauugcuggauccuccgguaguacuauguccaauuuucugaggaacugccagacugauuucuagagugguuguacaagcuugcaaucccaccaacaauggaggagcguucgucuuucuccacauccucgccagcaucugcugucaccugaauuuaugaucuuagccauucugacuggugugagguggaaucucaggguuguuuugauuugcauuucccuaaugauuaaggaugcugaacauuuuuucaggugcuucucagccauucgauauuccucaggugagaauucuuuguuuagcucugagccccauauuuuagugggguuauuugauuuucuggaguccaccuucuugaguucuuuauauauauuggauauuagucccagggcuuuguauuuuacacauaguuuacugacuagaaucagaaaggaauguaacuguugcauuucucuuacaauguuucacugucuggauuccaggcccggacuacacaggcauagccauccuguuugccgugcugugccucuuagggcucaucagcuuggcgauuugguuccucuugcaacgaucccauauccgcuggaccggcuucuccucgguucgguaugaacauggaaccaacgaagacgaggugaugcucccuucuuuccacgacuaacuucuuccaagaguuuguucauuggcccuggauguugcggaagcaagaugagccacuuagcacugcauccccccaaucagugucuaacuuuguuucuaaguagagaagucuuagagauguauucagcgggcgggaggggagaguugcucagcugaugcccuaacggccaugcuaaugagucaguuaucagagcagagagacuuaaagccaaaauggauauucagguuguucacagggggauaaauuuagcuaaugugaauuuucucuguaaaaaugcaguugcuaaauagauacguacauauuguaauagcauuguaacagccucauagaaaauuaaaacugucaguacaaguaggcuccacauuuaccuuuuaugggcaucugaccaaaugcaaaguuaguaacuccagcaaaaacucaacuauaaauaagaucaaugaugcuucaaaauagccuuuuaaggcacuggggaaaaaauacaaaauaaggcauauuuuuuauacagaaaacagagccccuuggaagauguuucuuauacuauuucaaagauauguauacugguauuaauuaauuguuacauuucuguuuuucauugcuuauauucagugaguugguuuuugucuuuaacuuaaaguuaauguuuccuaaaguugggaacguugcuguuaaguugccugggcgugcuguaucagcaugucugcguuugaugauuuucuuuuuuacaaggacccaauuacagcugagacuucagcuuuuacaguuccugucuuucacauaggagaucagcuuucuguuggugguggcugggguuuuugguuuuguuuuguuguuuuuguuuuuguuuuguuuuguuuuuugaaacaugguuucuuugugcaucauagcccuggcuguccuggacugacuuuguagaccaggcuagccacuaauucagagaucccccgccucugccuugggagugcugggaucaaagacugugcuggcaccaccccagcaagcaggcaggguaucaccuuuugaugaauguauuauguuguugccuuuuuacuugagcgaaacauaaaagugaucuuugaauaauguuguuugcuacuucuguauuuguaaacaaucaccgucccuaagacaaugaaacucagaacucugugauuccuguggaaauauuuaaaacugaaaugauuagugacacacuauuuuguugauguaauuuccauuugaacaucuggaauauacuuuuacuaguagugucaaaauaaauauggugacuguuuuauucaguguuucauauuuauacuuuagaguauuuuuguacaagauccagauuuauuuugcuugagguguuuaugcuaucauaaaguuguaaauaauuuucuaagacuguuuuaaugcaaucuacaguuuuccuaaaauauuuuucuugaggccucuuuuaacuaucacuaggaguuucuucaaaaaacuaaaucaauaccaugugaccacaguugugaucauggcugcuuccguggcugauccuugcaugugaaagcaucucuaaauuagguuugauuguaucccauguguaguaugaagagaagguguccagcuauugcgaguuaagguauuuuaagacuuugugagcacuuuuuaaagaauaaaucuuuguaugucuaaauuauuuuaau

SEQ ID NO: 831 - RNA, 1052 nt, Mus musculus
agggaaaacgacugguuaacuuugcuucuccuuguuugugguuguucuggggugcuccucugggguucucaucucaccucccugcuccuccuuguuuaacauccugauuucagagcuucccugggcaccgccucccugcuccaaacaccagcugggauuccaaagcaacagucuuaccucccuggguguuugagguaaguauggagacuguuugcccuucucugauuuccuggucaaauaacaaguucucuuugacagucccugggucuuacucacuugacucccucuaaccucccccuucugcccugugcuauggacgccagucacccugcaggcagcaugugcugcugaugagagcucgggauugcaaucaugaauggucuuggauuccaauccugccaugugucagcuguguaucaccgacgacgacaacacagaauguuucugucuugcuuuugucaucuguaagaugacguucacaacagguuugugaucuuuuaaauacuacggugaaguaguuaggaugagaacagggcauccauuaggaacccuggauggcuuuccaagagagaaggcaggguaggggugggcuggaccccaaagauugccauugcucucagggauugcuuccugugucacagaaacagacuguuuucugggacaagggaguggaauacuuuggcugacucucguuaagcagcugcugagguggguauacuacaaucagguugugacugcuuugccaguuaagugaccagcacuaaagucacaguacugggacagguuccugggggucuagaucuccuuucugaugagaccacaaugccuauaccucucuucuauagcacagucccagcgcuaccacggccccaacagagucagcuguacucaagacagaggaagacgccaugaugucaacuguacugauggauaccuaggaaucuaagaugagggcuggggagauggcucagguggcaaagucuugcaaacaugaagaccugaguuugauucccagaaccugugcaaaaauaaaaaugaaaaugaaacgggag

SEQ ID NO: 832 - RNA, 3169 nt, Mus musculus
ugcagugcucaagcagugagaaauggagcuguugcaaaacacggccaagcacaucguagccguuuccugguuccugcgcuugacucuaugaacuuaaccucugcugccaguuuuaugucagcuugacccaaacuugagucauuugugaagaggucgccucaguugagaacaugcaccuauagaauggcccauggguaagcuugugguacauuuucuaaacugauaaugaugugggagagccccucuucuuacugaugaugacucucuugucugugcuguccaaacccuagugcuggugcuuuaagaaagcaggccgagcaaacaauggagagcaauccagaaaacacccuucuuccacagccucugcaucagcuccugucuucagguuccuccugucuuucccugacuucccuucacgauggauuguaaucugugagguaaacgaaauaagcccuuucuuccccaaguugcuuuugcucauaguguuuaccauaaccagagaagcccuaacacagagaaguagacacugucuacuucugugccacucaagggccaauuccugggugugggucaaaucuugggugaugcccugguguacccccagcagcagcugcugcaguaucacuaaccauugaaccaucaggcacgcuaggugaugcccucgggaaccacaaucaugcccucugcucuggacuggggugcaggagacaagggacaccuccacucuuuuccccaauaccaauauuuuguuuucccuucuuugcuaauaaaaacucgauuucaggcuugucuacaauucacuugcaauucuacuggugcaggugauggggucaggaagagagacugugugguagcuagugcagaaugccuauacuuuuagugcaucaaccacagcgccuguguuuggagaaucucugggucugcaauguugaacuccagauuugcaggcuguaccuggggaguauggcagggagcugguuguuuucauauucaaagugcccuugauuauggaaaagaaggccucuucagccacuaucucaggucaggauuugggucugccaaauauagaaaggauuagcucccagugggugcugacccugacugggaggaucucggaucaggcuuccuguggcugagucccagcuagucucacaagcugcugcccuuuccuaacacuuaagcccaggcaggaucuccacgcuaagauacaaaguggccaacugccuaucuaugcauaugcuugccccuguguacuuagaguuuuacuuaacugaaaaauaccuaagagcauuucuggcugcuccagaauaggaagagcuggugugguuuagccuuggugaggauaaagccccuagagugcucugaaguacaacugagggaaaaaaaaaaaaaaaaaaacaacuuaaaaaugugugcauauguugaaggaaaaauaaaagaacaaagaacuggauuacaucuuguuuuaugccucuucgccaaagguuuuccuaggacagaacgcacaggagcugccaggaggcuccuucugguuuaaggccaccugcuugccuuugaucacggcacagucacgcguucagggacacaccuuuuaugucucagagacucgggccugaguugcuccuugcggacacugauucuuuuccuugggcuuccuucuaugcucacguuggggccuuacuguaugugggcugaugcucaaaccgaugcugcauuuaucaguuuguacgcgugucgggggcuguguaacuuauuugucagugguucaugaauauuauagagccauuguucagccuagagaaacggaggaccagaagguacaaaucccaucgcuguccaccccacugagccccgccuccccaaggggcguagcagacaggccuguuuggggguuaucuguagaauguagauccaacuucucccuuuggaagguaaugaaagaagacaucuuuuugucagcauuaucugaaaggugacccucuuaaucaacccguguaaaguuugcauuuugaaacuauuucuacucuccuaggucccgcaagccuggaaggcaagacccugccccuuaccucgcccuaauuuggaggacaagaggaugugcggaagagacugucccaucugccccgggacaguacacaagcaaccacaauacaaacuaggccuugcucuuacuugucuugcucaacuccuacccguuuuccgccccgagucccgggugccaaucagcccccaguucggcgcugcggacacucaccacgccacucgagggacgguuccuggaugugagucaaaucuugggcgaugcccuggugaauccccagcagcagcagcuguugcagccagagcagcugcagcaucgcuaaccauugcaccaucaggcacgcuaggugacacccacgggaaucagaaccguguccccugcucuggacuaggcugcaggaggcaagagaagcuaccacucuucuugaggaccacgccaucccagagcccuggagaugaacucgccucccuugucgccacagcguguacacuugggacucugggcguggagacgcaaauagcggaguuuucgccgccccgcccacacugcuuuggggagggagcaggaaaaagggccgggcccugugcagcuuaaacacucuggccuuuugggguuaggagaaaguagggcuaaagcagcaccguggcuccccuucccugcuccaugagugcucaaacuucucucucggauuugcugcaauuccuggucacccguccccagugugggugagcgagcuaauccucuccaggagaagaaaccugcccacuggauuugcaaggguuuggcugccggcagaggagucaaaagagcugccgggugaacucaggcccgggaugccucuggaaugcagagcacaggagacaccuaggggcccaaccuggucuucaacauugcuccagaguaaccagaagucaccuucaguauccagcuuuauccuauuuuaaaauaaccccaggcuuccguuuucuuagaucaucuucaucuaaucaaauaucccacacuguagaguugaagaacccagucagaaaggugugugacuggaucucgguuacuccuuaacucaacaaaacuuacucccuaaauuaguagacaacaacaaauaaauacaaaacaucaggcugcccaaac

SEQ ID NO: 833 - RNA, 3687 nt, Mus musculus
ugaaaauacugaucaucagaaagaaaagcauuucgggaaacccagagcugcguucccagguuuucuuuugagauuaguuuaugaaacuggauuguggucacugaauuauaaucaguacaaagccuuccuuccucugcuucuuuucuaauauauuuugcuaaaacugaaacauaauuuggggaguacagagugacucuucacaucccauucucugccaucaaucucggggacauguuagcuggacauguuagaggggacugagauuguugaccucauccacgccuccauccugucgcugccacggucuacuugguuucucccuguuaccguuaaagaugauuaugcuucaugcuuucucauccuccuguucccuagcuucuugaugagccugugucccugcagcugaugccuugcaaugcuuuccguuccaaaucuugaaagaggcaacuauagauuuauagauugaggauacaacacacacacacacacacacacacacacacacacacacccuugaccacucauuuccaugaauacauucuuugauucugacccuaacugcgaugcuccgugaucucuguguuguuuacuuuucugacgacauaugaauauuauuucuuuagcucaaucccuacauaucuacacucacaaucucucuguccaucagucaucaucgauuaauggaaccucuagguuucucauuaguuuccccugcagccucaccccuccuucuauccagcuuuuauauucagcauccuugcuuucuuugaacuguacaccugauugguuugaacacagcauuccgcuuacucugcaccugcgcugauagagaugaacauaucuagaggaaaucacugaugauaucgacucagaugcaaggcugugaauaugaaaagggggaccaacacugccuagcaauugcaucagaugucccuaguuguuaacuauuccacugucauaugugacuauuucuugccuucuuuuuuuuuaaauuccaauaccucauucauaauggauaguucugccuccucuggguaauuaacugaaguaauuacccacccacuuacuugugugugcaaguguuucacuucccgugaguacuguuguugagcggucuauguuccccgagaccagccuccauggugagucccagccuauguguucugaccuacuuaagccauaacugcagacauguugcuuccuuaccucuacucuuucagccacaaucacuuggcuuuauuucucugauuuagcaaaugagcugucuuuaccuguuugacuuuaaguaagcuuuugcggcuggcucuaguuugaacccgagcuaaucaacacgucuguccccguuucgucagcaacuuccagauugccaaauccaacgaucaauacuuagggcuuaccuuccuugagauguuggcagcauuuuccagaguuguucucucuauccuuaaaaaaccagacuucgcuuggcugccagaacagaacacuuugcugucccgauuauccucugugacagcuccaagagaagagagagaggcguuggcugaacugggauuuuacagguuuccguagucacuaggaaguuaggccagagagaaaaacgcuccacagagaagaccugugcuugaaaggaaauagcuggccuuugugugaccuaauaggaagacacugucccuagaaaauaauccagggagaagauggcuuuuacucucucuggcucugaagaucagagacauaggcaaggguuaaggaaggcagagacaauaauuaagaauaaaggcacaaguaagauuauuauuauacuaacaccacacauauaucuauuguauguguuauaauuuuuaauuaggugcugucacauuuauucacuuauuuguuuacaguauccugguuuuuaucccaaucgugugaaugaagaaacugagauucaccaaguuaacacaguugcuuacggcuauguagcuuuuuuuuuuuuuuaaacagagucgaggcuagaacccagacccaagagaaccaugaaggauaacagcggcagacaagucuccaaacagaaauccauggcaacagaaugagaagcaccacaugauuugguucaaaaaaucaagagcuuagagcuugggacugaguuucagacacaagcaagcagagggcuggccgguaagucaggcucaaggggcacagugcguguauggcgaaacucaagaagcaaacgagguaaauugagcacacguggaaggagaccauacauuauggaaaaugcuucucuguccuuuuacuucuggagcuaaaaguacuccacacucccuggauuagauguuaaggcagucaaccccaucugugugggaguuacuugacugagguacaguggcggcgagagaagcugggguuucugucaaucaacccacagauuaacugaagcuccagucucugugggagauuuggcauucccuccuagaguugcucgucccauguaggaaagaggcaaaugcugaacuuagcgugaugggcauggguggaugagugggagaugagaugggauuccaucugaaggauuuaaaauaguuccuggaagugcagaauuccuuagaagccgaauaaaagacuccacauuuuggguuuuguccccacuugcuguuugugauuccuuguugggucucaaaugcuuuaagguucaggaaugacagguguugaacaaguaugcccagggacaaagguguaugcacuacuguucccugucugcauacccucagugggguuggcacuucguuguuggugacuaagcauuugagcacauccccggucuuuacuugagugucugagacuauagcauccuccagucccuucgguaaggagacuuaaaugcuugcacaguuagaaaccagaacaacucuuucuccagacuucuccugcccuuugacgauucucucacuguggucacucacucucucuauccugugacuuccucugcccugacuuccagaagcuaccuugaagcuuauuggucaguuucugaguuaaagccaaauguaggaguaucuaggauuaccuuuaguauucugggccuggcaaguguuuagauaugagucuguccuucggggagcuuccaugaguauccuguggggucucugcuggaccuguggucccagauagaccugacuauggaagauuaaggacaggaagcugaccacaguggauuguguagacauauccccauuuuagacuucaugauuugcuaaaauguuuucuuuacccuuugaaggccucaccuucaugauuuaauuaugucuuacagguccuccuuccacuuggagcguaucacaguucuggccgagcagacaggcuggacaucccuuuuuaggggucaccugugacucucucuguagcucucgaucauucagcaucaauuuuagcuccuggauucugauuccuucucucuaggauacuaugagccaaaugcucccucgagggcccuggccauuguuggaaaucucucucucucugcccuuugaauucuggagcuagacgugcuccagccugucuggauuugauguguaaugugcucauccccaucugaguugcggaaacagcuccuuugcccccuccuuucuucucuccugguagauugccuuggacucuuaagauugaaccauuccucugagguugcccuagccuguuagaaggggccccucc

SEQ ID NO: 834 - RNA, 5637 nt, Mus musculus
ucuuuucgccucugcaaucaagcucucccaauaaacgugugcagaaggauccuguugcagcgucguucuuccuggccagucgagcgcgcgcaagaaguggugccgaaaacccgggacaagaaacaucuucaggcacgagcgaagacccccuacuacagggaggauucagaacugcaucgcggggaaggagcgguuaauagagguucccguaaaacagacugcugagaaggauccggcguggauucagaacucuucagcuggggagcgguguuaauaaagguuccugcaaaacagacugcugagaaggauucaacugcauggauucagaacucuucagcugaggaacggugguaccgguaaguguaaagaaauuaauguaaaucucugagaggcaugcucuccuacgaaguagauccauuaauagucgcugggauugugcugcuugcuuguuuucuugccuuaauuuuaugcuauugccuuaauugucaucgcccugggcacgaguguaucugcugggaauaauuucacguagauaacgcuuuaguccaggacgaucauggguaauggccagucuacgcccuuaguagggccggugcaagccuugcuuaaagaaagggguuuaaaaauuucagaaagcacagugagcgguuuuuugagagaaauagacagacuugcuccuugguuugcccccacugggucgcugacgcuaccuaguugggaaaagcugggaaaagauauagcaagagaggaaguagaugggaaagugaaagcagggacaaggccguuauggaaauuaauuaaggcuuguauccaggacaagaaaugugagcuagcuguuaaagaaggacagcgacuuuuacaggagcaacaggaaaguaugucagaaacagagagaaaugaaaaagaaagcgcgcgcagaaagauaaguaaagggagagaaauaaaaggagaaaaggaaaagaaaccaaaauguaaagauacaaaagauagaauaaaaaauaaagaacagaaaauuaagucaauuuacccuccucucgaggacuuugaguuguuagaauugucuagcucagaggauucggaacuaucagaaggggaggagaaaaauuuggaggaggcugcugcaaaguguaaggcagaaagaucugguccaauaggaaggaguaucacugcuccccuaccaccuccgccuuauacagauaagaaaacaauuggcuauggccacuccuuuugcacuccuaaagggcugcaaaaaauaugucaggcuuuuccuguuuuucaggaucaugcucaacagcgauauuaugagccaauaucgcauaaacaagugaaagagcuagcagagucaguaaggaccuauggaguuaaugcaucauuuacucagucccaaauugauagauuggcucacaaugccaugacuccuuuugacuggaugagugugguaaaggcaugucuuacgaugggacaguaucuagauuggaagucuauauggcaugaucuguguuugagucaggcccgugcuaaugcuacugcagggcaacaagcauggagcuuugaaaugcuuacaggucaggguauauggacaaacaaucaauuaggauacccagugcaggucuaugaucaaauuaaucaggcagcagugaaagcuuggaaagcauugccuaaucgaggagaaguaucugguaacuugacaaaaauuauucagggaauuaaugagccguucucugaauuuguagcucgcaugauggaagcggcaggacguauauuuggugauucugaggccgcaaugccauuaauugaacaauuaauuuacgagcaauguaccaaagaaugcagaaaugcuaucacaccauggaaagggaaaggaauacaagcauggaugaaagccuguagagaaauaggaggaccucuuucaaaugcagggcuggcugcugcagucuugauggcacaaacaaaagaaauaaccugcuauaauuguggacaaacaggucauuugcaaaagcaguguacaaagaguagaaagaguagguuugaaaagacaguaccagguauuugcccaaaaugugggaaaggaagacauugggcaaaugaauguagaucagucagagauauaaaaggaaggccaauaccucaguuuaaaggacaacagccaaaaaacggagugaggggcccccguccccagggcccccaaauguauggggcauuccagaccacaguguccaugaggccacccagagaccgaggagagccacuccggguucagcaggauuggacaucugugccaccuccagaguaauucuuacaccucaaauggggugccagccuauuucaucagauuuuagaggucccuuaccaaaggauacagugggccuacuguuggguagguccucuucugcuuugaaaggauugguaauacaucccggaguuauagacucagauuaugagggacaaguuaggauuauguguucugcaccccgagguauuguagccauuucuccuggagaucgcauugcucaauugcugauucuuccuaguuugcauaauauguucccuaguggccgggacucgcgaggagauaagggacucgguucuacaggaaauaauguggccuacauaucuuuagauuuggauaaucgucccacuuuacaauuacaaauagaaggaaaaaccuuucaagguauaauggauacaggagcagauaaaagcauuauaucuaguaagugguggccugcuucuuggccuguuaaucaaucaucacauagcuuacaaggauuaggauaugaggcuaccccaacuauaagugcaaaauccuuacaauggaaagauaaagaaggaaggacagggcuuuuucaaccuuauguacucccuuuaccuguaaacuuaugggggagagauguguuaucagcuaugaacuuuauauugacuaaugauuacucucagaaaagcaaggaaaugaugaaaggaaugggauauauaccuggacuaggucuuggaaaaaauuugcaagguagaauuucaccaguuaaagccacuguaaaggcagacaagaaagggcuggguuuuuucuaggggccacugaagagccuuugcccauuccguggcauacggaggacgcggugugggugccucaguggccuuuacccucugagaaauuaaaagcagcuaaagaauuaguacaagaacaauuagaccugggacauguggaacccacucaaucacccuggaacaccccuauuuucguuguaaagaagaagucagguaaauggagauuguuacaugaccuaagagccauuaaugcacaaaugcaaguuauggguccuguacaaagagggcucccccuacucucagcucuaccuaaggauuggagaauuauaguaguagauauuaaggauuguuucuuuucaauuccauuaaauaagaaagauaaaccuagauuugcauucaccuugccuucuauuaaucauauggaaccugauaaaagguaccaauggcggguauuaccccaaggaauggcaaauagcccuaccauaugucaguuauauguaggaaaagcuuuacaaccgguuagggaugguuuccccuccuuaaaaauuugucacuauauggaugacauuguaaucuguggaccugaagaagaaaguauacagcaagcuuauggcuugcuuaaugaaacuuuaaaaaauaaugguuugaguauugcaccagaaaagguacagcagucuaauguuagucauuuucuaggagccacuauuacuuuacaaugugucaccccacaaaagauuaguauuagaaaagaccaucuaaagacacuaaaugauuuucaaaaauuauuaggagauauaaauuggauuagaccuuauuuaaggaucccuacuucggaauuaaaaccuuuauuucaaauucuagaaggagacucacauauuaccucauugagacaauuaacaccugaggcuucugauguucuuaggaaaguggaaaaggcgauccaaacagcacaguuaacucguauaaaugagcaagaaccuuugugccuaugcauauuacgcaccaucaaucugccaacugcuguguuauggcaaaaugguccuuuaguauggauacauccacauauauccccuaauaaaacuauagagcauuaucccaccaugguagcaaauauggcccacaaagggauaaaaacuucaaucacucacuuuggaaaaaugccugauagcauaauugucccguauacugucgcacaaaugcaaauauugugugcuacuauagaugaaugggccauucuuagaugcaguuauucugguuuaauugauaaucauuauccuaaacauccguuauuacauuuuauguuauugcauccaguaauauuuccaaagguaacggcuaauaccccuauaaagggagccauugauauuuauacagauggauccaaaacaggaguuggaaguuauguaaucaaugaaaaggcuguaagguugcaauuuacaccaggagccccucaauugguagaauguuuggugguuuuagaagucuuuaaaagauuuccuaugcccauaaauauugucucugauucuguuuauguaguuaaugcgguucuagcauuagagacugccggaaauuuuaaacaguccaguccuguaucugaaauuuugaugaaaauacaaaauuguauucugaugcgugagcaucccuuuuauauucaacauauuagagcacauacaucauuaccuggaccuaugguuaagggaaaugcaauugcugacucagccaccagagacaugguuuucccaucacaaaguucuauagaaagugcaaaaaauuuucaucagcuuuaucaugucccugccucuacauuacgacaaaaguuuaagcucacaagaaaagaagcccgagauauuguccuacggugugguaaauguguagaauuuguuaaugcaccuuccguggguguuaauccucgcggauugcgaccccuagauguuuggcaaauggauguaacgcauaucccaucuuuugggaaauuacaauauguacauguauccaucgauaccaguucugguguccuacaugccucucccuugacaggggaaaaagcaguucaugucguaucucacugcuuagaggcuugggcugcauggggcaagccccuaguguuaaagacagauaaugguccugcauauacuucuucuaaauuuagccaauuuugcaaacaaaugcaaguaaaacauauuacuggauugcccuauaauccacagggccaaggcauaauugagagagcccaucgcacucugaaacaauauuugcaaaaacagaaagggggaauagaggcuaugacgccaaagauggcucuaucccuuacaauauuuacucucaauuuuuuaaaauuggaugaugcuggaagaucaccagcugaaaggcacggacaauggccucaaucacccaaugaaauggucaaauggaaaaauguccuugauaauaaaugguauggcccggauccuauuuuaaucagaucccggggagcuauuuguauuuucccacagggugaagaaaauccacuuugggucccgacgcgacugacaaggaccgugaaagagcaagaugaaccccaagaugauucuccugcuccugaugauugagaccggg

SEQ ID NO: 835 - RNA, 5260 nt, Mus musculus
gaaagaaagaaagaaagaaagaaagaaagaaagaaagaaagaaaaagaagcaauacacuuucugugggaaugacaaauaucaguauuaggaaauccaauuauacaaaaaauacuacaucuagucuggaguagauauauuuauuuuuuugguaacauacauuaaguggcacuaauuacacaguaacuauaagguaacuaacaugagaccacagaacuguaacucugccacagcugcauggacuugggccuuucuggcugagcaagauuucaaaaaacugaauacccaccccagagcucuggcauuggagucuguuaacaaggaaagcucugaaguagugacucaccagaguucuugcaguugacagaaaguaggcaggacauguuaguuauaaaguaguuacagccuaauucacaaaaauuaccaacuguuucucuuucuagaaagaagcaagaagaaauucuuugaauuagcgccuggugucagguggagugcagagagggcuguuagagcagugucagaaggacccuggcuggucagacagguuggacauuauuaauaaucaugguuggcuucuaaauacucuuagcaagaugacuucugauuuguaaucuuagguaaauuauagauaaaugaaaggaccaguaaucauacaauaagauuaauaaacagcacuucaaauuaaccgcaugaggcugcguuucacaaggcuucacaagaugaggcacccagaccuuuucuucccacgucuagcuugcagagcagcucucguggccaucucaaaaaccucucucacuccaucuuuggucuuugcugaacacuccauguacccaaaagcgccaauucuguuugccaucucucugccuucuucagguuuuaccggcuccugcuucauuuuggcuaacaccgucuugugugcucaucaugccgaagguccuucuugcucccaaccaagacgaugggcacauuuggacagaaaugcuugacuucuggaguccauuuuucugggauguuuucuaaacuaucagggcuguuauuggaaaaacacaucagaauaacaucagugucuggauaggagagaggccucaggcggucauaaucuucuuguccagcugugucccauaaagccaacucuaccugcuucccauccaccucgauauccuaucugccacauaguuuucaaacaccaugggcacauagaccucugggaacugguccuugcugaagacuaugagcaagcaugucuuaccacaagcuccaucaccaacaaucaccaguuucuuccugauggcagccgucacuuauaaaggugcugaaaacacacagguucugggaugcaguuguacaaaguaccuggaacuucucagaugcaaggcucaaggcgacgacuccgaguccugccucuucgcgcugaggacgccuguccgcgauuccgcgagcuccgagccaaggaccggcagcuccaaaaaguacagaauacccagcauacaauccaaagagcucaagaagguuaccaaacagaagagcucaagugaggaugcuucaaucccacuugggagagagaagaaaacaaucaagggaggcagagggaggcaccuagguggaagaggggacaaggaagaguaggggggaacaugaucugguaugggguggggagacaggagagaaacccugagggccagcagaaugaauagaaauaugcaaucuugaggggugggagguggggagacccucuagaaaguaccagaaacaugggaagugagaaacucucaggacuuaaagggagggaucuuagauuaaaugcacaacaguggggaaagggaaguuguagagucuacuccaauagaaagggcaucaagugaacuggugggaaugccaucagacagucaaaaccucugacccagaauuguuccugucuaaaagaacugcagggacaaauauggagaagugacugagggaaaggcaguccagugaccacccaaacuugugauccaucccaaggggaagcucuaaggucuaacacaauuagugaugcuauggugugcuuauagaugggagccuaacauggcuguccucugagaggcccaagaagcagcugacugagacaaaugcagauacuuacaccuaaccauugaacuaaaguuggagcccccugugguuuaauaagagaagggcuagaagaagcugaggaggagggugaccccauaggaagaccagcagucucaacuaacccagaccccugagaucucucagacacugagcuaccaaccacgcagcaugcacaagcugguccaaggccccggacacauauacagcagaggacugucuauucuggccucaguagaagaagaugcaccuaacccuggagagacuugaagccucagggaguagggagaucuggaggagggagcauggcauccucuuggaaacaggagggaggaguuauaggaugaguaacugugggagaguggaccaggagguagccaucaacuggaauuuaaaaaauuaaaauaauaauaauaauaauaauaauaauaauaauaccaaacacugaagcuaaauugugaauucuggcuuuucuguaaaguagauucccccuucuacucauaaaacacaagcuuuuauuuuugucuugauucauaaucugaccuucuccagguugccaaugucuaagaaauagcuucaagacuauagauuaaccuguauuggguguacuugacaugaauuuuuaagagaaauaguguccucaaauaaaugaucccaacacaaauuuaagauucaaucagcauuaauggugguauuagcaaugauaacuuuaauuauaagcauaaugcauuuuccuuucagagauuaauuuauguagaguagguacuuggaguuugcccugacagagacacacuucaaaucugcucauggucaaaggagaagcauuugugcuagcuugauuucauguaaaggaaaacguucuuuaaauuuauguaagacauuuuccagaaauacaguuucuucagucauuagacaaaagggguguaaguuaaaauuaaaccaaauaagacaagacauuaauaaaaagaaaucuauaacauauaccaauuugcauuuuauauuauauuccuguucaaucuguagauuaagauagcuauaaaaauacuguuauacaauaauaaaaacaugcaauaauaaaaauauucaguauuacuuucuaucauuuuacuuucuaaagcaaaaauucuuugagcagauacauuacuaaaaugauaagguaauauuaggggcacugacagcuauuuuuaaaugaaggucaugagagcacucagaaaugaaaacaaaaauaucuguagcauugaaaucaucuaagauaaaagcucagaagaauuguauucucuaaguaauuugaagaaauaaaauuaaauuuuccuguggaguuugacaaaauggaguagaaagauacacauucuuaaaauaaccuuucaaauguguagguugccaucuauauacaauguguaaauuuuauugaguuaaaucauuaagaauucuuuuucaacugugagguucuagcaugauaguaacaacaggcaacauuugguaagauuuuuuuucuaugucaugcaaaguauauccgaucuauuaagucucuuggcauagcuaaaauaacugaccauuuuucuauaugaauaaacagagcuuagaauucauucuucaucugaauuuuccccuuuagagcauggaaauuaggccuugaucuccaaggacaggccucucagugugaucuuuagccuagcaugcuaucuauugcucucuaguacuucuuggucuuuggggaaugaguguagucuguguagcagcuucaugagaaucuaaggugaccuaguguccauguguuuagaaugaaugaaugucuuauuggugauaccuuaacuacuuggggaaaguguaucaaguauagcccuggcuuggucacagaggcuaugccaagugcaacauuuaugcauuuaguuuccugugugcaaaauggcuuuggacuaaacauauacaccauucuacacuagcagcauuucuggugguggaaucuguuacuacacggaccaucauauaguuuuuauaacucaaaaaaauccuucauaaagucuugucuguaaauauuuaaauaccauaaacauuaagugguucaaccgauacuuguuauacagucaaaaaccuuuaguaggaagcucaaagaaaauaaaagucaaaggcagucuaugaugaccaugaaacaaccaacucuuuggagagauguuuaaaacucaucauuaaaauguuaaguguauagaccaguacaaaaauaacccauuuaaugagagauuguggaagaaaaccauuaacaaugugcgaugguugauugguguauacaaucaagaaagcaacaagcugcaggggagugguggaacuuggugccuaagagugacaaacucaguucagaucgccaacacccucagauaggccagaagcauagcaugagcaucuguaaucccagccuucguccagggaaagggaggcagaacaggacacucccaagaagcuccauaaacauacacauacauacacauggaaucauaacaucuuucauuuacccaaaauuauauuuaauauaugugugugugaaaauauauaugaaugcaaacaccaauauagucuaaaugaaguugugucacuugagaugaugaugucaaagguuucuaauguaaguugaaagguaguuauuccuaaucaaaaaaguuauauauauauauauauauauauauauauauauauauauauggaugcaucuuuagauuuuuaaaguaugcaauacaaauguguucccuuagucauuuuaaugucacauaguggcagguugggucuuauauuaaaauuuaaccuuccuuuugcaacagcuuucauugcuguuuugucuuguuuuguuuugcaaaaugcaacaguucaauuugaagcaagagagaaagagagagaaagagagagagagagagagagagagagagagagagagagaagaaaauagaucuuugaugacugcugaggaguuugcgauuaaugcaggaagaaauuaccuugguuagcccugccuguucucauuaguaucucgaaguuugacuuugcugaagaauuugugggaacuugaugcaaagccaaacucaguacaucggguuguacaguuugauuuuuaaucacuggauugaaggagaugcuagaaaugccuuccaagugauuacguaguucaug

SEQ ID NO: 836 - RNA, 1191 nt, Mus musculus
gcuccagcggcccgcugcgcaccaacugaaucccgugcaaacuuuuccggaggagcugcgaaccacagcgcccccgccuucccaagccacugcccgcuuuaggggacccggcccguccaggcuccgcuccucccccgcacggcuagcucggacgcccggagcgagcgcgcggcggaaagcggccggcccccggccgccgcgcccgcgccccaacucacccugccccauggcccugccgggagccccgagcucgcagccgccucggccaccucgcucugcagaagugagggugacgaggucagcaucggagcgagcagagcagccagccggagaggggacggguagggcgagcgggcggggacguggagcgaggaggaauuuccuaccccaccccgcaccccuccgcggagcacgcggcuuuuagguaccgcgggggaggccgguggagaggaagcgucuaggcugcucguuuuaguccccacugacacugaguagcuuugggaagccucgcgaacccaagaggaagagugggcggacagggaggcuaccuggccagcaaaaccccagggaggacccaagcuguagcggaagugaggagagcucauggaccgaguccugcugauugaccaccugcagucugaccuucgaagugcaggauuuucuuuuuaaccuuacugaccccuacgguugcuagcccuuaaaaggcaccucugacauugugaucuuuuuaaucccuggcagguuuaagcucguccagucuucccagacaugccucucuugauguaaacagccaacagcugggauuugaggacuggacguucucaugaugacagucuauaagcuaagaaagaacagcagagauuuaguggccuccuggaaguuucacaggaauaaaggaaucucagacagugcuugcuuguuuguaguuucgguuccugcaagaguucuucucagaggagacgugccaccugacaaccgggugcauauugucuccuuacccuuagacccuugccaacuguuuuaaaguaaaucauauugaugaguccaaaagcgaacaucaggaaauaaugcuaaauuaaaaauauauaaauggauaccucaaguggcaaaucuguaggcauaaaaacaugauguaggauaacaaaggacuuaacauuuuugguucacauuaaaauuaaacuaguauuuaua

SEQ ID NO: 837 - RNA, 4973 nt, Mus musculus
caaagaacauuagagacaagaaaguacccuccuauuuccauuagucuccaaugcuuugcugucuuccaguuuccagccaagcucgggcuugggcgugaacagaugauaguuucauauuccuuucuggauauuugccauuauuuccucaaaucuguagacguacagacaggcaguguuauagccacagcauugcaauuucuuaucauacuucugauucaagacguuaagcuuaaagauccuccuccagacacuguccuaaucccucugcaaagcuuagucaggaacuagguacacuguggcuuaaguccguucucuuggcagguucucauggccuccauuguaugucaguucuggcuaaccucuuggcuuuacagaagacagacuuucaggggcuuuacucugucuaaggacauauugugcuguauagacccuaucaggagacugcagacucugcaucuaaaagucuucaagccaugagucuauuguaugaacugugcgggugauuuaaggcauacccuauuuacgacacuuucauuggucuaacuucacugggaaaagagguuucguuucuuuuaguuugcuugcuuguuuguuuguuuguuuuuaaugagagugggggaagauagcgguaagauggauuaggaaguggauguguuacucauguuuaacaagggaaaggaaccacagaggcaaagcuguaaaucuaaaagugaaacagcucaggaagcauugcagugaagucagaguucauucuuucuguuacguacagaacugcaccagucagucagccccaucacagacgaagccccacucacgguugggccugcgcuuuagcgucugcauaguuugugaauuuguuuggaccacauguuuacugguuuccucauagugacuuaagaugacuugcagugugaaacgguaacagucacauuuacccagcacagagccagagagacggcacagguggccauuugccgcuucccccgugaugcgucuuguggucuaaaguuucguuuucccacagaaggaucauaucccagcucucuugggaauggcaacggcuuauaugaucuugaaacagacuccaaaagccagaaaccagcugaagcggauugcaaaaaugccuuggaauccuauugaagccgaggaucuggagaagagcuggcugcugcuugcugauauuuauauccagucagcaaaauaugacauggcagaggaauuacuaaagcggugucucugccauaaccggguaggugacugggaaacagugguuaacuguguggcauaagcuucccauagcagagcaauggguccaugucugaugccucuccuuugggucuugaauuuuaaauguuuaaaaucauagucaggaagugaauacuaaugauaaaaagaagcuguguucccuugaaggaagugggaagauagauuugugcagcuucaagucucagcuggugaugccccgcuuaaaagaagugcuuucagaaugucaagcauucgccaugauuacccagcucaucccagaacuaaugaaaauugcagauuauucauuguggucgucugucccucccuuuaagaaguguucuugaugaacuuacugcagcugcaugucaucuccacauuauuagaccaguaugcauaauauauaugggggcuucuaauucaguuuaaugaaaguccuuaucuuuagggaaaaauggaaaaucuccaagucuauacaaugugaacccuauuuacuuauguuauuuaaacacauaaagaagauaauguauuaugauuuuuuaauauagguguaaauuaguguuugcugagaaauaauuacauuugacuuagaaaguugaggcuauuuguauucacagauucauaccaauuagcuaaaaaugcuaaucacaguaaaucuauuuuucauuuucucuaagcaaauuauauuauaacuuggaucauuuacuucuuaaggaggaauuaugauuaccuauaguauuaagauaaucuuaggaaugaaaacccuagaauguauguccauuaucaauugguagacagcuuuaaaugaccaguuucaucaauuuuaaccuaaauuggccuugaagacaaaauacuugcugauaagcuuuaaaaucuaaacuacugugcaguugaacacuauacgccuagucugagauuaaucaaccuugacauaggaaucaaggccuugacauggauaaaaucccgccucucaucuacacugaccacauagcaacaccuuguaacauuaaacuugguugcuccuucagaaccuucauucagcccaguugcuuuggcauaucuauuugaaagcaugagaggcuccggaaucaaagcuuaggagccuugaauuauauaauuuuagagggaaaucucugauauuuggaccaagaaagcauaaaacaacacuagagcaucuugccauaccagauggcaaaaaagcuaucaaauacaguaagcgucauaccaggcacuccggagccucguggaagacaguccaacagcagaguugggacaccaaguacaaaaaggagugagaacugcaauagauuaaaacacauccgauauguuaaacacaugacugcauaaaaauacaaaaaagaaaauagaauuagucaacugaaguaugcuaauaagcugaguguuucugucagacaauggagaagaauucaacacuuacccuggguuuucuguaugaacugcauuuguaaguggccaauuauuugauaagauaucucaauauauaaauguucaaaauaauaauccaugauaacuaucacuauguuucaacauggacgaguuuaugaaugggcagaauauuacaaaggagagaaucaaacaugcggugcuuuguuauagaagaacacaaugucuaugacagagauggggguuaaugagggaaaaaccacaaucacaaugauuacaacaguguacuguauuuucaaucaagugaaaugagaaaaaguaauaugaaaacauacagacucuacugugcugagccgugggacacuggggugggagcuuucucagggucacauuuuugucugugauuuaauggaaagugguuuuagugaaaauacuuagugaugaaauuucuuagaauaaggaagaaccuuacaauaaauacuguugguauauaaagaaaauauucagacugaaccccuaaaacagugauuuucaaccugugggccaugacccuuucacuggauucgucuaagaccaugcugaauaucaguuauuuacaucacaauucagagcaguaacaaaauuacagucagaaaaagcauuuuaugguugggggucaucacaacaugaggaacuggauuaaaggguuagggauagcguuaggguuagcguuaggguuaggguuaggguuagcguuaggguuagcguuaggguuaggguuaguguuaggguuaggguuaguguuaggguuaggguuugcguuaggguuagcguuaggguuaggguuaggguuagcguuaggguuaguguuaggguuaggguuugcguuaggguuagcguuaggguuagcguuaggguuaggguuagcguuaggguuaggguuaggguuagcguuaggguuaggguuaggguuagggaagcauugggaagguugagaaccagagcaaaaagcaggaaacaucaauaauauuggacuguuauuacagaaaccccaccaaaauggagccaaccuaaucuguguagagagaaauacuguuguaaagauucuuuauacuuuuuaaaaucaagauaauagagacagaagaaagauucuccagaugaaaacagacuugagcuaugucaaaccacucacaaucugugaccuggauuggauucucagucuuaaaaacuucuuuaaaaauaaauuauauuucaaccauuuuaaauaugacagucucuaaauguaugggugaaguugguauauucuaggugccacgaguuuggguuauacuuaaggaagucuuuaucuuuuagaauagcauucuagcauauauaugguuaaacuuaugcaguaucugaguuauuuuucuugguaguauggaaguguaaauguggggcaggaucugagucauugguuaauuuuugaaagaaaguuaugaauucacuauacucuuaagucuaaauauguguuuaaauuagucacaauaaacuggauaccugucugugagucaaauacccaucccauuguauguauuccugguacuauaaaagaaguucugcuucugauagcugugggcuggcucuuggcauaaaaaccauucaguguguccuuuccguacuuuggugcuauacacagguuggagugccauugcuuuauacaccauguagagggguuaacaugacugcucugcauguuauacacauucuguaaaaguuuacugguauggagcuuaaucugcuucugucuuccauuguccccucaguccugcugcaaagcuuaugaauauaugggguacauuauggagaaagagcaagcauacacagaugcggccuucaacuaugagauggcauggaaacauagcaaccagacaaauccugcagugggugaguucagcagacugggcccagugucuucacaagaaauaauauaucauuuguaaauacuauuugaaaugcacuuuuagggcaauacauauacaagccaaccucuauugucaaugcuguauccucaucgcgaguuacuuaccugauuacuagguucauucugccuuuuuccuucucccuucauccuucuauuuggaaaaugguaauguggacaaaaaguauccuguugucagauauauuaugcaaagguuacauucuaucaccaccuaagguucuuuuacugagaaccuucuaaagccuuuuaacacuugaguaaggguuugggucucuuaccuuucuccugagcaucauagacguaaugaguuguauguguagacucuuguuuggggaguauuagccuacagugucugugcaguugaguguua

SEQ ID NO: 838 - RNA, 31517 nt, Mus musculus
auugguuaccuaauuuuuaauaagacaaauaaaaagcacaaucccaaauuguuuauuguaguauacuuuauuuaauacaauguuuaacuauaaaaguuaauacaguuuugaaguuuaaauuuuguaaaaugccaucugcagaaaacaguucaacauuuacuagacuaaugauaagagaagcagcaucuuuaaacuaauuuuacaauugagaaaacaaguuuucuaaauuccauuaaaaaaauauacaucacagugacuguggagcuaggaaaagaagugcauuaaccuaauuaugcuuuccccuuccacagagagcagccacaccucaagauuccauagaaauacccaauuuaugugucaaucuuucaaaaauacuauaaacacacaaagaggguggggcagaaauacagagaaugugcuuuuaguaacauggaauugucuauaaaagaaaaccaaaaccagacagaaauacaaaccaaugaaugcccuuccauccuccaguacuaggggugagucagggagagcaaaugaguaaaaccuuaacacuucuuccucuuuggccugugcggccuuuuuuuuuuuuuuaaaugaaugugauuuguuguuuauuugucacacagcaggugaaucccuucaagacauugagaagcccacugcaggcaguaauggcaaucaacacucaguuuccuugggauacuuuauuuuuaaaaacaauuaguuuaaaaauauauucuuacaauuaaaguuucucaaacuacacagagaguuugucaacuguaaaugcauaaacccuacagggaauaauuacaguaaauagaaacaaaagaaugaaaaaugcucauuuaguuuuuuauaccaaucaguuaagucuaaguccuuucugggaaauuuacagaaauuugcuguaaaagguuccaugaugaaagcuauuaacacauggaacaaaggaucaauuauacuaacugcucuaaguagucacuagaaaauaaaguaggagcaguaguuaauacuauuacccaaaauaccagaaccccagcaugugccuauccagaacauaaagguucuugguuugacaccuaccacuggaugcaagcaaagccagugagcagcuggaucacacuggggcaaagaaagcuagcagauuagcauaacuuuuaagugaaagagcacuuuaaacguuggauagcuguucccagacagucuugucuuuacagcaaguaaccauucuguaucagcuacaaugcaguacaauacaguagcuuuacuuucucuaacgaucucuuuguagugucaauuucugugguaaacaacuuauccagaacaauaauucauacaauaaucaucaaagucuuacauacugaaauaauuuccucagcuuuggagucaagcaauaaaaacaagugaaaguacuuucaagggguauuaaaaacuauucauuagcuguaaauuuagauauucuuagaaagccaaugugaugggaaaauugaaaugggaaauaguuuugggaauaugauguacaaauaacuaaaaaucuacuagaacaagaauuugggcuuugugcaauugauaacugugaaucuugggguacaauuaaugcuguuaauuauuuauucugaaaaaaaaaucuagauugucuuuucucaacuauuuaccccauuaucugucauauugaaaaaaauaacaaacuaacaaagcaggaguugggggagcccguaaaugcucagcucugagcugcucucuuggaggauauuacagacauuaccaauuuucucccauguuuacuuuccuaaagaacuggaaaguucuuguuuauaauguauaugcuaacaaguaaaagcucuagauaagaaaaaaaaaguaauuuuacuuaaaaaaaguauggauuuuaaaauguuuguugaaauuccuuucuuaaagaucagguaguuugggauauauuuuaaaacacaacugaauuuaagacauaaucaacuuuuuaagacauguaacagaucacguauauauuaacuauucccaucaagaaaaacuauuuguaaagaauccauuguggguauuugcuuuaggauguuccaaauagcuuuauaaucacugcacucuucauucuguaccagcuacaaugccaaauauaucuuaccauaguaaucaauaaugggaaguauauuaagcaucacuuuauucaguacaaauaucauugaaaagcuaguggguuuaccaagaagcuaccuugguaagagcugacacuauacugacaaauauuagaguacaaaaacguccuaaaggcuacuauuaauuggauuuuugaaauauuucucaaaugaggcagguuuuguguuugcuggauguucaauguuuuauuuagaaggauauuacagaauaaaaggccacacaucacaaaaaaauagcaaaauacaacacacaaaauucugaauggacuuuggauauguuuaguguuuaacucugcacgguaucauauuuugcaacuuucuauucuacuuuauauggcaauguuauacaugccaaguuaaaauaauguuaacaguaaacuggucuaaagccaucugaauagaaagaaaccagagucacaaacaugcuacacagccuaucaugguacauauauagaaagaugcaucuucuugacauuucauauucacagcuaugagaaucagagaaguuaguccaaguuuaaaaaaaaaaaaacaaaaaacaaacccaaaucaugcagaauuaccacucaaugugauauaggcuaauagccaaaauagggaaaucuuauuuccaauacuaacgcuuuuuagaaucugucuagcuuaagaaggaucuacacaaguaguauguuuuaaugagaaaugcauuuuuuaaauuguagaaaaagguaauaacauguucuuaaaaagcaacaauuucagcucuucacaccaaaagcaacaaagaauugaaaauuacagucuggucuuccaaggucuaauuucugucaaaugcuguauaacagcaacucaagcucaaucagcacaugaacugaaaacagcacucaccucauuuuuauagcucgcagagcaacguggacaauauuaagaaacaagcuacagcuggaauuguaaaguauaagguauaaagcacaaaaaaaguaacuaaaguacaaauaacuguaaaaucaaaugaagguuuaagaucacauaaggauccugcuucuguuaguuaaggaaacugcucuaagcccaugaauuauaaaugaaaaaucaaagcccaaaaagcuauacaaaacuucaagugguuucuaaagggauuuguaucaaaagaaacacaagccuauacaacaauguacugcaaccaacaguuaagcuuguuuccaaauggcugauuaagcaaaguaggcugcuauugacgguugcaacacaaaaaugaauacauaagaauuuaacauagcacacaguauuacaccaaaguguuguuuuucuuuucauuucaaguuuauuaaaacuuuagcaguacaaauuauccagguagcagauuaucaaaagaucaacucaaugaaguccacauuuaaaaaaaaaaaggggguggggggagacaaacauaaacaacuccaaaacaaugaaaacaauaaaaaagggagguucaacaguaagucuuaaaaacugaaaauuugagacaggaaggaauuaagaguacacaacucacucauccacuuuugucuucaucuguuccagggcuugauucaugaucacauuuuuuauuuuugucauguacauggucauuuucuugacccuuugauuuuugguuuucuuuuuccaccggggaucuggucuuuucguccucuugauuuuuuaauguggaggacuucacuucauuguccugacugcuuugcuuuguuuuugacacuggacuuugcucucuaucagccuuuuuuucccuguuauuacuugagcuauuaugaucacgacuuuuagaguacguucuuuucucacccucagaauuuucuuuucugugugaacucuuacuuucuuggcuucuauauuuaucuuuguuucuacuuugacuuucuucucucucugagcuccgggaaucccuccuucuucuccuccuaucuuuacuucucgaucguccuggcguucuucgaucccggcuucgugaccuuccucuucuccuauacuccuguucucuguaucuaugguacuccuugcuucugcugcgaucucugucguggcuucuggaccgcacucuucugcuccugucccuacuucugcuccgcucccuuguucuacuguuguaacuguguuuacuuuuagucagaucccguucucuacuccuggacugugcacgucuauccuuuucuuuacuuuugcuaugaucauguucauuacuuuuugauucuaccuguuuggaguucucuuugcuucuacuccuuuccugaucuuucccuuuaggauccagugguuuuucuuuuucuuuaguagucucaugaucccuuucuuuacuucuugaccucacccucuugucuucgugucugcugugcuucgagucucgcuccuuacucuuggaucucuccuugcucuugcuccuacucuuggauuugccccuuuucuucacuuuguuuuuguuauauuuaucaucuuuuucugaauuucuucugaugucucucucuuugcuuucagauuuauggucuuuagcuuucuuuuccuuuucuacuuuucuguuuggacucucagacaugugucugugaucuguuauuuuuuucucuuuuacucuaacugggcuccuuugauuuucuuuuauuucauuuaacucacuccuaaaaaguaaaggaagaaagauauuuggaauuauuauuagaaaaagaacagcauaauuauaagcuauaaugcuacuguguuuucucuaagguauacagaaauaaacuggcuccuaauaaaaucauugugcucagcaguaaaaaagcaucacacauuuaaauaacaaaucuuacuuauccccuuugauccaucuuucaccacuugacacccucauucucugagcucucugcaucucuugucuccaauguggaggagucucacuucgucugaaucgaucccucgaucuggaucuggaaggaguucgauaacgcuuaagaaaauaaaaaggggaaaaaaagaccauauaaaaauuuaaaagcaauaccauaacuaauauacauacuuauuucuagguugaaauaaaaugaaguuucuaugcuuucugaauuugcuaaaauuaggaaugagauaagaacacgcgguuagcauacaucagacucuagaaucuaaucaucuacaaaauaaaaaugucuuacuuuucugguagaacacuggcagucuuauccuaaauuccaaguauguaacaauauccacagaaacucgggcuuuuaacaccuugcuagaaacaguccugcuaaacugguacuagaauaugcuguauauuaacuacuacaaauuuccaauuucucauuugaauguugcauauacaucacucuccaaggcaaagaacaugagaaauagaauaaacucacagaagucuuuuguucaaccaaaauuuacucaguuuucagauggauggcuaaccacuuuacugaagaaauaccaauaagccaagauauagcagauuuugaucucuuagaacguaacauucuacaaaguuacaggaaaaaaagaauggauauauaaucacauacauuaaacuacaacagaaugauuacagaaggagaaauggugguaaaagaaucacagagacagcuuaguauaggagugcgaucauguaaaauaaagcuaaaaauaaaagaauguuuauguuaaguuaccuaagcaaagaugaggcaaaacauggaagauauaagaaagcucuguauugaaaauucugggggcuggcaagauggcucagcagguaagaguaccaacugcucuuuugaagguucugaguucaaaucccaccaaccacaugguggcucacaacuaccuguaaugagaucugacucccucuucuggugcaucugaagacagcuacaguguacuuauguauaaaaauaaauaaaccuuugggccaaagcaagcagggauugagagagcagaguggacaggagugaguggggcugacugcaacaagcaaggcugacgagagcaagcagagguccuaaaaaauucaauuuccacaaccacaugaaggcucacaaccaucuguaaagcuacaguaucacaagacaggacaagagaaagcaaaacuugaccauacugaugaaauaaacagaauagauuuuuguaagggcuuagucuaugcuauuuuuaaaauuuauucuaaagucaauacuacaggacuacaauacuaaucagacuugaccaaugcacaaaaguacuagcuagauauucaacuuaaggucuucugcauacuaggaaaguacuccaucaguggagauucaucuccagcccagauuuacguuuuuuuauugacuacugcgacuauuguuaaauauagcuuaugccccuuccaccugucacaucaugaucacucagacuauaaaacauguaacuacuuucauagcuacuuacacuuauggugaauauuucuuggcucuaauuucuaaaagaaucaauauugauaaauauaacucauacgaacaaaagcucuuuagggucuguaaucauuuaagguuuaaguuuaaauccauacugacagauuaaaaaauaacaaaaacaaaaacccuucuuccaaauacaaguuuggaagccauucuaauuugagucagcauccaguaaaaauuuauagaugcagauacaugucagaguagaggggagacaaaaaugacagaaguugacguaaguaaguuguguaaaauugaaagggaagagaauaaaaacgauucuuggcucacacagguggucccaugacucacugugagcagcagccuaaagagcucugaguucugaagacuaaguggucacacuguacucuccauacuaaguuugaggugcucaucagccaaacaaaccuuuggugccaagagcagauggagcugugaauuaucagccauccaugugaguaaaagagccugucuaaggaguaugugcaacuuaaaauaaacuugagucuugacauguaggucauguacaggaugcaaaauaguagucuacguuuaagauagacuggcuuaagagacaggaaaagaacagaugaaacaauacagagaacauuuuaaggagaaauccuaaguaaugacugagaggauucaauggauuuuguaacuuggaaucaaccagacagaaaaugcuguuuucagcagacuguagaaagaacaacugcauaagaagccaagaucuaagauaguauagcuaaguuucuuaaaaaaaaaaaaaaaucuuugaaaaaaguuauuuaaauucugaugggaaaauuuaguagagagagagacagagacagagacagagagaaacagagacagauagacacacuaauuaguucuugguaagaauagagcuaugauggguagaaaauuaccauaagucagaagacuucaauacccuuuauauccugacuuuauuugaaugcuaauuauuuuugagacagggucucaugcuaaucccaaguuggcaugaaauucauuauguagaccaggcuggccucaaacucacagcaaucuuccugccuuagucucuuaagguaugagccaccauucccaucucaaucccacuuuaaaccacguaacuacauaaucuaaaggauguauacuuuaaaacaugcauauacccugaguuuuuaguaacuuuaauaguaaaauauuuuuaaagcauuaaauuucuuuuuccuuagagugcugagaaucauaaacucagagcuguuuacauguucugcaagcacucuagcaaugagccacaccccagcacuccaaacucuguaagaaauacaaaugcaguaguauugaaauuucugauaaagaaucaccuacccucgguccucuuccuuuaauuuuccugccagaccuaguaacuaagaaucgucgcugguaugaagcaggcugggaguuagguggauuacuagaagcaagcaaauggaaaguuuaaacauaucacuuuuauaaagaggaaucuugaaacuauaccuuuacugaucuaaauuaauauauuuaaauucuuuuacauaauuaggaguuuuuagcccaaaaugcuaucagaucccaguaggcauuacugccuauggcuguaccaucuugaaugcgacugaucucggaaagaaauacuuauuaguaaggugaaauuaauuuaauaaugcuaacaaaaucaaaauauaauacagcccagagggcuuccaaaugagagaaaagaaaaauuacaaaaugcuuuaucucccaugaacaguugugcauuaguaagaaaauuauggacaaauuaagcaauauauauuaggcagagacaaguuggucugaauuagccaaauaccacacauauuauaucucaaacaugaaacuuuaaauuauacauaagaucauuaacaacauuaauguaagugauaucugaaaaguuuaacuuuaguagucaaauaguuuuccuuuacucugucuuuuacgcucaaugaaucaauuuuaaagcuuuuacuuuuauguauuaugaaagcauggcauauuuuuguuguacuaugccuauaaaauuuucacuuuacaacuauauuucucaucaugacuacaaaaagauuugaaaaauuuaaaacuuuucccauaucaucuuuuaaaagauuuauuuauuaugcauacaguguucugccugcauguauggcugcaggccagaagagggcaccagaucucauuguagaugguugugaggcaccaugugguugcugggaacugaacucaggaucucugcaagagcagccggugagccauuucuccagcccucaucucauuauuaaaaugacucauaaaaaccaacaaaguugguaacauuaauaaaauaaauuuauguaaaaaauauucaaaguaaaaagaauaaaaaaauauucaaagcaauugaaaaccccaaauuucauuauaguauaaaggcagguuuggagagcaagacuuuuauacaaauuuauaaaacaagauucauuuuucuuuuuugguguuugucugugaaugcacaggcauguaaauucagguguaccuauuuguguggcuagaucugaggucaacguuuggugacauuucuuuucuuucucucucucuuuuuuaaaaagauuuauuauuauucauuaguacaccguagcugucuucagaugcaccagaagagggugucagaucugauuacagaugguugugagucaccaugugguugcugggauuugaacucaggaccuucagaagagcagucagcgcucucucaccagccccagccaucucaccagcccuuaggagccauucaacuuguuuuuugaaacaggcucucaaacuggccuggaauuuacuggguaggcuaagcucauuggucagaaaaacccaaggguucacccaucuuccccagaacugggaucacaagcaugcuacuggacuuagauuuuuguuuuuguuuucuguuuuuucaagacaggguuucucuguguagcccuggcuguccuggaacucacuuuuuagaccaggcuggccucaaacucagaaauccgucugccugugcugggauuaaaggcgugagucaccacgcccggcuagcuuuuuuaaaacaaagauuucagcaaugaaacuagaguucuaaugcuuggacaacuuguagaaguugagcuucuccuuaagccauaggguccaggggaaaauacacacauuuucauaucaccauuauuucuguuucguuacuagcuucagaggaccuuuacuuauuaggaaucuauuucagguacaggaggaaucuugcacucauguacauauacaucauauacauauauauauucauauaaacacauuuauguaacuauuagcacacacauacacagaauuaaaaaaaaaacagcaaaaggagucuucuuaaaaaauuauaugagcaacauaccaaaauaucaucuuguuuuauugguuuaaaauuaucuuguuauuaaugccauuuggaaugucacuauuuacacuacagaccuuauauccucaaaaucuacugguaggaggaguuuugcuaacauccuuuuuuuuuuccuaauuaaaagagguuuucauugggauaagaucaccaauuuaauacugucaaaaaugguucaaauaugguucaaaaaauaagaaaacguuuaugguaauacguaacaacuauaaaauacacacauucacauaccacucucuuucucuuucucucucucuguuuuuccucuccuugucaucggcuuuaggaggacuuuuucucauuagaaaucuauuuucugguauaggagggaucucuucuggacggacaguagacuggggcugugcaucaacauuuucugcuucacuuucacuagaugggcuuaacagguaaaaucaaaguaagucacauuuggcucuuauguaccuaaaauuuccaauuguuagcauuucuuuucuuuuuaagugacauuuucaguuaacguguguauaagcauacaugccaugguacauaugagcagucaagagaaccugcaagaaaucaucuuuccccuuucauuaucucaguccaggguaaauucaggucaguggcuugauggcuagugccuuuacaugcugacuaucucaucaacccaacauuccuuuaauaucaaaauaauagaucaaccugucccuuucagagaugugaucauaugguaaaaaucuuccuccauuccucauaacuaaccaaccaaccaacucaaccaaacaaaaaccauuugcuaucaaacucaaaaauacuuuucuauaagguacaucuaaaauaugaaacucuguagguaauacaauuggauaaauuuaaaauacaggauggggcuggagagauggcacaguaaugaaaagcccuggcugcucuucuagaggacacagguucaauaggcagcacccacauggcagcucacaaccauuucuaacucuaguuccaggggaucugaugcccucuucugaccuccgugggcagaguaugcaagcuccuaugcacauacaaaacaaaauuuuguacaaauauagacuaaagaaauuaguugguuuugagguaauaguuugagguaaaugguuuuuuuuuuuuuuuaaagauuuauuuauuauuuauuauauguaaguacacuguagcugucuccagaagagggcaucaggucucauuacggaugguugugagccaccaugugguugcugggauuugaacucuggaccuuuggaagagcagucaggugcucuuacccacugagccaucucaccagcccgagguaaaugguuuuaaguauauacuuaaguuuuaacauaaacacauuucaaacaaaagcagaaaauagugacagaaucaucugcucucaauccauauacuucuaccaaagcaaaagagaaaagggaaccuauauguacugcuauaaaguaagggacauaacuuuugguuugcuguaauucaaaucuaucuuacaaauuucuucaaaauccaaaccuggagugauguacaccugcaaucauugcuaucuggaugugguaaaacaguuuccucugagauuuaaauauucuauccuguaggaagcuacuuaagcaggaaaguaaccaacucuaaacagcuucaggaaguuccuaaaacugacaagacaaagucucucccugcaaaagcagaggaaagcugcaaagacucucggacaagacaaacuguaaaugauucucaagccagaccagcugccuagaagcagaaacugaacaaacugccuagaagaggcuuagaccaaauuugggaccuggaacggacaugauccaaccuguugaacugccuguaggcugugcacugugcuucagguuccuaccuauaucagcugccaacuaggcuggugugggcuuuuggugaugugacugucugacugcucuugugaguaagcccaguaaaacucaaggguucaccaaauuggacuuuggguauccauacuuuauucugucauggacuccuaucuggggcuagauguauuuguugcaucucuccaggaagaguuuugucacacaacagaggaugaggcagaaaaccuaugaauuugaggcagcuugaggaauugggacuaccucaaugaaaccaaacuaaaagcccuguaacauaaaaccuaaagcaucacuucacugggagaacauaaaauuaauuaauuaauuaauuaagagcuucuguugcaugaucguaugccacuguuauaaaaccuuucuauuucagugcucuuacauaacugauuaaaaaaaaaucuuuuuaacacuaguauuaaagaccuuuucuugcuuuucuuucgcuucuucuucuccuucuuaugcuuucgggaauuuuuccuauguuucuuuuuccuuuuucuggauuuuucuucggaagcgcuuucagaaucagaagacucagaggaggacugagaaucgcuugagcugucugagucacuggaggaggaggaggacgaggacuuaugccuuuucuuuucuucuuucuuaacuuuaaaaacaaaagagucuacucagucauuucaggcaaacugaugagguaaaaacuuaacuuuuucuauaaauuuuuaaguccaguauuagauauuuuguucauucagucaucucaacucagagagaguacaacagucaggccuuggggauuagaacccgcauuuccagauucaugagccagauugcuauugagccagaguauuucuaaaaauaagcaagcuccaaauucuaaaccauguuaauuuuaagaaacauuugaauagaaaauuuuaaagcaaagaguaacaucuaagauuccccaaauucuaguauuauaguuuuuccauuucuucuccuauaucaaaacugaagguaaaaacaaacaaauaaaacgcacacaagaaaacaaacaaaaaccaaaccaaacacacugcugugucaacacaggaaggaauauuucauuggcaccaagcuucaacuuccacgacugagcaaggauucgucuaaugauuagaaacacagcuuaaagcacacucucauaaucagaaguacuuuaucaauaauaacuaugcuuaaaaaucucuacaaagaacuggagagauagcucggcaguuaaaagcacuggcuguucuuccagaggucccaagucaauucccaacaaccacacagagguucacaaaccaucuuaaugggaucugauauccucuucuggcaugcagacauacaugcagauggaguacucuacucauacauaaauaaaucuuuuuuuuuaagucucuacaaaaaagucucaaguugaaauuuugaguuaaggaaucuuuuuuuuuuccuuuuggucucauucuguagaccagcuuggccucaaacuuggauauccaccuaccucuaccucuggaguacugggauuaaaggugugugccacuaaaccuggauaggcaaucaauuucuuaaauauuaucuuauuauuacuaucaugugcuuugaugugugugccaugguuagaggacaauuuuguagaguuccacuuuuagguagguacaggaacugaacuaaggucagcaaacuuucauggcaagcacauuuacccacugagccaucuucuuagcuuaagaaauaaucuuuuaaaaugucuugaaacuuggaugcuuuaaagaauauauuaacauaaguaaaauuaucacacauagggcauaugaauuuuucaaaaguuagaaccugacccauuuaguuguacuaacucaaaccagaauggauuugaaauacuuauuugggccaaaaaugagucaacaugcauauacagaaaaaggaauuucaauaaauuagcaaacaguaaauaaauagacuuaaauucaucaggucaugaugguauuaguaaauuaagauauaaauaagcccucuguguuuccuacauaugauuuuuaucaauaaacaaaaggaugcugcaucuuaucagaagaguuccagcaauaaguaacgaaggcacuacgauuggagugucuuuuagaaaguccuacggagcacugaaugaacaccaacugcagagcagggggaaaccagucagcccuguaugacuccuagucucaaaaaaugaugggggacugaggggagaugggggacugaggggagauggggacugaggggagaugggggcugaggggagaugggggcugggggagauggggacugaggggagauggggacugaggggagauggggacugaggggagauggggacugaggggagauggggacugaggggagaugggggcugggggacuaaaacaaaacaaagcugauucucuucaguuuucuaaauggauuuacuaagguauuugaaacagaagcagaaaacuaugaaaaguagaauuaagaaaaaacgcuacaucacaaauaaccuagcuauacggcaagcuccuggccucaaaugauucuaugccucaacuucccaaguagcuggaacuacaguuauaccuggcacaaacuaauuaaaacaacuuuaauaccaauuucaauguucaaaccuuaagucagacucaagcaacaaaaugacuaacauuaauaaaacaauaagaaaucacaacauugcuaaguuuuugaucaauaggaguauguaauagcacggguuaucuuuuacaagucacaucuuaggaggaaaaguuaaauaucuguagauaaaauguguaucuggagugcuggagagaugguucagugguuaaguauauuggcugcucguccagaggucccagguuuaaucccuggcauccacacagcagcucacaacugucugaaacucuggguccaggggaucugacacucucacaccaaugcacgugaaauaagaaauuuaaaaacuguaucugaaauuugcuucaaauaagaaagcaggugagugcaaugacuuacacauccagaaaaauuuuaaaaagauuuauuuaauaauuauaaguacacuguaccugucuucacacacagcagaagagggcaucagaucucauuacagauggcugugagccaccaugugguugcugggauuugaauucaggaccuccggaagaacagucagugcucuuaacuacugagccaucucuccagccccacauccagaaauuuaagucuggcaauauagccaaacccugccuuccaaguaaagguuugugagggggagaaauaucuggagguagguaaaacaaaacuguccaugugugaacuguugaaacugggugguaaauaugcccauuauacuuaauuauauguauuaguauucucuauaauucaacaaaguuaaagagaaaaaaaucugcaucuuuggacuccacuggcuuccuuguuacuggacugguguaucugaacucaguaucuauuggagcauauuaaauccaaaauaaaaaagcaucucucugaaguuacuauguucuugaccaagaaccuugaacacugacuaugauucaugcucauuaugcagcagcucgagaccagcuugugggaacaaguuauaaaaacugaagagaccucuacagcaaaaaucucaacaaacuaagguagcccaugccuaccuagucacauuccucugaucauaaacauaucaaauauaagguucuuggggcauaaucaagcuguguauagaaaucaugaaaucuccaaaaggcuauuuccugugcuguaucuccuuucuuuauuuuuuguuuuguuuuguuguuuccuagacaggguuucucuguguagcccugacuguccuggaacucacucuguagaccaggcuggccuuaaacucagaaacccuccugccucugccucccaaguguugggauuaaaggcaugugccaccacugcccggccuguaucuccuuucuuaaaccuuagucaacuuuguauggaaagaaaccuauauugucucauuaauccaauuauuaaucugaaccuaagaccauuaaaacagagaggauauacaaacacaaacacugaaaaaucuacuauauauacuuuuaguaacuaaagggugggagauauuaaacuuuuaaagaaaauuaauucacaaugaauacaagucaaagaaauaccagaucuaucuauuuucuaagcaaaaugaaaauaaauaauaauaauaauaauaauauauccaucaaaguaauuugauuuugucaaauacuuuaucucauaauuaagaaaauuucauucuccuuuccgaucugccaucguggguggagccaccgccucgaugcagauuuuugugaagacccuuauggggaaaccaucacguuacggccaagauccaggauaaggaaggaauuccuccugaucagcagaggcugaucuuugcugguaagcagcuggaagauggccgggcuuugucugacuacaacauuccuaaggaguccacccuucaucugguguugagacuucggguggugcuaagagaaggaagaagucuuacaccacucccaagaagaguaagcauaagaggaagaagucuaaguuggcugugcugaaauacuauaaggcggaccaaaacgucaaaauagccgacuucgucgagaguuguccuucuguugaguguggugcuggaguuuucaugggaagccacuuugacaggcauuacuguggcaaguguugucugaccuaacugcuucaacaaaccagaagacaaguaguuggguauguguuaauaaaaagaaggaacucaaaaaaaaaaaaaaaaaaaaaaaaaagaaaagaaaagaaaagaaaauuucauucucaucagcucccacuuucauuuugcacuggaauucuuucucaagaaagaaagaaagaaagaaagaaagaaagaaagaaagaaagaaagaaagaaagaaaggaaggaaggaaggaagaaagaaagagagaacggaaggaagaaaggaaggaagaaaggggcauaccacaggugauuuuauuacagugugugucacagugcaugugugaagucaugaagucaguucuuucucuccuuauauaugugguuuccagccuaaguuugggcugccaagcuuguauagcugcuaagacaccuuacugacucagaagaugauuuaaaagcucauucuuccuaccaaguguaugaaauuuaucuuuuguuuuguagacucuguagaccaggcuggccucgagcucagaaauccaccugccucuaccucccgagugcugggauuaaaggcgugcccggcugugauucaguuuuacuuagacuaaaaaaaaaaaaagucuaaugacacugaagaauaccaggaguuugcuccugaaauuacacuuuuuguauaugccuauaaagguaauuagucaaguuagguuuucugcaauuacuuuguguguggacaagauuaugccuaaguaaaauuuucuaacauaacaauugaacuggaauaaaggcauguuuccaaaacauucuagcagauguaaccuauauuagaauuucaagcagaggcugagcaggacaugcugaugcauaccuuuaauccuaccacucagaaggcggugugugugcaugcgcgcguguguguacauaucuguguguacaggacuuacccagggcuacacaaagagaucuugucaugcacacacaccaaaagagauugaagaaaguagugaauaucugcagaagacauacaaaugcuaaacauuguacaaaguucuucacaacuauaauuuucuuauuguauauuguacuuacaguauaugguccaugccuucugaagaaccguaagugaggcugugcuugacccagacacauacguacagaagcacauauaaauuagaaaaaacugacagcacaggacacaucuaaacccacaaaaccucaugcuuauuuauaaucucuacuuauccaaguaagaguucccuuaacugugcacccguucuuacccuuagacuuuggaaucagcucuccgcaacugaguauccgaacuucagcaaaugguuugcuagcggcaucuguuuucugguuuucaaucucucucacaacuuccugaccagagaucacuugcccaaaaacaacaugaugccuaaaaugucauguaaaaauuauuaaauaaaagcuucuuacucuaauacaacaaaauaaaguauguuguaagauauuaaaauaaucuuuacccaucuaaaugaggaguugguuuuguuguucuuuugggauucaucagauaaaauaaaaacagaaaaacaaaguuagcuucuauaaaaacaaaaaaaguguacugaaaauaagaaaucaugugauacccuuauauagcagaaccucaugagugcaaaggguuucccauacgaguuuuacaaaagcuuguucggaauauaaaagccauaccuauugacugcugaagacagugagugcaugcaguugacauuuagaguuauuucuauccacuuguauuucuacuugucacuagguuuuuauuaaauauuccugguuguaugauguucuguuguauugaacugcuaaacuuaccaaaucauucuacuaacuuauggguuuaacaauggugcuuuucauccucuuuuuuuuuuuuuuuaaagauuuuauuuauuuuaugaauucaaguacacuguagcuaucuucagacacaucugaagagggcaugggaucccauuacagaugguugugagccaacaugugguugcugagaauugaacucagcaccucuggaagagcagucagugcgcuuaaccacugaaucucucaggccucacccuaaccuuuuaaacaguuaacguggaggguuuuagaggaauugagagaggugggaacagucagucugauggcucugagauauauuugcugaacaugaauagaaacaguccacuuaauuucauauauuuuagaaauuaacugccaacauguaguuguagguacuucugcauccaauuuucaaaucucucuggaauaucugaaaaugauaguaucuaguuuauggaauaaguaacuaguacuuaguguuccuguuuucuucaacacagguuuuaauagcugagauucuauguuccaacaggcuuacucauguuauucaacuacucuagguuuuugagcuuguuaucugugauauugaauaaaauuuuguguugaagaaaaguugaauuaaacugggucaaccucaaacaagagcauaauaauuacauguacuggagaaguuaagaugggguucaaggacccugaucaagagacuuucaaaacaaacucaccugaaucuaaagaaagcacuuguucaaugcauuuuuugcaaguaccccuaccucucuuuuauucucaaggucaaccucaaaacuauguaguuagaagccugguauuugguuacguagagacauacugguauauaaaaucucuuaaagauaaaauacuugguguacaagcuugaguuugaucccuagaauccacauagaaagcuggguacaguaguggaugguaccugaugugguggauguauuuccgauuuuguucucugacaauggcaaugucuuaagccaccuauuacuuuuucagcaagcucuaucaccugagacuuuaguaaccauucuacuauaccaucagugauuguuuuacuucuccuauaauuuuacaaucucucucuuauaaaggcaauagggacaguuagcagggauauuugaaaccuuaaauacauacauaaagaacugagagccauuuguauccuucccucuguuggccauugauaagagaaacucuuuguuguguuuaacagcaaaacucucaucuauauaaagagaagaaaauuuucaguuauauuagaaguguaagcuccaagacacuuauuuuucaagacuggagagauggcucagugguuaagaggcuugcugugcaaacauugaggacucauguagaaaaccauguuaaccauugcauacuuguaaccucagugcugugggagguaguaauagaaaaacugcugggacuugcuggcugauagcuuggcuuggauucagugacacugucucaaaggaguaaagcagaaugguagagcaccugaugucuuccucuagccuguacacaggaggaaaugcucacauuugcucacgcaugugcauauauaucacacucaaaauaauucauuuuccauucuuguucacaauggauauuuuccuguuugagacagggucuugcacuuaaacuaaguuggccuccaaauccuuccugaaccuccccagugcugguauuauaguucagugcuaccaugccuggcuggauguguucuuuacugucaaacacaacauaacaaggucagguuaugaaggaagaaagaaccuauuaugaaccaauuuuuaccccuguaauuuuagauuuauuacuaauuuuuccucccugguguaaaggauugaacucagagcuccaagcaugcuaucaagcucucuuaucucucagucuaacauacuuaaaaguucuugccuaccaucaacaaugcccuggauuugaccccagcacaguacuaaaaauaaauagcaagauuguaagaguccagauguauuucuuuacauuuuaucccuuucacucaugagcauggagggauaaacaucacagucuagacucauuaacugaaccuccaucagagcauuguuuacuucaaugauaagaacuuuucuuuuaaucuuugauuagagugagaaaaauguaugagaaauuugaaacaauauucucuugaauaccaaaaguaaaauaugaaaaccauuaaguuaucucuauauucauaugcuuaauuccuacuguaauuuauagugaguaaaauuucuaaaaacaauuaaauauaaaagcuuuaccuucaaagaauccuccauaaauagauucuccuccucuuccauucccuaguuaugaaaaacacucuuagaacucaggauaguaaacgcagucaaauacuucucaucaaguauguauacaaaugauucugcaccaauaacacucaaaggaacacaacaaauuauaagacaucaauauaauuucaauaacaagaggacugacucuuguaaauuguccucuguucuccauuucccuguacaacacacacuacccaaaaccuuuauguuuaacaaaaaauaugucgugucuuuuauaggacucaaaaucucaccuucacugaagucaccacccugaaccaugaaauccuugacaacucuaugaaagagacagcucuuauaauguaauggcuucugaguugauuucccugucccuuuuucaccuggagaaagaaacagucauagaucaaugaaaagacugaaauauuaguaaagcccauauucuucuagagaacacagaaaucaaucucagauaaaaucuuauuacaacuaguacuuauuuuuaauuaacuugaacuuuuuugaaccuaagucuaucuuuguaacucaugcugccauuacacucacaguccuccucucagcuucccaaggguugggauuacaggcccccuugcauguggcccagaauggucuugaaugcaugcuccugacucagccugaguuuugacaucauaugucuucaucccaaugcaggguucacagcuaguauuucuagaaauuaggacaauugaaaaaugcaaacaaaccugugcaaaggcagcgaaaguucucacacguuuugggacauacaucggaaaauaauucaaagacaacucuuccagcugaaaaagaagguaacagguuuaaauuucuugaguacaauuuuauauucuaguauguuaauuagaauauuuuauuaauuuauauauuuauauuaauauucuuaccagguugauuauuaauggcaaugucaaaaaaacaccgaggacgcuggaccuuuauccccaugguuccaacacuucagucuguaagugaaauaugguacaguuuuaggcagccaacuaaaauggcaaagauuuucuauuaaugucuaaaagcaaaaucuauugcacauaaauuacaaauguuguugaacuuauuuuacauuugucuccuagggggaaacucacuaugauucuuggagauuagacuauacuuugaggaaaauagaaaaaaacuuuaagauuaaggcauaguaauuacuauguuaaucuucuuuuauuauuccaauuuuaguaaaugugcucuuaaagagaaccaucauuaucguauaauaaauuccuauuuuaccaaccaaaaccagauuacuacccccauacagaauacuguauuaagucuguaaaacuagagaacaaaacauguauauuaccuuuaaguugggggaaacaauaaaaaaacaaaaauccaccaagaaugacugagccaauuguuuugcuccuaggaaagaaaaaugagagcucuaauuaaaauauaagauauuaaagaaaaauauucaaguuuccaaacaaaaccaaaaauauaucaucaucugugaagaaaaggaagagguuuuguuucugaggcaaaaucucaucagguaucucuggcuaacuuuguacucacuuuauagccuaggcuggccuacaauuuauggcaauccuucugccucagccuccugaaugcugcugggaugacaggugcauguuacuacaccugaaaugaaagguggggauuuuaaugauacuaauauaagguagauagaauucugaucaaaagcauauucaauuuuacaugagguuacuucuggucaugagcaacuaacagccuaugacaggcacauaguaaugugugaaacacuaugaagguagcuguauucacacagcagguaccuuuuacuugacauucuuuuguaaaucauuuauuuuaaggauuuauaauaagacuugguagggaaugauacaguaaggggaagaacugauaaagcaaaacuggcaaguauuaaauaacagccaagcuaacagaauacaaaaauaaccauuucauuugcucagaagagacugaauacacaugcguuuauuuaaacuaucacaccuaaaugacuaaagugccuuagcaaacagccugugauauguuacacagaguaagaaauacccuaaaaggucuauacucuucacucuaaagagucuuccuuuucccuuuuucuucuuuuucuucuucuucuucuucuucuucuucuucuucuucuucuucuucuucuucuucuucuucuucuucuucuucuucuuccucucucucucucucucucucucucucucucucucucucucucucucucucucucuuugugcuugccucacuuacacaugguacucauguucuaccacugaguuauacccuggcacaaauuagcugaaaauuugaggcaauuauagauuuauauccaguuacagaaaauaacugaagaaugggcauggugguucaccuuuuuaaauccaaacacuggggaacuuaagucaggguaacagugauauucugccuuaaaacaaaacaaaacauaacaaaaacuaccaugcccaaaccuuuaauccuagaacuugagaaacaaaagcagguggaucuggaggcuauccuagucuauguacauagagagucaaaggcagagcuacauuaauagagacccugucucaaaacaaaaaaauaaggaacaauggugacacaaaagauggcuuauauacuaugucucuaauguuacuaaaugggacagcaaagugguaggcaguuaggaacaauuagcugcucuucaagaaaagcaaaguuuaagucccagcacccaauggucggucucucacaggcaccuguaacacuccaguuccagggaucuaauguccucugugaccuuuacagacacugcacacacaugaacacacauacacacaggcaaaacacccccacacacaaaauaauaauuuuuaaaauaaguaaaauugcuaagaugcuauuacuauuacuagagacuuaacaauugcuagugauaaauaggacauuuccucuguauuuaugacucuuaauuaucacuuaauaauaucuaaaaucuaaaacaauaagacaaacaucuaaucaaguucucauuuuuuccaagaaaaaaggauugccaagauuacauuaguaagauauagaaaauuuaauucaaagaaaaauuaaauccauaaaaauuucaagaaaauggccauacaauucuguauucccagcauuccagagagucaucuucuaaaacaaaccuaggcuauguagcaagacucauuucaggagagaaaaaaauuuagccaccaguugucucagaauauaaucaaaucuuuugggauuaauuaucuguaaauauuuguuugccacaaauucauuuagccugaaugaguuauagcuaaucuaaucucauaaaacccagauuugaauuuuuugaaaaguaauuacaccuggcgcagugccccauuuuguagugaucagcacgugcugcucccauuauaaugauggaaugcauguucuagucugaccuuguuuccauuacugauuaugaacuguaaccauuaucaucuacuuaauauuauuauaaacucaauuuaccuauuugacuuccucagaaaugagugauacugauuuuuuuuucauauuagaauuacauuuuuuugagacaggaucaugcaauguagcucacauugaacuucaacuuucuauccuccugcuuccacuccuaaguacugugacuccaagaguacagcaugauguuuggcaugaaaauacuuuguuuauugaucuuguuuuaaauguuuauuaaucacuguauuagucaggguucucuagagucacagaacuuauggacagucucuagauaguaaaugaauuuauugaugacuuacagucggcagcccaauucccaacaauuguucagucgcagcugugaauggaaguccaaggaucuagcaguuagucagucucacgcagcaagcaggcgaaggagcaagagcaagagcuagagcuagacucccuucuuccaauguccuuauauugucuccagcagaagguguagcccagauuaaagguguguuccaccacaccuuuaaucccagaugaaaggcguagcccagauuaaagguguguuccuuaaacucggagauucaaucuucuggaauccauagccacuauggcucaagaucuccaaaccaagauccagauaaggaucuccaagccuccagauaagggucacuggugagccuuccaauucuggauuguaguucauuccaaauauagucaaguugacaaccaggaauagccacuacaaucacuuugcauguuaacaauaaaauaauuuuuauaaacaaaaugcuaaacuucuucaaauguuucagaaacaucagugaguggucagaaauucauuuugcacuuucaucuguaaaaugauuuccauauucacccuaaugggucuuuaagaugccagggagaaagaaucgguauauaggcagcuaauuauuaaauggaguauuuguaauuagauaguaauguagugauuuuaucacauuaaagaguauagucagcaauacacugacucuaagagucucaauacuuaaagggacaguggacuuuuuuuuuaagauuuauuuauuauuauauguaaguacacuguagcugucuucagacacaccagaagaggguaucagaucucauuaugggugguugugagccaccauaugguugcucggauuugaacucaggaccucuggaagagcagucagugcucuuaaccgcugagccaucucuccagccccugaguggauucuuuaaaaugauuaggaugacaaccaaggcuuuccuucuuuguuccuucuaauuccucuggcuaugucucuuuuuuuuuuuuuuuuuuuuuugagacagaguuucucuguguaguccuggcuguccuggaacucacuuuguagaccaggcuggccucgaacucagaaauccgccugccuccgccucccgagugcugggauuaaaggcgagcgccaccacgcccggcuauaugucucuuaagauucaguucagucacaguacucuagaaacuucuaucuccaggcugaaugagccucccugggugaaaauuauaaacucaucuauaaauuccaccaaccaaaaucuuccuggcuuuuuguuuuguuuuuaauuagauaucuucuucauuuacauuucaaaugcuauccugaaaguccccaauauccucccccggcacuuuuggguuguuuuuaaaaaaacaaaaacacaaacagcaccccacacacacaagaucuuccaugguugucaaagauggcccuaaacacacccugcgugucccaggcaggccaugaacuuauuuaacagccuccugucucaguuuuucaaguauuuggaauuauacgccugugucacaagucccuucuaaaacuuugucuucuacacaaagcacagugccacccccagagacuucaucaacaaauagaaagaauacuaauuaaugcaaauaugucuggaagcaguauuuuguuguuggcauuuauuuuuuguuuucauuuuuuucauaaauaagucuuuucuuuuuuuaaagauuuguuuuauuuauaucacuacacuggagcugucuucagacacaucagaagagggcaucagaucucauuacagauuguugugagccaccaugugguugcugggaauugaacacaggagcuuuggaagagcagucagugcucuuaaccacugggccaucuccccagcccuuguuuucauucccccacccacaccccccucccggguuucucuguauaguccuggcuguccuggaacuuacuuuguaggccaggcuggccuugaacucugaaaucugccugccucugccucccgagugcugggauuaaaggcaugcaccaccacaccggcuuguuuucauuuuuuuacaaauaguuuuaaguaaccuggccugccacguagcuugagaauaacauuaaauuccuuauucuuuuguguccaccuccuaacugcuggggugacaaguguguaccaaaacacccacacagaucuuguguuuccuauuauaaccgguguuguuuucuccccuauauauaugcuuuucacauuguuauuauuguuaguauuguuauuauugacucuccugaaagaaagguaauaugcucuuaucagauaggcuuauuuuuaaaaauuuaguauuuguuguugcuguuuugagacaggguuuuuuuauguaguccuggccauccuggaacuugggcugaccuagaacagagacccacaugccuucgauggauugaagaauuauaacagcacacccagcaucugaucggauagguuuguugacaaauaacagguucuguaucagacucaaguaaguuagauuaauuaaagcuauauuggauuuuuaaaauuaccuuuuuuauaaauguacuuugcuauuuugaauuaugguacuucauaaacaaaaaaacauauaauuucuguaagcccuuaacugcauaaaacauuacauuuaaacugguacauucaaacugcuaucuccauucuuugacagucuaaagagaaaaaaaaugucaaauaugguauuaauacaugaaaacaaaaugucauuccaggaaaaauuuuuaaaguuuuagaagggacuugugacacaggcguauaauuccaaauacuugaaaaacugagacaggaggcuguuaaauaaguucauggccugccugggacacgcaggguguguuuagggccaucuuugacaaccauggaagaucuuguguguguggggugcuguuuguguuuuuguuuuuuuaaaaacaacccaaaagugccgggggaggauauuggggacuuucaggauagcauuugaaauguaaaugaagaagauaucuaauuaaaaacaaaacaaaaagccaggaagauuuugguugguggaauuuauagaugaguuuauaauuuucacccagggaggcucauucagccuggagauagaaguuucuagaguacugugacugaacugaaucuuaagagacauauagccgggcgugguggcgcucgccuuuaaucccagcacucgggaggcggaggcaggcggauuucugaguucgaggccagccuggucuacaaagugaguuccaggacagccaggacuacacaggacuacacuuuuuuaguggggaggcauauguaaugcacauguguguaggucagaggacaacugagaggaauuuucuucuuccacuauguggcuuccagggagagaauucagauccucagacuuaguaguaaaugcuuuuaccugcugagucacuuuucagccuccuauauuacuuuuaauacuauucccagggaagacuuaaguuuugaauacaaagagaagggaaccuuuguuacaucuagauuuuuuuaaaaacuuaauuaaaaaauuuugagaauuccauacaugaguauuauuguauuuaaauugcuucuaacacccccucuccuacauccucccaaaaguccccuuaaauucaugaccucuguuuuauacacacacacauucaaacuccugggcccuuuuaaaguuggucacaugugcauguguuuuaggucuauuugggauuggauaaccuaucagggucucaucucugaagagaacuuaaauaucuucccguuuucagcagccaucaacugacaauaacucuucaucuagagguagggucuucugaaauuuucuuaauccauacuggcaugucaauugauguuugucauuaagcaagucuuggaagauuuguuuuguauucaucuucccuugucaggucuaaaagacacuuucuugauguuuagacauuaauugucccccaaaggcaguauguuaaagguuugguagccagucuuuggcacuaccaggagauggaggaucuuuuaggagauggggacuaauggaaugaaguugacucacuggaggugaguccuugaaggcaguauugggacagcccccucccuccauccucuguuuccuggacuccacaagaaggcauuuugcucuacugugugucccccaccauguaaugccuugccacaggauccaaaggaacaggccaacaggacugagaccuccagaacugggcaaaaauauaucccaccuuuuaaaaauauuuccugcuugggaagcauuuuaacauucaaaccagcuucaucagcucacucuuaaaguaugcacauggaucaaauaagaaaugaaaauuaacuaauuaguaacauuugcauacauuuacaaauguauacacugcugaugaauuaaguaaaacaagcuaacauuuugaguugucaggaaaagucaccuaugcucuuccaaauagaaccauuuucuuuaauguuuuugauauacacaaacuacugguaugcaaaaaaugagcugguagaaaaacaccaccuaacagguauucugaaaacuuaggaguuaguuugugguccagugaucuagcacuugcccucaguugugaagucuugaaucuaugcacacaaacaaauguggagaccaaugguuaggaauacagcucaguggugcuugcccuaaaaaugccaaagaccucaaacaaagcaaaaaaugcgccuugucaguaaaagucaaagguccaauuauagcagucuucucugaauauuugaaguacugccugcacaucucaagguccaaauuuuggccuacagaaauaaaaaauacaauuuuugauauauauauauacacacacacacacacauacauacacacacaccaaccuacuuagggagugagcagaacaacccaaucaauuuaauaaagcuuaaagaaacuguuaagcaacuagcuucuuuuaaacagagagaaauguaaacuauuacaugacuaauaacacuccacauuauuaaaauuaaagaguggggucccuaagguguuuuuguuugucucaucaaguuguucaggcuggccuugauuggugacccuuucucuucagcccgggauuauagacauugugacaccaaaucaggaguuacacuuuuagguaaguuagaagcagccuuucuaaguaucugugcaguuccucuuauggcuaucuuuuaaaacuuauaaaaaagguuuccucgaacuguccaguaucuguuacaaaauagcaauuacuagucaucauauucuuuauacaaugggaaugacacuaacacaaaucuuauccuuucuggauuuagcuucugaaaguuaauauggaccuuccaaauuuucaaaacacuguauuauuucuuaaauguucuggugaucaaaaacaaacaaacaaagagagucuuuacuuaaucuuuacuuagcgcaaguaauguauucgugcuaagaaaucaaacugagugcacaggguggugcuuccauaagguuuuccaaaacaauuagacaacggaugcccgcuacgguugacuuuguucgacaucaagaggaaacacggaaaaaaucaguucguuucuccuaaaggcgaacgggguucagaaaccaucuucuccucaacagaauccuccucccccaaaggcccggccgcuuccagucgcucaggaacaugagaaaacuucuaaggcccugagguuaacaucucgcauuugaguuuuaggagugucccuaacaccaagggccugugucacugaggcaugcacgccagccgcuguccuacgggaggaaaaggucgggaggaccggagcccgcggucgauuuuauucccggggauccuggcucugcgcccgucccucccuaacccuaaccugacaggcccucgcgcugcgccucccccuucccuaaccagaggucccaccuaccacgccgcagcgcuccgucucccgguucugaagccuccaaaacgaaccuagcucccgggagccgaggcugccgucgcugccgccauauuacagcuugugcggcaaaaugcgucagggaggaggugugcgcccgagccgggagggcgggggcuggagaggaagagccgcuuccuucgccccggggcucggcugcaagccgccgggccaccacggggccccaggccgcgccgcgguccccggggccaccccuccgagcccgagcagcccagagaccucgacggaaagacgguuaccucggcccagaggcccgccgcggcuccgccccucgcccugagcccuucccgcucucguccccaaggcccgcagaagacgccgccgcgccgacagacgcucucgcaucccucaccugccccgccgcgggcuucucgucucccggcccgguccuggaaagcgcuucaaaucuaccgccgucaggaaaggcgcuaaagcccacuaaccgccucccucccccacagcccaggccaggcguggagggaaggugucgcgccggaaguacgucagggaugggugccggcgacucccggcguucccgggcugacgucagcaucuucuccuugagcuuguagggucucuucugccuuuuaaaauacguucccgacgggucgcuugaugguuucugagaguugauuggaucgguguggauccgucagaaugucacagcgcucccgaaaugaugcgcaucacuuuauaaacagugacauccucugucgagguauuuagagagacguucugccuccaaggaaccuucagcaaacgcuca

SEQ ID NO: 839 - RNA, 10385 nt, Mus musculus
cugaaccgaggcccgaagcccgggugugcgcgugcgcagugcagagcagugggcgagccggcgcuagcaguucaccggcugcguaaggcacgagaaccaaccggccgacgcuggugcugaugcuggcggcccgcugcgacccaggccugggucagugaggagcccucggucccgcucggccgcugccgcuuuucucacucgcugcgcuaguuuggaaccggccggugugcgagucgaggcccaggcugggugcgagcuucuacucugcgccccgcuggcugaggugaaggacagcccuuugaccaccgagccacaaggauuaaaggacagaaaagguguuuuuaaaugauuugauuuaugaggcauagucaggacuauaugagacccugucaguuguuacguaggacuauuaaaacuugaauguuguccccagaacauucgcguugauaccuuuaacauacauuaaacugcuugguaaauaacuuguaauuaguguacuucgggaaccagucagucucuaaugacacaaaaaguggacuggcacuugaucucagcagaggcucuccugacauaucgcuguacagcugauuucauuacuaaauuaaaggaagugcgacuuucaauaaugaacguucuaaugcauaguugugcuaucucuccucagguuuucuaucagagauguuccacuguaauaaugcugguaaguauggaaggauuaauaaaaauuucuggagacggaacuuuuguguacuugugcuaagcgaguugaaagcuccgcagggcuggaaaggucagggauugaacugucuuuguaggccaacagccgcuugcauaguuugugagggagcacgacgccuagcgagagaucggugaauuacacagugcuagcugcauccccagcaaauuguaccuuucucuuccuaaggcccucuucccacaagauaacgcagagugagcaggaaguuccuucacgggacagaaacucugagcugagggaccucaccacaagggacaacacaggugcccuuuaaccuguucacucuagaguuauccuugaagcaacuggggcagaguauauaacuuagaaggcagaagcuguguagaccacgucucucagugaaaauuaucaggaguuuuaccaaauuaguuacaaguauugaaccucauaaaauaucucaguaacguucucauauggucuuauauuucaaauagggucucauauuugacuugaaacucccgauugcaagugccuuuuccauacaaguuggucuagaacuaguuuuuuuuuuuugggggggggguuggguuuuuuuuuuguuguuguuguuuuuuuuuuuuuuuuuuuuuugucucgaagcucuuuugcacccuaauuggaaacagaauuuaaaugacuauugagauauuuuaaaaacaaaaucagaaacaaacaaacaaaaacccacaaaugacaauuaaaccacucauuaagaucuggccacuguccauaaaccauuuuaugcgugcuauacuuaguuauguguauguuuguauauguguuugugugagaguaagugcacaugauugaaggugcccaaagagacuagggcugucagaccccccuggagcuucaguuacaaguagugauaagccaccaaaacuuggaucuucuacaaaaacagucaauguucuuaacugcucagcugccucuccagccccuuauuuauuuacuucuuugggguguauguguguguguacucgaauguaacagccauggcaucuagagacauuaaguccccuggagcuaaaauugucccaccugacuuggguucugagaagagcaacaugggcucuuacccagugagccaucucuccagcccugagaauacuguuuugauuuuguuaauaaaauguguuacuguguguguauugagugagugugaugguguacuagucagacggcaagcauuuggaguccucuuccccugugggggugucuugaggaucucacacugaacuugucagacucguucagcaagggguuccccauccucucugcucacuggcccucuucacacugcacacuugacacugcguaaccgaagcugcguccaacagugcagcauuaugucugccucagccuccugagugcugggauuacuggucugguuuucaaauuuucaaacuuuaguaaaagaguucccugguaaauugacauuguuaaaaguuggucugugaacuuccuuaaguuuuguagauuucuauuuuaaguacaucacucauagcugaauauaaauaaaauaauaguguuucccuuuuaaugagaaaaacugaaaugauauucaguugacuucauacuuaugauuuuauuaaucagauaaaauauuuuuauggcauucuuuuuuuaguauuuauuccaaguauauauguauaaucaaauuguuucuucauugcuaguacauguuuuguuuuguuuuguuuguuuuuuguuuuucgagacaggguuucucuguguaucccuggcuguccuggaacucacucuguagaccaggcuggccucaaauucagaaauccgccuaccucugccucccaagugcugggauuaaaggcaugugccaccacgccuggcuguuuuuguuuuuuguuuuuugggguuuuuuuuuuuuuauaugaagaagaugaaucuaauuagaaaaaauaaauuuugaaccuuuaaaauauuucuauuaauuuuaggaguuaaaaagucuuuguuccuuugcugcauaucagagcaauuucucugcauacagaacuggaguaauguuuacaaacagcuggcaaauugaagacugcaguggccuaaccucugugcugaaguagcauuaauuggacugcaaguaccaguuuggguaagugguuuuaauaaaaaauauguuuacaagacaggaaaaaaaucuaaaauugagaaaaaaauacucuuagauuaacuuuaaaugugaguuuacuucacucauauucuucucagccuggucuguugagugaguucccggacagccaggcuacacagagaaacucuguuucaaaaaaccaaccaaauuuuaaaaauucacuaauuuguuagggaaaauuuuucuuuuaauauggugcuggagauaaaacugaggugucgcacauguuaggcagucucucccucugaacuauguauacaucccuagaaaacuuuuuaaaaucauacucugugaaucuccauaagguaugugugguaguuugaauaugguuggcccaugggaagugaugcuauuagaagguguggccuuauuggaggaagugcaucacuguggggguggacuuugaagcuccaccugguguggaugugaccuuccucggcugccuagaaaacggccuucuguuugcuuuugggauaggauauaguacucucagcuccuccagcaucaugccugccuggacacuggcauucuucccaccauggugauaauggacgagaccucagaaccugugaggcagccgccauccccaguuaaauguugugcuuuauaaaaguugcguuggucauggugucuccucauagcaauggaagcccuaaggcaguauauuuaauuuaaauguucuuuuuugugggggaggggaggguucaagacauggauuuuucaaguagcucuggcuguccugguacucacccuauagaccaggcuggccuugaacucagaucucucugccucugcuggaauuaaaagggugugccaccacugccuaguuaacugaaauguucuuaagugaucagugaucaucaguuuugccucacuguuguuguuugguugguugguugguuuuugguuuuuugagacaagguuucucuguagccuuggcuguccuggaacucacuuuguagaccaggcuggccucgaacucagaaauccgccugccucugccucccaagugcugggauuaaaggcgugcaccaccauguccggcucgucucacuguuauuuacugaauuauuuguaugugagagugaguuucccacuuaaaccucuggcagccaaugauaccuggauuagauauuuagaaacacaaaacucacaugccagaacauaguauggcaucuaaauucauaccaacagcuggguauguugguucaugccuggaaucccagcacauacgaggcuaaacaggagaaucacaaguuuaaggacagccugggcuccagacagagcucugucucagaaaccuccccucaccaauaacaucaaacccaggaaguucacauaagaggagauuccccucuaggcucuacauucccugcauaccauaaagugacagaaugcuuguguguguguguguguguguguguguguguguguucauguguguguucuaucuuuacuacuaauuagcuucuuuaauaagccagaaauuacuuuagcuacauaccauguuuucuauuuuuaauugauuucuguaucuuuuuccuauuuuggauccuuuacuuuuuaaaauuucuaaaauuauaacaugauuacaguuuguuaguguguacuuuaagguuaaugaggauuuuuuuuuaagauuuauuuauuuuuguauaugaguguucugucugcgugccaccuggaugccagaagagggcaucagaucucauuacagaugguugugaguuaccauauguuugcugggaauugaacucaggaccucuggaagagcagcuagugcucuuaaucacggagccaucucuccagcccugaggauuuuuacuuaucuuuuuguuaaaauuaaccuacuuggagcugggcuugguggugcacgccuuuaaucccagcauucaggaggcagagccaagugggucucugaguucaaggccagccuggucuacaaaaugaguuucgggauagccaggacuaacuauacagggaaaccucauaucaaaaaacaaacaaccaaaccaaacaaacaaacaaaaaacaauaauauuuagucauaacauugacauuuagaaauugaguucaaucugaacgccaauuaaaauuauuuuacauuuuauagaguuacauaacuuaaauuuguucagaacuuuuguuaauauauagaauagcuauaguauauuauggccucuuacuuuaauaaugaugauuauuacaacuaguauaagcuaauaaaauaacuguagugguucucuuaggaaaaauaagcgaugguccuaaaaaaaaagcuuaauugggagcuagagagguggcucacuggguaggaguccuuaacugcuuuuucagaggaccuagguucaauuucuguggcccacgugacaguucacaaucaguaaccccaguucuggggauccaaagaucuuuucugaccuccuugggcaccaaguacaguuuuggugcauauaacauauauaagcagaaaaaauuaauuuuuuacagcauaauaagagcuaagugugguagcguguaccuuuaaugaaagcacuugggaagcagaagcaagugguugcucuucaguuccaggccuuuucuacauagaaugguccagacuagccagggguagauagugagugagacucccauuucaggaaaaacaaaaaacaugguaagauaccaauuucuacuucuuguuuuagcauguuaacuaguuuauacauacauacauauacauauauacacauauacauauauacauauauauuagguaaauucucauuguauagccaggucagccucaaccucuuguucuuucugcugcagccucuuaagugcuaaggugacagacacgugcuaccacacccagcucuuauuggguuagcauuggcuucucuuaaaucaguauaauagauauguaaacauaguguguuuagggaauaacauaucuucucuuucaggguaacccaagucuguuccuggaaccaugaaaguucuguugguguuugacuuugacaauacaaucauagacgacaacagugacaccuggauuguacagugugcuccagacaaaaagcuucccauugagcuacaagauucuuaucaaaaggggcuuuggacagaauuuaugggcagagucuuuaaauauuugagagaugaggggguaaaagcagaugaacugaagagggcagugacuucacugcccuucaccucagggaugauagaacuucucagcuuccugaggaugaauaaggacagauuugacugcaucaucauuucggauucaaauuccaucuucauagacuggguucuagaagcugcugccuuucacgaugucuuugaucacguguuuaccaauccagcauccuuugauagcaguggucgucucacagugaaaaauuaccaugcucauucuugcacuaggugcccaaagaaucuuugcaaaaauacaguuuugggagaauuuauagauaaacaguuacaaaagggcgugagauauacacggauuguuuauauaggugaugguggaaaugaugucugcccaguaacuuuuuuaaagaaaaaugauguugccaugccacgggaaggauauacuuuacauagaacucuugccaaaaugucucaaaaucuugagccuauggaaucuucuauuguaguuuggucuucagguguugaaauaauuucucauuuacaauuucuaauaaagaugugauaugccaacaauugaaagguguauuaguugagguugggcucggcaacauaaaacuaaauucccaauauuagaaccuuuaaaaaugugagagguuuuccucuuuaaagaauucuggugguaugucaaggccacuucguugcucagccaaucucagcuucugcuucuaaccccgugauuugaaauugauaucuaaagcucaaguccucacaacagacauugugaccagcaagaaucagggccauaggauuuuuacccuuuguucaggaauguuuuccaauuguaccaaacaguucuguuugaauaccacuagccaaaaccuggucagagccuucccuaacugcacagaugggaaaugcagcuuucauuccagguaguccugugcccaggaaaaagaggaaaaacaaaauacauaauugagguauguggagcucauagucuauacuaaggaugguuaauagauuguuuuguuuuuauuucugaagaaaguggcuuuauuuuacuuuuuaugaaauaguuacaaauguugaaaguagcucaugagcucucuuccccugaugucaagucaugaagagacccaaguguguucaagauucagcuucacccacaacccgcuaggacugaggaaggcauuauugcuggagguguaauggaucuuacugccuaacaggagcacugaagacugccuucauccaagagggcccagcauggggauauacgccuuggaucaucgcugccaaagccuuaggcaagugcaugcuugaacccuauugugaugagcgucaaguugguggagaagcuuugugcugagccugaagaucaaacuaaucaggcaucugugaaaaaaagagagaaaacccuagagacuugguugugguguguuaaggaugccaacugaagacuacuucaaaugcaagaaauaaaacuggcuuuauuuucucaacaacaacaaaaagccugauacuuucugcacaugagaauaaaaagcucuuaaauguauaugucuucugaaaucuuuuuaaaacaagggugcaguauuuuacauuuuauuuuugugagguugaggcaugccacgguacauguguggcggucagaagauagcuuauagaaguugguucucauuccaccaugugugucccagggaucaaacucagguccaucagccuuagugacaagugcccuuaacugcugagccaucuagcuaacucaugaggcaguauuucuuguuaguuuucaucagucgggauuuccuuuugaaauaaaguauauauugggcuggugagauggcucagcgguuaagagcacugacugcucuuccgaagguccagaguucaaaucccagcaaccacaugguggcucacaaccacccauaaugagaucugaugcccucuucuagggugucugaugacagcuacaguauacuuacauauaauaauaaauaaauuuauauauuaauuuuccucacguuucauguuuauaucauagcaccauaaauaauuacuauaauaugacauguuguuuuguuucaaggcaggcuuacucuauaacccagacagaucucaggcucucacuccugccuguuugcuuccagagugcugggauuacagguguguaccaccaugccuggcuucagcaugccaguuuaaauuguuucuuaugucugacaauucaguugugagaaaaaugaacuuguaugaauauucaacacuuaagagacugauguaggaagggcuggugagauggcacagcagguaagaacacugacugcucucccaaagguccugaguucaaauuccacaaccacauaaccacaugguggcucacaaccacccauaaugagaucugaugcccucuucugguucgucugaagacugcuacaguguacuuacguauaauaaauaaaucuuuggaccagaacgagcagggacugagcgagcagaguggacaggagcaagcagggccuaccagagcgugcuggguugaccagagggaucagagguccuaaaaauucaauucccaacaaccacaugaaagcucacaaccaucuguacagcuacaguguacucauacauaaaauaaguaaaucuuuuuuuuaaaaagagagacugauguauggauauuagcaaaauaccagcugaucuagguaauuuuauaaauuuaugcuaaagcauacguucauaauuacucauaaauauucaguacauaaauuaggguuuuguuuuggcuugguuugguuguuuugguuuuuuuaauucuuuuuuguucuguuuuggugggguuuuuuuuguuuuuuuuuuuuuuguuguuguuuguguguguguguucagguuucaucuuuuaauuagcuccauaaaggacauccuaaacacaucagacacaacagaauacuuuucuuccaguauuaaaaaaugacauucacaaacaauuuaaagaagcucuucuauauaccagaauggugaucuuuaauaaaaaacaucucuaaguaaucaugaucuugacucggauugcucauagguacauucagaaaucacuuucuggccaugauaagcauuguuuacaagguuuuaaaaugucccuaaauacacaacuuuaaaaacugauuuagccuggccacuuuuuucuuuuggccagaaacaauaauccugagugccuaaacaaaaauucugauaaaaggaaaaauauugggacuguaacaaaugucuuaaaauuuguuuuuaaaagggaaaaaaauguuuaaacaacacauggagcuuucuaaaaguucuuuaacaaacuaccuugggagcucaauucaaaaauaggacuugauguacuaaaacagacauuucagcgcagcuccaaaaaucuuuauaaauacagcaauuugcaaggacgauccuggaucagaagucuuauuccuuguguauauuugugugcaugccccaucucaguugucauaauugucucuguaauuuccuccugaguagcagucauagccacccuggcugccacuguagucucuagaccacccauacccauauccauauucuccagguugacugucauaucuuccacuuccauaucccuggucucuaccaccucuagaguaacugugaccacgcccaccaaaggcacccccucuggauccccuggcagacuuuccugcaugaucaacucggauuuggcgcccauccagggacucuccauucauggcucucaucgcaucugaggcaugcucuggguuugugaaggugaugaagccaaaaccccaggaucuuugagucucccgguccuugacaacaaccaccucagagauaggcccaaagcugcuaaaguaguuuucaagugccuguucauggguguugaaguugagcccucccacgaagagcuucccuucuucagacgacauggcagaaggcaaguccuggaaauuaaaagucagaggacggcagagacgaugagcucgaaggaaccgggagaacagcuguuuuggguuuuuuuguuugguuuuuuuguuuguuuuuuuugucuuguucuuuugauacauggucuuauguguuauccugacuggaacccacaacaguuuaccuacuucugccuccacgugcugggauuauaggcauauguagucacacuaacauaguuuucuuauucuccuaaauucaagugcucaguauaauguaauagggaaaaguuguacucaagguuuuuuuuucuaaauucaaaguaaaucuuuaauagaucagauuauacugaaacacauuacuuauaaauuauguguaucaaggccaauaaacuauaca

SEQ ID NO: 840 - RNA, 737 nt, Mus musculus
uauauaagucucuuauucucccaaaagagcccaaauuguucuuguggucaggaucucguuucuggggccaggaacuguaaaacaaacacacauguaaaaucugaggccuccucacucgucagccugcugcacaguucccuucucagacacauagaugccguccaaaaacuuccugauauccuuguuuuuaacuguuguggcuugcugaaucagggcagcugaauuugaaacaaguucaaugucauuuccuucaaggauuaacucauccuucugggcuugagagacaaaacaagccacaccuguccucauccgaacccugcggauguauuuuucacccaagaaauuucggauuucaaccaaagagccauucuccuggaugacgacguugauggggaagugagcguacacagaccgcaucuuguaucggaagcccagcgugacacccuugaucauguucugaacaugacugcagaugguccugacggugaccaguuccuuucuguuaccccaccauuugucaacccggagccuuuucuucuucuucccaagaagacucagcuccacguugaugugauugaagucccuccgcagagucccccuggggcccuucacaaugacugugcgccccuucagagugaugucgacauucucuggaauguccacagucugauugcugagaauggucuucauccucgcaguagauggggcaaagagagaacgucuuuccuaaacauucc

SEQ ID NO: 841 - RNA, 51488 nt, Mus musculus
aaacaguaaccgcuuuuauuucagggaacacugcucuuuauaaacgugagcugagaauaccugauauuccaaccccagaaaggcacugugaacuauccucagguauacaaucuuauuaaacaagaccuaaaacaaagcaagcgccaggcgugcucggcaucugcucccuuccucucuggccucuggucaccaggaggcgcugcgaccaaauacccuucugcgaagguagaaacgcgccgagauaagucuugucugcuccggggccccguagcgagccgucgcguuccgggcugucuuuccgcuuucucgcgcucccugccuccgcccgcugcgcucuuccgaucguucccuccggcucccgucagggggcgcugucugcggcguggcagcggccguggcugccgggcgacgaucucccggcgggcugugcggcccggcucgggcugcugcaagugccacgucccaagagcuacgcggagucgccaagcgggcggugcgcgaggcggagcagcgcugagccggccgggucguacggaucgcccgccgccaugggcuccucgcagagcgucgagaucccgggcggcggcaccgagggcuaccacguuuugcggguaaggcccggggggacgccggggcggccaggcccgaguccgcggagcacccugggcgcggcugccggcgacguggcccgggacccaccacccuggcuccuggcccuccgcacggccucgccgcgcacuggccugagcuucagaguuaggaagagcaaggggcgccgccuccagaaggagccggaacccguaccuguguucucggggagggugacggagccacaggcuaagcggagaugucacgaccggugucgguucaucucggcuaccccuggaugcuugcaagggccaccuggacagggaaaggagcacgaacggccucgggcuagauuugacagacuuaaauuuaguugauuuuugauaggacuuuuccguuccgggucgcuccugacccuuccagaucucuccaacauuuccuggaggagaggaacuuccguucuucuuucuaagaugaaauagucggggagauugagguuuagguccgcggaggagaguuuccaaaauagccaggcuugaugaggaaacgcagcgccagacaccaggggucaaagacacauccgccugugaacgguccuuuccucguggaaccaggaauguggugacaccugugugagugcuaacaugggcugugaacagaguggccucagucugcaucgccauuuagggacaaucuucucugagagugugcuugcuuaccuucauuuucugcccugggucgcauguucugaaugagauaacguuuuaaaauagcccagauaccugaacgauaggacugugauuggucaccugguugucgggauugugguugucucuccauuccacucaaaagagacuuuugaagcccuuguuuuuccaggguguuucuucauaugccauauuacuuuccuauuuccuucagcuaaccaaacuccuaaaucccacacuaauaggaaacacaggagaaagaacugcuucaucccggguucguaggaaaauuaauggcgaugcuuuuucaucuggucugauucugaguugacucaugugagguguauuauccuguuacuugcagauucugaguguggccaugaacccuuagggagcugcaguauuuuuauuauaauaaacacccagggaaaccuaguaagacacauuaguguuaaugaguaggaaaaaaaaauagucuuuagggucuuagauggaucuucaugucaacagaacuucaguuuaaugagcucauuccuauggaagacaguugaaguaugucgucuucauaggugugcuucggaggauuucugagugcacacauaguuaguacagguguguuauuacucucuuccuugagcuuuagaaauaguaggggcagccccaguuaccagucugcaucuggagcacaaauguuacaaaauaugaaaucauuguauagaggguauaaaccaagggagcuuuagugauuaugucaugaaagcaaauguuuuuaaguuuuuaacccucucucucccugauuuugccacucauugccuuaccucuguuuucagagagaaaaaaagaguucucucccuccuauccguugcuuccuaaggcauggugguacgucccacuacagaccccgaucuugugagccaaugugucuauagcaggaaacuuuugagauaaacucacccauguuugaacugauguaauuucacuuucugugguaacuaccaguuugcuggccguucacuuguuagugguaaaaacacuauuugcucuucugaugcccguaucugcugcuaucuuacaggaauccacauaaucaaguaaacuuggagagauuauuuucaguacuuacugcucagcucugcuuuacaaucuuugggcaaucggaaacagacccagcaauuacucuaagcagaguacuuuaucuucuuaggugcuaugaauuucugucuuccugucuguucucuuagguggcguauacguguuuuuuucugccuucccgcaugguucggugcaauugugaucccauuauauauuuacuguuauccccauugcagaggugacugaccacggcaggguuucuccugcggucauucaguguguuuuaugcagagaagcaucucuucccacaccucaucugcuuuucucagguuuuugcuucuuuguguaacugguggaagcauaugauaccuacugugacugugauguuuccuaacagggccgugagguucacugcauugagcuucauaggagaaugugguuaacuagcaccuccugguguugagcacggaguuuucuggucuuuaauucuucaaaggauauguucagacccuuaaauucuuuuuguuucacuugaauuauacauuccaaaauuacagacuuaacauucuguaaguacugaucuucauuuuacuaaguugcuguguuuucugguuauccguucuuuauagaacacuuaaacacauuucaagauaaaguuucaugaaauugcacugucuaaagguaaauacugcuggaguuuuugucuuuauuuuccugugcuuuccucuacccccuauauauaugccacaaagguuuugaaugcuguggcauaaugaaguugagugugggcaaaauauauauuagagugggguguggucaaccacacccauaauccagcacuugugagguaaggcaggauugccaaaaguugaagaccaaguuugaguacaaaaugaguuuuaggcuacucuuaguuacagacugagacccuguuuaaaaucaagaacaaauaaagauagauuagucauacagccuaaauaauuagcaguuuuauuucuugguaaguaaauuggaacuaauuaauuaaucagaaagcuguacuuucaaggaaaaguuuaucaaacacccugaauauuuucaaaaguuauuuuuuaaaaguggguacuuaggccgaagagauggcccacugguuaaagucacauacugcucuuggagaagacccguguucaguucccagcaucuaaauuggauggcucacaaaugccuauaacuuuaacuguaagaguuauaccucuggccugugcaggcauaugcacauaccacugccaaagugaacucuguaguacacaccuuuauucccagcacucuggaagcugaggcaggcagaucuccgaguuuaagcucagccugguccauauuuugaguuccagacuacuugugucacagaguuuaaagaaauguuacuuuuaaaauccaaacaauaggcuagaacuauguaucacuuuuuacagacaauguguccuuagggcuucuagguuuuauagaaguacuauaggcugccuccuacagucccuguauguugaaugccagauucuugcuuccauuugacauuuguuauuaagugagucuaacaaagccauucucaaaaguuucaucuuuagaguggucucuuagauggccauuauaaauuuuaaaauucuggccuuacauaacacucugagaaaggagcucuccaaggacauuguggacccagcgcucacacuaguuuggggaaaugcuguuuuacucuguugacugaugggccauugauacgcuuugcaucuccacuguaaucagaagccuaacccaagcuugcugcagacuccacaguaguuacgugcuaacuucaaagugcaaagugacuguaaauuaguccuguagaaagaacaccuggaccauuggguggagcugcccuauuuuaggggugccucacugacaaagaagcccuguuacaggggacuacuuuuuugacaaacucauaaacaacugggcuacuuaauguuguuuuccaaauguaauuauaaugcuauauaagcaggucccaccugcagauucugucucccuccccguugauuucuucaguuuaacaccaggaagcuuuuuaauucauaagcauucuuugaaauuacguucaaaugcaggacacagaugauugcagcuuccuacagccccagauacacaauacaugaacccaagggcaccuuuaaacauuguaucacugaacguaaacuuucuguccaaagacucaagcaaguuaaucuggcgggcugggcuccucacuggccagaucuccuguucuccauuaccugugacuuugguaaagauucugcgaagugcugguuccauugccuucggggccagcgccacugacaccacuguacuuuuuuuuuuuuaaaccgucuuuaauauucuacugaaaggacuauauccgcaggauucacuaacuuaaaaaaaaugugaacugguaaauacuugggaaguucagcaugugcuuugcaaucugacugcauauugcguggggaaaugugauuaucuaguaaaaugacuuguuucuuuaaaagacacacucagagugguuacuuugagagaccguauacugcccuguuugcauugcaacuaaauuuucuacacuaggaaaaggaauaaugcuggcauuuuucuuucucuucuucccuucacccauacacaccuuuugaaaccaugaaaacauauuuucagaaauggggaaccacaucgacuagugggcauagauacccugagagacuguucugguagaccacuagugucuaguagacacuggggaacuggauuccagccccugaugcuagcucggcugacagccuguuugucugaaagucgacuacagcagugccuuugucaccuucgucacucagucccacagcacacauuagacauaaauauuugaaaacaaguacuguuaaauuauaauacauccuacccuucgguuauccugugcauuaagugagcuauuccaugacacacucuggacugugguaaagacucaaugaagguuagcugguggccuucuuaccagcauuacauuauugccuaguuugugagauccacucuugcaguaguaauaaacaguuucagcaguguuccuuucuaaucaacguguagcuacuuucugcaugugugccuagcccaguauaugcugcuauuugaaacaaguuuggagggaauuaacaaggugacuugcuaggcaccuguguccgugcacaggccugucaaccugagcuugguccuuagcucccacaagacagcaggagauaaaugacucccaggaacugucaucugauuuccacacccaucuuuguguguacauugcacacugucuuaucugucugucugucucucucucucucuccccccuccucccucuuuuucauacauguacaaaaguaauuaaguauaaaaguuaaaguuugcuucaaaucugauccuuuaauuccugucccuaaaguauaugcauauauaguauuuguugcuuuuaaagacuuuucguuuuugaagacauuguuuguuucuugaaacucaggugagcaccauuaucuuucucauuacuccguccugcuaugaguggauacagucauuuguuccuaagaacccagguggucagggccgucuucugcauuugguguucuucgugccuuccagcuucacagaccgucuggugauggccucacuucacaguuagagaagcacagagagguuaaacugaugugcccaaucacaccguuagcuccccuuccucgaggaaagcaucuaacucaguauuggagcugggggauuggguaguucuugcccccucuucccagaucuuuucuagaaagcuaauuuugccaugcuuuucugccaauuccuucuagucaucaagaguugggguuguuuguuugcgaugggauguguuuguauuggagcuaaagucucagccuucuaaguaguugggacaauaggcagagugcuucagcuuaauaaauaacucauuucaaguugcuuucuguguuaugcauuacaucaugggaccaguuguuagacgugaaaggagaauuuguugguuaaugaggccuaacagucuagccugucacagaaucguuacuauacauuuugucuuuuauaaccacagagcauuuagguuuuggguuuuuuuuuuuaugucacauuugcaaaaucuugcauugcugugaucauguaagcacacacauauaaggauuuaugugugcaguugaagugaguccuccagggcccauauacauggaauuauauucuagucuuuuugagucagggccucacuuuguaguucagguuggaucucacuagauagccuaggccagccucaaauuuguuguaaugccccugaaucggccuccuaagaacaggacuuacaggugggccuaccacacucaaguguuuucuagccuugauuaguaucuuuucugcuuuuaagucaguacaaaagugaaaauguggggcuuaaauugagagccagggaacauggugguacaguuauucauagagauuuuaccuguguuuuauaaagaagaaucugugguacagucuggcuggggagguagugguugccaagcacgaggaccugaguuuaauucccauuacccaaguagaaaaaagcuaggugugguggccugcuuguaauccaagcauuagagaugcuaagauaggcagaucccugagacuugauaguucuggucagggagagccccugucucaaaaagaaaggcaaaaagugccugaggaaagauaccuuaguugcccucugacuccucagccaugagcacauccacacacacaaaagaaucuauaucaguaucccuagccaucagagaaaugcaauucagaacuacuuucagauaccucacuccagucagaauggccaucaucaauaaaugugacaacaaauguuggacaggauguggagagaaaggaagccuuagucacugcugguggggggaacagucacugugagaaccugcuuggagauuucucaagaaguuaaaaacaaauagcuguaucacccagcuacacuccuggacaaauacccaaagaacaccaaacuaccauagagguguuugcauucccauauuuauugcugcuuuauucacuauagcaaaagauugcaaucaacguauuuguuuaucagcagaugaguggauaacgaaaauuugguauauguauguaaaauggaauacuacucuguucuuaaaaguaagucagaaaauuugcaugaaagagaauagauuuagaaucugaguuuuaagugaggucacacaaucccagaaaggaaaaaaccgguucuccucaugcagaaccuaaccaauaagauaugugcauguggcuacaguaacaauauacguguggauacaguguaucaugcaggagagaggacaggaaaaguaaacauuaggauggaggauggaggacagaggacggacugaugcagguaaugagcaugccugugaaaggagagcgagcucagugugugucuaggucuagcuguuguggauuugcaguuugguggaggaccagcgcaugaagauauagacucaauaggcuaagagauggcucagagauuaagggcacugacugcucauccaaaggacccagguuugauucccagcacccgcauggcaucucacaggcucacgaggcccaguguccucuucaggcuucugcagacaccaagcagaauagccaugcacauaaagcaaacuaauaagaaaguuaaaaguaccuauuuauauuggcaauaaaacuaugcaauccaguguauagcuucuguucugaauggccaccccaacugaauagaaguucauuuaguuucauaguguuuugguauaguuaguuucuguuccuuguuuuugguuuuugguuuuguuuuuuuuuuuaaacuuaccaccuuuuuaaaaauaaguuugaaauuuaaacaaggacagugacacaauaauaagugucccacuuagccugcuguauccaggaagucccccauggaucccuguccaggugcuuugugguagccauuguguuuauacgagcugcaaagcauagaaguuaugcgugaagagugcccagcuucacucaaacuucuguuacugugagacugccccuccucaucuucuucucccaguuggagagcuaaagaggagaaaagguuggugcugacuaacacaugaaguugaaaugguuuuuguuauuauuaucuuuaauaugcauugguguuuugcuuugcauauaugccugugugagggugucugaucccuuggaauuggaguuacagacaggugugagcugcuaugugguuguugggaauugaaccaggguccucuggaagagcagccagugcucuuaccucuaagccaucuuaucucuccagucccacgaaguggaauucauaauuccagagaaaaggagguggguguuguguuacucaauccuaauugucaccuaggagauuagaguacaccucuagguggcuaucuggggcuuccaaugugaguggguccucuggacagugacuucauaagugcauuacucccugauuaagucguugugaugggauuaucagaggugcugaaaugucagucuagcuggagggagcagccauugaggucaugaacuugagacuguguccuaggcuaauccauucuaauauccucuuuccuucucugcuuccuggcugccaugauguggcuuguucuuccuggcugccaugguguggcuuguucugccugcccaguugaccuccagcucaugaaacugagcugagcugagccucucucucuuaggcuguucugucagguguuuugucucagcaaggagaaaacccugacuacagaggcuuuccugggaaggaaucaguaagacaacagaggaagucagugugcagggagggagugcuugauugguucaggguaaguuugguaaaacuuuaauaugaagucagaagauagaaguuggaaguuauagaccugaaagaugguucacaaagccuaaccacucguguucagucaaagaaacccucguggacuggucucacaagggguccucucacucucacacacacaccaugacaugcacacacccacagucacaucagacaaacccaugugaaaagggaaaauugaaaguuauuguauuuaugaccagaaacgucauugggcaaacuuaauguuuugcagcucaaagcagcacauuaaugaaaaauagaauaugcccuuaaaaaugcccuuauuaugucaugaauuuuuuauauguuugcuguucugguugucuguucaauauuucuuucuauccuaaaauccucccuaacuggauuuuaugaccuauggaaacuucccacuguaucuggacaguacauuaggaauuucuuguuuugaaauaaaugacucaaauuccaacuucuagacauguucuguggcuguuguugguauuuuauuuugguuuugguuugguuuggaagacaguuuugugugucccagccuggccuagacucacaguguagcuggggauggcuuugaacccaugauccuccugucuccacuuccuagacagguuccacuuuucaaacucauuuuaaugugguagaaacggcucauuuacaaucucauaaacuuugcugguuuuuuuuuuuuuuugggagggauaacaagaucuagaccauuccaccuagcaaccacuggugagugucuccaugucuguaucaagcucuucccagcagcuuguugaaaauccuguguuuacuauugcaaaaugcugcugacaggacucugauacagcugucuuuugugaggcuaugccagugccuggcaaauacagacgugaaugcucacagucaucuaugggauggaacacagggucccuaaagaaggagcuaaagaaaguacccaaggagcuaaaggggucugcaacccuauaggaggaucaacaauaugaacuaaccaguaucccccagagcugugucucuagcugcauauguaguagaggauggccuaguuggccaucauugggaagagaggccccuuggucuuacaaagauuauaugcccaggugcaggggaaugccagggccaggaaacgggaguggguggguuggggagcaggguggggggcagaggguauagggggacuuucggguuagcauuugaaauguaaaugaagaaaauaucuaauaaaaaaaugaaaugaagccgggcaugguggcgcacgccuuuaaucccagcacucaggaggcagaggcagguggauuucugaguucgaggccaaccuggucuacaaagugagcuccaggacagccagggcuauacagagaaacccugucucaaaaaaccaaaaaaaaaaaaaaaaaaaaaaaaugaaaugaagaaaaaaaucccguguuuaaaauguauugcauccucccccgcccccgcccccgcccccagcaucacaggccgcacugccuucugucuuauugugguagaugcgugguaaccuuucucccagugaagaaaccuccaugacuaucuacuaaacacgcucugcugaaauggccucuuguaguugccauguagaugcgugcuauccagccccauguggcuauuuuuaauaaguuaacuggaauuuaaguugcagcccuuaguuucauuagucaagagcuuuguggauguuacugguggccacuguauuggaaggcacccauucagagagcugucgucagcauguaggcuagagcugccuuuucuacgauggagcucacaguaaguuagaugaugcaguaaccucuuaccacuuuggcuuauuacucuguugaugcuggaggucacacaugugaauugugugaaguaaguguucugugaagaaugaacaagaacaaaguuuuauaguuuguuuuguagcuuuuacacugacugcucagagguuuuuuuuuuuguuuuuuuuuuuuuuuguuuuuuuuuuuaaacaaacaaauuucagguuuucacacuuuccaugaaguggacaugcucucagauuacaauuucauuucucuuuuucagguagaggaaaauugccuuaggccauuacauuaagagucccuguaaugcauggcuuggugaauuuuuacaaacaguccuugaacagcagccuccuuccagucgcaccccacccacuccuaucccucccaagugugaauucugucugcuacacugguuuguagcaauggcaauuaguuggccuauucuuggaauuuaugguaauauauacucauuucuauaugucuucuuugccucgaauguugcuuuaucuagauuguguuuuauuaauauacuuaguacuguugaaaauaugccagauuuucuuagucugcuguugauaggcauuuguacaagcuuucguuugggucuaaaacaaaugugcacugccaggaacaccauccugcuccuuuuggagaacauuuucauaccuguuucugugguaacacacuuuuaagaguggaauauugggucaaaagguauacauauuuucaauauuaauaaauacugccaaauugcuauuuggagccccacuagcagugcuugggcuuucugaaugugcacccucauucaccauccgugguuucuaucuuucucguuuauggcuuaaaguuaugucagcucuagcuggggguaguggcacaugucucuaaucccagccuugggcuauuccaggccagucagucaagccuacacagugagauucugucucaaaacaaaacaacugucuccgucuaaucuaaagcucuuaucuuuuauuacacauuuuaaacaaucuuaaaauuucaaauuuaaccuauuuaucuuaaauuacuauaguauaauauuugacccuauaauaagugucaaauggucuuuggaaucagggacauacaguuuuuguuuuguuuugauuaagguaggcuugaaagaagcaaaagauaagucgaggccuuagaaagaacagcgagugcugaaauagucaccggcugcuggugagucucgugaguggauaagauugcacgaggagccuacccauguagaauguccaugcuacauucuaaaccuuguaggccuucuuuucuguacugcgacaaauggaauacuaacuagagauggauuuucagagcucccucugcugguguccuagccauaauuaagauaucuucuugcuuuaauuugugcugggcucuaaugguguaugauaaauuugagaaagaaauuaauuucaagguccauuaaaagcagaugaaauagauguuuguagcaaaugaaauggaaaaauagaaaggguuguuuauuucuuuuagaauucagacugagcuuugagucucuugaguuacagggaggauacuugugaugguauuggaggcuuuccauuucaaacaguacuuuauacuuuauuacacugagggggguagggcagcaugcuaggaaucgaugcagacucaccuuugcaaguugaugauaguccaaaagcacucucccuggcucuuuuuaacuaaaagagcaacuuuucagggaagaagccccaaauucaucaguaaacugguuggguucuagauaaugcuaccaguggccauuuagaaccuacauuuaguucauuuauauuuagauaaucagauuagguguggacccaguuaaaagagaaauuauucugaaggguaccuaaggguuggcuuaacuuuuuauuaccugggcagcucacaucuaacugauagcuacuuguggcgggguccgugacuaguagauguggcuucacccucuuucuaacuauaacuggaucuguuugguuugauuuggacagaaucucucugcuguguagcuuguccuggcaugugccacaugcuccaggaaguccccucugccuguuagaguugcuauuugaggagaaaucuauuggauauuuugacuuuuagcuguuuugauaguacauacaauggaacguacauuuuccacuuaagaaaacugaagaauguacucugauugcuuuuguacuagaacacccuuggggcuggagagaugccucagugguuaagaccauauucuguucucacagaggacugaguucaguuuucagcacccacacugggcagcucacaacaacccuguaacucuagcuucaaggaucuaauacucucuucuggcuucugcagacaccuacauuuauuaugcaugccauacacagacauauacauguaaaauguaaguaaaaauuaaauuguauuuuauuucuugggauacucucacuaguagguccagcuggccuagaacuugauauguagaccaggcuaggcucaaacuccuacagaucugccuaccucugccuccucagagcuaggacuaaaggugugcaccacuauaccacccacaucccucaaaaaaaucuuauaaagaaauaacuaauuaaugagacccuuugauacuuuuuuauuagaacuaucaucuuuagauaauuguuuccuuugauauuuaaauuauuuauaaaaagaguuuauagugggggggggaucacugaaauggacaaagaauuagauaucuaggaaagauggaagacccauccauggcgaaagugaaaauaacauuuugcaaacaacucucuucaugggccuagacugcaaggccacuaucgacucuggucaggcgucguacggugccuccagguccucccuucccuuguuagcccugcuuagauacuugcccuccugccuucccgcccucuccucucaguggcuuuaguggacaagaagcugacaucuuagggagacuacucuccauuucccucuuuaugucccucuagagcuuccucagauuuaauccaaaauuuacaaggaaacauaauaaagcagaaaaaaaaguuaaaugcaguaaacacugaaauuuuucaucuuuguaaugaagcauuacuuacugagcaaaauaaaaauacuuaguuuuguuguuuagggcuaaugauacuaaaguaaauuuaaacaaacaaacaaaggcugggugcuggagacacaggccuuuaaucccagcacuuaggaagcagaggcaauuugaucucugaguucuaggccagccugaucuacagaacaaguuucauccagggcuauagcaaaaaaagagcugucucaaaacacaaaaaaggaaagaaacauugacccaaaaaguacaguacaauuuugaauguucuucucggaauaucuaguuucauaugcauauaaauauguaugaacugcacucugcauagccucagaauugcccuuagagucguguggucuaaagcuggauggggugguucaucccuguaacuccagaacucagggagacuuagauggcuaacaguuccagccuggacuacuaaaaauuagugcaagccucauuuuuaggguaguuuugauaguguaaacaaccucaagcaaaauacaaauuccuuauugggccggguaugauggcagacaccuuugucccagcacaagggucccugagaaugaggccagccuggucuacagaggaagguccuguccaaaacaauaaugacaaaagucacaagcaaaagucuuuuggaaaagcguggaaaauuaauuguuuccacuugggguuuguagguuacauuucucucacuggcguuaguguuccuaugaguggagaaaguuugguagacaauguugauccacuuuaccucuuccccuugagagcguccucucucugcuagccccagaucgcuuaaguuugugauuagaggccugugcaccgcucugugcuccuugcuucuccucugcaagguuagcaggcugcccuggcauugcuccuuuguugguguugagcugaguggugccugagaaauaaaugcuggcaugugucucagcacugguugucugcugauuuggggaccucccauucugcacccucugcccccaccucugauuucauuuucaauuucaaauauuucuuuuacagguacaggaaaacuccccaggacacagagcuggacuggagccuuucuuugauuuuauuguuucuauuaacgguucaagauuaguaaguucaaccuuuuauaauuuuguacauagaacuuuuuagaacuucuucaaaguggaauuuuaaaauuuuucuagguuagguguguaucaauuaccauuuagaaauaauuauguugggagcuacuaagauuucucauuugguaaaugcccuugccacagaagucucaggaccugaauucaaucucugaaacacaugcaaagagagugagaaaauugacucaagaauuucuuccuaccuccagauauguacuacagaacaugagugccagcucuugugugcucucacauuccccccaccccccucaccccccucacauacacacacacacacaaucagguguacacauaauauauuuaaauuuuauuuguuuuguuucuucaggcagggucucacuauauagcccagaacuugcucuguagaccaggcuggccugaaacucagagauugauuugccucuauguccugaauccuggaaucaaaagugugcacccuugugcccagcauauuuaaauucuuaagaggauaaugcuaauaaacauuaaagucucacaucaucuuagagaaguagaaucgcuucagauuugaacuucauauauuaaaguuugauuuuuuuuuuuuuagacuauuggcaaauggacuaggaaaauggggcuucccugacaguuuucauggauccaagucccaugaaacauaaauuuauuggaacaacaaaaaaaguuguucucaaagaaagaaagaguuauucuuuaaaagcugcuuuuucuaaacugucuucaguuuacuacugauguaaucuguuaaaaaagaaauuauguaauuuccacaaagggaauuuuuaaaacaguaucuauuuggcuggcuuuguuuuauaauggucuuauuaaguuugugcucauacuuugucuuguuucugacaucauggccuuugguuacacaguacaguaacauuauuuacaaccuuucccuuuuagcccuaauaaacaacagaacauagauuagaaaggucuaaaauuagacuuuaaggucaacacauaauuuagauuuuaaaagcaaagucauuguaacuuuguuagauuuagaugcaacuucuuacaggauauuuuguugcuugaucaccccaguguuggccugguauucuaugauuagauauuagaaaaagcagucugauuggauaauugagaguucuuaauuuccaaacauccuuuuacuuggagaaauauuugacugucaauacaacuuuagccugaugaguguauauuuauacugauuauuaaauuauuuuaugagaugcuuaaacuaauaauuagcauuauuuuuaauuauuaaagacuaugauuucucuguuuuuagaauaaagacaaugacacucugaaggaucugcugaaagccaacguugagaagccuguaaaaaugcucaucuacagcagcaaaacccuggagcugcgggaggccucggucacaccgagcaacuuguggggcggccagggcuuguuggggguuagcauucguuucugcagcuuugacggggccaacgaaaacguuuggcaugugcugguagguacugaccaugaacugcuccuggggguguaagcguaguguagaaagcaggagagcucugucgucuccagauugggaaggcuguagcgauuaaggauuguauucuauuauggagacacuauguuuuuuucauuucugaaagaucaguauccauugccauuuagguauggauuaguuuuuaauucaaggaagaaaagccaaagagcugauagugcagauaaccauagaaauauuuuaaguaucaaauauuauauaguuuuugugguuggaaauguaaauacauauauucuccagucccuuaaaucugacauuucuagugugggauauuggggguucuucagacgcuauagcuccgagcugucacucuuaacgcgccgagaguugcuuucugugguugaguuggggugugucugucguccuaggaaguggaauccaauuccccagcagcgcuggcaggauugagaccucacagugauuacaucauuggagcugauaccgucaugaaugagguaauuaaagcacugccugguaaggaacuguguagguaguuacugugucugguaguagucagagugacauugccucuccgcuguugaaguucaggaucuuugcaggaucccuucugucugaggaucuuaacgggaacgucugaacuugucugcauaaggauggccgugaggaaaccaugggauccuugcacagcuucuuugugugaugcagagagagacagcuuuagaguaccucuagcaaggcucauuucucauugguugcacuuguccaucaugcaccgcugcagagucucccuuagcucagcugugguaguccgauccuuuccucagccgucagcuagugcaaguacauacaaaaucgaaauagaggaaaauaaggcaccugaguagccaggcucuggagcagagcucacagugaacacaugagacucuggagcuggccagaggcuggcgucuagugaacaagcuugaauuaauauggacuuuggauuagacucugcuuggucaguugguacuaaguagugacuuucaugcuaagguagggccuugaggcugaauucuauuuuuuuuuccccccuugguuuuucucuguguagcccuggcuauccuggaacucacuugguagaccaggcugcccucgaacucagaaauccuccugccucugccucccgagugcugggauuaaaggcgugcaucaccacugcccggcgaggcugaguucuuuucggaagcuucucgguugauucugaagggagccagcuuggaggcccaguguucucacauacaggaucuuaagguuuuucuuuaugauguacagucugaagaccuguucagccuuauugagacccacgaagcaaagccccugaagcucuacguguacaacacagacacagacaacugcagagaagugaucaucacaccaaacucugcauggggcggagaaggcagguacgauccuucacagugaaauuaugacugcuuagucuuagcagucagagauguguuacaacuuuuaucuuacuacguuauaaaagaaugcuuuuguuuuuaaaugacaucuugauuuaagaaaaaaaacagaaaaaaaaugauguagaauauugaaguuaacaauacauuuuuuaaaggugcaugccuagggaaaaucgcaccuauuuuauagcccauuuguuuugcuuugcucugcucuucuuggccuaagagccaacugccuuucugauuugagaaauugucgauuguaaaucauaguuaagaaaagccuaugcagaauuaaacuucacacauauucucaccucugcuccaauguaugguuuccuugcuuccuagagcaaggaaggacuccacauggacucauagccucacagcguuuguauuucacuaccuaagguucuggagugaaauguguuuaaccaccagaauucugagucguugcaagucaaggaaaguaagauagggugucuuucgagccucugggcugccuguggcagcccuugaucauguuaccauugucuccuguccagcuuauugcacccagaaguaaagacuucucaaggcauuccuaauugauccaccucagggguagauugugugccuggugaguacagagcccuggcuuugauccccagcacuguauaaaaccagacauuauauacauacagcccucuaaucacagcauucaggaaguagaagcggaagggcagcaaguugaagagcaucuugaaccacguaagacacugucucaaaaauaacccccuuuagaaggacugccucauaaacuuaauuugcaaagaagcgucuguacugcauuugggggcacauuuuugauucacagcacagaaaggcccucucccaguguguuuuuguuuucguuuucuuucucuggcugugauacaauacccuggcagagagcggcuuguggggagacagcuguuaccuuagcucacaaguucagguugcaggccaucacuguggcaggagcuugagacaucgagucauagcaagaaagugaagaugugugcucaguacucugcuaguuuucucugcucugacacaggacagggacccagaccaagggauggacugggcuuucugcaucaauccccacagcuacaccacaggccacccugaucuggacagaaccucaccgagacugugcacacuguggaagaauagacaagucagauuagcgccgcagacugcagugagauggagcaugggucacagaaacgaaauagcuuuauacagugagucccugcagcagagacaucacuuguucuuucaggguuucuuuuuucuuuuuuuuuuuuuuuuaaggaauuauauguuuauuuuauaugaguacauucagccacacaagaggcgggcaucagaucccauugcagaugguugugagccaccaugugguugcugggaauugaacucaggaccucuggaagagcagucagugcucugacugagccaucucuccagcccuuugaucuuucauguuuaaugacauugacuguauacuguacaucagagcccuucuguuguaaacaucuaccuaucguuccuuuccuuugaagacuuucugcuuuuauaugguuuaauaccauuuaugggcaucucuuuagacaguuccuuuuuggccauuuucuaagugugcccugccugugcacucaggaucucggccucuuguccuucauuccucaggagcugaccagguguuacucagccacucuucauuucaagccucucuugaauuugcagcagauuuuguuguugcuucaagcucuuucucugucauuaccuaguuauuuugaauagcaggcacuucguaagccaguaggguggugcccaccccagugcugagaaaguugauauagcaggauggaauccaaguuuaagaucagccugggcuacauagcaaaacccuguuguucccaucaaacacuaucccccagcaaaaaacaaaacaaaacaaaacaaacaaccaucacaaaacuccuugcuuuaaaaugugauuaugccaaaaggcgaucauucaucaauauagaugacuuuaucuuucuuccauuaauuuugagagaaaguguagcuuugauaugagaaaauggaaguguaauuuugaaauacaaagcaucacugugaaaaucagauuuggauaaggaagaacugaaguuggauacugcccacuccaccagcuuuugguaguaguggggccaacagagauaccaugugugccuuggcaaaggagagagauggaggaauccgugcauaguggcucugaaagugccaggugccagggaaagaugagauugugguggaagcagauuggaaccuuaccuugucaaugaccguaaaugcagugguccagauuuggcuuacuuucagcuauaagacucaacuuauauaagcuguaagauaaguaagcauucauugaccccacagugcagaaaagagcugucaccacauucauauggauucgugcuugucccuagagacagcuaaagacccaggugcagaaaaaagcauuccacugauaaaagaacgagccuauuuuuuaguuuucguguuacuuccaagauuuucagcucugggcagaagcugaucggcugacuugggccaugaguugcuuuguuugauuggcagaguaaagcacugcacucaggacagcaggacuuccccagaggaagaggaagaagugagccagcagccuggaaagaagcagugugcucacaucuguuagaaaggugccucuccuaacagugcaggaacaaaaggaagaaacugucaucaaauauauaaaucugguuuaugcuguacucaucaaaugauaucaucauauagauguguguagagaucuucagugggcaggcaggcagggugugauuuaugcaguagguaauaauuaggcucugccuaguaccggaaacuguuaagguaauaaaaagcaaagacuguuccuacucgccuuaauauuuuauuagggaacagauaguaaaaguaaacaugccaugugcugaauggugauaaauguuugaagaaaacacaagaacuaagagaagugcccagaguggacuuacaguguuauauguaggguggagcccagagaccucugggaagauggcauuauuuaaaagaaugaaaugcagaugaagacaugaggaucaggaguccagacuacaugagaccaugucucaagaaaacccaaaggagugggaggaaauacaugggcguauauguuuuaaaaccucaaagaaaugaauuuguguuuuauaacaauaagaaaaauguuuuuuagccuuggauguggcauuggcuaugguuauuugcaccgaauaccuacacgccccuuugaagaaggaaagaagauuucccuuccaggacaaaugacugguacccccauuacuccucuuaaggauggguuuacagagguaagauguguggaaaccuauguagguggcucuagcugaaacauucagugcugaguugugcaauaagcaucauauugaauuugagguuccuguacauccgagggaggugugugcuggcuggccuuuagcaaacagaggacugaguauucagauuugagaucaucaguacagaggacaguuuagaccaguggaaggugcugaaaauggucacaggguuguguggcuugcaggguuaaaaacaguucuuaggaaggcaucccaggugcuugcuucuccugucuacuuggccaccuaaaaaccacacaccagaaaagauauaaagguggggcuagguuuuggugguggaaugugugugugugugcgcgcauauggaugaguguccccaaggaggccagaaaagagaauuggagcccuugaaguuaguuauguacaguugugaacugcacagucugggugcagggaagcaaacucaggucuucuguagugcuggcugcuguuuucucuccagaccccagccauauugucuuaauccagccuucccuacuuccagaggaagugcagcuucugagaaaugucuccuuuccuuaauuacucucugugccuauaaggccuggggccagagcccagguaguuccacccucuuccacccaguaauuaguggcgacuaccuagagaggucaguaugugaagaccguagugucacauggcagccagggaaaggacagaauaugauaagagaacgcagagagucauaggggauuagaagugacacagaauauagggacucuagagugucuagagagcagguuccugaaagguggaggcauugucagggagagagaagugauacauuugaggaggucagagccuugagauuggagaaaugaauauuuuaaugguuucucaacuaauucauaaguaauuuuccacccacccccuuuuuuugcuagguccagcugucuucagucaguccuccaucuuugucaccaccaggaacuacaggaguugagcagagucugucuggacucuccauuagcucggcaccaccagcugucagcaauguucucaguacagguauguagagccgugcucaccuagacggcuuuacccacacucuaccccgugcaggucuucuguuuugguuaauguugucuuuaacagcuauauggagagagaauguccauuccauccaacucacccacuucaaguggcuuuuaguuauucacagaguuauacaacuaacuucauugccccaaacuccagagaaaccccccacucaucucuagccacucccuggcuuccauagucugccaggcugaagcagcuacuaaucuugccacccauuguggacauuucauagacuguguagucuugugacuguuuuguguucuuagcucaauguuuucaaggaucuuugauauuguuguauacauuagcaguucauuccuuuuaauuaauaauguuuuuuuguuuuguuuuguuuuguuuuguuuuucgagacaggguuucucuguauagcccuggccauccuggaacucacuuuguagacuaggcuggccucgaacucagaaauccgccugccucugccucccgagugcugggauuauuggcgugcgccaccacacccagcuaauuaauaauguuuuaugguaugacuguguuacauuuucuuacccauuuaucaacugagagauauuuaggcuguuucuguuuggcuuucuaaguaaggcagccuguacccuugugagcaagucucugagucuguaugaggccacauuucuguggcauguuuacccacaugcguauggagucacuuagucccaacacaguucuuuuuuucccguuugccaucuccuguuuucugguuucuccucuuuauaaugucuggaguugauuauauaguguccauauugcagucagaagcacuagccgaauucuaacauuguuuacuuaggaaauaugggagggaguguuuguuuuuugguugguugguugguuggucggcuguuuuuuuguuuuugacucauuuagcuguuuguauucagaauuugcuuauccccaacucuguucggggucagacugcccaucaagaagcacugaugggcacgaugucuggagucggucaucugguuuaaacccugccacuucucagagaggucgggcugcuccacaaggcagcaggccaaucggccaagccauucugauguagugagaaugagucuuggagaaauugacaacucauucugacugcucuagucacauuacaguuaaaccuguacuguguuagaugcacaggcaccgaggucccuggagcugacgaaauggcugcuggauacugaagagacaaacaggaaugaaacaaugcuuacucacaaaagacugaauguuuucacuguugaguccauuuaaaaagacaguacuaacauguucaguguagaacaugaauuucagacaugaaagugucaauaccaugacaugucagaagcagcuuccuguuagaaauguuuuccaucccgacuucuuguucucagagaacuccacauaguaauuguggacaaaggaaaguguguugguuuuguagauguuuuagaauauuaagugguguuaaucagugugaauuuuguacacagcacacacucucugcccucucccacugccuugugugauuuuucugcagaaaguauauuaccacuuagaagccaagguuguuauuguuugcuguguuucauuucuucccucuccuucugaaagguugaauuucucuuucuuccgacugacaagggccucaaugccuagaacacuaugaagcagacaguggguacccucuagcuagaaugccugaacccaccaaccaucccacucccuuaagaaucugacaacaggggugcuggggggggguggcucagcaguuagggcacuggcugcuuuugcagagguccuggguuugaucuccagcacccacauggcagcucacaacugucuguaacuccugucccagggggugcaacauuauuuucugguaucugaggauacuaugcaccuauaguacacagacauauaugcaggcaaaacacucacacacauaaaguaaauauaauuuuuuuaaaaaucugauaacagcaaagaacacucuucuccaaaaacugcuaggaacuucccaggcugaguaaaggccauucguggcccuagguuacaaucccuggcuuagauucaguuaggucaguuaguguuugcgcagauauuuaaaaaggagccugccagcucugggcaggggguggacacucccggaggcaacccucuccagccagcccccacugcgcccacugcugcauucccagcucucauuugcuugucccaggcucugcuucuucuuccucagccauaaacccauguagucggcgaucccgcauuccaguaacuaaauggaaccaccaaccucgcgguugcauaucacaauacccaguaagacucuuacagcuuaauuaaccaaucagauguauguaucaauaauaucacaacuuacaagaugccaguacaauaauucagagccaauugauaaugauaaaagcuuuaucccaauuaguauaaccuuacgauaccacaacuacuuguggcugguaaacaucacacgagguucaugccugcggccaucuucugucucccccuacccugggacgcucccuguaucuucagcucuuaguuccgccucccuuuucccuguccaaucacagaccuccucuguacuaauguacagggcagggaaaaucuugugacaaguuaguuuuugguacaaaaaaaugagauuuacccuuuaaaagggaagaaauaucaugugaaggguuuuauuaggauuuaagcaaaucuauuuuuauuuucuuuuuguaaauuguuuuuagauuguuuuuuaauguguaugaguguuuugccuucacguguauacgugcaccacacaugcuccugcugcccuuggaagucagagagggcgucagaugccccggaacuagaguuacagacuguugugagccccgugugggcugugggaaccaagcccucuggaggagcagccagugcugagccgucccuccaaccugucuucauuucuuaaaggcaagauuuaaggcagaaauauaaaauaguuauaacaaugcuauugucuguuacuacuuaacaagcacacacugguaacugugggguccagaaaagagaggggucuccuguacuggacuauggcagccugagguccuagaacucuggccagugccgugaccaggcuuucucuucucuguucaucucuuucuuuucuuuccuuccuucucuccucccucccccucugcccucuuuugcauguccccaguuuccucaggaaagcacuuugaacacuaguaaauaaggcagcugccuaagguuggcucacccugugaagagcgguucgcuccuguugcuuauuaaaacauaucccugucuggcccaagccuggcucagcacggggcuugagcaccucucccuggaacacagaugugagcagcagaugugaggagacacccugcagcuggagcccaagucuaagcaccaguucauuuguuugaaacacaugcacguagcuugacgaucaguguguaccggguuuucaaugugccuuuguuuugacuuccaucccuucuaugagguauggaaguuuccacuugcagagucacauuggcucucuaaaaagcuuuauauuugguauuaacucagauuuuggauuuucaguaaaggguguucaacauguauuacuauugugacagaaaaaccucccacuugaauagguuagugccaguauaugggucuucaucagauggcauccugaggguccuuguuuguggagaauauuuccacagccucucuugguacaggugggcugcacuggguauguagaagcuaaggcuaaaggaagccuaguccuucucugcaccucugggaauccaggugcuguuugucugcugagacagcccugugaucacccuuguuucucaggccgccuuucacuguuccagggcagagggggcuccagcagcccaugcuugcguguuugcacgagccugcucuugaucugacccaucuuagggcagugacagauuucuuguccagggagucuauccagggaaggcuacacaguuuucuucccucaccaggcugaggcuaaggugucugucagggccauacaugcauuggugaguuagcucugaaagguuauacauaguaaugauacagccaagaguucggccauagugaagccggaacagcauccuccuguaugugaucucuucauaucuggcgguagaauugguuuaaaaugauuuaaugugcuuuauuuuaggcguaccaacuguaccauuguugccgccacaaguaaaccagucccuugcuucuaugccaccaaugaacccagcuaccacauuaccaaguaagcagcaggcuaaagacuuguuugauaaugguguuugcuccugaaacucuuugucuuuuaaccguccauuaucacugcagagcucugugacagaacaagaguacucuccuuagcaggccaggaaacaggugccacuuagccugagacuccccaacaucucaccuucccacgcauguguguguaggacuugcuggaggcucuucuguggccgcccggcuaaggcggcgccguaguuauuugugcauugagaugcucccguguuaaauuguguggauucucgguauuuccagugcagacuaaguccuguugucuagcugauauccgugagauguuacuugaguaaugaguaugugcguugucagggccucccauuacagggcuacaguugucagugugcagauguagucagccaugaacugcgcaugugcucacacagaacgaugggcagcacggugagcuguuaguguguagguaggcgccuucucucugguccagggccgugggagcguguguugcuuguguagcauuugcugcuuucacagccugaucccucagacgaggcagagcgcguucugugagacucaguugucgcucaucagugaacccuggugucggaauucugaagagauccuuuugucagcgugugaugaccugucuccuucccaggggaacgacuuaccuuguguucuuucucgcccucugcucaggucugaugccuuugucagcagggcugccuagccuccccaaccuccccagccucuccaacuucaaccucccugcuccgcacaucaugccaggggucgguuugccagagcucgggagcccggguauguugcaugccuuacccuccuaagacauugcuaauaaaaacauggauucaggaaagcgaggccucccguucagucuuuuccagaaagagcaucucagcuaaacacauuucagcuacuucuaaucaguauccaucuuuuauauggagaagaagaaagaaguccaugacccggccuucugccucccucccuuucucuacacccugguagguuuggccccaggcaggcuaccauaggaucaguggaguugcacugugcacugaauuugacagugugguacagucaccuaauaaagaugcuugaguccccucucuucacuuccuguuuaaggaugcuacccacaggaaaugcuggugacugcucugugcaguccaggccugguauuuuuguuuuucugagauuggaggggcaggcggagucucacuguagcuggccuggauuaacuuccugccucagccucucaagugcuaggaccacagcucugcacucgggccagcuaaguguucuggggguugacagaugguuuuauaauaguaacccagagcaccagcugccagcagguggcucucaggucauaugcccaggugaaaagggagcagcaguccccaagccugcuccugcugacgcucccugugacugcccaucaugacacugcagugaucacuccauacugaauagugguugucauugucacacuucugacagguuugcauuuuuuacaucuucagugccagggcugaagaacaagggaccuagaaagccccagcugcaccgaccacacucccugcuucuuuucccuggggcccauauucuuggucccucugucuuuaaaugcagcaagccucuaaggacaggacagcuucuccagccagugguguccuggacauaccccguacaauccgccuucccuuugcucuuuccucucugaagaucuccagaauaacgcaccaagagcagcacaggcagugcggggccuccccaggugcagggcggcucccuugaggcagugcugcugcuccuccacagcuccuccucuuagcugacaagaggcgccuugccugggcaggauccuccuagcucacauccagccagcgcccuugaacgccagggagcacugcuucccauggcucuggagggagcuguugucgcaucggcagacuccugagugcagggcugaguacacggagcuugggccuggaaagcuuuuggccccagccuccaguuagaggucagcaaagguggcagugagcaaagagcucugcuucggcugcaggcucucaggggcagguagaggagcuugauggccgugcucugguugcugggagaauaugugaccucugcuguuucuauccuagguuugccaccucuucccuccuugccuccccgaaacuuaccuggcauugcaccucuccccaugcuguccgacuuccucccgucauucccuuugguuccagagggcucuucugcagccagcgcaggggagccgcugucuucccuuccugccaugggcccaccuucugacccugucaugacuacugcaaaggcagacgccucuucccucacuguggaugugacgucuccugcuuccaagguccccaccacuguugaggacagagucagcgacugcaccccggccgucgagaagccugugucugaugcagaugcuucagagccuucuuaacugggaaccaauguucagaaccgacguggucuguuuaguuaaccacggggucaggucuggaaucgcaaacuaccauugauuucauacuaguguguaccguaucuguagguguccuguacauaauucuaaggggaaacuacgcaagaggcugagggcuugccucccaccacgucgggggguuacagccgaggagggcaaucugagaaugugcuuguauuuuaaacaaccaaaaaaaguugucauggguggcuugcugccaggcaucuacugccguucugggagguucaucuuuggaagagagauggcgggguacccacuggguucccuguaccacugcuaugccuuguguaaggaaaugaaauauuuuaugccuagugcccacaugcaacauuucuuguacuuuguaagucguuugcaagaacacagaccaccucacuaaacuguacaaggaaacaagaauuuacuguuggucucugugagucgcaucucuauuacgguuuacacaaaacucccaguugcagauguuuuguuccgguccauggcacacuauuaauugaacaucuuuuuauucugccuguacacagaucuuguuuugaacucagaauuauucagacaccauuuuguagcugcugcuguugcuuuagaugccugugguaagauggcauuuaaagagaaagagaggagcugcgcucuguagcuacuuaacgguaucgcggcaauaaacuccagucgcuuuacggucuccuuguguucuaaguggcgagcguguacuucaugugugccucacaucucucaggucagccuguggugggugugcuuuucuaaguuuccaagcgaugcuccaucgagugggacugauguccugggugacggaaaagcaucugacagcccccuuuggaaguaagguggaagcaguuuguugacuguugaccugguacuagcauaaagauacccacaccgcagugguggccauugcugacucugccagaaacccagccccucucccaggaugcauuuauagagacacaggccuaaagucagugauguagaaaucuccacagucccagcacugggcaucccugaagcagucuggcagcucaugagccaaauuggcaaguuccacacucagugagagaccugcaaaaacaggugguuuuuucucucucucucucucucucucucucucucucucucucucucucucucucucucgugagagucuaugaagccccaggcucugggggagagagccugggggggugggggggugauggucagugaacucuacuugaagugcaaaacugaguauucuguucaggaaaucaugagucucuuaaguguuggggauuaaucccagggccaugagcaagcuggguaaaugcuuccccagugagcuccuuaguuccagucauuugagggcaaugguagacccuguaguggguuccagaagcacagauuuaagacuguguccuggucaguaugccacucucuuugauaagccaagaagaaaccuuguggggccccaauuuaagugcuauagucaacaaugguggagcuauguaacagccccugguggcaggcgggggacacagucuuguugcucaggaaagccagggcaguaaugauguuggauugggcuggauuaaccucagagauccuugaaguacagugauuuaaacaauaaaguucauuucucccauuuagacaaguuuccagccagccaguggugcuggcaguacacuucaauccuuuagcuccagcacuugggaggcagaggcaggcugaguacuguuuguggccagccuggucuacagaacgaguacuaggauagccagagcuacauagagagauccugucugcuccaucugcauguguguccacccacaaggucauggcauggucucagaugacagguggaaacccagccacuauuagccagaagacaggcguucuuacccuuuugagaucaugguagagaaguuugcaacaccaucauaacaaaaucugcugacgagccaugcagccacagagaacugaggggggcugggaaauggagccuuugguucuuguccacccacacccauuagcggagagucacuggggaagucagcgggcguguacaguggaaucacuugccaguauuugaggaaagcaagacucuggaggggaaagcacugggaagggacagugaagugacauuugcagggaaguguggcagugacucuguguguguguguguguguguguguguaugugugugugugugugugugugaggggggggggcgggagugauggucagaagguagcuuaugggaguugguucuuucccaccaaguguguucugaggauuaaacucaguuaugagacuuaauggcaaaguccuuuauccgcugagccaccucaccagccaaauuuacccucccuguugauuuuugucccuuuugggguuugcccaugcuaaaaggaugacuucaauucuugguccagcuuagugaguagaugaaugcauugagugagggugaucagagcacucguggguggccacuuguggcacucacccaaccugcaggacauguaauagcuccaucuccucaccccagcaauuguucacuguuguuauaaucuugcgguggggccuguggguucuuuagauuucaggaacuuccucccucuuaaccgcuuuugcuuacuuccagauucuuaggagcaaguguuucacugugcaugacaaucaccauguaacacggaacccuccaccccuuccgcagcccuuagguucucucugcucccauuuccacuguguuuccugaguccagaggaaggcaguauauauguuugguuauuuuccuucaccugugacugaguauuaggccacugugccacagcaagucucugguuagaggaguuuaaccaguugagucuagaguacaccaccccuugugucuuagucaggguuucuauuccuggacaaaacaucaugaccaagaagcaaguugggaaggaaaggguuuauucagcuuacauuuccacauugcuguucaucacugaaagaagucaggacucuaacucaagcaggucagggagcaggagcugaugcagaggccacggagggauguucuuuacuggcuugcuuccccuggcuugcucagccugcucucuuauagaaccaagacuaccagcccagagauggucccacccacaaggggccuuuccccccuugaucacuaauugagaaaaugccugacaguaguuguaucucauggaggcauuuccucaacugaagcuccuuucucugugauaacuccagcugugucaaguugacacaaaacuagccaguacaccuuguacuaagucuccuucugugagcagcugacagauuguaguuaucuauggauggaaaaaccaauagaggcaauuugauguaucugaugugacuuccuccucuaaggaagaccuuaaguccaaugagaagggaguuagucucaccaucccaacagucgugcagcuguuacaccaguaggcacacuugcccugcaugguaguccaguucagcauauauagcaaagcaggacucuuagggacaacucucucccagcagcccugccacagagagggggcucccagcucaguuacagccuuauuucucuauguccuucggcagcguuuccaauaaggacuuagcugccuaguguggugugcaccaacaguagugguaacagccuuaugguuuguggggcuuaggggccuucccuuguacuggcaauuuccucuaagcacuuuauggcuccuggaaguuauuuucacacucauacagagugccugccuuuauuuaaaccccuucagucugucuucacuggauuuccacaagcuuuuacaacccaguaagauacccgugguuugaauagguaugaccccccccccccaaucauguguuuaaauacuuggcccauagggagugccacuauuaggagguauggccuuuuggagaaagugugucacuaugagugagggcuuugaggucuccuaugcucaaguuacucccagagugguacacaguguccugcugccuuagaucaagauguagaacucuugccuccucuggguaccaugccugccugcaugcugccaugcuuccugccauuguuaaaccuacuaagccucugaaacuguaagccagccccagugaagugucuuccuuuaugagaguugucaugaucaugucucuucucagcaaugaaaccccuaagacagcacuaaaggguuaucaugauauaaagaagugcucucccagugagccagugaccucuuugaaggcacaacacuguucuagguuauucuuggauggcuaaggggauacuagaauagaaaugcuggcaaggucaacuauuguuugaucaaaagagcagugcuggguaagaaagaaagccuggaugccaggccccaucccauuagcccccuccccagccucauuuuccacagucaucuuccauaaggcgccgauccaccuggccuccugauccuagggcgcugcugccacccugggauugcugugcaucucugaugcagggaucacacugugaacccugagauuguguucuuuauuggaaaaaccuguugcuaguuaugguguggcuuagcuuuagcacacaccuuuaagcccucuagcugcaauacccuuaguauacaccuguaaucccaauggagauaaaaauuuguagaaggaaacagccacguuugaaagugauguugugcccuucucgugaaccucaaaaagaucagaagaucaccaaggagcugacgcggugcucaagcgugagugugggccgugcugccgucucuggagcagcagaaugggaggguguagccgagcuuaaguacuuauuuguagagguaagcaaacaaggggguuucaagccuggcacacauuugauggggggggaggggcugccuuauggaauuuuguugaccuuaacauaauuaauuggcuggugcuggaagccaaaccacaaacuuguucuuuccuccucauuggugguugucaggaagugaagcaccaggggcagguuuguuagcgagaguaaccuggaaaccggugcuaggugcuagcuuguuaguuaacuggaguuuaaccuuuaagucagguucucuaagauggagucugaacccaagaucuggucucucaaugucuaaucgagaggcagacaaagugacaagucagagaaacauuugacagaauaggaugugaccagcucucaguggaacagagagcaaagugaggcuacugaagagagggcggcagaagaggcagaggcgguuuuacugggacagguugcagaaagagaccaagcuagacacaggugaaggcagagugagccagagaaugagaaggagccagaagauuagaacagacugccaggguuggaaugaggucaaacagagcaauucagugagaagcugagagaagccagauggaauuauucaucuuggagaagaguuuugagccagaacaguugaguuuauucagcagugagucucagaggcugaaaacauucuaggccuacauaagauugcccagaggccugaagcuuccaggacuaggccuggguuaucagucagaggcaguaaaccuccaagaugacaguuacaacaccuaauaaaagauacuuuuacaucuuccaaccaacgugguuagaaggagaacccaaccuaacuggagaaggacaaaggccaccaacguugcagaaagcaguggacauuggacagaaaugucacagagggcaucugacagaaaguugcagaggaaaaauuggcccaggauagucuccagaggaagcauccauuguuugaguuuauccggaugcccagagagaccuggaaaagucugaacugguaggagccccaagcccagagcaagagaagacacaggacucucugagacggagaauaacaguaagccacccccaaagacaauuuuaguuuuauagacagacucuuccugcauuaaaaaaaagugggaaacuccaugucagaucccuugagagcaaggguaggacuugcagcacucauugcaauuuuaaccacuggaguaaaccccucccuacuuucagcuguggucuuuauauuuuuucucucaaaaaacauugaaagaaaauaguuguacaacaagaaacauagcuacaauaauacacaggcucgagauacaagagacagaggaagaaagagauugugcuuaauugugaaucuguguuauguauugaaauugaugaugaggauagacagcccuuggacagugaguaugaagccugguuccugggguggagcuggguaugcaaugccuacaugugcaguuuauguguagauucauaaagaucuaauuguaccuggauaaacagagugggaaauaagaucagcuggcagacacuggauugcagggaaaaaaaaaaaaaaaaaaagcccugcugaauugggccaaccuguguacuuuaaagauuuguuaacaucagaauggaggucagggaauguguuaaagauuugaucuggguacucagaaagacagaaacacagagagaaagcugaucccucugcuugggacagcucagcaaacuggcugaaaaaugacagaucauucagcagcccugcagacugaaaaccgugaugcauccaugauguugaugucgagggacacaugaugucgagggacacaugaugaaggcagcagugaugagggaucauuccaucaguggaucuuccugaggacauaacgacaguuacugugggauggaugacugucucuguugaaauaguuuuacugugguagagauaaaaaucuuuccuuuuuauuuagaaaauguggaaacauugcaggauauuuaaccacacugugaaccucaagauuguguuuacuggaaaaaccuguuucuaguuguggggcugaguacacacccuuuaaucucaaacagugaagguaaaguuaguuuguaaaaggaagcacucacauuugaaaguggcgucuaauugaggggcagacaaagugaugaaucagagaaagauuugacagaauaggcuaaugcccaacucugacaagaacagggagaaauaacgaggagggcagguuuaccaggacaguuguucagagacagauugcagagagaaagagcaagguagacacaggugaagacagaauaggccagagaaugagaaggagccagaagauuagagcagauugccuggaguccaagcaaaacaaaaacucagaggcagagggagaaaccagauugaaucagucagcugggaaaggaauuggagccagaacagcugaguugaaccagccagccagagcucagaaagaacuaggaagggcugaguuuauucagcagcaacucucagaggcugaaaacauucuaggucuagguaagauugaacagaggcuggaagccuuugucuaggcuagcagacagaggcaguaagccuccaagacaauuacuucaggcaaauacaauuuacuguuacacaucuguccauuccugauggcaguugggccagccagugcugcucaacccagcucagggccauacucuuguuugucauguuugucucuagagccagugccuuagguuuugacaggcucccagcuagcaucauggcccuugcuguacugcacucagccacaccuggcugcuuaaaggaacaaucucuccccgacuauacuucaugcagaggauaaaugcauacugcauacucaugagguaacuauuccuaagucaagcuuaauguuuuuuaccugugcuauuuugucauuuacuucuucuccuguugaauccagaaggucauuagcacagcguuugagucccuguaagccaugccacagcugccuuugagcacccagacagcaaagcugcuuuguccuuucaacucacuuugauuuaauauuuuacaaaucucauuuacauggcugcccaaaucacauaggccuuucagaacaucuccuuucuucuacaguucaacccccccaccccccaugggguucaguaagacuccugaagcuccgaauccaaggucccugaugcaucagucaggucuggugaacuggaaaucaaaugcuguccucauguuuaauuuccucaguccaucuguuccccgauguccuccaaucccugcuauuauucauggggaccuuagucagugcuaaguguacccaauggcucagugauccaccggggacagaguccccucgcacugugcagccuuugucucauggagaggugaagacuuguauugcuuaguuucucugauuucccugcacucagacugguaccugagcccagcuggaagaagcucuuucacaccucauuuaaaagucuuccucgggacuaggugagaugcucagugguuaaggggccguguaacuuuugcagaggacagggauuugauucucaacaccaacaugguggcucacaaccauuuauaccuccaguccaggcuuucuaguggcucuuuugagcucuaugggggcacuaggggcacaccuacaugccauguaggcaaacacucauacacauaaagaauaggucuuuagaaauggagcggguggguguuccucgauccagcaggucagggucacaugcugugcuguucucuuccuucucuguaccccgugcuucccaagcauccugcaagacauggcaaaaccccaucucauucuuccacuuuccacuucugcugaaucaaaggcuauuugcaguaggguguggugccgaacaccuuugaucccagcaauuggcagacagaggcagguggaucgcugugaguuugaggccagccuugucuacauagagaaacccugucucaaacaaaggcucuugcaugugccuaucuuuuuacuguugcgaucccuaacacugcaaguucucucuggcagaaagcucagaggaaggccaaaaaaccauuuucacagccugcuuauaauucuauaucccaaguguguggggauuagaauauauccccuagucucucaucaguccuguacuaaggcaauggaccccauucaucaaggagacaugugaccacauauuauauagaacaauguuucucaaccugugggcuuucaccccuuuggaggucaaacaaccuuuucacaggggucacuuaaggcugucagaaaauagauaucugcauuacaaaucauaacaauagcaaaauauagagagaauaacuuguguauuguauggaugcaucaucuguuaauuaaaaauccuauggcugggcuggugagauggcucaguggauaggaacacuaacugcucuuuugaagguccugaguucaaaucccagcaaccacaugguggcuuacaaccacccauaaugagaucugaugcccucuucuggcgugucugaagacugcuacaguguacuuauguauaauaauaaauaaaacuuuuuuuuuaaaaaaagccuauggccuauagccuauggcuuaggcaguaaauaggaggugaggcaucaggaggcagaaagaauccugcaauagagcaaggcacaggaagauauaaggggacggacacauggggccugagcacgggugaccagccauguggcagaauguaggcuaaagguuaaaguaaauggguuauccuuaguuaggauucuagucagaagagagccuagcuauauggucaaaguguuuguaaauauauuuugagucugagucuuauuucugggagcauggggcugggggggggggaagaacuuuuacauauagugccccacguuggaugccauuuguaaaugaaauuucuuuaauauaaauguagcaguagguuaaacugguagcuguauuucuuuaccuugugcuuuuccucaauaaccucacaaagaaaccaagauugauuuaaaacugcaccucaguaacugagcaguuaagugauguacugcugcgccuuguccacgagccccaaaggaccaagcaggagcugacucugaugucaucacacuaggcucucuguauucuaagcuugagcuugggcuuacucaccacugacccugacauggcaggacagguuggugaagcaaccccaagcccucaacaggacaagguuuuauaggaaauggcgagcaagcaaaggggguucuggccuggcaagcaucuaauuaugugacuauuguaagccaacagguggguguuugaagcaaaccuaagcuucugugcuaauccucccagccccaccccaugacacuugcauauuauuguugaucucacucuucagaauuccaguguguuuccccaaucucucuccagaccucuucuucauggcuccaguccucucuccauccauucugcuggucugaaucuccuccucugguugacaaauguccugcucuauucgcuacucugcccagccauugggugaccagcauuuauugacaaggcagagaauaaauaguagaacuguuuacacaaauuugagacaggagauucuugguauaagcauuaccaugccuagucuggauugaaacacgauaugagggcagagaaauugucauuugaauaacacacggguaaacuuuauaguauauaaaaacaugccuauagcagaauuaguuaugaagaagcaacaaaaauaauuuugcagcuggggaucaccacacccugaguugcuguaugaaagggucagagcuuuaggagcucuggaggaagguguucacacuggcguccuccggaggaagcuccacucucagauagcuuagccuugguuuccugucuuggcaccggugcacugcagggaacacgcagccaccaccauacccacaaagcacaccaucccguaugacagaugaaaaagaagccacaucaggaccgccuccacagacgcucuacacucacuugggcugggcgaacacuucagcacccacugcaggggccugcaacuucuccucccaaauucauuuuggcucccucagcccguaugggggcacugugugacuuuuccaaggaaaaugugaacaaacaucucuuugcuccagauagaauaacaaugacagaccaaagggaguuucacuugaaucuaucuuagggaacgugugaguuuaccggggucacagguuacuuacaggaacggcguggggugggguaacucacagguagcuagcuacaucaaugagaagucuagcucacaaugggggcucaugaaagcugaaacccugaaguuucagcucagcucaaccuucaggcacuaagaaccccaggcugaucugccuaauugucagaagcaggcacccaggagacuccauccuaccucagaggccacuucacagaaacgugugugaacugagaggaauagagagccaggagcagggaggagaggcccaccacuuugagggaacagacucuggucacugaagagaucuuagcugugccuguguauccucacaggggagcugcccagaauccagaaagccccacugcgcugcagccaaacaccacauacacaugugucaaccaucaggcauuuucucccagaguguggcccuccuucucuuuuauguugccuuuuaagaaagggagcgccucccuccucccugaaacaaguuguucuaucucuggagugacaggccagagagagggcaaagaggaaguucucccgggugcuggggggagcaggcggugagaacccccccccccucucucucucucucucucucucucucucucucgagggcugaugguuuggucagcacagugccugccuugcagggaugaugaaguaaguuugaugccccccaggacuuguguacaaaaaaaagcaaagcauagcuuuaugugcaugguagugcacacuuucaaucucagaauucuggaggcagaugaagguggagcucugggaguaugaggccaguuugguuuacauagcaaauuccaggacagcuaaagcuggguagucaagacccugucucaaaccauacccaaucccccaaaaggcacgguagcagguacuuguaaucucagcaccagaaaggcaaagggcaggugacagguggguccuugguugucacuagagcaaggagaggagccaaggcugucccgugggcuccaugcaccugcuuacaugagaacacaugcacacauaaauacaaagacaucugccuggggcucagggaagcaucuuuaaaaagcccuugacuuaggguaaguggggggaacuuaugaggacauuucauuucuacauccuguguaaucauaauaauuguuauuggugagacaaagucucaggaagccagcugcccuugaauucgaggugcagccaagggugauggugaauucuugauccuccugccuccagauguguggugcugacauuguagagguacagcaguagugugacuguguguguuuuuguuuggagggcaggucuugcauauauuugacaagugaucuaucuacuacugaguuauacccuauccugccagaguuuuucaacacauacuuggauuguuuucuaggguacacaaacaagaugguucuaagcaggagaaauggguuccuuaaagucugggagagcuauuccaucuuggcuucuugaagcuuggagucucugccaucucaaagucuuacucugaggcuggucagucauggaggcagcugccucuugaacagguguaccccgcugggaucugcaucacuguaagguuugggaaucaguuuaaguaggaauggcccugucuggugccaacagaugugauagagaaagacccagagaggaggacccauggcgcauaguccuguuugaguccuuguucucagaagaauuaccauuaccugucagguacaggaagcacacacauguaacauggcuuaaauuugauagccaguuucauguacuucuguggcuggagggagugaauaaguuacagcgacaccuuucgcuugguuagagggcuaaaauaaagcaagcguccagcuccucugacccaagcuuggugcuuaaaacaugagcuaagaagguucauguuuucaaaugcaugucuuuacuaguuaaguaaaguggaagggaggucaggaaaggggaggugagguggggggaagggaaagaagaaagaagagagggagggagggagggagggagagacagagacauauacagagacacguggagacuggcagacacuggggggagggggagagggagagagagagagagggagagagagagagagggagagagagagagggagagagagagagauugcacugaccagguuuagguuuugaacagccuuauggaugcauuuccaacuguggugcauggaagaaaacuauuuuucuaauuuaauauauaauuauuuugacuguuuagagagacgugauggucugagggcaggccaccaaaugcuuuccuaggaaauaacaagccuuccuucucagguugcucaagccgaggcuaggaagguucuaguucacacgguaggaaagcuuugggugggaaguuugaauccagauagaucugucugcucucccuuacaaagcggcccagaaagucuccacggcgccccgcagugaacguuauaggccaccagguggcgcugcgaacuuggaaaagccgcgauccauccgaggccgcggggucuacgggcugacccugcagggcccggggcguggccagcagagauggaaggcgugcuccagcuccuggggucuuuccagcacugugacuuggcuggcuggaugaugcccuggagcuccgggauaucagcccaaaaggguccaggcuuugaagaucguggcugggacgcggucugguguagcaucccgccucacugccagcgccugccucagguguccuacuugguugcuaccugggaugcuaggguauggcaggcaucccgcgcccagucaguuagaaguuugugcccagguaagggacagauggugcaagcagucacuccaucugaggcauucucuaaggugacgaaagagggaagaugauccuagaccagcagagaagaggcacaugcgguuugggugauauaugcaguuuggggugacacacccuucgcagacugaaggagcgcggcuggguaagcacuggggguggaaagggauggaguaccccguccugcuuagaucaucccaguccugagcuccuugacuucugcagagaucaagcaagguuugaaaacccucauugucaaauauaagucuuuccuucccaugggcaauggaaucuguggggauccagaugagccagguggauggugcucuuuugccagaggcuucccaucucuagccaggccgguggcaauaagaacccuccugcagguguccuucaguucucuacgcagcagcaguggacacugaguggcugcugugugaccucuggcaggggucacaucuggcuuuguugcuaucuguuaguuagcuguggcgagugcagcuccaaguggugagggggcagagagucacaggacuacucagguguccuguggcaccuuggcaaauucagguggacccgcucuagaccaagcaggggcauaaaagggcaauggaggaugaggagacgcuucagccgcaucuguccuccucgcgggaguggcguccagguaacugagaggaugauagaccauggguauucucugccuccgugauggcaucuaagcuugaguucuuucauucuuuucccagugugugugugguggugguggugguggugggugggggggggggugacgacccaaacaugguuaagacggaaauggauccuuuaaauuuuccaauagaaucgcuuuucagaugugauuuuucucuccauguugaaucgugaaugaagucuuggccagaaguacuugcaucgcuucaaagguuucuaagcaguaugguggccaucuuaaggcugcuggaacacaagucaaagaaguuaaagcucacaucugacaaauucugagaacguaguuucuuuuauacacacacacacacacacauauauauauacacacacacacacacacacacacauacacauauacauauacacacacacauauauacacacucacacauuuauauacacacauacauauauauacacacacauauauauauacacacacacauacauauacacacacacacauauauauauacauacacacacauacacacacacacauauauaugaugcccacaaugacuggagcuggcugucauuuaauccaguuaagccuugggguccccagucccacacuaugagcagacuagacuacaccccuccccaccuaacccuacaagauggggauaacucuaguuaccgugguucaauccagagccacagauacagcuaagaguucagcaucuuuuccccagggauccuuuucuuaaggacauagcauggaccugaggggcaguuucagcuucuucccccacucuuaggcuugggucuccaggaguuuccaucuggaauugggggggucuguugggaccuugauagacagaacauuauaaaaacaugccagacaccaucauguucuuuuguguagaagcuaaaagaaaaaguucaccugaauuugcaaucacuaaaggcuaaaugguguguuaguuuggagauagacaguagcuggacaucagaacacagaagagcaguuucauguucacagcugggagggguccaagcuccuaacagcccacuauguguuuaugaaguaaguucuaaggcccccaaacauaaauggcaaagggaaggaaaugcaccccaguuggaccggcguguugagcuacccccccccaaacucuccuagaauguacaauuacuauuaaugaugacacgaggguccucaagucagauguuuauagcugagcucuuaggcuccugccgugauucuaugugcaugagaacaugcaugcacuuaaggcagccuuuucagaaaguacagauuacacacaggaacaggucauuugucaaguuacugaugugucuugaagcuguuugaggccucgugacucaacuggagucaagaaggauugauacucuggguuugaggcaugagaauccaggugcccucccuugcuucuccugugcaguggcuguaagugcauggauagagccaccaaaugaccaaaugugcucaagugugaaaaacacaaguacccuuccaucagucaagacccccaggacagacagcuggcuuggagagaugccaaggagacuuaccaagcuugaguagacuuuugcaugggaugagaaccaagcuuuucuuucuggcaugguaggggacuuguaacucuagcuugcccuauccaauuacgccauuuugagucaauggaaagaacaaccacaucauaaaaacuuaaaacuuggugggggcggggaggggggaccccaacacuuggugcuacaggagaaggugaagggcugguggccucaguuguuacuguuguuauugaaguguacccugcguguuagcaggaaggggcaaaugcgcacaaagaacaguguuucuuaucgagaccaaacccugcuuggcuuuaacucuuaguccugugguaacagcaaaccagcgcaacaguggcuccaucaguuccacccaaacuccaaaccagaaggaaaaauuguagcgccaaugaggcuggccugagaaacaggcaagaaagcccuucgagguuucauauuacuaguuccaaacaagacaccccauugccacucacagcuucugugccaggccacuaaccagaugcaggcaugcuucuccccucuaaccaauguaggaccaagagcuucauauuuuccagauuccaucucaaaguauggcuucuagaaaugugggaguuaaauguagacaaugagcuccaugaaacaagaaagccauuuuguggucauuuaacauuagcgccacuagaaagucaauuauuuucucuaaagcauccuuacaaaucagcccauuuaauacuaaaggucaagaccuucuuuuagaauuaaaaaggaaagaaacccaacaaaauaaaauuacacuuuaacauagcucuuucuccuaaaagacaaaaccccaccaaaaaacaaaaaccaugugcauugcuggagggaagcaaagauaaguaagguaaacacgcuauugauuaaugcacacauaagauaauccugcccaugcuuuuuagauuccguaacuaauauggccacuccuggggaacuccgaaucuugaugaauguguucugauaaugcugagggggcagggucucuucaaagagguuucuuuuagacuugaaacuauguuucggagcugaaacugugucugcuagauaaccuauucuucugaaaaagcuuuacaaacugaaggaaaacccauuccuacuggagaguuaaaauugucaugggaaaaaaaauguuaacaagccagccaccaguguuaguguccaccguggcugcagauccacagagcacaaaguggggagcagcauuuaccugggagacagaauccaaccuacccaacugugccccacccccaugugcuaaggcaguugagggacucuugagagccacaggcaggccucauacugacugucaugcccagauauggguucaaaagcacaucaaaaccaggggcuggcugcugcccagucguccaucucuucuuagggccgcccaauggcuggcugggggggccuggaggggggugucucuaacccucacucagguguggguuccugugcuagguuccugcuaggcaggggcaguuaguaaaguuuacagauguggaagccucccauagaaguuagugacuaugcucacacuaauaaacuaauauggaagacaaagccacagcugacuuccaagccagagacgccagccuccuccaccccguccccacauuauccuuuuccugaaucuuuaaaaagaacguaugaauuuggucauuaguagacaagauaauuaaaaaauugaaacaccuaaaaccacagcuaaacaccacauucauuuuucagcaacuuuagugucuaaguuugaugacuacccugucuuacagaagaccuugguaucgccugcuaaguggaugaauuaacacauauacagcaggcaauuaacucagaugagaugguggggucaugguuuggccuaaggcuuucccaacagucaaggagccuugaagcuuacaugaaaaucugaaauggauucuguguggaaggcaggcugugcugagugcucccaugguggcaugcgugagggggcgggaagugugcgugagggggcgggaagcacgccugagggggcaggggugcgcaugcuuuucaguccuuagacguggagagacgcacugaagcuuuuccaaacuuccagaacuuuuuuugagugagcuacugagucaguuccaaggcucuccuuaggaagagaacagugggcagggagaagcccagagcuacuuucuggcuccuccauggggaggcaucaacaccccggaagccucucuggggagggcacacagguccuacugguggguggcccgccugcagaaggcaugggaacacagcaaggacagcacugguuugcacucaccuucaucuuaccugaaaugagcuuagucacaagggugcgcuccagugacucagcaccaacagugagugcugacagcguuccaacacuuuucuuuagguuugcucuuuuaugaugauauaaaaagucacacuugcucuuugauuuuugucaccacugaaaagugacauuucaggcuuccaaagauagauagauagauuggucugucugucugucuaccuuuuuauaggcccagccaggcuauaaugcucucucucuccuccacacaucccugauuccgagguugcagguauguguuaugaugcccagcuccuucucucucucucucucucucucucucucucucucucucucucucucucucccucccucccucccucccucccucccucccucccucccucccucccucccucccucccucucucucucucucucucucucucucucucucucucucucucucuccucucucucucucucuguguguguguagcccuggcuguccuggaauucauuuuguagaccaggcuggccuugaacucagaaaucugccucccgagugcugggauuaaaggugugcgccaccaccgccuggcccgucucuccucuucugaugcaucagugagcauguggcuguuacgucagcuuccucuauugaagagcaguccguccauccacccaucuuacuucaaacgacugagacacagaaagauaacggaaaagcacagcagagcucugcgcauagccaucacuggccacagcaggguccuucuagcccagcucuggguauccccuccagaauccuuuccuagggacagagaaccuagacaacagcuguuaccauccugcuuccaaaacuguggugagguuucugugccuggaggcgugggccugcgcaggugauucacauccaagcucaaggcccaagagggcucaggccagggccacacacccugcucgucacuggagacuuugguuuuauaaaaauaaaucuugaauucgguuuauacacucaaaucuuacuuauugaaaauuuuuuacagggugucuuagugugggaaagcucuaaaugagucuucugcgaccagauugccucugggcugggcacauaugugcgacuccgcuccuaggcagagguuuucucucuggccuugucugggguauucuaagccccacacuugccucuaccgaggaaugucauuuagccuugguuaguuugcaggaucgauuuccuuucuccugauaaaccuagucauucaaccugcauccaagacuaccaagaggauuccccaugcuaaugaggcauucuaggucccuuaaaguccucagccaauaauggccuuugcucaucuuggaugucccuacccucagucccccaaacuuuauaaaccuucagucacucugaguaaaguuggucugccuacugacaagcagucccugugggcaugcacuguacacacucagggggcuuccgaaccccaacccccucgacagcucugcuaucuuugcucuuguguucuuaggguuauacugcugugaagagaaccaugaacaaggugacucauaaagaaaaacaucuggcugaggcuggcuuacaguuucagaagguuaguccguuaucauggcagcaugcagguagacaugguacuggagaaacagaugagaguguuccacaucuugauccgaaggcacccaaauggagacuguuccacacugggaggagauuaggcauauauaugaccucuaagcccaccuccagagugacacacuuccuucaacaaggccacaucuacucuaacaaggucauaccucuuaguagugccauuuccuaugggccaaccacuuaaacacacuaaucuauggggaccaaaccuauucaaaccacuacacugagugaaguagcccacacauaauuccagcauucuggaggcugaggcaggaggauugcuaucaacuuugaggccagcuuggacuacauaaccagacucuagauaaaguaauuaauggggguggggggaggagguaagauaaguggagaugcauuuugggugggaaagccaauucagauacaaauggacaagcuauacacacucaaaaaccacuacagaaugagccaaaauccaaaaauucaauuuagaaacuagcugucaaagcaguuuuggaauuaggcuaaauauuuuaaaacacugaaauucaguguauucagaagaaaaauuauuuuaaaaacauggaaauuuacagugauacuagaaaaggaccugauguguucacauuuaaacucaaguucuuuuguaggaaaagaugguggccauccggaaaaccaaccacaucucccacccucaacgugaugucguccuggcagccucugcuccuuucaacauccauguguuuauuaaagugcacacacuuacuguuuuuuggugggcaguaugcugaggacuuagcccaugagcuaaguucaaaacucucccaguaaacuacucccaauaaacuccaacccagggaugagaacugugcacuuuaucugcagugaugacuccagaagacaagaaaacagcuagcaccucaagacaaauggguagaaacugccagaguaacauggacauuauuuagcagcuagcaccaguuccucacaaagguuauacugguucacugagcccaaguauuaguaggcuauuuaaaucuacauuuggaaaaacuuagaagacauggguacguuaucuccgauacucuuauuaauauuuuuucuaaacuuuguuuuuaacuuuaacaaccugaaacacuuccugcuuguccugaguaugcauaaggaauuuaccugccuuuuaaguaaagcagcuauguuauuacccucaaucuuaaggguucuuugaguguaauuuucacagucuuuacauuuuuacugucauuguuuauuacuguuuggcuacauucucuauaauuccagcagcaucuuaaacagacagugugucuauguacaaugaaaacaaacaaacgaaauggcuugcaacaccagguaagagccacaguguaacuguacauguuaggggcggcuggcagggauagccuguugucugcaccauggacaacuuacauguaagucucggcauuaugaauuuga

SEQ ID NO: 842 - RNA, 51488 nt, Mus musculus
ucaaauucauaaugccgagacuuacauguaaguuguccauggugcagacaacaggcuaucccugccagccgccccuaacauguacaguuacacuguggcucuuaccugguguugcaagccauuucguuuguuuguuuucauuguacauagacacacugucuguuuaagaugcugcuggaauuauagagaauguagccaaacaguaauaaacaaugacaguaaaaauguaaagacugugaaaauuacacucaaagaacccuuaagauugaggguaauaacauagcugcuuuacuuaaaaggcagguaaauuccuuaugcauacucaggacaagcaggaaguguuucagguuguuaaaguuaaaaacaaaguuuagaaaaaauauuaauaagaguaucggagauaacguacccaugucuucuaaguuuuuccaaauguagauuuaaauagccuacuaauacuugggcucagugaaccaguauaaccuuugugaggaacuggugcuagcugcuaaauaauguccauguuacucuggcaguuucuacccauuugucuugaggugcuagcuguuuucuugucuucuggagucaucacugcagauaaagugcacaguucucaucccuggguuggaguuuauugggaguaguuuacugggagaguuuugaacuuagcucaugggcuaaguccucagcauacugcccaccaaaaaacaguaagugugugcacuuuaauaaacacauggauguugaaaggagcagaggcugccaggacgacaucacguugagggugggagaugugguugguuuuccggauggccaccaucuuuuccuacaaaagaacuugaguuuaaaugugaacacaucagguccuuuucuaguaucacuguaaauuuccauguuuuuaaaauaauuuuucuucugaauacacugaauuucaguguuuuaaaauauuuagccuaauuccaaaacugcuuugacagcuaguuucuaaauugaauuuuuggauuuuggcucauucuguagugguuuuugaguguguauagcuuguccauuuguaucugaauuggcuuucccacccaaaaugcaucuccacuuaucuuaccuccuccccccacccccauuaauuacuuuaucuagagucugguuauguaguccaagcuggccucaaaguugauagcaauccuccugccucagccuccagaaugcuggaauuaugugugggcuacuucacucaguguagugguuugaauagguuugguccccauagauuaguguguuuaagugguuggcccauaggaaauggcacuacuaagagguaugaccuuguuagaguagauguggccuuguugaaggaagugugucacucuggaggugggcuuagaggucauauauaugccuaaucuccucccaguguggaacagucuccauuugggugccuucggaucaagauguggaacacucucaucuguuucuccaguaccaugucuaccugcaugcugccaugauaacggacuaaccuucugaaacuguaagccagccucagccagauguuuuucuuuaugagucaccuuguucaugguucucuucacagcaguauaacccuaagaacacaagagcaaagauagcagagcugucgaggggguugggguucggaagcccccugaguguguacagugcaugcccacagggacugcuugucaguaggcagaccaacuuuacucagagugacugaagguuuauaaaguuugggggacugaggguagggacauccaagaugagcaaaggccauuauuggcugaggacuuuaagggaccuagaaugccucauuagcauggggaauccucuugguagucuuggaugcagguugaaugacuagguuuaucaggagaaaggaaaucgauccugcaaacuaaccaaggcuaaaugacauuccucgguagaggcaaguguggggcuuagaauaccccagacaaggccagagagaaaaccucugccuaggagcggagucgcacauaugugcccagcccagaggcaaucuggucgcagaagacucauuuagagcuuucccacacuaagacacccuguaaaaaauuuucaauaaguaagauuugaguguauaaaccgaauucaagauuuauuuuuauaaaaccaaagucuccagugacgagcaggguguguggcccuggccugagcccucuugggccuugagcuuggaugugaaucaccugcgcaggcccacgccuccaggcacagaaaccucaccacaguuuuggaagcaggaugguaacagcuguugucuagguucucugucccuaggaaaggauucuggaggggauacccagagcugggcuagaaggacccugcuguggccagugauggcuaugcgcagagcucugcugugcuuuuccguuaucuuucugugucucagucguuugaaguaagauggguggauggacggacugcucuucaauagaggaagcugacguaacagccacaugcucacugaugcaucagaagaggagagacgggccaggcggugguggcgcacaccuuuaaucccagcacucgggaggcagauuucugaguucaaggccagccuggucuacaaaaugaauuccaggacagccagggcuacacacacacagagagagagagagaggagagagagagagagagagagagagagagagagagagagagagagagggagggagggagggagggagggagggagggagggagggagggagggagggagggagggagagagagagagagagagagagagagagagagagagagagagagagagaaggagcugggcaucauaacacauaccugcaaccucggaaucagggauguguggaggagagagagagcauuauagccuggcugggccuauaaaaagguagacagacagacagaccaaucuaucuaucuaucuuuggaagccugaaaugucacuuuucaguggugacaaaaaucaaagagcaagugugacuuuuuauaucaucauaaaagagcaaaccuaaagaaaaguguuggaacgcugucagcacucacuguuggugcugagucacuggagcgcacccuugugacuaagcucauuucagguaagaugaaggugagugcaaaccagugcuguccuugcuguguucccaugccuucugcaggcgggccacccaccaguaggaccugugugcccuccccagagaggcuuccgggguguugaugccuccccauggaggagccagaaaguagcucugggcuucucccugcccacuguucucuuccuaaggagagccuuggaacugacucaguagcucacucaaaaaaaguucuggaaguuuggaaaagcuucagugcgucucuccacgucuaaggacugaaaagcaugcgcaccccugcccccucaggcgugcuucccgcccccucacgcacacuucccgcccccucacgcaugccaccaugggagcacucagcacagccugccuuccacacagaauccauuucagauuuucauguaagcuucaaggcuccuugacuguugggaaagccuuaggccaaaccaugaccccaccaucucaucugaguuaauugccugcuguauauguguuaauucauccacuuagcaggcgauaccaaggucuucuguaagacaggguagucaucaaacuuagacacuaaaguugcugaaaaaugaaugugguguuuagcugugguuuuagguguuucaauuuuuuaauuaucuugucuacuaaugaccaaauucauacguucuuuuuaaagauucaggaaaaggauaauguggggacgggguggaggaggcuggcgucucuggcuuggaagucagcuguggcuuugucuuccauauuaguuuauuagugugagcauagucacuaacuucuaugggaggcuuccacaucuguaaacuuuacuaacugccccugccuagcaggaaccuagcacaggaacccacaccugagugaggguuagagacaccccccuccaggcccccccagccagccauugggcggcccuaagaagagauggacgacugggcagcagccagccccugguuuugaugugcuuuugaacccauaucugggcaugacagucaguaugaggccugccuguggcucucaagagucccucaacugccuuagcacauggggguggggcacaguuggguagguuggauucugucucccagguaaaugcugcuccccacuuugugcucuguggaucugcagccacgguggacacuaacacugguggcuggcuuguuaacauuuuuuuucccaugacaauuuuaacucuccaguaggaauggguuuuccuucaguuuguaaagcuuuuucagaagaauagguuaucuagcagacacaguuucagcuccgaaacauaguuucaagucuaaaagaaaccucuuugaagagacccugcccccucagcauuaucagaacacauucaucaagauucggaguuccccaggaguggccauauuaguuacggaaucuaaaaagcaugggcaggauuaucuuaugugugcauuaaucaauagcguguuuaccuuacuuaucuuugcuucccuccagcaaugcacaugguuuuuguuuuuuggugggguuuugucuuuuaggagaaagagcuauguuaaaguguaauuuuauuuuguuggguuucuuuccuuuuuaauucuaaaagaaggucuugaccuuuaguauuaaaugggcugauuuguaaggaugcuuuagagaaaauaauugacuuucuaguggcgcuaauguuaaaugaccacaaaauggcuuucuuguuucauggagcucauugucuacauuuaacucccacauuucuagaagccauacuuugagauggaaucuggaaaauaugaagcucuugguccuacauugguuagaggggagaagcaugccugcaucugguuaguggccuggcacagaagcugugaguggcaauggggugucuuguuuggaacuaguaauaugaaaccucgaagggcuuucuugccuguuucucaggccagccucauuggcgcuacaauuuuuccuucugguuuggaguuuggguggaacugauggagccacuguugcgcugguuugcuguuaccacaggacuaagaguuaaagccaagcaggguuuggucucgauaagaaacacuguucuuugugcgcauuugccccuuccugcuaacacgcaggguacacuucaauaacaacaguaacaacugaggccaccagcccuucaccuucuccuguagcaccaaguguugggguccccccuccccgcccccaccaaguuuuaaguuuuuaugaugugguuguucuuuccauugacucaaaauggcguaauuggauagggcaagcuagaguuacaaguccccuaccaugccagaaagaaaagcuugguucucaucccaugcaaaagucuacucaagcuugguaagucuccuuggcaucucuccaagccagcugucuguccugggggucuugacugauggaaggguacuuguguuuuucacacuugagcacauuuggucauuugguggcucuauccaugcacuuacagccacugcacaggagaagcaagggagggcaccuggauucucaugccucaaacccagaguaucaauccuucuugacuccaguugagucacgaggccucaaacagcuucaagacacaucaguaacuugacaaaugaccuguuccuguguguaaucuguacuuucugaaaaggcugccuuaagugcaugcauguucucaugcacauagaaucacggcaggagccuaagagcucagcuauaaacaucugacuugaggacccucgugucaucauuaauaguaauuguacauucuaggagaguuuggggggggguagcucaacacgccgguccaacuggggugcauuuccuucccuuugccauuuauguuugggggccuuagaacuuacuucauaaacacauagugggcuguuaggagcuuggaccccucccagcugugaacaugaaacugcucuucuguguucugauguccagcuacugucuaucuccaaacuaacacaccauuuagccuuuagugauugcaaauucaggugaacuuuuucuuuuagcuucuacacaaaagaacaugauggugucuggcauguuuuuauaauguucugucuaucaaggucccaacagacccccccaauuccagauggaaacuccuggagacccaagccuaagagugggggaagaagcugaaacugccccucagguccaugcuauguccuuaagaaaaggaucccuggggaaaagaugcugaacucuuagcuguaucuguggcucuggauugaaccacgguaacuagaguuauccccaucuuguaggguuagguggggagggguguagucuagucugcucauagugugggacuggggaccccaaggcuuaacuggauuaaaugacagccagcuccagucauugugggcaucauauauauguguguguguguauguguguguauguauauauauauguguguguguguauauguauguguguguguauauauauauguguguguauauauauguauguguguauauaaaugugugaguguguauauauguguguguguauauguauauguguauguguguguguguguguguguguguauauauauauguguguguguguguguguauaaaagaaacuacguucucagaauuugucagaugugagcuuuaacuucuuugacuuguguuccagcagccuuaagauggccaccauacugcuuagaaaccuuugaagcgaugcaaguacuucuggccaagacuucauucacgauucaacauggagagaaaaaucacaucugaaaagcgauucuauuggaaaauuuaaaggauccauuuccgucuuaaccauguuugggucgucacccccccccccacccaccaccaccaccaccaccacacacacacugggaaaagaaugaaagaacucaagcuuagaugccaucacggaggcagagaauacccauggucuaucauccucucaguuaccuggacgccacucccgcgaggaggacagaugcggcugaagcgucuccucauccuccauugcccuuuuaugccccugcuuggucuagagcggguccaccugaauuugccaaggugccacaggacaccugaguaguccugugacucucugcccccucaccacuuggagcugcacucgccacagcuaacuaacagauagcaacaaagccagaugugaccccugccagaggucacacagcagccacucaguguccacugcugcugcguagagaacugaaggacaccugcaggaggguucuuauugccaccggccuggcuagagaugggaagccucuggcaaaagagcaccauccaccuggcucaucuggauccccacagauuccauugcccaugggaaggaaagacuuauauuugacaaugaggguuuucaaaccuugcuugaucucugcagaagucaaggagcucaggacugggaugaucuaagcaggacgggguacuccaucccuuuccacccccagugcuuacccagccgcgcuccuucagucugcgaagggugugucaccccaaacugcauauaucacccaaaccgcaugugccucuucucugcuggucuaggaucaucuucccucuuucgucaccuuagagaaugccucagauggagugacugcuugcaccaucugucccuuaccugggcacaaacuucuaacugacugggcgcgggaugccugccauacccuagcaucccagguagcaaccaaguaggacaccugaggcaggcgcuggcagugaggcgggaugcuacaccagaccgcgucccagccacgaucuucaaagccuggacccuuuugggcugauaucccggagcuccagggcaucauccagccagccaagucacagugcuggaaagaccccaggagcuggagcacgccuuccaucucugcuggccacgccccgggcccugcagggucagcccguagaccccgcggccucggauggaucgcggcuuuuccaaguucgcagcgccaccugguggccuauaacguucacugcggggcgccguggagacuuucugggccgcuuuguaagggagagcagacagaucuaucuggauucaaacuucccacccaaagcuuuccuaccgugugaacuagaaccuuccuagccucggcuugagcaaccugagaaggaaggcuuguuauuuccuaggaaagcauuugguggccugcccucagaccaucacgucucucuaaacagucaaaauaauuauauauuaaauuagaaaaauaguuuucuuccaugcaccacaguuggaaaugcauccauaaggcuguucaaaaccuaaaccuggucagugcaaucucucucucucucccucucucucucucccucucucucucucucccucucucucucucucccucucccccuccccccagugucugccagucuccacgugucucuguauaugucucugucucucccucccucccucccucccucucuucuuucuucuuucccuuccccccaccucaccuccccuuuccugaccucccuuccacuuuacuuaacuaguaaagacaugcauuugaaaacaugaaccuucuuagcucauguuuuaagcaccaagcuugggucagaggagcuggacgcuugcuuuauuuuagcccucuaaccaagcgaaaggugucgcuguaacuuauucacucccuccagccacagaaguacaugaaacuggcuaucaaauuuaagccauguuacaugugugugcuuccuguaccugacagguaaugguaauucuucugagaacaaggacucaaacaggacuaugcgccauggguccuccucucugggucuuucucuaucacaucuguuggcaccagacagggccauuccuacuuaaacugauucccaaaccuuacagugaugcagaucccagcgggguacaccuguucaagaggcagcugccuccaugacugaccagccucagaguaagacuuugagauggcagagacuccaagcuucaagaagccaagauggaauagcucucccagacuuuaaggaacccauuucuccugcuuagaaccaucuuguuuguguacccuagaaaacaauccaaguauguguugaaaaacucuggcaggauaggguauaacucaguaguagauagaucacuugucaaauauaugcaagaccugcccuccaaacaaaaacacacacagucacacuacugcuguaccucuacaaugucagcaccacacaucuggaggcaggaggaucaagaauucaccaucacccuuggcugcaccucgaauucaagggcagcuggcuuccugagacuuugucucaccaauaacaauuauuaugauuacacaggauguagaaaugaaauguccucauaaguuccccccacuuacccuaagucaagggcuuuuuaaagaugcuucccugagccccaggcagaugucuuuguauuuaugugugcauguguucucauguaagcaggugcauggagcccacgggacagccuuggcuccucuccuugcucuagugacaaccaaggacccaccugucaccugcccuuugccuuucuggugcugagauuacaaguaccugcuaccgugccuuuugggggauuggguaugguuugagacagggucuugacuacccagcuuuagcuguccuggaauuugcuauguaaaccaaacuggccucauacucccagagcuccaccuucaucugccuccagaauucugagauugaaagugugcacuaccaugcacauaaagcuaugcuuugcuuuuuuuuguacacaaguccuggggggcaucaaacuuacuucaucaucccugcaaggcaggcacugugcugaccaaaccaucagcccucgagagagagagagagagagagagagagagagaggggggggggguucucaccgccugcuccccccagcacccgggagaacuuccucuuugcccucucucuggccugucacuccagagauagaacaacuuguuucagggaggagggaggcgcucccuuucuuaaaaggcaacauaaaagagaaggagggccacacucugggagaaaaugccugaugguugacacauguguaugugguguuuggcugcagcgcaguggggcuuucuggauucugggcagcuccccugugaggauacacaggcacagcuaagaucucuucagugaccagagucuguucccucaaaguggugggccucuccucccugcuccuggcucucuauuccucucaguucacacacguuucugugaaguggccucugagguaggauggagucuccugggugccugcuucugacaauuaggcagaucagccugggguucuuagugccugaagguugagcugagcugaaacuucaggguuucagcuuucaugagcccccauugugagcuagacuucucauugauguagcuagcuaccugugaguuaccccaccccacgccguuccuguaaguaaccugugaccccgguaaacucacacguucccuaagauagauucaagugaaacucccuuuggucugucauuguuauucuaucuggagcaaagagauguuuguucacauuuuccuuggaaaagucacacagugcccccauacgggcugagggagccaaaaugaauuugggaggagaaguugcaggccccugcagugggugcugaaguguucgcccagcccaagugaguguagagcgucuguggaggcgguccugauguggcuucuuuuucaucugucauacgggauggugugcuuuguggguauggugguggcugcguguucccugcagugcaccggugccaagacaggaaaccaaggcuaagcuaucugagaguggagcuuccuccggaggacgccagugugaacaccuuccuccagagcuccuaaagcucugacccuuucauacagcaacucaggguguggugauccccagcugcaaaauuauuuuuguugcuucuucauaacuaauucugcuauaggcauguuuuuauauacuauaaaguuuacccguguguuauucaaaugacaauuucucugcccucauaucguguuucaauccagacuaggcaugguaaugcuuauaccaagaaucuccugucucaaauuuguguaaacaguucuacuauuuauucucugccuugucaauaaaugcuggucacccaauggcugggcagaguagcgaauagagcaggacauuugucaaccagaggaggagauucagaccagcagaauggauggagagaggacuggagccaugaagaagaggucuggagagagauuggggaaacacacuggaauucugaagagugagaucaacaauaauaugcaagugucaugggguggggcugggaggauuagcacagaagcuuagguuugcuucaaacacccaccuguuggcuuacaauagucacauaauuagaugcuugccaggccagaacccccuuugcuugcucgccauuuccuauaaaaccuuguccuguugagggcuugggguugcuucaccaaccuguccugccaugucagggucaguggugaguaagcccaagcucaagcuuagaauacagagagccuagugugaugacaucagagucagcuccugcuugguccuuuggggcucguggacaaggcgcagcaguacaucacuuaacugcucaguuacugaggugcaguuuuaaaucaaucuugguuucuuugugagguuauugaggaaaagcacaagguaaagaaauacagcuaccaguuuaaccuacugcuacauuuauauuaaagaaauuucauuuacaaauggcauccaacguggggcacuauauguaaaaguucuucccccccccccagccccaugcucccagaaauaagacucagacucaaaauauauuuacaaacacuuugaccauauagcuaggcucucuucugacuagaauccuaacuaaggauaacccauuuacuuuaaccuuuagccuacauucugccacauggcuggucacccgugcucaggccccauguguccguccccuuauaucuuccugugccuugcucuauugcaggauucuuucugccuccugaugccucaccuccuauuuacugccuaagccauaggcuauaggccauaggcuuuuuuuaaaaaaaaaguuuuauuuauuauuauacauaaguacacuguagcagucuucagacacgccagaagagggcaucagaucucauuaugggugguuguaagccaccaugugguugcugggauuugaacucaggaccuucaaaagagcaguuaguguuccuauccacugagccaucucaccagcccagccauaggauuuuuaauuaacagaugaugcauccauacaauacacaaguuauucucucuauauuuugcuauuguuaugauuuguaaugcagauaucuauuuucugacagccuuaagugaccccugugaaaagguuguuugaccuccaaaggggugaaagcccacagguugagaaacauuguucuauauaauauguggucacaugucuccuugaugaaugggguccauugccuuaguacaggacugaugagagacuaggggauauauucuaauccccacacacuugggauauagaauuauaagcaggcugugaaaaugguuuuuuggccuuccucugagcuuucugccagagagaacuugcaguguuagggaucgcaacaguaaaaagauaggcacaugcaagagccuuuguuugagacaggguuucucuauguagacaaggcuggccucaaacucacagcgauccaccugccucugucugccaauugcugggaucaaagguguucggcaccacacccuacugcaaauagccuuugauucagcagaaguggaaaguggaagaaugagaugggguuuugccaugucuugcaggaugcuugggaagcacgggguacagagaaggaagagaacagcacagcaugugacccugaccugcuggaucgaggaacacccacccgcuccauuucuaaagaccuauucuuuauguguaugaguguuugccuacauggcauguaggugugccccuagugcccccauagagcucaaaagagccacuagaaagccuggacuggagguauaaaugguugugagccaccauguugguguugagaaucaaaucccuguccucugcaaaaguuacacggccccuuaaccacugagcaucucaccuagucccgaggaagacuuuuaaaugaggugugaaagagcuucuuccagcugggcucagguaccagucugagugcagggaaaucagagaaacuaagcaauacaagucuucaccucuccaugagacaaaggcugcacagugcgaggggacucuguccccgguggaucacugagccauuggguacacuuagcacugacuaagguccccaugaauaauagcagggauuggaggacaucggggaacagauggacugaggaaauuaaacaugaggacagcauuugauuuccaguucaccagaccugacugaugcaucagggaccuuggauucggagcuucaggagucuuacugaaccccaugggggguggggggguugaacuguagaagaaaggagauguucugaaaggccuaugugauuugggcagccauguaaaugagauuuguaaaauauuaaaucaaagugaguugaaaggacaaagcagcuuugcugucugggugcucaaaggcagcuguggcauggcuuacagggacucaaacgcugugcuaaugaccuucuggauucaacaggagaagaaguaaaugacaaaauagcacagguaaaaaacauuaagcuugacuuaggaauaguuaccucaugaguaugcaguaugcauuuauccucugcaugaaguauagucggggagagauuguuccuuuaagcagccagguguggcugagugcaguacagcaagggccaugaugcuagcugggagccugucaaaaccuaaggcacuggcucuagagacaaacaugacaaacaagaguauggcccugagcuggguugagcagcacuggcuggcccaacugccaucaggaauggacagauguguaacaguaaauuguauuugccugaaguaauugucuuggaggcuuacugccucugucugcuagccuagacaaaggcuuccagccucuguucaaucuuaccuagaccuagaauguuuucagccucugagaguugcugcugaauaaacucagcccuuccuaguucuuucugagcucuggcuggcugguucaacucagcuguucuggcuccaauuccuuucccagcugacugauucaaucugguuucucccucugccucugaguuuuuguuuugcuuggacuccaggcaaucugcucuaaucuucuggcuccuucucauucucuggccuauucugucuucaccugugucuaccuugcucuuucucucugcaaucugucucugaacaacuguccugguaaaccugcccuccucguuauuucucccuguucuugucagaguugggcauuagccuauucugucaaaucuuucucugauucaucacuuugucugccccucaauuagacgccacuuucaaaugugagugcuuccuuuuacaaacuaacuuuaccuucacuguuugagauuaaaggguguguacucagccccacaacuagaaacagguuuuuccaguaaacacaaucuugagguucacagugugguuaaauauccugcaauguuuccacauuuucuaaauaaaaaggaaagauuuuuaucucuaccacaguaaaacuauuucaacagagacagucauccaucccacaguaacugucguuauguccucaggaagauccacugauggaaugaucccucaucacugcugccuucaucaugugucccucgacaucaugugucccucgacaucaacaucauggaugcaucacgguuuucagucugcagggcugcugaaugaucugucauuuuucagccaguuugcugagcugucccaagcagagggaucagcuuucucucuguguuucugucuuucugaguacccagaucaaaucuuuaacacauucccugaccuccauucugauguuaacaaaucuuuaaaguacacagguuggcccaauucagcagggcuuuuuuuuuuuuuuuuuuucccugcaauccagugucugccagcugaucuuauuucccacucuguuuauccagguacaauuagaucuuuaugaaucuacacauaaacugcacauguaggcauugcauacccagcuccaccccaggaaccaggcuucauacucacuguccaagggcugucuauccucaucaucaauuucaauacauaacacagauucacaauuaagcacaaucucuuucuuccucugucucuuguaucucgagccuguguauuauuguagcuauguuucuuguuguacaacuauuuucuuucaauguuuuuugagagaaaaaauauaaagaccacagcugaaaguagggagggguuuacuccagugguuaaaauugcaaugagugcugcaaguccuacccuugcucucaagggaucugacauggaguuucccacuuuuuuuuaaugcaggaagagucugucuauaaaacuaaaauugucuuuggggguggcuuacuguuauucuccgucucagagaguccugugucuucucuugcucugggcuuggggcuccuaccaguucagacuuuuccaggucucucugggcauccggauaaacucaaacaauggaugcuuccucuggagacuauccugggccaauuuuuccucugcaacuuucugucagaugcccucugugacauuucuguccaauguccacugcuuucugcaacguugguggccuuuguccuucuccaguuagguuggguucuccuucuaaccacguugguuggaagauguaaaaguaucuuuuauuagguguuguaacugucaucuuggagguuuacugccucugacugauaacccaggccuaguccuggaagcuucaggccucugggcaaucuuauguaggccuagaauguuuucagccucugagacucacugcugaauaaacucaacuguucuggcucaaaacucuucuccaagaugaauaauuccaucuggcuucucucagcuucucacugaauugcucuguuugaccucauuccaacccuggcagucuguucuaaucuucuggcuccuucucauucucuggcucacucugccuucaccugugucuagcuuggucucuuucugcaaccugucccaguaaaaccgccucugccucuucugccgcccucucuucaguagccucacuuugcucucuguuccacugagagcuggucacauccuauucugucaaauguuucucugacuugucacuuugucugccucucgauuagacauugagagaccagaucuuggguucagacuccaucuuagagaaccugacuuaaagguuaaacuccaguuaacuaacaagcuagcaccuagcaccgguuuccagguuacucucgcuaacaaaccugccccuggugcuucacuuccugacaaccaccaaugaggaggaaagaacaaguuugugguuuggcuuccagcaccagccaauuaauuauguuaaggucaacaaaauuccauaaggcagccccuccccccccaucaaaugugugccaggcuugaaacccccuuguuugcuuaccucuacaaauaaguacuuaagcucggcuacacccucccauucugcugcuccagagacggcagcacggcccacacucacgcuugagcaccgcgucagcuccuuggugaucuucugaucuuuuugagguucacgagaagggcacaacaucacuuucaaacguggcuguuuccuucuacaaauuuuuaucuccauugggauuacagguguauacuaaggguauugcagcuagagggcuuaaaggugugugcuaaagcuaagccacaccauaacuagcaacagguuuuuccaauaaagaacacaaucucaggguucacagugugaucccugcaucagagaugcacagcaaucccaggguggcagcagcgcccuaggaucaggaggccagguggaucggcgccuuauggaagaugacuguggaaaaugaggcuggggagggggcuaaugggauggggccuggcauccaggcuuucuuucuuacccagcacugcucuuuugaucaaacaauaguugaccuugccagcauuucuauucuaguauccccuuagccauccaagaauaaccuagaacaguguugugccuucaaagaggucacuggcucacugggagagcacuucuuuauaucaugauaacccuuuagugcugucuuagggguuucauugcugagaagagacaugaucaugacaacucucauaaaggaagacacuucacuggggcuggcuuacaguuucagaggcuuaguagguuuaacaauggcaggaagcauggcagcaugcaggcaggcaugguacccagaggaggcaagaguucuacaucuugaucuaaggcagcaggacacuguguaccacucugggaguaacuugagcauaggagaccucaaagcccucacucauagugacacacuuucuccaaaaggccauaccuccuaauaguggcacucccuaugggccaaguauuuaaacacaugauuggggggggggggucauaccuauucaaaccacggguaucuuacuggguuguaaaagcuuguggaaauccagugaagacagacugaagggguuuaaauaaaggcaggcacucuguaugagugugaaaauaacuuccaggagccauaaagugcuuagaggaaauugccaguacaagggaaggccccuaagccccacaaaccauaaggcuguuaccacuacuguuggugcacaccacacuaggcagcuaaguccuuauuggaaacgcugccgaaggacauagagaaauaaggcuguaacugagcugggagcccccucucuguggcagggcugcugggagagaguugucccuaagaguccugcuuugcuauauaugcugaacuggacuaccaugcagggcaagugugccuacugguguaacagcugcacgacuguugggauggugagacuaacucccuucucauuggacuuaaggucuuccuuagaggaggaagucacaucagauacaucaaauugccucuauugguuuuuccauccauagauaacuacaaucugucagcugcucacagaaggagacuuaguacaagguguacuggcuaguuuugugucaacuugacacagcuggaguuaucacagagaaaggagcuucaguugaggaaaugccuccaugagauacaacuacugucaggcauuuucucaauuagugaucaaggggggaaaggccccuugugggugggaccaucucugggcugguagucuugguucuauaagagagcaggcugagcaagccaggggaagcaagccaguaaagaacaucccuccguggccucugcaucagcuccugcucccugaccugcuugaguuagaguccugacuucuuucagugaugaacagcaauguggaaauguaagcugaauaaacccuuuccuucccaacuugcuucuuggucaugauguuuuguccaggaauagaaacccugacuaagacacaaggggugguguacucuagacucaacugguuaaacuccucuaaccagagacuugcuguggcacaguggccuaauacucagucacaggugaaggaaaauaaccaaacauauauacugccuuccucuggacucaggaaacacaguggaaaugggagcagagagaaccuaagggcugcggaagggguggaggguuccguguuacauggugauugucaugcacagugaaacacuugcuccuaagaaucuggaaguaagcaaaagcgguuaagagggaggaaguuccugaaaucuaaagaacccacaggccccaccgcaagauuauaacaacagugaacaauugcuggggugaggagauggagcuauuacauguccugcagguugggugagugccacaaguggccacccacgagugcucugaucacccucacucaaugcauucaucuacucacuaagcuggaccaagaauugaagucauccuuuuagcaugggcaaaccccaaaagggacaaaaaucaacagggaggguaaauuuggcuggugagguggcucagcggauaaaggacuuugccauuaagucucauaacugaguuuaauccucagaacacacuuggugggaaagaaccaacucccauaagcuaccuucugaccaucacucccgccccccccccucacacacacacacacacacacauacacacacacacacacacacacacacagagucacugccacacuucccugcaaaugucacuucacugucccuucccagugcuuuccccuccagagucuugcuuuccucaaauacuggcaagugauuccacuguacacgcccgcugacuuccccagugacucuccgcuaauggguguggguggacaagaaccaaaggcuccauuucccagccccccucaguucucuguggcugcauggcucgucagcagauuuuguuaugaugguguugcaaacuucucuaccaugaucucaaaaggguaagaacgccugucuucuggcuaauaguggcuggguuuccaccugucaucugagaccaugccaugaccuuguggguggacacacaugcagauggagcagacaggaucucucuauguagcucuggcuauccuaguacucguucuguagaccaggcuggccacaaacaguacucagccugccucugccucccaagugcuggagcuaaaggauugaaguguacugccagcaccacuggcuggcuggaaacuugucuaaaugggagaaaugaacuuuauuguuuaaaucacuguacuucaaggaucucugagguuaauccagcccaauccaacaucauuacugcccuggcuuuccugagcaacaagacugugucccccgccugccaccaggggcuguuacauagcuccaccauuguugacuauagcacuuaaauuggggccccacaagguuucuucuuggcuuaucaaagagaguggcauacugaccaggacacagucuuaaaucugugcuucuggaacccacuacagggucuaccauugcccucaaaugacuggaacuaaggagcucacuggggaagcauuuacccagcuugcucauggcccugggauuaauccccaacacuuaagagacucaugauuuccugaacagaauacucaguuuugcacuucaaguagaguucacugaccaucacccccccacccccccaggcucucucccccagagccuggggcuucauagacucucacgagagagagagagagagagagagagagagagagagagagagagagagagagagaaaaaaccaccuguuuuugcaggucucucacugaguguggaacuugccaauuuggcucaugagcugccagacugcuucagggaugcccagugcugggacuguggagauuucuacaucacugacuuuaggccugugucucuauaaaugcauccugggagaggggcuggguuucuggcagagucagcaauggccaccacugcgguguggguaucuuuaugcuaguaccaggucaacagucaacaaacugcuuccaccuuacuuccaaagggggcugucagaugcuuuuccgucacccaggacaucagucccacucgauggagcaucgcuuggaaacuuagaaaagcacacccaccacaggcugaccugagagaugugaggcacacaugaaguacacgcucgccacuuagaacacaaggagaccguaaagcgacuggaguuuauugccgcgauaccguuaaguagcuacagagcgcagcuccucucuuucucuuuaaaugccaucuuaccacaggcaucuaaagcaacagcagcagcuacaaaauggugucugaauaauucugaguucaaaacaagaucuguguacaggcagaauaaaaagauguucaauuaauagugugccauggaccggaacaaaacaucugcaacugggaguuuuguguaaaccguaauagagaugcgacucacagagaccaacaguaaauucuuguuuccuuguacaguuuagugagguggucuguguucuugcaaacgacuuacaaaguacaagaaauguugcaugugggcacuaggcauaaaauauuucauuuccuuacacaaggcauagcagugguacagggaacccaguggguaccccgccaucucucuuccaaagaugaaccucccagaacggcaguagaugccuggcagcaagccacccaugacaacuuuuuuugguuguuuaaaauacaagcacauucucagauugcccuccucggcuguaaccccccgacguggugggaggcaagcccucagccucuugcguaguuuccccuuagaauuauguacaggacaccuacagauacgguacacacuaguaugaaaucaaugguaguuugcgauuccagaccugaccccgugguuaacuaaacagaccacgucgguucugaacauugguucccaguuaagaaggcucugaagcaucugcaucagacacaggcuucucgacggccggggugcagucgcugacucuguccucaacagugguggggaccuuggaagcaggagacgucacauccacagugagggaagaggcgucugccuuugcaguagucaugacagggucagaaggugggcccauggcaggaagggaagacagcggcuccccugcgcuggcugcagaagagcccucuggaaccaaagggaaugacgggaggaagucggacagcauggggagaggugcaaugccagguaaguuucggggaggcaaggagggaagagguggcaaaccuaggauagaaacagcagaggucacauauucucccagcaaccagagcacggccaucaagcuccucuaccugccccugagagccugcagccgaagcagagcucuuugcucacugccaccuuugcugaccucuaacuggaggcuggggccaaaagcuuuccaggcccaagcuccguguacucagcccugcacucaggagucugccgaugcgacaacagcucccuccagagccaugggaagcagugcucccuggcguucaagggcgcuggcuggaugugagcuaggaggauccugcccaggcaaggcgccucuugucagcuaagaggaggagcuguggaggagcagcagcacugccucaagggagccgcccugcaccuggggaggccccgcacugccugugcugcucuuggugcguuauucuggagaucuucagagaggaaagagcaaagggaaggcggauuguacgggguauguccaggacaccacuggcuggagaagcuguccuguccuuagaggcuugcugcauuuaaagacagagggaccaagaauaugggccccagggaaaagaagcagggaguguggucggugcagcuggggcuuucuaggucccuuguucuucagcccuggcacugaagauguaaaaaaugcaaaccugucagaagugugacaaugacaaccacuauucaguauggagugaucacugcagugucaugaugggcagucacagggagcgucagcaggagcaggcuuggggacugcugcucccuuuucaccugggcauaugaccugagagccaccugcuggcagcuggugcucuggguuacuauuauaaaaccaucugucaacccccagaacacuuagcuggcccgagugcagagcugugguccuagcacuugagaggcugaggcaggaaguuaauccaggccagcuacagugagacuccgccugccccuccaaucucagaaaaacaaaaauaccaggccuggacugcacagagcagucaccagcauuuccuguggguagcauccuuaaacaggaagugaagagaggggacucaagcaucuuuauuaggugacuguaccacacugucaaauucagugcacagugcaacuccacugauccuaugguagccugccuggggccaaaccuaccaggguguagagaaagggagggaggcagaaggccgggucauggacuucuuucuucuucuccauauaaaagauggauacugauuagaaguagcugaaauguguuuagcugagaugcucuuucuggaaaagacugaacgggaggccucgcuuuccugaauccauguuuuuauuagcaaugucuuaggaggguaaggcaugcaacauacccgggcucccgagcucuggcaaaccgaccccuggcaugaugugcggagcagggagguugaaguuggagaggcuggggagguuggggaggcuaggcagcccugcugacaaaggcaucagaccugagcagagggcgagaaagaacacaagguaagucguuccccugggaaggagacaggucaucacacgcugacaaaaggaucucuucagaauuccgacaccaggguucacugaugagcgacaacugagucucacagaacgcgcucugccucgucugagggaucaggcugugaaagcagcaaaugcuacacaagcaacacacgcucccacggcccuggaccagagagaaggcgccuaccuacacacuaacagcucaccgugcugcccaucguucugugugagcacaugcgcaguucauggcugacuacaucugcacacugacaacuguagcccuguaaugggaggcccugacaacgcacauacucauuacucaaguaacaucucacggauaucagcuagacaacaggacuuagucugcacuggaaauaccgagaauccacacaauuuaacacgggagcaucucaaugcacaaauaacuacggcgccgccuuagccgggcggccacagaagagccuccagcaaguccuacacacacaugcgugggaaggugagauguuggggagucucaggcuaaguggcaccuguuuccuggccugcuaaggagaguacucuuguucugucacagagcucugcagugauaauggacgguuaaaagacaaagaguuucaggagcaaacaccauuaucaaacaagucuuuagccugcugcuuacuugguaaugugguagcuggguucauugguggcauagaagcaagggacugguuuacuuguggcggcaacaaugguacaguugguacgccuaaaauaaagcacauuaaaucauuuuaaaccaauucuaccgccagauaugaagagaucacauacaggaggaugcuguuccggcuucacuauggccgaacucuuggcuguaucauuacuauguauaaccuuucagagcuaacucaccaaugcauguauggcccugacagacaccuuagccucagccuggugagggaagaaaacuguguagccuucccuggauagacucccuggacaagaaaucugucacugcccuaagaugggucagaucaagagcaggcucgugcaaacacgcaagcaugggcugcuggagcccccucugcccuggaacagugaaaggcggccugagaaacaagggugaucacagggcugucucagcagacaaacagcaccuggauucccagaggugcagagaaggacuaggcuuccuuuagccuuagcuucuacauacccagugcagcccaccuguaccaagagaggcuguggaaauauucuccacaaacaaggacccucaggaugccaucugaugaagacccauauacuggcacuaaccuauucaagugggagguuuuucugucacaauaguaauacauguugaacacccuuuacugaaaauccaaaaucugaguuaauaccaaauauaaagcuuuuuagagagccaaugugacucugcaaguggaaacuuccauaccucauagaagggauggaagucaaaacaaaggcacauugaaaacccgguacacacugaucgucaagcuacgugcauguguuucaaacaaaugaacuggugcuuagacuugggcuccagcugcagggugucuccucacaucugcugcucacaucuguguuccagggagaggugcucaagccccgugcugagccaggcuugggccagacagggauauguuuuaauaagcaacaggagcgaaccgcucuucacagggugagccaaccuuaggcagcugccuuauuuacuaguguucaaagugcuuuccugaggaaacuggggacaugcaaaagagggcagagggggagggaggagagaaggaaggaaagaaaagaaagagaugaacagagaagagaaagccuggucacggcacuggccagaguucuaggaccucaggcugccauaguccaguacaggagaccccucucuuuucuggaccccacaguuaccagugugugcuuguuaaguaguaacagacaauagcauuguuauaacuauuuuauauuucugccuuaaaucuugccuuuaagaaaugaagacagguuggagggacggcucagcacuggcugcuccuccagagggcuugguucccacagcccacacggggcucacaacagucuguaacucuaguuccggggcaucugacgcccucucugacuuccaagggcagcaggagcauguguggugcacguauacacgugaaggcaaaacacucauacacauuaaaaaacaaucuaaaaacaauuuacaaaaagaaaauaaaaauagauuugcuuaaauccuaauaaaacccuucacaugauauuucuucccuuuuaaaggguaaaucucauuuuuuuguaccaaaaacuaacuugucacaagauuuucccugcccuguacauuaguacagaggaggucugugauuggacagggaaaagggaggcggaacuaagagcugaagauacagggagcgucccaggguagggggagacagaagauggccgcaggcaugaaccucgugugauguuuaccagccacaaguaguugugguaucguaagguuauacuaauugggauaaagcuuuuaucauuaucaauuggcucugaauuauuguacuggcaucuuguaaguugugauauuauugauacauacaucugauugguuaauuaagcuguaagagucuuacuggguauugugauaugcaaccgcgagguuggugguuccauuuaguuacuggaaugcgggaucgccgacuacauggguuuauggcugaggaagaagaagcagagccugggacaagcaaaugagagcugggaaugcagcagugggcgcagugggggcuggcuggagaggguugccuccgggaguguccacccccugcccagagcuggcaggcuccuuuuuaaauaucugcgcaaacacuaacugaccuaacugaaucuaagccagggauuguaaccuagggccacgaauggccuuuacucagccugggaaguuccuagcaguuuuuggagaagaguguucuuugcuguuaucagauuuuuaaaaaaauuauauuuacuuuaugugugugaguguuuugccugcauauaugucuguguacuauaggugcauaguauccucagauaccagaaaauaauguugcacccccugggacaggaguuacagacaguugugagcugccaugugggugcuggagaucaaacccaggaccucugcaaaagcagccagugcccuaacugcugagccacccccccccagcaccccuguugucagauucuuaagggagugggaugguugguggguucaggcauucuagcuagaggguacccacugucugcuucauaguguucuaggcauugaggcccuugucagucggaagaaagagaaauucaaccuuucagaaggagagggaagaaaugaaacacagcaaacaauaacaaccuuggcuucuaagugguaauauacuuucugcagaaaaaucacacaaggcagugggagagggcagagagugugugcuguguacaaaauucacacugauuaacaccacuuaauauucuaaaacaucuacaaaaccaacacacuuuccuuuguccacaauuacuauguggaguucucugagaacaagaagucgggauggaaaacauuucuaacaggaagcugcuucugacaugucaugguauugacacuuucaugucugaaauucauguucuacacugaacauguuaguacugucuuuuuaaauggacucaacagugaaaacauucagucuuuugugaguaagcauuguuucauuccuguuugucucuucaguauccagcagccauuucgucagcuccagggaccucggugccugugcaucuaacacaguacagguuuaacuguaaugugacuagagcagucagaaugaguugucaauuucuccaagacucauucucacuacaucagaauggcuuggccgauuggccugcugccuuguggagcagcccgaccucucugagaaguggcaggguuuaaaccagaugaccgacuccagacaucgugcccaucagugcuucuugaugggcagucugaccccgaacagaguuggggauaagcaaauucugaauacaaacagcuaaaugagucaaaaacaaaaaaacagccgaccaaccaaccaaccaaccaaaaaacaaacacucccucccauauuuccuaaguaaacaauguuagaauucggcuagugcuucugacugcaauauggacacuauauaaucaacuccagacauuauaaagaggagaaaccagaaaacaggagauggcaaacgggaaaaaaagaacuguguugggacuaagugacuccauacgcauguggguaaacaugccacagaaauguggccucauacagacucagagacuugcucacaaggguacaggcugccuuacuuagaaagccaaacagaaacagccuaaauaucucucaguugauaaauggguaagaaaauguaacacagucauaccauaaaacauuauuaauuagcugggugugguggcgcacgccaauaaucccagcacucgggaggcagaggcaggcggauuucugaguucgaggccagccuagucuacaaagugaguuccaggauggccagggcuauacagagaaacccugucucgaaaaacaaaacaaaacaaaacaaaacaaaaaaacauuauuaauuaaaaggaaugaacugcuaauguauacaacaauaucaaagauccuugaaaacauugagcuaagaacacaaaacagucacaagacuacacagucuaugaaauguccacaauggguggcaagauuaguagcugcuucagccuggcagacuauggaagccagggaguggcuagagaugagugggggguuucucuggaguuuggggcaaugaaguuaguuguauaacucugugaauaacuaaaagccacuugaagugggugaguuggauggaauggacauucucucuccauauagcuguuaaagacaacauuaaccaaaacagaagaccugcacgggguagaguguggguaaagccgucuaggugagcacggcucuacauaccuguacugagaacauugcugacagcugguggugccgagcuaauggagaguccagacagacucugcucaacuccuguaguuccugguggugacaaagauggaggacugacugaagacagcuggaccuagcaaaaaaaggggguggguggaaaauuacuuaugaauuaguugagaaaccauuaaaauauucauuucuccaaucucaaggcucugaccuccucaaauguaucacuucucucucccugacaaugccuccaccuuucaggaaccugcucucuagacacucuagagucccuauauucugugucacuucuaauccccuaugacucucugcguucucuuaucauauucuguccuuucccuggcugccaugugacacuacggucuucacauacugaccucucuagguagucgccacuaauuacuggguggaagaggguggaacuaccugggcucuggccccaggccuuauaggcacagagaguaauuaaggaaaggagacauuucucagaagcugcacuuccucuggaaguagggaaggcuggauuaagacaauauggcuggggucuggagagaaaacagcagccagcacuacagaagaccugaguuugcuucccugcacccagacugugcaguucacaacuguacauaacuaacuucaagggcuccaauucucuuuucuggccuccuuggggacacucauccauaugcgcgcacacacacacacauuccaccaccaaaaccuagccccaccuuuauaucuuuucuggugugugguuuuuagguggccaaguagacaggagaagcaagcaccugggaugccuuccuaagaacuguuuuuaacccugcaagccacacaacccugugaccauuuucagcaccuuccacuggucuaaacuguccucuguacugaugaucucaaaucugaauacucaguccucuguuugcuaaaggccagccagcacacaccucccucggauguacaggaaccucaaauucaauaugaugcuuauugcacaacucagcacugaauguuucagcuagagccaccuacauagguuuccacacaucuuaccucuguaaacccauccuuaagaggaguaauggggguaccagucauuuguccuggaagggaaaucuucuuuccuucuucaaaggggcguguagguauucggugcaaauaaccauagccaaugccacauccaaggcuaaaaaacauuuuucuuauuguuauaaaacacaaauucauuucuuugagguuuuaaaacauauacgcccauguauuuccucccacuccuuuggguuuucuugagacauggucucauguagucuggacuccugauccucaugucuucaucugcauuucauucuuuuaaauaaugccaucuucccagaggucucugggcuccacccuacauauaacacuguaaguccacucugggcacuucucuuaguucuuguguuuucuucaaacauuuaucaccauucagcacauggcauguuuacuuuuacuaucuguucccuaauaaaauauuaaggcgaguaggaacagucuuugcuuuuuauuaccuuaacaguuuccgguacuaggcagagccuaauuauuaccuacugcauaaaucacacccugccugccugcccacugaagaucucuacacacaucuauaugaugauaucauuugaugaguacagcauaaaccagauuuauauauuugaugacaguuucuuccuuuuguuccugcacuguuaggagaggcaccuuucuaacagaugugagcacacugcuucuuuccaggcugcuggcucacuucuuccucuuccucuggggaaguccugcuguccugagugcagugcuuuacucugccaaucaaacaaagcaacucauggcccaagucagccgaucagcuucugcccagagcugaaaaucuuggaaguaacacgaaaacuaaaaaauaggcucguucuuuuaucaguggaaugcuuuuuucugcaccugggucuuuagcugucucuagggacaagcacgaauccauaugaauguggugacagcucuuuucugcacuguggggucaaugaaugcuuacuuaucuuacagcuuauauaaguugagucuuauagcugaaaguaagccaaaucuggaccacugcauuuacggucauugacaagguaagguuccaaucugcuuccaccacaaucucaucuuucccuggcaccuggcacuuucagagccacuaugcacggauuccuccaucucucuccuuugccaaggcacacaugguaucucuguuggccccacuacuaccaaaagcugguggagugggcaguauccaacuucaguucuuccuuauccaaaucugauuuucacagugaugcuuuguauuucaaaauuacacuuccauuuucucauaucaaagcuacacuuucucucaaaauuaauggaagaaagauaaagucaucuauauugaugaaugaucgccuuuuggcauaaucacauuuuaaagcaaggaguuuugugaugguuguuuguuuuguuuuguuuuguuuuuugcugggggauaguguuugaugggaacaacaggguuuugcuauguagcccaggcugaucuuaaacuuggauuccauccugcuauaucaacuuucucagcacuggggugggcaccacccuacuggcuuacgaagugccugcuauucaaaauaacuagguaaugacagagaaagagcuugaagcaacaacaaaaucugcugcaaauucaagagaggcuugaaaugaagaguggcugaguaacaccuggucagcuccugaggaaugaaggacaagaggccgagauccugagugcacaggcagggcacacuuagaaaauggccaaaaaggaacugucuaaagagaugcccauaaaugguauuaaaccauauaaaagcagaaagucuucaaaggaaaggaacgauagguagauguuuacaacagaagggcucugauguacaguauacagucaaugucauuaaacaugaaagaucaaagggcuggagagauggcucagucagagcacugacugcucuuccagagguccugaguucaauucccagcaaccacaugguggcucacaaccaucugcaaugggaucugaugcccgccucuuguguggcugaauguacucauauaaaauaaacauauaauuccuuaaaaaaaaaaaaaaaagaaaaaagaaacccugaaagaacaagugaugucucugcugcagggacucacuguauaaagcuauuucguuucugugacccaugcuccaucucacugcagucugcggcgcuaaucugacuugucuauucuuccacagugugcacagucucggugagguucuguccagaucaggguggccugugguguagcuguggggauugaugcagaaagcccaguccaucccuuggucugggucccuguccugugucagagcagagaaaacuagcagaguacugagcacacaucuucacuuucuugcuaugacucgaugucucaagcuccugccacagugauggccugcaaccugaacuugugagcuaagguaacagcugucuccccacaagccgcucucugccaggguauuguaucacagccagagaaagaaaacgaaaacaaaaacacacugggagagggccuuucugugcugugaaucaaaaaugugcccccaaaugcaguacagacgcuucuuugcaaauuaaguuuaugaggcaguccuucuaaaggggguuauuuuugagacagugucuuacgugguucaagaugcucuucaacuugcugcccuuccgcuucuacuuccugaaugcugugauuagagggcuguauguauauaaugucugguuuuauacagugcuggggaucaaagccagggcucuguacucaccaggcacacaaucuaccccugagguggaucaauuaggaaugccuugagaagucuuuacuucugggugcaauaagcuggacaggagacaaugguaacaugaucaagggcugccacaggcagcccagaggcucgaaagacacccuaucuuacuuuccuugacuugcaacgacucagaauucuggugguuaaacacauuucacuccagaaccuuagguagugaaauacaaacgcugugaggcuaugaguccauguggaguccuuccuugcucuaggaagcaaggaaaccauacauuggagcagaggugagaauaugugugaaguuuaauucugcauaggcuuuucuuaacuaugauuuacaaucgacaauuucucaaaucagaaaggcaguuggcucuuaggccaagaagagcagagcaaagcaaaacaaaugggcuauaaaauaggugcgauuuucccuaggcaugcaccuuuaaaaaauguauuguuaacuucaauauucuacaucauuuuuuuucuguuuuuuuucuuaaaucaagaugucauuuaaaaacaaaagcauucuuuuauaacguaguaagauaaaaguuguaacacaucucugacugcuaagacuaagcagucauaauuucacugugaaggaucguaccugccuucuccgccccaugcagaguuuggugugaugaucacuucucugcaguugucugugucuguguuguacacguagagcuucaggggcuuugcuucgugggucucaauaaggcugaacaggucuucagacuguacaucauaaagaaaaaccuuaagauccuguaugugagaacacugggccuccaagcuggcucccuucagaaucaaccgagaagcuuccgaaaagaacucagccucgccgggcaguggugaugcacgccuuuaaucccagcacucgggaggcagaggcaggaggauuucugaguucgagggcagccuggucuaccaagugaguuccaggauagccagggcuacacagagaaaaaccaaggggggaaaaaaaaauagaauucagccucaaggcccuaccuuagcaugaaagucacuacuuaguaccaacugaccaagcagagucuaauccaaaguccauauuaauucaagcuuguucacuagacgccagccucuggccagcuccagagucucauguguucacugugagcucugcuccagagccuggcuacucaggugccuuauuuuccucuauuucgauuuuguauguacuugcacuagcugacggcugaggaaaggaucggacuaccacagcugagcuaagggagacucugcagcggugcaugauggacaagugcaaccaaugagaaaugagccuugcuagagguacucuaaagcugucucucucugcaucacacaaagaagcugugcaaggaucccaugguuuccucacggccauccuuaugcagacaaguucagacguucccguuaagauccucagacagaagggauccugcaaagauccugaacuucaacagcggagaggcaaugucacucugacuacuaccagacacaguaacuaccuacacaguuccuuaccaggcagugcuuuaauuaccucauucaugacgguaucagcuccaaugauguaaucacugugaggucucaauccugccagcgcugcuggggaauuggauuccacuuccuaggacgacagacacaccccaacucaaccacagaaagcaacucucggcgcguuaagagugacagcucggagcuauagcgucugaagaacccccaauaucccacacuagaaaugucagauuuaagggacuggagaauauauguauuuacauuuccaaccacaaaaacuauauaauauuugauacuuaaaauauuucuaugguuaucugcacuaucagcucuuuggcuuuucuuccuugaauuaaaaacuaauccauaccuaaauggcaauggauacugaucuuucagaaaugaaaaaaacauagugucuccauaauagaauacaauccuuaaucgcuacagccuucccaaucuggagacgacagagcucuccugcuuucuacacuacgcuuacacccccaggagcaguucauggucaguaccuaccagcacaugccaaacguuuucguuggccccgucaaagcugcagaaacgaaugcuaacccccaacaagcccuggccgccccacaaguugcucggugugaccgaggccucccgcagcuccaggguuuugcugcuguagaugagcauuuuuacaggcuucucaacguuggcuuucagcagauccuucagagugucauugucuuuauucuaaaaacagagaaaucauagucuuuaauaauuaaaaauaaugcuaauuauuaguuuaagcaucucauaaaauaauuuaauaaucaguauaaauauacacucaucaggcuaaaguuguauugacagucaaauauuucuccaaguaaaaggauguuuggaaauuaagaacucucaauuauccaaucagacugcuuuuucuaauaucuaaucauagaauaccaggccaacacuggggugaucaagcaacaaaauauccuguaagaaguugcaucuaaaucuaacaaaguuacaaugacuuugcuuuuaaaaucuaaauuauguguugaccuuaaagucuaauuuuagaccuuucuaaucuauguucuguuguuuauuagggcuaaaagggaaagguuguaaauaauguuacuguacuguguaaccaaaggccaugaugucagaaacaagacaaaguaugagcacaaacuuaauaagaccauuauaaaacaaagccagccaaauagauacuguuuuaaaaauucccuuuguggaaauuacauaauuucuuuuuuaacagauuacaucaguaguaaacugaagacaguuuagaaaaagcagcuuuuaaagaauaacucuuucuuucuuugagaacaacuuuuuuuguuguuccaauaaauuuauguuucaugggacuuggauccaugaaaacugucagggaagccccauuuuccuaguccauuugccaauagucuaaaaaaaaaaaaaucaaacuuuaauauaugaaguucaaaucugaagcgauucuacuucucuaagaugaugugagacuuuaauguuuauuagcauuauccucuuaagaauuuaaauaugcugggcacaagggugcacacuuuugauuccaggauucaggacauagaggcaaaucaaucucugaguuucaggccagccuggucuacagagcaaguucugggcuauauagugagacccugccugaagaaacaaaacaaauaaaauuuaaauauauuauguguacaccugauuguguguguguguguaugugaggggggugagggggguggggggaaugugagagcacacaagagcuggcacucauguucuguaguacauaucuggagguaggaagaaauucuugagucaauuuucucacucucuuugcauguguuucagagauugaauucagguccugagacuucuguggcaagggcauuuaccaaaugagaaaucuuaguagcucccaacauaauuauuucuaaaugguaauugauacacaccuaaccuagaaaaauuuuaaaauuccacuuugaagaaguucuaaaaaguucuauguacaaaauuauaaaagguugaacuuacuaaucuugaaccguuaauagaaacaauaaaaucaaagaaaggcuccaguccagcucuguguccuggggaguuuuccuguaccuguaaaagaaauauuugaaauugaaaaugaaaucagaggugggggcagagggugcagaaugggagguccccaaaucagcagacaaccagugcugagacacaugccagcauuuauuucucaggcaccacucagcucaacaccaacaaaggagcaaugccagggcagccugcuaaccuugcagaggagaagcaaggagcacagagcggugcacaggccucuaaucacaaacuuaagcgaucuggggcuagcagagagaggacgcucucaaggggaagagguaaaguggaucaacauugucuaccaaacuuucuccacucauaggaacacuaacgccagugagagaaauguaaccuacaaaccccaaguggaaacaauuaauuuuccacgcuuuuccaaaagacuuuugcuugugacuuuugucauuauuguuuuggacaggaccuuccucuguagaccaggcuggccucauucucagggacccuugugcugggacaaaggugucugccaucauacccggcccaauaaggaauuuguauuuugcuugagguuguuuacacuaucaaaacuacccuaaaaaugaggcuugcacuaauuuuuaguaguccaggcuggaacuguuagccaucuaagucucccugaguucuggaguuacagggaugaaccaccccauccagcuuuagaccacacgacucuaagggcaauucugaggcuaugcagagugcaguucauacauauuuauaugcauaugaaacuagauauuccgagaagaacauucaaaauuguacuguacuuuuugggucaauguuucuuuccuuuuuuguguuuugagacagcucuuuuuuugcuauagcccuggaugaaacuuguucuguagaucaggcuggccuagaacucagagaucaaauugccucugcuuccuaagugcugggauuaaaggccugugucuccagcacccagccuuuguuuguuuguuuaaauuuacuuuaguaucauuagcccuaaacaacaaaacuaaguauuuuuauuuugcucaguaaguaaugcuucauuacaaagaugaaaaauuucaguguuuacugcauuuaacuuuuuuuucugcuuuauuauguuuccuuguaaauuuuggauuaaaucugaggaagcucuagagggacauaaagagggaaauggagaguagucucccuaagaugucagcuucuuguccacuaaagccacugagaggagagggcgggaaggcaggagggcaaguaucuaagcagggcuaacaagggaagggaggaccuggaggcaccguacgacgccugaccagagucgauaguggccuugcagucuaggcccaugaagagaguuguuugcaaaauguuauuuucacuuucgccauggaugggucuuccaucuuuccuagauaucuaauucuuuguccauuucagugaucccccccccacuauaaacucuuuuuauaaauaauuuaaauaucaaaggaaacaauuaucuaaagaugauaguucuaauaaaaaaguaucaaagggucucauuaauuaguuauuucuuuauaagauuuuuuugagggaugugggugguauaguggugcacaccuuuaguccuagcucugaggaggcagagguaggcagaucuguaggaguuugagccuagccuggucuacauaucaaguucuaggccagcuggaccuacuagugagaguaucccaagaaauaaaauacaauuuaauuuuuacuuacauuuuacauguauaugucuguguauggcaugcauaauaaauguaggugucugcagaagccagaagagaguauuagauccuugaagcuagaguuacaggguuguugugagcugcccagugugggugcugaaaacugaacucaguccucugugagaacagaauauggucuuaaccacugaggcaucucuccagccccaaggguguucuaguacaaaagcaaucagaguacauucuucaguuuucuuaaguggaaaauguacguuccauuguauguacuaucaaaacagcuaaaagucaaaauauccaauagauuucuccucaaauagcaacucuaacaggcagaggggacuuccuggagcauguggcacaugccaggacaagcuacacagcagagagauucuguccaaaucaaaccaaacagauccaguuauaguuagaaagagggugaagccacaucuacuagucacggaccccgccacaaguagcuaucaguuagaugugagcugcccagguaauaaaaaguuaagccaacccuuagguacccuucagaauaauuucucuuuuaacuggguccacaccuaaucugauuaucuaaauauaaaugaacuaaauguagguucuaaauggccacugguagcauuaucuagaacccaaccaguuuacugaugaauuuggggcuucuucccugaaaaguugcucuuuuaguuaaaaagagccagggagagugcuuuuggacuaucaucaacuugcaaaggugagucugcaucgauuccuagcaugcugcccuaccccccucaguguaauaaaguauaaaguacuguuugaaauggaaagccuccaauaccaucacaaguauccucccuguaacucaagagacucaaagcucagucugaauucuaaaagaaauaaacaacccuuucuauuuuuccauuucauuugcuacaaacaucuauuucaucugcuuuuaauggaccuugaaauuaauuucuuucucaaauuuaucauacaccauuagagcccagcacaaauuaaagcaagaagauaucuuaauuauggcuaggacaccagcagagggagcucugaaaauccaucucuaguuaguauuccauuugucgcaguacagaaaagaaggccuacaagguuuagaauguagcauggacauucuacauggguaggcuccucgugcaaucuuauccacucacgagacucaccagcagccggugacuauuucagcacucgcuguucuuucuaaggccucgacuuaucuuuugcuucuuucaagccuaccuuaaucaaaacaaaacaaaaacuguaugucccugauuccaaagaccauuugacacuuauuauagggucaaauauuauacuauaguaauuuaagauaaauagguuaaauuugaaauuuuaagauuguuuaaaauguguaauaaaagauaagagcuuuagauuagacggagacaguuguuuuguuuugagacagaaucucacuguguaggcuugacugacuggccuggaauagcccaaggcugggauuagagacaugugccacuacccccagcuagagcugacauaacuuuaagccauaaacgagaaagauagaaaccacggauggugaaugagggugcacauucagaaagcccaagcacugcuaguggggcuccaaauagcaauuuggcaguauuuauuaauauugaaaauauguauaccuuuugacccaauauuccacucuuaaaaguguguuaccacagaaacagguaugaaaauguucuccaaaaggagcaggaugguguuccuggcagugcacauuuguuuuagacccaaacgaaagcuuguacaaaugccuaucaacagcagacuaagaaaaucuggcauauuuucaacaguacuaaguauauuaauaaaacacaaucuagauaaagcaacauucgaggcaaagaagacauauagaaaugaguauauauuaccauaaauuccaagaauaggccaacuaauugccauugcuacaaaccaguguagcagacagaauucacacuugggagggauaggaguggguggggugcgacuggaaggaggcugcuguucaaggacuguuuguaaaaauucaccaagccaugcauuacagggacucuuaauguaauggccuaaggcaauuuuccucuaccugaaaaagagaaaugaaauuguaaucugagagcauguccacuucauggaaagugugaaaaccugaaauuuguuuguuuaaaaaaaaaaacaaaaaaaaaaaaaaacaaaaaaaaaaaccucugagcagucaguguaaaagcuacaaaacaaacuauaaaacuuuguucuuguucauucuucacagaacacuuacuucacacaauucacaugugugaccuccagcaucaacagaguaauaagccaaagugguaagagguuacugcaucaucuaacuuacugugagcuccaucguagaaaaggcagcucuagccuacaugcugacgacagcucucugaaugggugccuuccaauacaguggccaccaguaacauccacaaagcucuugacuaaugaaacuaagggcugcaacuuaaauuccaguuaacuuauuaaaaauagccacauggggcuggauagcacgcaucuacauggcaacuacaagaggccauuucagcagagcguguuuaguagauagucauggagguuucuucacugggagaaagguuaccacgcaucuaccacaauaagacagaaggcagugcggccugugaugcugggggcgggggcgggggcgggggaggaugcaauacauuuuaaacacgggauuuuuuucuucauuucauuuuuuuuuuuuuuuuuuuuuuuugguuuuuugagacaggguuucucuguauagcccuggcuguccuggagcucacuuuguagaccagguuggccucgaacucagaaauccaccugccucugccuccugagugcugggauuaaaggcgugcgccaccaugcccggcuucauuucauuuuuuuauuagauauuuucuucauuuacauuucaaaugcuaacccgaaagucccccuauacccucugccccccacccugcuccccaacccacccacucccguuuccuggcccuggcauuccccugcaccugggcauauaaucuuuguaagaccaaggggccucucuucccaaugauggccaacuaggccauccucuacuacauaugcagcuagagacacagcucugggggauacugguuaguucauauuguugauccuccuauaggguugcagaccccuuuagcuccuuggguacuuucuuuagcuccuucuuuagggacccuguguuccaucccauagaugacugugagcauucacgucuguauuugccaggcacuggcauagccucacaaaagacagcuguaucagaguccugucagcagcauuuugcaauaguaaacacaggauuuucaacaagcugcugggaagagcuugauacagacauggagacacucaccagugguugcuagguggaauggucuagaucuuguuaucccucccaaaaaaaaaaaaaaaccagcaaaguuuaugagauuguaaaugagccguuucuaccacauuaaaaugaguuugaaaaguggaaccugucuaggaaguggagacaggaggaucauggguucaaagccauccccagcuacacugugagucuaggccaggcugggacacacaaaacugucuuccaaaccaaaccaaaaccaaaauaaaauaccaacaacagccacagaacaugucuagaaguuggaauuugagucauuuauuucaaaacaagaaauuccuaauguacuguccagauacagugggaaguuuccauaggucauaaaauccaguuagggaggauuuuaggauagaaagaaauauugaacagacaaccagaacagcaaacauauaaaaaauucaugacauaauaagggcauuuuuaagggcauauucuauuuuucauuaaugugcugcuuugagcugcaaaacauuaaguuugcccaaugacguuucuggucauaaauacaauaacuuucaauuuucccuuuucacauggguuugucugaugugacugugggugugugcaugucauggugugugugugagagugagaggaccccuugugagaccaguccacgaggguuucuuugacugaacacgagugguuaggcuuugugaaccaucuuucaggucuauaacuuccaacuucuaucuucugacuucauauuaaaguuuuaccaaacuuacccugaaccaaucaagcacucccucccugcacacugacuuccucuguugucuuacugauuccuucccaggaaagccucuguagucaggguuuucuccuugcugagacaaaacaccugacagaacagccuaagagagagaggcucagcucagcucaguuucaugagcuggaggucaacugggcaggcagaacaagccacaccauggcagccaggaagaacaagccacaucauggcagccaggaagcagagaaggaaagaggauauuagaauggauuagccuaggacacagucucaaguucaugaccucaauggcugcucccuccagcuagacugacauuucagcaccucugauaaucccaucacaacgacuuaaucagggaguaaugcacuuaugaagucacuguccagaggacccacucacauuggaagccccagauagccaccuagagguguacucuaaucuccuaggugacaauuaggauugaguaacacaacacccaccuccuuuucucuggaauuaugaauuccacuucgugggacuggagagauaagauggcuuagagguaagagcacuggcugcucuuccagaggacccugguucaauucccaacaaccacauagcagcucacaccugucuguaacuccaauuccaagggaucagacacccucacacaggcauauaugcaaagcaaaacaccaaugcauauuaaagauaauaauaacaaaaaccauuucaacuucauguguuagucagcaccaaccuuuucuccucuuuagcucuccaacugggagaagaagaugaggaggggcagucucacaguaacagaaguuugagugaagcugggcacucuucacgcauaacuucuaugcuuugcagcucguauaaacacaauggcuaccacaaagcaccuggacagggauccaugggggacuuccuggauacagcaggcuaagugggacacuuauuauugugucacuguccuuguuuaaauuucaaacuuauuuuuaaaaaggugguaaguuuaaaaaaaaaaacaaaaccaaaaaccaaaaacaaggaacagaaacuaacuauaccaaaacacuaugaaacuaaaugaacuucuauucaguugggguggccauucagaacagaagcuauacacuggauugcauaguuuuauugccaauauaaauagguacuuuuaacuuucuuauuaguuugcuuuaugugcauggcuauucugcuuggugucugcagaagccugaagaggacacugggccucgugagccugugagaugccaugcgggugcugggaaucaaaccuggguccuuuggaugagcagucagugcccuuaaucucugagccaucucuuagccuauugagucuauaucuucaugcgcugguccuccaccaaacugcaaauccacaacagcuagaccuagacacacacugagcucgcucuccuuucacaggcaugcucauuaccugcaucaguccguccucuguccuccauccuccauccuaauguuuacuuuuccuguccucucuccugcaugauacacuguauccacacguauauuguuacuguagccacaugcacauaucuuauugguuagguucugcaugaggagaaccgguuuuuuccuuucugggauugugugaccucacuuaaaacucagauucuaaaucuauucucuuucaugcaaauuuucugacuuacuuuuaagaacagaguaguauuccauuuuacauacauauaccaaauuuucguuauccacucaucugcugauaaacaaauacguugauugcaaucuuuugcuauagugaauaaagcagcaauaaauaugggaaugcaaacaccucuaugguaguuugguguucuuuggguauuuguccaggaguguagcugggugauacagcuauuuguuuuuaacuucuugagaaaucuccaagcagguucucacagugacuguuccccccaccagcagugacuaaggcuuccuuucucuccacauccuguccaacauuuguugucacauuuauugaugauggccauucugacuggagugagguaucugaaaguaguucugaauugcauuucucugauggcuagggauacugauauagauucuuuuguguguguggaugugcucauggcugaggagucagagggcaacuaagguaucuuuccucaggcacuuuuugccuuucuuuuugagacaggggcucucccugaccagaacuaucaagucucagggaucugccuaucuuagcaucucuaaugcuuggauuacaagcaggccaccacaccuagcuuuuuucuacuuggguaaugggaauuaaacucagguccucgugcuuggcaaccacuaccuccccagccagacuguaccacagauucuucuuuauaaaacacagguaaaaucucuaugaauaacuguaccaccauguucccuggcucucaauuuaagccccacauuuucacuuuuguacugacuuaaaagcagaaaagauacuaaucaaggcuagaaaacacuugagugugguaggcccaccuguaaguccuguucuuaggaggccgauucaggggcauuacaacaaauuugaggcuggccuaggcuaucuagugagauccaaccugaacuacaaagugaggcccugacucaaaaagacuagaauauaauuccauguauaugggcccuggaggacucacuucaacugcacacauaaauccuuauaugugugugcuuacaugaucacagcaaugcaagauuuugcaaaugugacauaaaaaaaaaaacccaaaaccuaaaugcucugugguuauaaaagacaaaauguauaguaacgauucugugacaggcuagacuguuaggccucauuaaccaacaaauucuccuuucacgucuaacaacuggucccaugauguaaugcauaacacagaaagcaacuugaaaugaguuauuuauuaagcugaagcacucugccuauugucccaacuacuuagaaggcugagacuuuagcuccaauacaaacacaucccaucgcaaacaaacaaccccaacucuugaugacuagaaggaauuggcagaaaagcauggcaaaauuagcuuucuagaaaagaucugggaagagggggcaagaacuacccaaucccccagcuccaauacugaguuagaugcuuuccucgaggaaggggagcuaacggugugauugggcacaucaguuuaaccucucugugcuucucuaacugugaagugaggccaucaccagacggucugugaagcuggaaggcacgaagaacaccaaaugcagaagacggcccugaccaccuggguucuuaggaacaaaugacuguauccacucauagcaggacggaguaaugagaaagauaauggugcucaccugaguuucaagaaacaaacaaugucuucaaaaacgaaaagucuuuaaaagcaacaaauacuauauaugcauauacuuuagggacaggaauuaaaggaucagauuugaagcaaacuuuaacuuuuauacuuaauuacuuuuguacauguaugaaaaagagggaggaggggggagagagagagagagacagacagacagauaagacagugugcaauguacacacaaagauggguguggaaaucagaugacaguuccugggagucauuuaucuccugcugucuugugggagcuaaggaccaagcucagguugacaggccugugcacggacacaggugccuagcaagucaccuuguuaauucccuccaaacuuguuucaaauagcagcauauacugggcuaggcacacaugcagaaaguagcuacacguugauuagaaaggaacacugcugaaacuguuuauuacuacugcaagaguggaucucacaaacuaggcaauaauguaaugcugguaagaaggccaccagcuaaccuucauugagucuuuaccacaguccagagugugucauggaauagcucacuuaaugcacaggauaaccgaaggguaggauguauuauaauuuaacaguacuuguuuucaaauauuuaugucuaaugugugcugugggacugagugacgaaggugacaaaggcacugcuguagucgacuuucagacaaacaggcugucagccgagcuagcaucaggggcuggaauccaguuccccagugucuacuagacacuaguggucuaccagaacagucucucaggguaucuaugcccacuagucgaugugguuccccauuucugaaaauauguuuucaugguuucaaaagguguguaugggugaagggaagaagagaaagaaaaaugccagcauuauuccuuuuccuaguguagaaaauuuaguugcaaugcaaacagggcaguauacggucucucaaaguaaccacucugagugugucuuuuaaagaaacaagucauuuuacuagauaaucacauuuccccacgcaauaugcagucagauugcaaagcacaugcugaacuucccaaguauuuaccaguucacauuuuuuuuaaguuagugaauccugcggauauaguccuuucaguagaauauuaaagacgguuuaaaaaaaaaaaaguacaguggugucaguggcgcuggccccgaaggcaauggaaccagcacuucgcagaaucuuuaccaaagucacagguaauggagaacaggagaucuggccagugaggagcccagcccgccagauuaacuugcuugagucuuuggacagaaaguuuacguucagugauacaauguuuaaaggugcccuuggguucauguauuguguaucuggggcuguaggaagcugcaaucaucuguguccugcauuugaacguaauuucaaagaaugcuuaugaauuaaaaagcuuccugguguuaaacugaagaaaucaacggggagggagacagaaucugcaggugggaccugcuuauauagcauuauaauuacauuuggaaaacaacauuaaguagcccaguuguuuaugaguuugucaaaaaaguaguccccuguaacagggcuucuuugucagugaggcaccccuaaaauagggcagcuccacccaaugguccagguguucuuucuacaggacuaauuuacagucacuuugcacuuugaaguuagcacguaacuacuguggagucugcagcaagcuuggguuaggcuucugauuacaguggagaugcaaagcguaucaauggcccaucagucaacagaguaaaacagcauuuccccaaacuagugugagcgcuggguccacaauguccuuggagagcuccuuucucagaguguuauguaaggccagaauuuuaaaauuuauaauggccaucuaagagaccacucuaaagaugaaacuuuugagaauggcuuuguuagacucacuuaauaacaaaugucaaauggaagcaagaaucuggcauucaacauacagggacuguaggaggcagccuauaguacuucuauaaaaccuagaagcccuaaggacacauugucuguaaaaagugauacauaguucuagccuauuguuuggauuuuaaaaguaacauuucuuuaaacucugugacacaaguagucuggaacucaaaauauggaccaggcugagcuuaaacucggagaucugccugccucagcuuccagagugcugggaauaaagguguguacuacagaguucacuuuggcagugguaugugcauaugccugcacaggccagagguauaacucuuacaguuaaaguuauaggcauuugugagccauccaauuuagaugcugggaacugaacacgggucuucuccaagagcaguaugugacuuuaaccagugggccaucucuucggccuaaguacccacuuuuaaaaaauaacuuuugaaaauauucaggguguuugauaaacuuuuccuugaaaguacagcuuucugauuaauuaauuaguuccaauuuacuuaccaagaaauaaaacugcuaauuauuuaggcuguaugacuaaucuaucuuuauuuguucuugauuuuaaacagggucucagucuguaacuaagaguagccuaaaacucauuuuguacucaaacuuggucuucaacuuuuggcaauccugccuuaccucacaagugcuggauuaugggugugguugaccacaccccacucuaauauauauuuugcccacacucaacuucauuaugccacagcauucaaaaccuuuguggcauauauauaggggguagaggaaagcacaggaaaauaaagacaaaaacuccagcaguauuuaccuuuagacagugcaauuucaugaaacuuuaucuugaaauguguuuaaguguucuauaaagaacggauaaccagaaaacacagcaacuuaguaaaaugaagaucaguacuuacagaauguuaagucuguaauuuuggaauguauaauucaagugaaacaaaaagaauuuaagggucugaacauauccuuugaagaauuaaagaccagaaaacuccgugcucaacaccaggaggugcuaguuaaccacauucuccuaugaagcucaaugcagugaaccucacggcccuguuaggaaacaucacagucacaguagguaucauaugcuuccaccaguuacacaaagaagcaaaaaccugagaaaagcagaugaggugugggaagagaugcuucucugcauaaaacacacugaaugaccgcaggagaaacccugccguggucagucaccucugcaauggggauaacaguaaauauauaaugggaucacaauugcaccgaaccaugcgggaaggcagaaaaaaacacguauacgccaccuaagagaacagacaggaagacagaaauucauagcaccuaagaagauaaaguacucugcuuagaguaauugcugggucuguuuccgauugcccaaagauuguaaagcagagcugagcaguaaguacugaaaauaaucucuccaaguuuacuugauuauguggauuccuguaagauagcagcagauacgggcaucagaagagcaaauaguguuuuuaccacuaacaagugaacggccagcaaacugguaguuaccacagaaagugaaauuacaucaguucaaacaugggugaguuuaucucaaaaguuuccugcuauagacacauuggcucacaagaucggggucuguagugggacguaccaccaugccuuaggaagcaacggauaggagggagagaacucuuuuuuucucucugaaaacagagguaaggcaaugaguggcaaaaucagggagagagaggguuaaaaacuuaaaaacauuugcuuucaugacauaaucacuaaagcucccuugguuuauacccucuauacaaugauuucauauuuuguaacauuugugcuccagaugcagacugguaacuggggcugccccuacuauuucuaaagcucaaggaagagaguaauaacacaccuguacuaacuaugugugcacucagaaauccuccgaagcacaccuaugaagacgacauacuucaacugucuuccauaggaaugagcucauuaaacugaaguucuguugacaugaagauccaucuaagacccuaaagacuauuuuuuuuuccuacucauuaacacuaaugugucuuacuagguuucccuggguguuuauuauaauaaaaauacugcagcucccuaaggguucauggccacacucagaaucugcaaguaacaggauaauacaccucacaugagucaacucagaaucagaccagaugaaaaagcaucgccauuaauuuuccuacgaacccgggaugaagcaguucuuucuccuguguuuccuauuagugugggauuuaggaguuugguuagcugaaggaaauaggaaaguaauauggcauaugaagaaacacccuggaaaaacaagggcuucaaaagucucuuuugaguggaauggagagacaaccacaaucccgacaaccaggugaccaaucacaguccuaucguucagguaucugggcuauuuuaaaacguuaucucauucagaacaugcgacccagggcagaaaaugaagguaagcaagcacacucucagagaagauugucccuaaauggcgaugcagacugaggccacucuguucacagcccauguuagcacucacacaggugucaccacauuccugguuccacgaggaaaggaccguucacaggcggaugugucuuugaccccuggugucuggcgcugcguuuccucaucaagccuggcuauuuuggaaacucuccuccgcggaccuaaaccucaaucuccccgacuauuucaucuuagaaagaagaacggaaguuccucuccuccaggaaauguuggagagaucuggaagggucaggagcgacccggaacggaaaaguccuaucaaaaaucaacuaaauuuaagucugucaaaucuagcccgaggccguucgugcuccuuucccuguccagguggcccuugcaagcauccagggguagccgagaugaaccgacaccggucgugacaucuccgcuuagccuguggcuccgucacccuccccgagaacacagguacggguuccggcuccuucuggaggcggcgccccuugcucuuccuaacucugaagcucaggccagugcgcggcgaggccgugcggagggccaggagccaggguggugggucccgggccacgucgccggcagccgcgcccagggugcuccgcggacucgggccuggccgccccggcguccccccgggccuuacccgcaaaacgugguagcccucggugccgccgcccgggaucucgacgcucugcgaggagcccauggcggcgggcgauccguacgacccggccggcucagcgcugcuccgccucgcgcaccgcccgcuuggcgacuccgcguagcucuugggacguggcacuugcagcagcccgagccgggccgcacagcccgccgggagaucgucgcccggcagccacggccgcugccacgccgcagacagcgcccccugacgggagccggagggaacgaucggaagagcgcagcgggcggaggcagggagcgcgagaaagcggaaagacagcccggaacgcgacggcucgcuacggggccccggagcagacaagacuuaucucggcgcguuucuaccuucgcagaaggguauuuggucgcagcgccuccuggugaccagaggccagagaggaagggagcagaugccgagcacgccuggcgcuugcuuuguuuuaggucuuguuuaauaagauuguauaccugaggauaguucacagugccuuucugggguuggaauaucagguauucucagcucacguuuauaaagagcaguguucccugaaauaaaagcgguuacuguuu

SEQ ID NO: 843 - RNA, 4382 nt, Mus musculus
auauuuaaaagagagucauauuuaaaaaagauaucauauaagagucauacuuaaaacacagagaaaaaucaggauacaauuaacaauuggcuuaguauuuaaaacaguaucagaaacaggacuacauuccaaauguuuucagaaaaagccugucuaccaagaguuuuauaucuagcaaagucaucuuccaaaacccaagaggaaauugcauggcagaauaaugacuggaaauauacauugguagccauccugcuuuucaauugcuaaaggaaaugcugucugaaaaauggcauagaggggcucauagucacgagagaggacgacgggaaaaccugaggggaagacuaaagacucagugcauguuuucuucaguagauguaaaauauaacuucaaggcacagugaugugaaggguggagucaugacuacagauaagcacagagcacgggaauggggguggggacaacugucuuagaagaaugacuuuuauuuuacugaaauauaucucacuggaaauagaagauuguuauaaauuaauguauuuauuauaagcucuaaucauuaaggagauaacuugaaaacucaaaguuuaaaugauauaccauaaaauauauauuuuacaaaaaguucauaaaggaagagaggguagugugucugcagcucaggggcagaauguucccuuaguuugucaagucccuggguucaauacucagcacuaaaaggaggaggagggaggaaagaaggagaagaaaauaaaggaaagagaggaagggagggagagaggagagggaaggaaagaaaaggaggaaaggcagaugugggaaacaaaaccauugacugcaaggcugaaagaugagaccaggauugguacacuaaugcgaguuguaucuugagcaugauggcacaguucugggcaagguggcauccacuuaacaauucccagaaauuaagucaagaagagugagagcucuggccagcccagguuaaccagugagacccugucucaaacacuaagggcuaggaaugugacugaaugcagaagggcuugccuaccaugcacagauauuguagugaaccccuaacacugcaugcacaugcaugugcacacacacaaaugcacaugcacacacagagagauuaucuauaguauucaaaugcaugaguuuccuaaaagcacauauaacaagagauguacacgacuccuuuggugagcacaaacuuuuauuaagacaugaaaaauauuuaaguagagauauaguauguuccuggaucagaagcccccaucaugacacagauucuuccaaagcagcuuauagauucauuacuguuuaaauuaucagugcuuuuaaaacgguuuugauaagcugauaaaauauacauagaagagcgaagaaccaggaagaaucauagcucucaaacaacaggagagacgaguaccacacuguguaucaggagcgugcauuguacuggauacagaaaugaacagaguagggcgagaaccugcaucuaagacaggagagcccuacagcaaggagcccagagacagugaagcccaggcugauucuuagugaacaacaacgaugaugcuccagagccgcugggaaaggacaggcguucaauaaacagugcuggcaagccuggcugccaaucagagaaacaaaggucugccccacauugccagagacacgaggagagguccaaacugcauggaaccugaaugugaaaggcaacacucuaaacuguauaacaagaaaauaacuuuaucauuuuuaccuagaggucugguguuuacccucuggugguucuggggagugaacccagggucuuguagccgcuaggcaagcaugcugucucucagcaacagucccagaacaauaaagaauaauuuuuuuaaugagaugcucaacaagcuaacaaaaauaccaauacauuuggacauauuaaaauuaaaauguuaguauaucaaaaccaucauaaaaagacauggcacaaaguaggaaaauguguaagacaaacacauaguaguauccaaaacaugaagaauaucaugggcugaagagaugguucagcaguugaaaggacuuucugcucuuacagagaaccuggguuugauucccagcacccucguucgacauuucacaaucaccugugacucuagcuccagggggucuggcacuuuuuugagcucuggagccacugacaugcauauggugcaucacacacacacacacacacauuuuuaaaaaagaggcacagugaagaauagaugucuacauuaucuauagcagcguugucuauaauaaucacaaacugggaaaacaaaugucagucaagacuaagaucgaaaguaaagaauaaugcauccuauaauagaauggacaaacucucauauguauuuagcacaagaagucucaauuucauucauacaaauuucaaaaaaauaaauaagaauaggucagggcuggcaaaauggcuccgguaaaagcucuugcugcccaaaccugaagaccugaguucaaaucccggaccccacauggaaaguggagaaaacuuauucucaauaguuauccucucaaccacacauguguugugacauguguacauauucgcauacacauagacauaugugcaucauugaugcacaagaaacaagucaagaggccagccuggaugaaaguagauccaagaggccagccuggaccacgguagaucuugucucaaaaagggggaagaggaccacaguauuuaaggauguauaugugagcaggaaaaccaagcagaaaugaagacaugguaaggggaugggguaaagacuggggagaagugcacggguacuucuggcugguugagaauguuguauuucuugaccuggucaucgcaugaguacuauuuuaaccuguaugcacuuuucugugucuaugccuuagauacuucauaugccuucuguauauuuuacaaaaagaaaauguacagaugaccaguaaaaaugaaaagacagcgaauguucugcccacaccuacaauuccagcaccuuauuggggagaccaaagguuaccacagguucaaggcuagccugauccacauagggaguucccagacucugagguugcaagagugagacccugucucaaaaaacaaacaaacaauaaaaagacauucauucaagcccauuagcaauuagaaaaauaaaaacugcaacagugaccucuguuuaugaucugccugugaaccgggcaaucuuaacuugcccauggggcaggagauugagaccucugugaacagcaauguggcgagauguauacaaaauaaaaaacccgucuauuuuaugaauuagucccuaacaaauacuaauauacaauaacauaucaugacacacacacagagauauucuccucuaacuacaguguuguuaauaauaaugaaaugacuauuuuaaaaaggcuucauaauccauacagugaaauaauacacagcuacuagaaacaggauacacuuucuauaaacugauguggaaagagcucagggacauacuaagaaaaccaagucacggaaucacacauacauugcauagcccugguucuaaauauauaaauauguacauauggagauguauggaaaacagaucacaaauuuaugcucuaaccucucagcaaaggaugacaggaaugcugguugaagaggagguagcgagggcacuuugucaucgucuuacacacacacacacacacacacacacagacacacacacacagacacacauguaauuucauguccuugaacuacuuguauaauuuuaacaagcauagcaagaacaauuaauuaugcuguguguucaguucuaaugggacuaauccaacacauuuagaaauagccagcuuucaaauaucuuuuguucuuaggguuucaagaaagcucagaguugcagauacaggguugucagccaccaacuggugagcacugugaggggcacuuggugacuugggccaucuccagguucaccucuaaugauaucugcauauauccucacagccauggccacagccgugcuuucccagagcuauucgcuaaaguuaguaaguccugauguugccagcuaucaaguaacagccacaguaaauguggcuguaggucagaagcaauuguuaaagaguaaauaugggcaugugugugugugugcacacacacacgagagagagagagagagagagagagaccuucugaggaagucaucuccaucugaacuccuagcaaggacccaggcucacaaaaucaccauguaggaaccuccccgcuucccucccucacuccacccgaguuccuucuguaacaaaauaugcauccccuaggagcaggcgagugcagacaaaaaagccccgagaggag

SEQ ID NO: 844 - RNA, 1177 nt, Mus musculus
gucuuucuuuuuuuuuuuuuuuuuuauuuuuuucauuuaaaaugagauaugaacauauuuauuaggaugcucaauaaugaacauguuaucacuuucuucaugugagguagaauacaccugacccaugcugugggaagaacaggauaagggcucccaacacgggcaucaaaugguuccacaagacauccccauuuaccaaggagaggauguuuccugcuagcacugucucugcuguaaguuccagcaaauugccacgaucuccacaauacugccccagauacgggagaauaucaggcuacauacaucaaagauacacaggacauuaauaaacggcucccagacauaggcccaacaucaaauuucuucaaaugauaaggggugggagacugcuacccaaaggaaguuccucagugucaguaacauuuauggagaucuuauaucaaaggcacaagggaccaggguuacugucauccuauccugcacaguggaauaaguuugcagaugaaaguauacacuguccguggcuuaaguuucuccugguucuuccuguuguuaaauggugacauucugccuuucaccuguccuagcuaucauuucauuuuuuaugguagaagauaaugaagagauggugaaaaauaaccguauuaagacaaaaauaaaaauauaaaacacagauguaguacaauauaauaguaacuggcugaaaauaguacaugcuaacagacaauacgauacacaaacaggguggcaguagacagggaagggcagaggccacggccuacaccaggagccuuucaauagacugcugaauggacuggaucugcugcuuuaguugagagccuucuuugaugguaacagaacaggcgaugacuggccuggagacaccacaggccuguccuaaagccugcuuggagcgcacaaauacguagaggacauucuugucuucacacagcagagggaggugcgggaugaucuccaagggcucagcgucugcugccaucacaaugaacucagagaugccucuguuggggguuuugguggcuucauuggcuccuuuccgaagcugcuuguaguuacaugacuguugaacaagguccagcagcuucuuggugaggugggcaucugcgaggggauaggccuucggauucacaucagccucugucaugcgacucgauga

SEQ ID NO: 845 - RNA, 3349 nt, Mus musculus
cuccaaugaaaacaauaauuuauuuuaaauaaucucuucauauuguaaaaucaacauuaagaguauguugcuuucauaauaaauaacccccaaauaccuugcauuucaagaacaaagacuuuaggacaagauaaaaacaaauucaaaucaguagcuuaauuuaacugagaaaaauuuucaaagggggaaaacauagggacugcugaggucacugcuacgucgcagcuuucacaacucgggggcgguuuacaaaaaagucugaaaagaugagaaauuuuuauacaaauaaauguggggaaaucugcacagacacccuuauuuacaaacucugcaucgaaguucgagcuaauaguccuuaauucaucuuaaaaaagauaauuuaaacacauuuuuugcagcguccacauauuaaaaaaaucaguuuuuuuuuaacaucaaaaugaggucauccgcaaaggcaccuaaacuuuuaaaaaaauaaaaauaaaaacccuccacuggcaauggaugaaggagcuacgggaguguuccuggggaaagugggaggcgggaagaguugggagagcugggaauucucccccaugagcccccaggaggggaaaaaaccggcgggaucccgggggucacggggguaggugauaggguggaguaggacccaggaggucaauaaccgaagcggacuggagcugaggccuggagcaggagagaaaaaaggagccucugagagccgggaagccucgagggcggggaaggcgucccagugccugaccccgcucagggccugaagagaccaaggacccugaggaucacgcugagggggcugggaaggggcgacaaguccgaggauggccuaaaaguggccggggcucaggucggaauugaggccagggacgccaggcuuggcacuaaaggaucccacgaggccuccuuguuuccggcugcuccguggcagugcgagaaguggcuccacgacgggucaccccuggucgccacuuccaauaccgcuggguggguggcggucgcgggcugguagguucgagccucuagcuacaggacgcgugcugaagaacacggugucucaguucucaagucucagacgcuguccacucgagguuagaaaaucguccccgcgcucaccggggcgcccccgccugcguggugguggugaugguggugauggugcgccugcggagucugcgaaggaugcagaaguggcgcuguggccugcaggugugaagcggagcccgaagccuggugguaccacggguaguuucccagaaaggccgaggcggcgcugcucgggcuggagccagagcugcccgcaccgccgccuccgcugcccgggccgccgccagccauccgcugcggcgcgccgaagucccaggaugcuggcgccgagaccggcggggaggcacaaggaggagaagcgcuggcuccagggugcugcucgguggguaucucgccgcuuuuccacaucuucuugaacuuggaucggcgguucuggaaccagauuuugaccuuuguagaaaaaaaggaaaagcccugagcuuuaguacaggaaccugggcaggagguugguggaguggagacggcgggcgagcagaccugggcucugggccuccgcugcuucuagcuacauuggggggaucucaaaaugcugauggaugagcucuaaguaugugaccaagguucuggguagugcggugucaggucaguuauggaacccgcuuuagcagcagcgaguggaaaggcguuguagugugggauuucuguccacccgggucauuuucuuuccucccaugcggcugcccccuuugaaaaaaauuucuuauuuuguuuguuuguuuguuuuaagcauugggccuagaaguuuacuuugcccggaauaaaaaagcacaggugaaaauauacuuuugaaaaguuguuccggacgugcccgcuuccuagagaaagcaggccaucucccaccuugcucaccugaguuugggugaggcccagggacgccgccagcucggcucgcucuggcagggccagauacugggucuucuggaagcgucguugaagggccgccagcuggaaacuggaguagauggugcgugguuuccggacuuucuuuggcuucccguucacuauucggauuucaggcucaaggucuuccuugucugcaacgaaaagugaguggugagcacccaccguccaaccccgcgguccuaaaguucggagcggaggccuuuagagacuugaggaggccuucccaacuucagcacgcgccgacuggccuggccacggaacccugcaagggacccgggggagcugugcaagagagaaagaagaggcgggcagcaaagcuaugcgcuacccacagcaugccaacuggcccaaccgcccaccgacucugucccccggagcguggagaggcagaaacugcgauucgcgugcaguuggagauugggcagaguucagggcgggagcaagagaugcacagagugcaaggcuagagcuccggacugccccccaccccaugcuuacccggucccuccccgugacuugggcacccuagaugcuugcgaugcuuacccggcucguuguugaccggagacgaacuggugccguagggcgcguaggagguguacgcggcgguguagcccaggucguagcugcuuuuggcggaguaggagacauuguugaggccgcuggcgugguacugguaggagcccaugugcgcguagggcgaggcccccccgccgccgccgcccgccgggugcugcugguugguguaguagcugcuguccguagccguggacaccgggaggguuggcgacuccuggggcuugugcaggcugcuguugcugcugcugcuguugcuguugccgccagggccggcgcccgcaccgcucgggggcugcuggugcuggugguacgugcuggaggcggugaucugggucgagugcauaucagccaccagacugucaaagacuccagucauccugacccgggacaggaaagagcacggguggcgggcgagagggggaugcgaggcgccuccucugucuaucucuccgggucccuuccagcaaccaauguaauuacggggagggggagggagaggaaaacaagaaaugaggcuacggucuaggcgccuccuccccuggaggaggcgaucaccgugcguggcucgggaccgcagcugcuggccgcauccuucccgggccucucggaccucucggcuccuggcccggcucgggcggggggcgggcaauggagggggcaagagcggucagacccgguaggggcuccaggaggcgggagcaggugagcgacccccgagcagcuuuacgauugucugccg

SEQ ID NO: 846 - RNA, 11552 nt, Mus musculus
cuaucgacaaaucauacauuuaauagucucccaaaucugccaaggcucauggugacaccuagacauaaaucacagacauaaauacggcaaccaccaacgaacuugaugaaacagauggcaauuuggccucugcuucauggccgaccgugcuggucugcugugagucaucuccuuugcauauuccacucgcuugcuggccaggcuggccaugagauuuccugguucccuugcugcuggagguggauggcuggugucaggccugaagaggaauuuaucuucuuuguaaacaucuagaggcagagacauugguaagacagggucuuccuuguagggaugggaaauggugcauucaugacaagcugccuguccucaucucaaacguaugucccaguaccuugccacucccugucucugcuaaguauccacuguccacuuaggccuuguagcucuaucagagagaacauugagggcagaggccuuuuuguauguaaaaaguucuaauccacaaacacagucaaauccaccauacuuuaccagaugcagagagugauucuccaacaccaggcuagaacaagaacccauuucccuggguuguaggguggucacccucucacauuccuguaaacagagaaaaagaaaagccacacaccuguguuaaagauucuucaagggcaagugacugacugagaccauaaagaguuagaauguugcagacccaauuccgcagagcuauuuuuaguuccuuugaaagccguccauugcccaggccugugcaucugaccuaacacccuguucuuagcagagcuuccaccaauccaaaggccaagccugucaucagauaacgucugaaaccuaaaucagugcuuacuuguggucuccacaaauguauuucagguuggacaaaugcuuuaugacccuuuuuuucguucuguaacuaaugaagugucuguaaccacuuccacgguggaauaugucauuugagauaaccugaacccguguuuucaggccauggucaccccuguguagcucucccucccccugcccccaucccuauuccuuugagguaagggcuagcgaggcuuuacauccaacacauuaacauuggaaccuacacccuaugauacugucggagcuaggacacaagggcuguucagcuccacacuggccucguguuuuuguggccucuccuccucuucaucacggucacaguuacucuugccuggcucugcucagcucaguucugggcugcugcaggaaguggggcuucggggaucuuucccauugggauucuguuuuaucucuagcagaagagcugcuggaccagggugaaaacacagcguuggacaaugugaaacuucccagggauucuuagggacucacgcacccaucgauaccuuuagcaauguaucaagcuugccucuuccaaaaucuuacucucuaaaugauuauaauauuuaaauccaaauaacuugacguaucacuccagagucucuuuucuaggcucaggacagauggaaucacaugccuucauuugcgcaggaaguccuggcaagcucccuaugagcugcaaaguccccaugccccaccagccacccagccacccagccacccagggugcuuuccuaccugcaaacucaagcuuacucuggauggacaugagucugcacagcaaagcauauggaauauggaguagagcaucucucaguccguaggaaggcacagcuaugguggagccugaagggguggccccaggcugccugcucuucagccuuguccuucaacugacuguacuguuuuuuccuaugagacgcagggcagcaucugagccugcugacacuuucugguuuguaauuaugcaccggccauuccuuucaacuccuggaucuccacagaugcaguaagugugccuccugggucuuccuggcaacucccugauaacaagugcugcccagaugucagcugacgucacccuguccuucgagaguuaaauaagguuggcuggagccuguuggcacacauuccacgggaagucaacuggccugggguuuguagucaccuuguucuauggucuuccucuaaugaucugggauucacacauauucuacagcuguucucuuagcuggggcucaugccaaucaggcucugccauuggccuuaaagaaacaggucagauaauuugagagacagcacgguagauuuugcuuugagagcacucugccugguguccuucugauggcugauguggaccugcuaggccaggguccagccuggaagcauacagcuaacaagccaguagccuucuuucugcaucuucuuuucucuccccacugcccgagcaaacagcuggacagaacucuguucuaugagccaccucugaguucugcccuucaugguaccugccucaccaacucucagucuccaggggugggggcugggacgggcagguguaaccaggacucaagucgcuagaaugugcaggugucccuucuguccuugaaagcccuucaguaaccgcggcagagccugccuuuggucuccuuuccccaaacguuccucaugaguacccacagagccacacgacagaggacuucccaacacaaccaauugcugucaccuuucuaaugcccauaugcauguuuauauaaauacacggacuuauguguagguuuugacaaauaugagacugugugcuguaaauaacguuucuuuuucuuaacauuuugaguaucuuucuggaucaucagauucuuaaaaacacaguuuccgaagggcgugguggcuggcacaugccuuuaaucccagcacucuggaggcagaggcaggcggauuucugaguuugaggccagccuggucuacaaagugaguuccaggacagccagggcuaugcagagaaacacccccacaaaaaaaacaaaacaaaacaaaacaaaaaacccacgguuuccugcagcugugcuguaucccauauggucucccacaugcaaccauggacacucagguaacuuccaguuuaacagaagagacccccagccgccauucucuuugauagucacucccauuccaugggagguaaugagauguucaggcuuggaauggagcagaggggacauauaucagaugagauaccuguaacacugcugcucaagaugcuaauggugggauacagaagaugaaguagucaggcagacuacugcaugcuaaccaaacacuaucuccaccccugcuuugccuugucuauucccacugccugggcacaagucugaaugccauuugugcucuacaaaacaccuucaaguuccccgcuucauaccaaccaucacacuaguucucuuacagucuccugucaagguagagagccuaaauggcucuugaccucuauagugauauuagcucuguccauggagccaaguuugagaugugcaguacaauggacucaguccaggacugggcaggcuggagauggagagagcauuagacaccaaaggcugaugacaacauuccagcagugauucuccgucaccucacacagucaggaaggccuauuugugguuuuucagcaagccacugaccggucagaacaggucuuucuguucugucuccagguucagcagacacccuucaggucauuuagguuggcgagaaaugucaggauuucuaagacagugugcucgggggucagaugugcaggagccacauccuggacaggacagacaccugccuuaucagccagggugugcugucagccugugcuaggaauaguuacauuucaaggaugaaucugaccuaagucugucugaauguuaucaacaaggucaaacuugauacuaaauuuuccuucccuagaacggaaaagccuuagucccuuugauaagccuagaagguccaaauuagaauucaaagccacgauaagggagagggggaagggauauuugucugggaagagauaauuguccuggagggacaacucuggauacaaaggacacagauauagcccacaggcaaaaggcuggauuuaggaggcaagcaugguggcacaggccuuuaauucccucacuuaagaggcagaggcaggcagaucucugaguuugaggccagccugggcuacagaguaaguucuaggauagccagggguacacagagagacucugucagaagaagaagaagaagaagaagaagaaggagaaggagaaggagaaggagaaggagaaggagaaggagaaggagaaggagaaggagaaggagaaaagaaaagagagagagaaagagaaaugaaagaauggaagaaaaagaaaaccuaaauaaauguaagaauaaauaaauaaauaaauaaagguaaaaggugaaauccuguguuaggaugaagaguuuaauuuuaauugggcauguuuauuaggugagccaaaaagggacuuuugauugcuguacuucaauacuuugauagcuaaaccaugguuguuagccucaggggagaaaguggccaaauaagggaauggaccuugggggcuagcuuuagaaauauaaucuaacauuuucuaccaaggcagaaagaaugggagaagggcaagacuugccagggccauguuugcugugcuccagcugucuagagucccuucaccuggucccaggaaugucaguucucaaacugucguuacagauggcugugauccaucacaugggugcugauacucaaacccagguccucagaaagagcagccauugcuccuugaaugaaaaagauacauaaaaagaagacagaugggcuggagagauggcucagcgguuaagagcaccgacugcucuuccggagguccugaauucaaaucccagcacccacaugguggcucacaaccacccauaaugagaucugacaccuucuucuggugugucugaagacagcuacaguguacuuacauauaauaauaaauaaauguuuaaagaaauuuaaaaaagaagaagacagacuguuccuaagggcugaggcuuucacuauggcugcaaggaagagcacaggcagagguagacacaucugggagaguccagagugaacgcaaccaucagacugaguccugggaggagagaugagaggggagagccaggaguuagccaggagaccaaaagggcacaaagaggccaaaagagccagucuagacaaaauaucuggguuauauagggaagagcagcuaagagaagaacagcccaucucuguccccgagcugaagaaguuuaggguaggagacuggguaugccagacugaagggcccuguaacagguggggacugagggaugcugggagaaccuggagaccaggucugcuuugauauguuaaaauggcacagcagccauuuguucugccucugagaccuaacacuuaaccauugagcucucuuucuagcccucacacacuuggcuacauacagccagguuggcccugauuggcagggugugugugugugugugugugugugugugugugugugugcaaguaaaugaagugugaaaugggauguaucagggaaguguuuccaaaucuggauaaggagaagaaagcugagcgagauaagaacaauccuaaucagaccagcccaggggucugcuuccugcugauggcaggaaagcaggcacuuggcugucaaaaggugccugagaacaguuugcaucuacugucuaucagcuucugguugcucugguguggauuagaucuccuucaggcgcaggggggcugcccuacuguguaauggcuagcuagcucaaauaggugugagucaguugcagggagguuuuuacuuugauuuuccuuuuggguugcaccugaucucugccccuauuggauuccaaguuuuucauguccauuuccaugcagcugguagauuucagguuggcucucucuuguuacuccuccuacaucuaggaucguccaguugaccguggaggugggccauccgacucagccuaccccagcuccuugcccuggggcuauaaagcucugauuugggguucacauccuaacccuaucaucagcacccaugcugggugccccuuuugugcuuucagguuacccacugugggcuucucaccgguagucuuguaaagucaccucaguaaauccccugacucuccaaacuagaccugggcagaacuguuucucuggccuggcauuggcauuucuucuaggguaaagagaaguuaguuugccucuccccaggaagucacacagccauuaauaccuuuaucaauuuauucauagauguauggagcuuaccucuucaagaaucuuguucucuaacugguuauaauaaguaauuucaugaaaccuuaggaauacauugcuaauaucaaauagaaaacaaccaaguuuaacagauuucaauaauuugccuccucucaaaauggagccuccugguuuuguucaauuagcagugucacacaguuuccuggggucagcagacucaaagggucacuuucaagugccacaugacacaaucuuaucuggaccaacaacuacagagaggccagaagccagggcagggagcuucagcaugggaccuugaauguguaucagcucuccaagagcucuuaaaaagcgcacgagugucucuuaacuuccccugcauuuacuuucuccauguguagagucucuggaagcccaggaaaccgagagacccucaagaaauccucacuacucauaucuauucgcuuuccccagacuaacaccaaaggacucucuugcaauacuguuuuaucuuugcuuagggaugagucacaucccguccaucccaagucucuuaacauucuauuaacucugaguuauagaaaauagcugugucuuauguugacgaggcagagauuugagaagaugcuauuaccuugcuugcaucuccucugcagcucuccuaagacaugggacacuuugugaaauaaccugcugcuguacaaagcuagauaggagaagccaucugacaaaugguuacuacagauauuaagguggaaaggaagagagauguagaacuuacauacaccagcagccucauuugggacauuugugcauccugcagcaauuugcugucuuugagaacuaccucugaccacuauauuucuucccacgggagcugcaaccagcacuguguuuacaccaugacucuguucuauuucacccacaacccaugggaccaaaacugagccaaagacgcugcugagaauguuggauugucacucagaguacuuguaaacccagaaaccuuaacaaagggaagaagacucaagcacggagguauguguccaucauccugauacuuaggaaccugaggcaggaggauuucaaauugaaggccaggcugaauuacauagugaguucuaugucagccagcacauaccuugucuaagaaaaagaaagaagaaaagaaaugaaggaagagaggagggagaagaaggggagaggaacaaacaagaacagcuaccagagcuguguccccaccuuuagagagugagaagauggcagcccuguuggcugcagcuuugucuugcuugaacccaagcugccacggggucucagcaacauuucugucuucccgggaccugggauucugggaucacacaagacauucccuugcuucucaaaugggcuugugcauuuggcuguggucauucuacaugaucugauugcugcuugagcuugaaccugcuucuggucaacaacaacaacaacaacaacaacaacaacaacguagauacagauaauacaaaguaaccaaacauccaaaaguauugcaucauacagacaucuggaaaugggucagaagcauugugaaauuaauguacuugaguuacugaauuuuguaacucuucacacaauagcacacacccucaaaaucauccugagcugcaagccugccauuuccuguugugcccuaggucugcuuaucucugcuugcuguccugacagggcaugaacccaucgcucccucuccuugcuccacggcaucucccucgcaugcuccagugacguggaacucauucuggggauguaauuuuccugauagccaugagaagaaggcaacaggcuggggggaaaagcagaaggccccugaguucuuuugggaaggaucuugccauuggaccuuccacacuguaucaagcaacagugacuaagaacuucaguggcuggguagccacaaaagggucaauggcagcucacgaaugcugaaggaagacccaugagagggcacuuguuuaaguagccaggggaauaaauauuccuucaggaaaaagagagaaagugacuguuugagggaugucagggugucuggacaagaaaacagugccaagcuugggcacacuuugggacaauggaucaaggaucaugagugcaggggaagauccuauuccuguaaauaggauccagaugugucacucaagaaagauuuguccaaauuaugacaaaauaaucuuuucuuuuccuuccuugcaaguaaaguuauaugagaaacacauacacacacacacacacucauauauauacucacacacauauauauauauacucacacacacucacauauacauucacacacaaauauacacauucacacacucacauauccacucacacaaauauacacauucacacauauacucucacacacacacaaacacacacaugcucauggacacacacaaugcauacacaugcucauacacacauacacacucauggacauaccugcucacaggcauacacacacucacauauacacacauaugcucacagauauacacagacauuacacuuaaaugcaugcuuacaggugcacacauacacacagcacagauacacacacaagcucacagauacacauucacauauacguacaugcucacacacacaaagacacuguacuaguuaauuuuaugucaacuugauagaaacuagagucaucaaagaggcaagagucucaguagggaaaaugcuuccauagccaggcagugguggcacauaccuuuaaucuugccacuugggaggcagaggcagaggcaagcagaauuuugugaguucaaggccagcaugguuuacagagugaguucuaagacagccagggcuacacaaaaaaacccugucugagagagagagagagagagagagagagagagagagagagagagagagggagagggagagggagagggagagagggagagggagagggagagggagagagggagagggagagggagagggagagggagagggagagggagagggagagggagagggagagggagagggagagggagagggagagggagagggagaggagaggagagagaggaucaggcccucaggucuauaagaggggaagaggagcaagcuaugauagcaaaccaguaagcagcaucucuccaugguuucugcaucagcuccugccuccagcuuccugcccuauuucaguucuugugcugacuuccuuugaugaugaacuaaugauaaugagccuaagccaaacaaacccuuucuuuccugacuugcuuuugaucaugguguuucaucauagcaauuugaaacucuaagacacacacacacacucacauacugucacacacagagacacauacucacagauacacagacacacacagauacacuuguucauauacauguucacagauauacacagacacacagagacauacucauacacagacaacacagcuacacacauuuucaauacacucauacauacucacuguccuuuuuuuguuuuuguuuuggggauuuuuuuguuuugguuuuguuuuguuuuguuuuguuuuguuuuguuuugagacagaguuucucuguauagcccuggcuguccuggaacucacuuuguagaucaggcuggccucgaacucagaaauccaccugccucugccuccugagugcugggauuaaaggcaugcacauacucacuguaaggguuuuauugcuaugaauagacaccaugaccaaggcaucucuuauaaggacaacauuuaauuggggcuggcuuacaguuuuagagguucaguucacuaucauuaaggcaggaacauggcagcauccaggcaggcauggugcaggcaaagcugagaguucuacaucuucaucugaaggcugcuagcagaauacugacuuccaagcagcuaggaugagggucuuaaaggccauacccacagugacacacccacuccaacaaggccacgcccacuccaacagggccacacccacuccaacagggccauaccuccaaauagugccacucccugggucaagcauauacaaaccaucacacacauagauacacguuuauacuccuacauacacauaaagauacacacuuacaaacauacugaaacauaggcacacacucauacacauucacacagacacacacacuuguaauauacacucacacacagacauacucucucagagacaugcucacacacacacauacauacucacacagauacacacacacacacacacacacacacguccucauagacacauagacacccacauacacacaaaacauauacacaccuacacacucacauauauucacacacagaacacauauacacacuuacacacucacauauauucacacgcacacacacacucuuucucacacacacaucuucaugacacauucuuacacagacacacauacugagacacacacacacaaguaauucuucuguguguccugagagauuuccucaugguuauucaacauguacacaugcuucauguucauguaccuguuaaauuccaugguaaucuaggauuccugcuaaugcacagguaguggugggguggggggcagagaggcagcuuugguucaccagagcuuugucucaucacaaaacaagguuuccaggacccuggggacccuucuaacugcagcugaaaccacagucucuugcaauguuacugccucgucuaaaggcaagugccucuagccugggccagguuucuuugucuccugucuaauguagcaggccauucuggcugagcuuuuugucccagaaugccagguuuugccaacaggcucucacagugucuuaacagacaggcuaacagacaggcugccaagcucaggcccggcgcugguucauuauucacaggcagggcucuccuaugacacccuggcuggccuugcugucaccucuuuuugugggagcacuguaacaucuuggcuaauugugcagccagucacagguccugccuuguucgguagauaagcauggucaaguuccaaaccuacugugaacacaggaggcggcuucccagcucuccacaaagcccaggcuguuuaacuuuggcacucugggcuggagugguuaacaccugagacacaugcacaaagagucacaggaagagacaguauggucaccagagccccagcacugggcuucucuucccagaauggcauucccaccuuucucugccagcugguuccucuccaugcacugcaaaaccugccuccugggagacacugaagcaucuggcagagucacugcaucucugaaag

SEQ ID NO: 847 - RNA, 7585 nt, Mus musculus
accaaaccacaauggaacacaaagggacuguagacaucuuaagcaguguugcuuuaggaagcauuaaugguuuuuguuguuguugugguuaaucaaguccauuucucccagcugucuuccagagcccucccaaccuccuguguaggugggggugggaggguggggggcucauggaaguguguuuggggugguccucugucacugucuagaaguacugcugguugccucuagcgugucugccuuggagaagauucagggcuccagcagagccaucaaauaucucuucuucagaucaacuggacaaaggagguuggugugcauauauauaccuauugagaaaagaaaggcgugcauauguaacuaagaaucauuagcugugggggguugaggaagugggggaggcaauaauugggauguaaagugaauuaaaaaaaaaaaaagaaucguaaguugaaucucuuguucagcaguaugaaaauaagaaguaaaagagacuucuagacuucagaggcaguaagguaugggaacacgggugacugucacugacugguguaugacuauuaaaaucccagugucuucaguaauaucucuccagccuuccuaaaaagaucuuagaaagaauacauucaacaaagcauauuuacauuucugauuaugaauguuugugacaaaaggagggguuuguggcuucauguaauccugcagauuuugccgcuaaucuccccuucauuccuucgaauuaucugugcccuggguguccuggucucucgggccuaucuuagccuuggguggcucagcaaguuacccaggagacugcaggcaggaauuuccauucucuuuacccccagguaacacugccuugggcugccugggaagacuacagguaagacuguccaggaaacuucauuucuaugacaggucuggucuugacucugucuuucucaucuuccuaaguacgacuaaugaacaaagacuaugacauagcugucuguauugucuggucuggaaagcgguuucuuugaaaaaaaaaaaaaacccauaaauuggauuaugaagccuauuguucuuauguucuaggacaaaacaaaagccacagcuucaggcuucaagcuggauaaaaacgacgguaugucggauuuaaagagcccagaaaucugucggugagcacauuuuucugcccaugugugccagcugaccucauagcucucuugccuuacugggucucugugaugagaguguguuugagcacacacagucuaccagcuggaaucaucagggauucaccuaaccugacccuaagucucacccacaugguggcuugaaacccucugucaccccugucucagggaguccuuaguuucagucaccuauuaucuaccuucucuuaugucagagcccuuagcauucuaaaagacccagacaaauucauuuacuagcucugggaaaaugucuguccagcccuucuugcuuccagucuucaauucucugugcuauuuaagucuacaaccauacacacaccauauaaagagaaggcaagucacgaggaagcccaacagcucccugagcccggcuucauucugguucaauaggucacugggguuccauccaauuaaaaccaggggcauuuccaucuucauauuagucuauagcgguguguguguguguguguguguguguguguguguguguguguaaaaggcauggaguuugcuucuuagaaugugcaaaaauccuuuuaccaugcuucagguagacuuccuggaagguaacuccuagaauuacuuauuuaaacaaagccugaaagucugauuaaugcccaacggaagaaacagugccaccgauuaauauuuaacugcuggaaggggcagcugugcuuggguuuaauaggucgcagaauaaguuggcauggucucuaccuugucagcacuuacugggucaccucauucccuggaccacggguucuccuuaccuucauucccuucccccucuuucccacagagauucugggaagaaacguucaagcuaugacuugcuaaccaaaggcguagccgagcuggaguuuaauauuuacuuagcugggaaaugaucuaauuaaggaaacuaguucuuaacauugaaaagcccuaccuggaaggacagaaaugaauucccccaaugggcucuguucuggggguggggguggaggauucaaauagaugucucuagaccaaaguuagacagcucuuccuuccaaaacuccgcagagaguguaacuaggauuguugguuaaauguucaugaaugccugaauaauuucuagaauaauagcugacuguguggaacccccgaccacagacagugaauaaagaguaacugauauccuaggguagaaggagaguuuugguguagagaagcaauuuaguuugugaacgagagagggaaccaaucaaccuaggccaaauccuagcuguaccccuauuuccugugggaccuuugggugugacucaaaaagcuaagucuuuauuuccucuuggguaaauugugauaauaguaucuuucgcaugguguucuggagagaauuacacaaaaauaauccauguaaaauauguaaugccucauaaucacucaggaauuaucuguuguccuuacuugcuuauucauagaaccauccauuuagaaauaugccuugugucuacaguguaccaagcaaugugcaaaaugguaguaauaaguaauugugguuuucccaaggggacaauucagagggggagcuaauagccaaguuuccccguccccgcccccauuuauacuuaguagcaauguuguaaacguguucugagugaggugcaacccugugcugaggaacuccuccgauggagaguucgaggcggacuuccuuggucacagugaagcugggucuuuaugagaguguuggacuuuuucauacagugaauaacgaaauaauuauuucagaaagaaaggacagccucaaaguuuagcccaguggcacacgccuuuaaucucagcacucaggagaccaagacaggugcaucucugaguuggaggacaguguggucuacagggugagauccaggaaagcaagggcuacagagaaaccuugucucaaaacaauaauaauaauaauaauaauaauaauaaaguuuugcugcuaugaacucgaauacugucagggcaaacaauaggcugugaguaauucucugaagagauuguacccauugucuagguguuauugucuaucugugcuguggggaagaggcagucacagugggaacagcuuagcacuaauguugcuuccacuaaacucucaggaauucuugaauccauaaccuaauuuauaacucaggucugggguuuauucuggauuucacggccagguuuugcucuaccuagugagcauuccgauuugcucuggaauucuuuucuacucaacagaaaggacgcuagcauucacacuuccuuugaccuggagguacgcuucugucaaugaaugcuucauguaugcucgugcaugcgcacguaggcacacacacucacagcacauccauauguugggucugcuucccaggugcugauauuaagaucugcaaguuuagcagucaaacauaguuguuauuauuuuggagauguguuucuuuuuacuuuauggguaugaauguuuugcugccauguaugugugugugguaaguuucuguguuugcugugugugcaguuucugugagggucagaagcagaaaauagauccugugacauggugucauaguugugagcugccaugugaaugaugggaacugacccugggucuucugcaagagcaucaaguccucuuaaccaaagagccugugguuccagacccuagacaugguuacuaauagcaugguugcuccuaaucauaguuauuauuaacauuuacauaagcagcaaaugaacuauguucauagcaaauauaauaaauuaccaaaguucagccagguaguggugguggcucauaccuuuaaucccagcauuugggaggcagaggcaggcagaucucucucugaguuggaggccagacugaucuaaagugaauuccaggagagccaauuacacagagaaauccuaucucaaaaccaaaccaaaccaaaagccaaacccuuuuuaaaaauuacuaaaauuuuuuccuucauaauaauuugcgucuaugagaucuguaugcuuggaguccugcauagugugcuguguugugccuauacaccugucaccugcucugcauucauugaauccacguugcuaguuuaaaacugauuacgguaggagcauuuauaucauggaaauuggcaaacacuacaaugaggccucuuauuucacugcuucauugugaaccaguuccuaucagaccacuguacauacauacaugcaagcacaggccccaauguagaccucuugcauaucuguaagcauagauggcucuacuuuuauacuaugucgcaguacaguacaacaugucagggaaaacugggucaugcaugaaaauauuguaucauauacaucauucauaauuacagccuguuuccaagauauguaucugccugccuuuugcgguaagucaaaugucguugcuaggcaucagggcacucagauaucuucuugagcucuuuuaaggagcucuaugucaugaaagacucaucuucuauguaggugcaugcuauucucuccuuuaacucagcuccacgucggagagcgccgcuggcauagaaccagaagucuuaacacuuucccaaguccuugaaggaguaauugcucaguagccaaagauaauuuacacugcuugacucuuucggccuuucucgcuaacagaaauguauuuaugaauucagcggcugucacuggaauauuauucccuugcugaguacaauuaagccaagucuaaagcucagaauggaaccaaauccugaauaaauacuguuuuaaggcugauguaauuucuugcuuuucuugcaaacugcaauugaacaugcaaaucuaagggaccagccguacaggaggccagccaauauguuaaggcuuuuaaucugcuuaaugggauaaagguugggcauaauuaaauaucuuugagcuugaaucuuucacugcaauaaguaaaugacuuugaauuaaauuauuccagggauaaaacaaaagcacuuauuaagguaugaauuuugaaagaauaacuaacucucugucuaguuaaggaacuugggccaaaugccugaaaauuaucuuccaacuuaguaggaagcuggguuccuucgugcaggcuuuuccuggagcccgggcuuuuccuuucguguuuggcuuccauacugucccaugaacauacuggauggcuguuggugacccaaaggucgcuucaaaggcugcaaauuccaagcaaagcuugccugagggaguuuguacuuuccugggauaaagugucugccucuggaagugaggaaagaguccuuucacugcuggagcagaauuccugugaagugcucacaagcaugacaucccccugccucagauacuaucuggaaacacuguucugagaucugagucuucuucucgcugcuacuuugccugcgacagcuguggucuaaacagcugccucucugcaaacgugucuuugcucccagguucuaggcucaccugucugccuguuguccagaaaagaguucagucuucccguuaagcaucgcaacaaacuaguuggacaggacucugcagcauugaggcagccuagaguaccuucguaggcuauguccagggaucagaaggucagcaggagucaacgaggcugggucacuagaucccugcuuaaaggcaaaggcgucaugcaaaagucacaagacuuguggcugguugcuguacugccaccucucauguccccagagaucuacucauccuagaauuuuaaucuuggcuuuucuuugcugaguaauagaccuucccccugcccccccccaucuacauacucauguauuuauagacagauucacagacaugcaaagcuauacucuuggguguaugugugugcauauguguaagcccuaauacucaaccuugcuucugauuaauuuugacauauuuuucugccguaacacuauauuguccuuucuaauugugaccuacauuguggggucauuuacacuuauuuugauauucuacauuuuaaauuccaccuguuauguuuucuauaacagaacuucuuuggauccaaugcccaucagguauuuuauugguagaauggauucuguuuccagguugacucauuuaagcccugauaaaccagagcccuggccuccucagcaacuugaagauuaucaaaaucaccuuaucugaaugggggaggggggaccggguggggggaguaaguauucagcuguagugacucagccaacuccucccauucccccccccccaaaaaaaaaacuauauaggagaccguucuccaugaggaaaugaagguauaaaacguuuuccaagauccagaggaagagagacaagcucaugaaugacaaaugccauggagggccagagugacuguuuguucaaaaagcuuuugaauacgaggcuccaguggcccaucccauggguggcugugcccuucagcagacacagagccucugacuacuaucugcacgguccuccguguaguguuccccacagccagaucuccccacauccacggacaucgaacgucuggaauaccagcccugggaauuuccucagcugugcuggagcuugggaaggcucagcauuguuuguggagccauggaggcaaagcuaggaacugugugcugcugacuggauaccagguggucuccucagccacagugucuuucccgaaacuccacacucacucguguggagucacucaggaaggucucugugcguggaaccucaaagagacaguccaaacacuugagccgcuuuagaaauuaauggucaggaaugaguuaguuaaaaucuaugagagacugcucaaauacaccucugacucccaaauccugcagccuuuaaaaaaauuagugaaugaaaauaaaguucuccgaaucucugaagcccuccuuccccacgagaggaccuugugcucuggacacgcaccaucagcauuucuauuuaggggcaaaccucagacagagaaauguuuaccauugagccgucccagcacagugaagugacuuuucugucacugaggucacccugccaugggccucucacuuccucuucagcugcuaguauuccagcaaucccugcgaugcagaacugcccgcccagccaucucucacccuuaaugacaagggggacugugaccagucacauuuucucacaguucagaguugggucuuagaauuugucccaaauccuccaaucccccuuggucuucucagauccuugguuuuguuuuguuuuuuuccucgguggaaugcaucuggagcucagauacaggacucacccccaguguuggagcuuguaggucacagugacauccaauggauucauuaacauagcaaugggaaagagacuagaaggccgggcuuccggggaaugccacgcuuuuguuuuaaauccccacauugaauccu

SEQ ID NO: 848 - RNA, 10737 nt, Mus musculus
aguuagaacaaaauguuuuauuauuaaaauaaaaaccuuuguauaaaagcauuacagagcaaaaagcuguauuuacacugaaugauucaagauccaacugagcaccacagacagaguacagaguaggcacagcugacaggcuacacaggugagggacucagucacuucgucaccaguacugaaugacccaccuguagggaaaggggagggagggugacuucaggcacccacccauaaacuacacuggcagagagguucaaagcuacccaucucuaaaaggccacuucccaucauuccaaaaguguuuaaaaccuaaauauauagaaacccuggacacaacccccaggguuaccucuuuaggaaacugccaggaucuaaagugacauuauuaagguuaaguuccugaagcagaacaccaagguuucagaucaacccgcugcugagcuaucaucuuuaauuucccagaacaccuuuucuacagcaauuuuuaguaauuaugguaccaaguucccacaaaccuuugggugacuggguaggccagaugacagcagcaacagugucagcugugacaagacguacacugagcacagcaccccagagauguauuccuccagaaagccauccaauguggccauacuccaguuuacaacaacuaccuaauucuuccucaugguuuccggcccuuugugccuuggcccuuuccauuuaaaacauuagccaauauaaacacuagacacuaaacuaugugcguugauucuguguaaacaaguuaaggggcucuucucugugauucaucacaaccguugcuucacaauacuacuguaccccaaagugcuuggguauguccugaucacacaaauucucaagcugccaguuaaagauagcucagaaucuaagugguggcaaaagaccagggaggcuacaagguggggccggggcaagcucugagacacuacauaucgcugaaauguaaggaguagcaugccuuucaugaugcuucagaaacaagugugagauacgagaucaacgcgaccaaguucuaaggcagacggauggccgagauucuuacucggguucccaucaacacaacgucgagaacaagagagccuucagaggccgaaggcgggcagacaaucuucaggcucuacgcuugcauuucaaauuccugcuucagacugugaaagacaaaggggaagacgucaaaacgguuuucaaccauuaauucucuuuggaaagucaaauucuuccuuuaaauaaugucuuuauggaccccuaacauauauugucaguggacaucuuagacacacacacugaauuuuacauacacuccccacccugagaaagaugcauuuccacuaacauuucccugccccagaccagccacucagacuucuaucaucuuuuaucaaggcacauaaaugaauggaagacucagaugugaaagaaagaaagaaagaaagaaagaaagaaagaaagaaagaaagaaagaaagaaagaaaggaaggaaggaaggaaggaaggaaggaaggaaggaaggaaggaaggaaggaaggaaggaagaaaggaaggaagaggccauuaccuuuucaaguaagcauggacguucccgaagccaugauacuuugccagauacaccaggacuccaguggcgcaccgcccaucacgcuggcggcagaagcugcaguugcaaauuccucgacaaggugggcagugccaauucugaagaauugugggaaagcgcccugaggcuaggcuucaugcuccauccacucauuuguuuaagguuuuuagucauuaaagaacuuaguauuaauccauuuaacccgugaugauuuaaauaaaauaaaucauaaaauaggaguuuuggguccaguaugagagcauuugccuagcauauguaaggcccuuggccuugguuugaacccuagcaagauacacacacacacacacacacacacacacacacacacaccccauaaaaucaauucaagaaaguuacacaaccaucaccaaggaaaaagggaucagcuucucugggcagcagcccugugcucucugcaguuauuucauuauuucaugcagcaucacacuguggucuccugacaccaagagcucaagccccaccccaaguaucacagccacuuaccggauccagcagagcguccuugaccuccucgccauagcgguuucgaaggcagggaccacagaauuggccccggaugccccagcagucuggguuucggcaguugguuuuggugucagugguuuucuggcgacacugaugacauguagaacccuaaaaggaggaccggaugagggaaggagcaaacgcugcccuuugcagagggaaacagagagcacccacacuggucaaaaaggccuuugaaggucaucugacaccuacguguguaaggaugagaagcaucccaagcaaggcucccauuccaucggggguacaacagcgucgucaaaacuaucacucagugcucagugucagaauaccugcccaacccacucaagacccugaguuugauuuucagcgugggaaaaagaaaaucccauccaaauccauuuuucaucuuuggcucucugcuacagucucagcaaauaucaguaaguucacccuaacaauacacaguaaauuccaguugaaugaaucaacuucuaaauuaaaacaaaaaauguauauaacccuacuguagaccuccuauacagauaauucgaucccagacaugcuguaaaacucuuucucuuuuaugaaaaagaaaugugcaguuaagaaugcccagaccauaacuccgugcagcacccucaggacagauacuaucugcgcucugcaagguguuucgguuucuagauguaaccucagggcacucaccagagagcgguuauaaaucuucucucucgaguugcugcagauguuccuaaucucuuccucugugacuucuucuacuggucggauuauaugcggaagggucauggauccaggccuccgacuucugggcacaucaucguccugaagaagaaucaugaaccgaguuccucuccggcucucugcauccccaaaucuccagaugcuucguuuagaguuucauaagaaagucaaccugggaaaucucucuugcuuauggagagagggggcaggcccuacguuuacuuaagaauaacuagccgaaaguauaagcauaauuccuacaauauugaaucugacucuugcccacuaacaaagcuaaguguguguguagcucugaugacuugggaauggucugagacuguguuggugaugccaagcuuccuagagauggacaacaucacccaucagugaggacucacguucauguagcuguccauggacuuccucugucucaccagcauguacuuauccucuuccuccuccucuuccuccuccucuuccucggugggcagggcacccaaggagcccaggauccgggaccuugaccugguaagaggucgaguucuccguuccggguuccuucugguagccacaccugggaaugugcgucgucuaggcgacuuugacuggcaaaugaaacacacaagauagauccacuuacuccguaacagagagaaccagcacuguggagagccugcaucauccccuaaguaguuuuaguauaagaagaggcccccguuuucccauuuucuuugccuuuucguuauguguagaaaauaaaccccaaugccauauagccacugaaaauuuuauuuauucuucuauuuaauuuuucuaccauuuacucuucuacuccagauacugaauauauuaacacccaagcuccugacccaaaaaccuuuccuguaacaucucuacacuccuggaacacguaugcuaucuacauauaagcaaagaaugcccgguuucuucuccccauuucucgcuggcuuccagccugccuuccaagggagaagcaaggaacgcuggcuuuacuuuucugcuauagacaacacaacaaaccacccauccccggucacaccagcuuugauccuugggauacaaucaaauaauuauuaagauuauuaagucauuauuaagauaugacuugacaaagagauuguauauacuuccuuuucccucaaucucuucuuaaaaauaccuacuuuguaucuagcauguggggggcaaaaugugcuacuugagggaacagaaauaaguuaacuauuuuguuggcugcugauggggagcagagagcugaucagaaggagcauggccguaggagagcagagccaacguguccaaaaugcagagagcagggagagcuucaaggacccaguucuagccccgcccccauauaaaaacaagaucguaaagucucagagaucugcucugccuuguucacaacaggauagaaagaagcacuuacaucuuuggcucuguggccugggagggaaugucguccagagaacaagccagggaagcuuucuaauucugacaugaguuuugcaagcuaaaaaggggaagagcguaaacagagauuagaaccggugacaacaggcaauuuguagaaagaaggcuagccugccccucaacucuccgcuuaguaaguccacauagucagguuucucauuucccuacuaggcuuauucuaacucuuacaggauguaaagagcggacggaugggggcuggagggcuggcgcagcugcaaaaggcccuuguuacccucgcagaggacccggggucagugcccagcagccaccugagaucucacaaccaucccaaaccccagguccaggggauacaaaaugcccucuuacggccuccaagagcagcugcacaguuucacccucuacuccacguaaauaaguauaaaucuuugaaacaaacacaucgucaaaucccacagcuuacaaacaguucuuaggagagagaagaaaggaacugcuuagaagaaaguggggaaagguuuggguccauucaaauaccuaccauugcuuuguucugcuuuauauuuaaggcucucuucuccagaaaguucaugccaucuucuucuucuucuucuucuucuucuucuucagagucagagugggaaucguuugcagagcucucagagggcuuugggggcgcugcuuuuuugcuggccgcccuccggguauuucgugccggaaacuucauugcuacccugagaggcccggagugccggcacugacuucggguccugcagccuucccuguucaacugcagucucuaguuaaccagagagaagguguuauuaaaaucugcccaguggcagacaaguggcaccacaaaauccuuuuggaauaaaggacaugagcaaaaucagucuuaaccagucagcaagguugguggguaacaaaaucaagucuugcaaaugaauacucuguuacugguguaagacagugucugagccacccuuacuguccugagaccuacaugucuaaaugauuuuuuaauaaauuccugcccccuucucauucccuuaaaaauaaucccuauuuucaaaagauccucuagggauaacuaaguucauccauaaacaugguuuaaaugccuaugacgguaggaaauaauagccuaaacuaucaacuuccaauucaguuuuaacugcgauuaaaauacacauaauauugccaaucucugccaccccaaccccuggccuuucugucuuugaaccugacuagucuagguaccacucaaauuaacauuuuggaagucaagaccuagugagacaucacuucauaccaacuaguauagccaaaucuguaagcuugcucaaaaacuaaacaguuucuauguaucccagccaucuacucuuagguauagacgcaagaauauauguccacauaaaagcuuuggacauguauguucaggacagcugcucucauuuuuacauguaugcacgugugaguauacacauggaggccugagcuuaagaucaggaggcauccuuaacauuacuaauugagacagggucucucaaucaaacucagagcucacugauguaaucucaucuuacuagucaucuugcucuagggauccuagcucugccuucugagaagcuggaauuacagauaggacacugcguccacuaggcauagguuucuugaguucuuguacuugcagggcaagcugagccaucucccuagcaccuccaaaaaaacugagugggccgaggacuuaguucaauggaagagucuauguuuagcauaucuaagacccuggguuugaucccuagcacaaacaaguaaggaucuuucggguagcucuuaguacuucauguacauuuaguauucauagauggagaucauaaaucaaaccuguuauggauucuuagcucuuucaaucaacaggcauuugauucagcacaaguaauaccuacaaagagcuaugagccuaccuagaguagucaagccacaaacaaugggucacacccagaccuguagacuggccccagcucacgaaugccaaucaacaccaauuuggaccaaagucucucauuagagaaaacaugcguagguauagauggugauaaaauaguucuagagccaagugcugucacagcagagccagucaagugguggccugcagggaauguggucagugacaacaacguaaauaacaugcgggugauuuguaacaagugcacuucuuugggagaaagucuauagaaagcaugcuaugcucaggaguagggaguaaggcacaggcacaggcacagcaggugacagagcugagcgaaaggcagcacacccagggaaagcagacacagaagcaagaagggcccuaccugcuaugagcuacgcgguccuaagggguucuagacacaggaacaacuagaaccaugggacccggcucugucagcuccaugcuagcacuggguugggcaccugcacguguaagcgccaacgguagcuaaucuuuaggacacacgugcuuccugcgaucaggucagcucugcagcuaaugguaaucuggaggcuagccaacuuuacuuagcaauuucccaaaaccuaaaaaaaugguuaagaucuacaagcaggacauuaguauaagaauggcuuuaagacaugaagaaaauauuuauaaucaggucaucaaaaucuccgacauggauggggaguuaucagcucaaaaagccaaugucuccugccucucgguguaccucccugcuugauacugguggaauucucacacucaccauuccaucuuguaucucacucucugaaaaaccgcaaaauaauuccucaucagagucggcaugaaaaaugcuggccaauuccuuaguggcaucuggccuugguuucuguaaaaauccagugacuuaauacauccugcaccucacccuuugaaaagcugcagaaagauucauucucagaguccucauuacaaaagaaagaaagaaaaaacaccaaaaacaugagcccaguucuucacugauaucugaccugaauuuagguuucuguaaaauaaauaaauaaaugugcauguggauuuuuuuuuuuccuuuuucaagaaccaauuuuccauaaacugugcagagagcaaaucacauuuacaagugcacucacuacaggagaauggcuuuuguuacaaagaaaaaugguucagagguuuacaaaugauuucugaguuguuauagcaagucaucagucgcguuagguuaggcgacacuucaaaaggacacaauaagcagcuaaucugccuucaacaauuaccaccuagaaccacagcaaagagcgaggcgaaaugacagcgcauggugcaguuuccuaacggcuguauagaaaugcaggcgaaaaagcaagcgguuuuuaaaucgugcacaaaguguuugggggcauuuggagcauggcagacucgauccuguuuauucucaggcagcacuuacuguguuugcaaaauuaucagaagcaaagcugucacaacugucaucggaggaggacgaugucuccauggaaaucaacuucauauaucugacauccuuuaaguucuuuacuuugagagccuuuugcugcggagagaaauggcaacaccauugaacagggugcuucuggccauacaggacuacucaacacaucaguucucagucugguagguuuacacagcagaguagacagacggacugaaacuuuuucagaccuuacagagaaaaaugauuggcaauuaccaccaaaaaaauaaauaaauaaaaauuaaaaaaauauaaucaacucaggucaaauucuaaggaaggaucucuucaggaggucauuuuaaugguacgcaucaacuuagccucuggauaucugcaguuacuucuccucccaccuuaaacuccgaagcauuuagcauuauagaacuccacagagcuuaacaccagcuccuaaaacccagccucauuuuuucucauugaacuguacuucuaaaaggagauuucaaaaguacaaaauggaggagcaauuuuucucccucagccaaaaaucaagcuaaugaggucuuuuuauguaagccuugggcucugcacugugaugcuaauuuccuaaacuacaaaaauugggcagguccuguguuuuaagauggcagucacccaaacaggcgccgcucgcuccaaggagaggggcauggagguuuugcagucuuuacaaaucaaggguuaucagcccgaaaauacauaguacaagaagccaagucagaggucaacuaacacuccuaggccagguugaagacuggauuccauaggaacucucugaccaugggcuccauacagcuuucucauggcccccagaaggcuugagaauucuaagaccugugguagaagucaacaguaagcauuucuagcaaauaaaggucaaguuagucggaauuaugaaaaaacuccauucauuuuagcuuacagccuuguacuguccacuagaaaauguaaccaggacagccuauuuggccauuucuuauugacccaaguugggccagccccaccagagugcccaaggguguuagggaacagaaaaugccuagauguugggaaagacuuccuuccgcaccuaacacauuacauuucagucucucggauacaauaaaaugauuuccaagauguugguggcccagccuccacaucauguuccuaaguagacaccaaucaaccauuuguguaugcuucugauauccuaauggcagcaaugugugguauucgagagagcuaccaaauauuguauuuacaacaguaguucgaggcgguggguggagaguuaggaguuaaaagggauucaaaagucugcccagguuucugguagaggaaguccaaggcaauaaggugcaacaaaaugcaaagaacuaagaaauccccaaaacggcacacagcuccuuaaaugacuuuaauucucuacacucuacuaaucaauuuaacuccaugucagccucaggggaggcagucaaucaaaagccaucaggaaaagaggcuaaucuuuaacaagccaggacaggccaacggucagucauucaccaggcaaguaugucuucgauggaaaagacacacaaaaaaggagagccaaaggucgugccuggggugaacuuuuuuggcagauguaacucuuaauucuguuuacggugaguguucuuugacggcagauuugguacugauguucgcuuaauucuuugcagcgacguuaccaucacuuaaauaaguaagaaaacugaagugcggagaggugaagucgauuccuccagucagguguccaaauaugcaccaaggcaagccaaacuccaagcccauuuccccacgcgcggagauccgcuaugagaccacgacuccgucuacccacucagaccucgccacaagggcccccgaacccgauauuuauuugaagcacgucacugucuuccuuuccgcccauccccccacucuucaacccacuccagggcaggacauaaguucuggcuuccguuggagcaaaaagaguuacguuccagcucgcagcugcaagccgggaagaaaagggugggacggguggggaguugggggacgcagggaagguuacuaaacggucgcggcacacgacuugcaucgcugggccccaaaauugcaucugaccacagccuaggacuaaaacaauaccuccccccacgugcacaacccaaguucucaagaaaugcucacaaggccaucuacgcuaaacccgcagauccagagugguuagaaggggacgcagagcaaaagaggaucgaucccagggccacuagugcacgcguagguaacaacgcacucgccgccagcgggucgugcagggugaggucccagaagguggaaggcugggauacgaccgccagacaggauggccagcggcgagucccaggccuccgcgcgcacguggagcaugagcgcccgugccgcagguuccgggaacgcuggcaacuccgugcgcgccggcgggcgcaucaccuuggccuugaguuauccugggugcaaagauuauaagaaaaucgaucugugauuucccucaaccuggcgacaaucaggagcgcgugggacaagugagcggagcuaacccgcggagucggagggaaguggcccggacccgcccgugucuagcacccaccaaccccgccccggugcacccggccgggccucacccgcgcgcggcgagccuccauguuggcggcggguacccaggcacucggaacggggauaguucgucggaacacaccagcacucagagcccgaacaacccgagcuccgggacagaggcggggcgcgcacuccgccgccggaggggcggggccaccg

SEQ ID NO: 849 - RNA, 45176 nt, Mus musculus
acaauaauugggauguuuauucuugcuugagguagauuucuaauaaaaguauuguggauaguguuuccuacucuuaaauucaaccuuucuuaagcaaaaguaucuagagguaauagacaacguucugucuguuguuugcagaacacuuuuuucuccugaaugacugacugcaaggcauugaggaugucaaaggaagggguguuaauacaccacuaaguacaaaauuuaaaaaaaaaaaaaaaaguaacuaaacgcucccaagaggaaggauacuuuuuagauguacuguuuuaacaaauguugacugacuuucuugguuaagaagcagguaguuugugugugcagcaaacugauuuuaaagggugacuguaucucauugaauaaaaacauaacuaagccugcuuugauaucacuggccagaacuaaaaccuuuuuucuuuaugaagggacuggagauaucuuuuugcucuaagugcccgccuccaggguccacaaaaguagaugguugguaaccacgggcuaagcucgggaggaugagaaggugauggauccgacuugcgaccaagagcugaaugugugugaaaacguccuccuccagccucggagggggugucucccccaauaccagcucccucccccagggcucguggggcggguccgguuugcucaguagcagcagcagcccuggggccgagcggcgguggccuccuggcagcgcuggcaagacgcagcuccgagcgcccgggcccuggggagauccaguccggucggcugccaggauggaggagacgucgaguggagccggagccaccggggacggacuuccuccccagcucggcuccccgacagccuggcgaggccugcacacagggccagccaguggaagaggccugcgccucgggucuggcagccgcagccgaggaacgaggcuggcacagcgggguaacgcgcgagccggggccguucuggagaaccuacggcgccacggccgcucauugucucuccccuucaacccgggggcaaacaggaagcccgccgccaggccgagcgacggacaggcguccggaccaaugaacagagcugacggagagccuagcggcaaaugagagccgggaagaggggcggaacuuccgggcgggcugucgcccucuuccccccuuuugggcuggaggcuccaccuuuuguguuucccgcacagucaaucaaaauaggaaaaaaaaaauuccccggaccgcuccggccguguccgccgccgcuucccgcauccucucccgccgccgccgccuucgcuucucaccauguguaaggcggcggggagccccgccugagcuguccuaaacacacuaugaccgguacguaaagccgagagagagcaacccucgcugccuccgccgcugccacugccgcccacagccagcccggggccgccaccgccggcucccggccuccgggagcgugcgaccgagugucggcggaggcagaaagccgcacucccaucuccgccagccagcuguccagcccuuccagccccagcgccgagugcccgccgggcuccgggcgggcggcccgguccgccgggagcgcauccccccugugugcgggcgcgggcggcggcggcgggcgggcgugugcgagugacugacggugcgagaggagcgagcgccgcggagggaaaggggaggagaggagaggagaggagagggggcaggggcagcgcggggaggaggaggagggaacgaggaggaggaggguuacagccgcggcgggcgggggcagcaggaggggaggagggagcgcgccgccgccgccguggccgccgcggccggggggagggcaggggaggggcagggcccgggccgcccggcgcucacuaauguggccgcggcucgcgggcccccucccuccccgcacccgccuuccuccccaccccacccuccuccuccccccuccccccgcgcugugccugcagcucccgaaaagcccgugaaacaagaggaaauggcugccuuggacguggacggcggcggaggcggcggcggccacggcgaguaucuacagcagcagcagcagcaacagcagcagcacggaaacggcgcggcggcggcggcggcccaggugaggagcggcugagcgcggccgggcuccccgcgcgccgcuuucuccuccccucgcccucccuccuucccucccucccucccgcgcgcgcucgcccgccccucccccgccccgggagcugcccgcccgaggcgccaacgcuccgaccccgcccgcgcgcccccgcccgccgccuuuuuguguguguguuugugugugugugagugugcaagugugcgcgcccucccgggugggauccggacggagggaagaggcccggcgcgcagccguccgccgcgggccaccgagcgcggggagaggcgccgcagaccccggaggaggaggaggaggagagcgcggggccggguuggcggcgcggccaggcgcggagcgagccguacuuccugugcgagcgggcccggcccuaaccgccaccccccucccugucucccucucugaacccgcccaucgcggguaggacacucagccgucaccgcucgcucugcuggccgcuaccugcagcaagauagggccgccaucgccgggcgacgacgacgaggaggcggccguugccgccgccgccgggguccccgccgccgccgccggagcgguaagucccgcccgcccgccaucccgggccugcggcgcgcccgcccgccagcccgccagcccaaggccucccgccgccgcgcggccgucacgcgcgggccguccggcucugccgcgcuucccugcucgcucgcguccccggugggagcccgggccggcccgcgcuuuccggagauugucacugcggcaucgcgcgcaaaauuccucacaaaaugaagucugagacggaggagguggggggugggcacgggacuccaaaauggauguuuaaguaauucguaucaggacuugaaaacucacucgcucuuugcacuacauuugcaagcacagccuaucggucacagauaguaucaccuaccgaggcaaggauggcucuaguuucuagaguuuuugaaucuggagcaaguuuccagaucuuggguauuugaucauuuaaggaggguguucuuuuauacgcagggacgaacauuuuuauuauuauuauuuuuuaaccugaucauucagaauuguuggcguuuugcagacuacuccaacuuugcacuaguuuuguucugaguaggguuaagugaaauaguugggaggcuauugaaauuugaauuugaaguuaguaauaacuuuggccuuugagguuuucuagaauaucaaucuuaaaaaguagaugaaagucauuuuguuuacaugcuuguuagcacacuucauacuuuuaagaguugaaauugguuggcuaaauguuauuuuuauuauaacgagucugaugggauucuuuuguaaauuuuagaaccucuagguuguggagaggagcggcaagucuuagugaagacucaguguaaaauuaggugcuguagacaaugugaauuuuacaucuguguggaccauugcugcucuuagcuuacugugaaaagguguguucaccuguuaagauaguuaaaacacgccucaagacuaaguuuuuaagagguuuauagcaaucgauuuauguagugucaguuuaguugucacuguuagaaaaguuagcuguuguauacuagucauucaacguuguuacucuguauuaguaaauagauauuuuuagucugaaauuagacuauggacagugggagcauuuuuaaugucauguauuuuuuaagcauauuaaaauaucaaaagcuguuugggaaaacuuuuaaauuuaaagaaacguuaagcagauuaguaaacuuuuaaaguaaguuauauuucccuagucccaaagugucaaauuaaguuuauuguuuuccuuaauaaacuaccucagaaguaaaauugaaaaauaaacuuuaaauaaagugcaauuuuucauguaacuaucaaaguuucagaaugugcuuacagauggggaggggaguggugaggagaagcacaggguugaaagcaucaugcuuagacuccaacucuaguggaucacuagacugaccccagccauguguuugugucauguucuugggcuucuuuaagaucucugaccuaucacaacauuacuaagaacaccauuuccugccagaugaacaugaacacucugaauuuaguaaaaguaauaauaugaaaauacaguuugcuagagaagccucuaaacuuggaauuuuuuggugcauguuugaugcucgauaaaucugaguucuuccaaauuuuucacuuugagcaaaguugaaguaaacugagcugaaaguugaauaaggugaaaaauaugagagcugucauuuuugucugaacauuaauggggaaaaaaguugguuucuaguuuaaaaguaguuuaaaguuuuuuucagaaugcuuaaaagauauuuucaauauuuaaaacuauacuuaaauauauuuaaguacucuaaaauuacuggagaucacuagaggaccguagugucuugaggguugugggauguuuuuagauuuagggcaaagcaggaaauccagugucagagucacgaccuucaccuuuacccagcuaccccccgugcugccuuauuguggcacaguuuucaaaucuguguaucacuaacauggguagcuacagauuuugaguuuugccaauuuuuccauuaauguucauuuucuaaucuagguucuagacaaagauaucuauuaauguguucuguccaaagccaaaugcagaugcucaaccuaaugacaauuuagcuugguauuucuagaugaugaguaccuugagaagccaguguucacuagagacugacuuuaccauuugaguuuggaacuuauagaggauccuggccaagggugugcagagcuacagauuagacagacacagugguuucaucuauaaugaccuguaaugggcauccagagaugaugcagcaaaguuccuuuguauuuuauuauuaauaauuaggaaaugagaucucugcgaauauuguccaaauuacaggcaugaccuuaaugauaauuuauuugugcuuuugugaaauaaacuauacaaacauauguaauaagaaucacagguuuaaguuacaaauucaauguuuauuaguuuugcagguaaauguugccacauuuaaaaagugaauacugauuucauuucaagaguagggaguuuuaccauuaagaccuuacagggcaggauguagcuuagugacagugcuugccuagcauuuauuugcaaaggcuuggcugccauuccacccccacauacugaguugggguggggaagaccuuacagugcccuugcaguuugaguugacauuuuacuugaguaucugcucaagaauuauuauauuugacuccaccuuaguuucacacuuguucugauuuucagguacacccuucuggcuuuuauaaagccauuaauggggcuaagaaguuaaucauuauuucaaaaugcagugagaauuucuuaucccuuuccacugguacaaucuaagaagacagaccuuguucuuugcuuuuccuucacucuccacccaucauuuuuaugccucauugcauuggagaaugcccuugucaugaauugcuauagcaacaucauugggugugccaccaccacccaaggccucuguagguuaugguccuuuucaccuuguuagguguauagacccaggaggaaugagcaaugccuuuuacaucaacuuugauguugacgauuuuuuccuuguucauuuucuaauaagaauauuagcgugacugacugagacuuaguuuuauuugggaacuugcauagaggguuaucaggcaccuaaggccauccaaggccuggguuguauuaguguuucccuuuguuucuguaguauuuccagucacugccuuuugguauuggaugacuuucuaauuuaucacuucuccaucugguauuuaaucuuuucuauugguguguuaauggaacuucuuuuaugaaggaaagggcuucaaacuucaggcuuuauaguguuggacuauuugggacuugcucauuguagaauuacauagguagguuaaaaauugguuccguaggugcuaauaucuaaaaagucaguuuuacugauuucuuucguccucuauauauuuucuguaauuuucuuuuauguauuucuuuuauuuauucauaaaguauauauugaucuuuguuccagcuaucuaaugggugcuuuuaaaaccugauaucauaguuuuaauaauuaaugauaacuuggaauuacaugcuuugcacauagauacugugugcauauauauuugcuuuccuuuuuucccucuucuuuuucagacagggacgucauauauacauacacauauacauauacauacauauguaucuccuagguuggucuuaaauuugagguucugccaaauguuuggaauuagagagauaaacaauuguaccuggccuuaaguauauuuuuaaaaaaugcuuuuuacuuuaggauuauucacaaaaguuuuaauauauuauuuugccucagauaugcagauuucccccuucauuuaacugcuuauacuuugggaaguuggauuguaguuuacuuagcucuggaggggugagguggacaguauuuaugcagacuuguacaugaguaccuauguauagucaaggaauuuguugacuagaaagcuguucacucaugguuaaaaucuacuucauuauuacuccuguaaaaaauuaccuaucuauauaucuuuagguaucauauauuggucacuuuuaaaagaaaauggacaaaaauacaauucuguaaaauuagcuuaugacaaaguacuauaauugucuaaauaacccaagaauguuugugaauuuagugcaagcaaaaaucuguugauuuuucaguugaacaauaacuuaagacgaugaauggauuuuauucauuuuaaugcagauuuuaauacaaaauagacuaaguaaauaucaauuuacuuaaaaugccaaaagacugaaauaaaacaaauuguuuauguuuggaaagauuacuucugguuauaauuucaauucuaaauuagaauugaccaaaagugacuucagugccugguccuugauauaaacauugaagauuaaguuuuuaaguguauuugaguucaggccuggagauuugcaguggguucaguuucuucaucuuuauuuucuucugcauuuauuucagucuccuucacugagccuuuaguuuaucuuuauaaauacaaaugugauugcaccaaucacuugcuuuaugaaccuuguauaguuuucauuaacugucaauggaauaaaguccaacaaguuagcauguucuguaaagccauuuacaaguugauagaaauguccccauugcuuuugugugacuauaagccuguucuggauccucucagacccuuaaguuagaauuaaaaagucuuguggauuuuaucgucucuauaccuuuauuaaugccucuuaacugaccaaaguaaaagcuuacauucuaauaugacuuccaaauuaguguggacaauuccccacccccacacccucucuguucccacauugugcuuugauuauguggcuaguguauaucacuuuucacauuguauuagcaugugugucuacauuugcuugcauagaauugugaccauuuguggacaaagauuuuuauuguuuugcuuguacaugcuuauuucaucuucacagaucugcucaaauugcuugcauuaagucagaaaugaacugugguccauucuuugaaauauagacuuuucaacugcaugaaaauugaguagugaauuucuuagugucucauauauucucaaaggggacuaugaaaaacaaaaaaaaguuaaagauaaguacuguuguaaaagcuuuccacagaaguuaguguaaguuauaaacagauucacuugccccaaauaguacuucauaagaaauggauauacuguuuuggaucauacagauuccuuggugcucaguuauauagcuauuuugacauugcuggauaagcuauguuuguauuuuucaugguccagugacauacagaguuauugaaacucacaguauggaauacagugaaguuaaaauggcuuuauuuugaugguaaauaauauauggucuuuuuucuagugucuuuauuuuauaauuggucuuaguauauuuuacuccuggucaucagagaggggugagcauagcaguaguugagagggcuuuggguugagauguagauuuaccuuaggauuaucuauugucugcuguuugcuaacuaugugacuugucucucuuauuucucaucuaugaaguguagaugugaauaguguuuaucaaucacaggauuguuuuaaaaguguguuacugugguauuuggcauaaaagaaaaggccaaaugucagauaaugccuuuuuuuuuuuucucuuuuuuuuuguuguuuugagacagguuuuuuuguauagcccuggcugucuuggaacucacucuguagaccaggcuggccuuagacucagaaauccaccugccucugccucccaagugcugggauuaaaggcauacaccaccacugcucagcucagauauugcuauuuuuauucccuuaaaagacucuacuugaugaccuuguaggauuuuuuuuuuuuuugcauucuuuuugccuacauugacauuuuucuaauguugaaucuauaagcuaugggggugacaguuaagaaucuuguggguuacaguauguaauacauguaugcuucauauucuacugcaauuuuagaguaauagauauagucacauucuuuauucuccaguauuuacuuaguaguaaaacuuuauagacuuggcuauuuuacugugucgucguagggcaaucaccuuuucucauuaaguuuuguuuuucuuugagacaaggccuuacuugcuauugauagcccaggcuggccuuagauuccauaugauccugucucacccucuccugugcugggauuauagauaggaggggcuuuaauauuacccagcuguuaaggucuuaaccccucccucagcaccccaguaguuagucaagaaaaaguauguuguuugaugguuuacacaucauaaaaauugaaguguuuuuagauuuaugacauagcaauaacagauuuacucuccuaauucauauggcuuguuaacaaacaucaugcuguuugugacucccucuucccucaauaguaccugauggcauuuuuuuuuuuaagucuuguuauauagcccaggcuugccucaguagcccagcgagucuuaaacuuaaggaaguccucugcuucucccuccagaguguuggcacuacagguguguucuagccgaucuagaguuuuuaaaguuuuuuuuuuguuuguuuguuuugagacaggguuucucuguguagccacaacaaucuucguuguaaauuagacuggucuugaacucagagauggauccacuugccucugcuucccaagugucagaaguaaaggcagcuuaguuaaauauuuuuagugaguugcauagucuuuguucucuguccuguuuauaaucuugcuuauuuuaugccccuuuguuuuauacaguuuaaagauuauagaugagugauuaaaagaucaguuuguaucaccaugcauuguaguguguaccuauuuagucccaguuuauucagcagcugugacugagacugaagaaucauguggauaugugaguuccaagacaaguuugggcaacaaacauagugagaccuugcucaccucuaccaaaagguguggcugcaauauaaucuagaauauucugauuaagacauuuccccauuuaaauaggauguauuauauguuuuuauuaaaccaagaagugaaaauuaucaugguauguauaguacugcuuuuguguuggaacucuugugcuauuaagauggcuuuuauuuucacauagucgaauuuauaccaggugaaguuuuuuugcaaauuggguuaaguugucacaaauacaucacaacguuuuuuguuuucuucauccagacaggugauuuggcuucugcacaguuaggaggagcaccaaaccgaugggagguuuugucagcuacaccuacaacuauaaaagaugaagcugguaaucuaguacagauuccaggugcugcuacuucaagugggcaguauguccuuccccuucagaauuugcagaaucaacaaauauuuucaguugcaccaggaucagauucaucaaauggcacaguguccaauguucaguaucaaguaauaccacaaauucagucaacagacgcucagcagguucagauuggcuucacaggcuccucagauaaugggggcauaaaucaagaaaacagccaaauucagaucauuccuggcucuaaucaaaccuuacucgccucuggaacaccuccugcuaauauccagaaucucauaccacagacuggucaaguccagguucagggaguugcaauugguggcucaucauuuccuggccaaacucaaguagucgcuaaugugccucuuggucugccaggaaauauuaccuuuguaccaaucaauagugucgaucuagauucuuugggacucucgggaaguucucagacaaugacugcaggcauuaaugccgauggacauuugauaaacacaggacaagcuauggauaguucagacaauucagaaaggacuggugagcggguuucuccugauguuaaugaaacuaaugcugauacagauuuauuugugccaacauccucuucaucacaguugccuguuacaauagauaguacagguauauuacagcaaaacacaaauagcuugacuacuacuagugggcaaguccauucuucagaucuucagggaaauuauauccagucgccuguuucugaagagacacaggcucagaauauucagguuucuacagcacagccuguuguacaacaucuacaacuucaagauucucagcagccaaccagucaagcccaaauugugcaagguauuacaccacagacaauccauggcgugcaagccaguggucaaaauauaucacaacaggcuuugcaaaaccuucaguugcagcugaauccuggaaccuuuuuaauucaggcacagacagugaccccuucuggacagauaacuuggcaaacauuucaaguacaagggguccagaacuuacagaauuugcaaauacaaaauacugcugcccaacaaauuacuuugacgccuguucagacacucacgcuuggucaagucgcagcagguggagccuugacuucaacuccagucagucuaagcacuggucaguugccaaaucuacagacaguuacaguaaauucuauagauucuacuggcauacagcuacauccaggagagaaugccgacaguccugcaggugagucuuaaugauaugucauuaaaugugcaaugguaauauccaggaaaacugcuuuaguuguauauccuuguauuuauguguaggaggcaucauagaaucguccaaauuguucuuuuugaaacuuuguuuauuugaagugaaagauuuacuauuguacugguaauauuuuucuuuucuacaacagguauuuauuuguuuuaacaucugaucgguacuaucaacuaucaggcaucauaauuuuuuucuuuaauuuggcaggagauugucuauuggucuugguaugggaugaguuugacuucuguuuuauggggagggaaugaaaggguaguccaaguuuggccuggaacuugcuauguagaccaagcaggcuuugaacucagauaugccuacuucugucuccuuagugcugugauucaagauuugugccaccauggcugacugaauuaaauguaauguauauuguaucgggugaaguaucagguuggcauaauaaaacauggugcuggggcuugaggguacuucacugucucagccacuagguuugugauuuuugacuuagcuauuuuucucuggcaaauuccauuucuucauuguauaaaacguagauauuagacaggauaacuauuaacuagaaacuguguacaccuaacauucuuugguuuuggugauaguugccauuaaauuugguugucagaaauagcuauugauaaguauguauuauagaugcuucaaguuuauucauugaauguuuugcaugcacaauuaacuaaugaagcuuuaaaagguagcaccauugauuaccguauuaauguuauuugucuagauaugaugaauauuuuuguuuugcacuaauuccuuuuauaacauuaauucuucuacuucauauuuggauuucuguggagaucauacuguuuaaauuuuccagucugcuucuaaaguugaauuggggcacagaauugaagagauugaagugguuuccaucacacuuuuaaugacuccuuuccccuuucaccuuugucuucuuacagauuuguuauauauuccuagaaagaugaguuuguccuugagugucagauuugcauuuagaaaucuuuacuguagcuugaguuucugaaacuaguuagaauaaaauuccuacccuccacccuuuucggacacaggguuucccuguagccccagcuagccucaaacucaagagaucugccucucuguguuuccugacugcuagaauuaaaggugcccaccaccacuaaaugauuucgaauagaauuuuucaaaaguugauuuguagauuucuagagagccugaguauccuuucagaaaucuuuuuccuaauacuaaaaaguuguuuguauuuucauguguucacauugacugauggguuaaauuuuaagcucaaguuuggagacauuuuaacucagugguuaagagcuuguugggugacucacaaauaccuguaaacuccagcucuuaaaggucugauaucuuuuccuggcuucuguaagcaccugcauacucaugugugugcauacacauacagacauaggcacacaugguaaaaagaaaaaaaaucccuuaaacuguaggaauguuuguuguauucuuuuuucuuucuuuuucuuuuuucuuuucuuuuuuuuuguuuuuuuguuuuuuugagacaggguuucucuguauagcccuggcuguccuggaacucacuuuguagaccaggcuggcuucgaacucagaaauccgccugccucugccucccaagugcugggauuaaagguauacaccaucaugcccggcucguuuguuguguauucuuuuuuuaaagauuuauguauaugaguacacuguugcuaucuucagacacuccagaagagagcaucagaucucauuacagaugguugugagccaccaugugguugcugggaauugaucucaggaccuuuggaagagcagucagugcucuuacccaaugagccaucucuccagcccuguuguguauucuuaaugacuguacuuuuuaaagacaaauuacaauuucacugaaaaccuacuugauaacucaauaaaaauguucacaaaauuuccaccuguugcacauugcaugaaaacuguccuuuaaaacaaaacacccauggaaggagauacagagacaaaguuuggagcugagacgaaaggauggaccaucuagagacugccauauccagggauccaccccauaaucagcuuccaaacgcugacaccauugcauacacuagcaagauuuuguugaaaggacccagauguagcugucucuugugagacuaugccggggccuagcaaacacagaaguggaugcucacagucagcuauuggauggaucacagggcucccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccguuggacaugcaaacuguguaugucccaguacaggggaacgccagggccaaagaacugggaauggguggguagggaagugcgggagaggguaugggggacuuuugggauagcauuggaaauguaauugaggaaaauauguaauaaaaaauauuuaaaaaaaaacuguccuuuaaaagacugccacuugucaaguaucaaagaauacccauaguuagccaacaggcuguuguuauuccuuccuuucccagcuacaucucuuugugaaguuauucauaugcuuuagcccaaaccacauuucacaagcaauuuaguacagaaacagaucugagcuucugucuucucuucccuuagauauucagggauuugcaaaaauguaaagcauguuuuccuuuuuuguguuguguaguccugacuguuacuggaucuugcuguguaggacgggcugggcuuuaauuuguagcauugauccuucugccucagcuucuuuagugguaggauuacagacaugcaccaccaugccuagcuuguuuucucuauaagacuuuuguuuguucggcaaguaaaucuuccuguaauguucaguuguguugaugugaugaguuugucuaacuguuuacuuacuugaugcuggagacuaagccugaggccugacacaugcuuaggcaggcacucuuuaagauuuauuuuucaauuuuucaaaagcauuauuuuuuaaaugauuuuauuuuauguacauugguauucugccugcauguaugucugugaggaugucaggaguccuggaacuggaauuacagacaguuguaagcuguuauguagugcugggaauugaaccugggucuuaaccucugagccuuuguuccaauccuuuucaguuuuaugugcccacuugcccugaguguuugggggguagggagagacagacaucauggaaauucuaauauggacaaaauguguuuuugaacugcaguccuauuuaagaaauuaaaaagagaauccuggacuggggguguuguucagugguuagcauacaacaggcuuugaauuuaauccuuuuacguguaagaacuacuugugacagacaucugaagacacaagcugaaauauuuaaaaauucugaaguauaaaccacauacaaaauuuaucuuuuaaagcauauauaacaauucuguaguuuucaguguagucacacaucagucuuucuuuagccucucagacaugagcagggcacauauuuuggaacauaaccugggauacauuaaaugcuuuuaaguuacuuucagaugcuauucaauagaaacacuggcuuaaauacaagguuggauuuguucuuugauagguaguccagaagcaaguaauaaaaguaguauaauuucauuugaagacuauuaagccuguguguuuguagguauagguguuguagguguggguguugcagguguggguguuguagguauguuguguuguagguguggguguuguagguguggguguuguagguguguuguguuguagguguguuguguuguagguguggguguuguagguguguuguguuguagguguguuguguuguagguguggguguuguagguguggguguuguagguguggaugaaagguugguuuauguugagucucuugaugauaaggucaacauuaccuguuuuucuuugguuuugagacagugucucuuguggaccuggugacuacugcuugguuagaauguguggacaaugaugcuccggggaucuuucugucggccacuaagccuuuccuaggguuacaaucacaugggacccugucuggcucuuccagcccuucuccuuuuccuuuuuuauaugggaacugggaaucugaacuccgguccugaugcuuugacuggcugaaccauuuuccaagccccagugaauacuagauuauuaggaaacccuuuuguuuacugucuuucuaauuggcaagauggggaaaugaaagcuggguuuagugguaaacauggcauuuuaggacauacaaggcccugacugauccacagcaugaaaagggaugggccgaagagaaaggcauucucagaggaaaaaguauuuccuucuuguuuaacauuuuaguuuugguagauaagaauucaaugucaguuuucuaaaguacuggagaaacccugaaaccagugcucuguaauuguccaaaaacccucaaaaacuuaacaaaaacuuuuuaacuaaaccuuuauuccagccuucuuuuuuuuuuuuaaagaauuauuuauuuauauauuauccgugaguuaccauuacagaugguugugagccaccaugugguugcugggaauugaacucagaaccuuuguaagagcagucagugcucuuaacugcugagccaucucgccagcccugauuuuuuuuuaagugaaacucaagcuaaugacuccaacagcaguuuuagaaaucaaggauucuaauacaacauagccucacuauuaacguaauacauauuuaggagauggugguaauuacagaccaaggaguuuucuguuaggaaugucacugaaacagaaacuagaugguaguugaaaguggacuucugaugcuagaaagaaggcauaguggagcaaaggugcuuaaguagacagcaggauaauguaggauacaggcacaggguugaauguugugagauauugugauuagggagggauauggagagaggucuucccuuacaaguugauaagaaacaauccgcccccccccaaaaaaaaaaagaagaaaaaagaaaguuaauuuuuaauagaaaccagauggguagaagggcagauaaugacaaguuugagaaagagggcauguguuagucuggcucuaagagagucugcuaugaaauuggaauauacuuacucuaucuuucacaccugacuuuuucuuuuuuccagucuuuuaauucuuuagacauacuacuuuuucuuuggucaauuuuguuuuugucuuagaauucauaucuguagaccagcuuggccuugaacucccagaugcuccugcuucugccuccugugugaaggaugaaaaguauuuaccaccaucucuggcugacauacucauauuuuaauauaauuacucgcacaaaacacaaguuuacaaagcaacaaaaggaguuuaaaaacuaucugcaauucuuuuucaauuuuccuuagaauucaguaguauaaauguguauauauugauauauucagaucagauuuuucauuauccauucauuuguaaauucaccugauauuaagugagguuacaugaucucaguaauaaaccauacgcucucucucauauuuggaaccuagccaaugauguguguguauaaaacaaacaaguguuccuguggguacauagagcaugaaaacagagcacgccucauccaggccugaggaggcauggaugcgaggcagugacaggagguuggaggaggauaugaagcuaguuguuuuucagacucuaauuuuguuguggauuuuuuuuauucuuguugcugauaaguggauaaaauauauucaguacuaguauauaaauuaaaaauuauauaaaauuuaaaguauaaaauuuagugugaaacuucacagcuucuauuuuuaaugucauuaauuguauauaaauucauugaauuguacauagauuuugggccuaguuaauuuugcugugugguuuuuauucacacugcuuuuuuuuuuuuuuuuaauuuuuuuuugugaugguuuuucuguguagcucuggcuguccuggaaugcacuuuguagaccaggcuggccucgaacucagauccgccugccucugccucccaagugcugugugugugccaaccauugccuggcuuauuuauacuuuuuaaauaauaaaguguauaaaauaauaaaauuucagaaacaguuggaugguggugguauaugccuuuaacaaccacacucugagcuugaggacagcuagugcuacacagaaaacccugucuugggagcugggagugggggagacaggaaacagugacaacaacagcaaaaaugagcaacagcaaagauggaauaaaaugaaaaguguucucccccaccccaccccaccccaccccaccccaccccaccccaccccaccccaacaggguuucucuguaccuuugucuguccuggaucucacucacucuguagacaagccuggccuugaaucugccuugcaugccuaccaagugcugggauuaaaggcaucacaaccacugcccugcuguaucaucuuuauagcaaaauuuuuuccuuccuuguuaucuguuuuuauacccauagacucccuaguauaaggauaaauuuacagacauuaccaugccuguauggucucuugacaggucuggauauauaucccucuucugaauuacauuuuuaugcuaugauauuacaagcuauagcugguccauuaucaguggcagucuuuuuaaagauauuuuuauguguaugagugcuuuacuuacauguaugugugcaccaugugcauguuuggugccugcagaggucaaaagaaggccuuggguccccuggauauggagugacaaaugauuaugagccaccaugugggugcugagaaccaaaucucaguccucuagaagagcagugaucuuaacuacugagccgugucuucagucuuaucucaccucauuccugaauagaaauuuugggcuauucaaaaguuguuaaaagaugggauuuuaauuguguugggagaaacccagaaugcuugaguuagugaaugcuguuccuagugauaucuuagggagugugugacuaugaaccuggcuuaaaagugggaaaauuuuaucaacugugaaaaucuugcagaugaauuguccauuagacucuguacugguuugucucuuguauuuugaagaaaguaguuguugaguuuuggguagagguagaugcucuaaaguguugguucuuauaucugaaggagaagacuuauuuuuauaaaaacuuaugauucuuacauuuugguugucuuauuugaauaaauacagagaaaaggcucaaaaaacuugacuggaggguagauagguuuguuuuuaaagaaucuuuggucgaauaaauaguucuuuuuucaccauugggugauucuuaagaggacuagguacguguucacauucucuacuuugcuggauuguugagccagcuauacaguauaaagcuguacucaauaaaguuguguaacuggcaaauauuauacuaaguuacuaaauuauaugauaaauaguuuucuaguuguuagggagaagggagaacuuuaaugaggaagucuauauucuuaggucaagagauacuguggcaagauacuuacuaguuagugaaaagauacaguagccuguuaaggagacugggcuuuuauuuucuacauuuuugguugugaacccaaccuuuaacggcugagucauuucuccagccuggucauuuuauuucuaaauguuuuuugguuugggugguugguugauguuuuugagauaaggucucauuguauaacccauauuggccuuaaacuaugaagcacccugccucugcuuucugaaugcuaauaguacagguaugcccaucccuggagacaguuuaauaacucaguauuucuuacuguucuccacuccaaccaccaaaugguguaauaugcaaaugaaguuucugugaguaaucuggugcaugucccaccuguucaaggaaagaaagcaauaguaugauccugggcauggggaauguugguaugaguggccauauggacuguuccacuaguaucuuguauuuauuugcaaggcacacaccuuuaaucccagcacuuggaaggcagaaaagcaacgccagccugguuuacagagugaauuccaggacagccagggcuacgacagagaaacccugucgggggagggaauguguuguuauuuucuaagugugcauagauuccaagccaugaauaugaugcucagggcaauuuguggaaaucaguucuuuauaucuggugggcuggaggggacggaacucaggugguuaggcaugggcugcaugaacauagacccacugagucaucgcacaguaaaauuggauaggaguggaacacugaauuuuagugguaagagauuuauuuaucuuggggugggugugggaggucuuacuguguagccccagcugucuuggaacuugcucuauagaccagugcugagauuaaaggcgugugacacuacgccugacuuagaaauguauuauuuuuuaauuuaggauugcagcguuuugaagaggaauaacaugagugugaaugcuggaaaacacuucgggaauaaauuggaacuagaagaagcuaguacuaaagguagaaggcuguuucaguuauauaggauaaagugauaaaaggaagaguuuuagguauugaaacagugaauuuauaggauggaugaauccaauauuguuuacaguuuaaagagaaucuuagucuggguguuacaaguaauuuguugccuugaaaugacuaugguaauagaaauauagagacugagcucagaaugcaaaccaaacuaaauagaaguuauauacuugaggucagcagagaagauaauuaacaaagaucagggguagaugggggugcugguaagguagcucaguaguuagagugcuuagugcuuugcgaggaccaguguucaguucucagcacccacaucauggaguuuacaauuaccuguaacuccaguugaauuaccuguacugcagugaauacaacacccucugguuucuucuuguaucugcauacagguaguucacauaaacuuaacacagaugaacacacaacauuuaaaaagauuuacaagaauuaaaagauguuuaagcaaguuucuguuugagacagauucucucuauguagucugucuguccuggaacucacuagguacaccaggcuggccucagacucaagagaucgacauuccucugcccucuuaagaguagaggugacaacaugccuggguuguuuaggacaauuuugaggguagacuggggaccuuaaguuaacuacuaucaguacaugcagguaauuauguacauuuucuguaacuucuaugaugcucugucaggauauuuaguggguaacauuuuguuaaguaguaagaugagaaguuucguuuagaauagugguggagaguuuugguuuggauugguuggugcauuaauuuucuacacugugaccaaggcaacaaauagaaguaaggguuuccuuggcuuuacaguuccagagagaugaguuuacaguccauugcagugggcuaagaauggcagcaucuaagcauggccacugcaaccgcugagagcucaacuggaaagcagaggauugggagugcugacagucguccuucaaaccuuaaaacccacccucagugacuuccuucagcaaggccacccuuagucucucaacagugcuaccacacguaaggggcaucuuauagaaaccaccacaauugaaauuugauuuuaauucuuuuucagcaguuacaugauugccgacuauccucccucccucccucccucccucccucccucccucccucccucccucuaucccacacacucucucucugucucugucucuguguguguguuuuguuuguuuuuguuuuaaagaauuuauuuuaucuuagucuuguaaguuagagcacucuccaaagucuggaaacaaagaugccuuagcagugaagaacauuuacagcuuuuccagaggaccugaguguaguucuagcacucacauggcagcuuacaacugucaauagcucuaguuccagggaauccaggaauauccucuaccgucuaugcguguaccuggcauaaaugugcaugaauguacacacuugcacgcaaacacaguguauaugcauacaugcaaguaaaacacucacauauaaaauaaauaagccuuuaaacuuuaaguuuauaaggaaaaauuaaugguuguuugaagugaacgugucugcaccaguacaguucuuccuauauauuaaugucuuauuaugcuuuuuauugcuuaccacuuauaaguuuuuaauucuuaguaugucuugugauucagccauuaccaugaauccucagauaucccaaaauuguuuuguaaaugcucaucuguaaauggaacagauagaagcacuuccucccaggaaagggggguccagccucacaccugagaccgggcuuuuuaacuuccuugaaaucugauaacuggucuuuauauuuugacugaaaagacauugauuuugugugugugugugugugugugugugugugugugugugugugugugaaaugugagccuuugugaaaauguuaaaaaacucucguuagugcuuaucaauauuaccccauugccuuauuuuguuuccuuuugagacaggguuuugcuguguaguccagacuggccuugaaauuuuggauuucuuccuuccugagugcuguguucagguguauaguaauggcugucuaauucucucuuuuccuuuugagggauggauguaacuauccaucuaauuuucagagucuuggucagagaaguugugaagagaauuugaaguuuuguuugaauacuguuugaguuguguuaauaguuuucuuguggcuuuuccaaaucuucugaaacuuucuugguuuuguuuguuuuucgagacaggguuucucuguguagcccuggcuguucuggaacucacucuguagaccaggcuggccucgaacucagaaauccgucugccucugccucccaagugcugggaguaaaggcgugcgccggcucagaaacuuucuuaaaggggaaauauuguuaccugguaaauaaucuugcuuucuugccauucuuguuuccugcaguugguuguagaauuguugcuccauauaguauagauuguaaccucaccuucuauuguuuccuuuaaguccuucuacuccccuuuucuacccuucugugccucccuccggaguucuuucccucacaucuugggguuaaguuuugcugaucaaaccuuguaccacugaaaugcaaguguguguguugagggagaaaaaggaaaaguugggauaaaauucuuugaaaacaguaaguuucaaauuaugacuuuaaaauuaaaaacaaaacaaaaacaaaacaccccaaaaaagucuagcugggugcuggugcacgccuuugauaccagcacucaggagacagagaagcagucagauuucuucagucuaguaauacaguguaaguuccaggacagccagggugucacagaagaaaccaugucuugaaaacaaccagucagacaaacaaacauggaaaaaaaaaaucccuaaagaguguaguagccaggacugcugucuacuuugaguacaguugguuugucuguuccgucaugauugauuugugaggaaagcuugaaauacagcauuagcuguuacauaguggauaugaacaaaaaauauauauuuaagccacugugauuuuagggauuauagucuuaguugauuuuaagugcuugaaaaaggucuagacuaaaauaugaaaaaaauacaaauugaauuuugaagauuuaguauuaaaauagaauauaaaaaucucagguuugguuuucauauagccugggcuagccuuuagccuugagcucuguuggugaggguacuuugaaguccuuguccucuuguuucuaucuccaaagugcauuauuacaggcaugaacuaccuugccuggcucaaaauaagugauucuuauauugaucauggguuaaguggaauaauaccaaauuuuacugcuuuuuagcuuugacaauuggaaauuauauguguuauuuucauuacaugucuguugggucauacuuaaguuauagccuguuuuaauuaaaaauugauagaaggaauguauguucauaacagaaaaccuuaacuguaccauuggcucaaugcagacaacuguuacaggcugguaauguuauaaggagaaacauuugguaaaacuuagcugcaaaaacuuaggugacaaggacuucaaaaaaauugcaaaucuaaggccagccugggcugaagucuggucucaaaccaaccacccagauuuaguaguguucucuaggcacugcauauuauucuuauaauuuaaaauacaaugguaauggcauaauauauaaaccuauuuucugaaacuaaaguaaccuaggauuauuuucaguaagcuugaauuauaauuuuuuuaaaucgaacccuggaagaguauuacuuacucuucaggaaauaacuguaaucacucuguaggccaggcuggccucgagcucaagaaacgugccugccucugccucccgagcagauuugcaaucuuccuuuuaggugcuggaauuacaguaggaauaugccaaucaaugccuggcuaaaaucuauuauuuuaaaggauauuuuaauagcuuauuacaaacuauuaaguuugaaaaagaguucuuagagugcaacuaaaauagauuaauaauaaaauuuucuuuuauuugaggcagagucuuaaacuuggaaucuucuugccccucagccuucugaguucuggguuugcuguuguacaaggaguacaggugugcacaagcaagcccagugcucccauaucuguauucuuggugaguagcagaaacacgccugagagucuggaggaagauagguagcuacuggguagaaagaagcuacagaaaaucagauccuagguggagaaaugaauguuuacaaagcauuguaccauuuagggcuguuuuuaauauaaacuauuuauucuuaaugauggguguagcuuuaaagagaauauuuauccucaacuacuuacucuaagaaagcaguuuaauucuguuuuuguuuuugcuuuuugacaagugaguguuugaggagaugggaagaaagcaagguaaacuaagauucucuuucuguuagaauuuugaaucaagaucagcuuuauaucuguuuuuuuuuuuaaaagacauuguagcugucuucagacccaccagaagagggcaucagagcccauuacaggugguugugagccaccaugugguugcugggaauugaauucaggaccuccggaagagcagucggugcucuuaaccacugagccguuucuccagcccucaacuuuauaucuuuuaucuuaaguuugaauacuucaccuuuuauuccuaaucacuuucagaucauuaguuucuaaaauuaguuucuaaauacugaaucuguucuuuuuuguuuuuuguuuuuuuccauuuauaucauuuuauuuggaaauguuuguaacaguacagugaaacuaaaggucagagacaauggcugucaguuuaggcaucauccguuuauuauaaaagggaggcaugggaauuauucacaugaugaagugguucaggcaucagugacaccauuucagcagugauuucagucgacauacuuuccaagaaugucacuaucucuaaauaagaaauaauccuugucgucaagaacuacuuuggugccuccauauucugggagaacuuuaucuccaacuuucacacugacaggcccaaucucuccacucuuuccuuucuugccugaccccacagccacaaucguugcuugcaacacuuuuccuugagacuuuucuggaagcauaaugguuacaguuucggaggcacuccuuucaaccaauacccugucagagagcagaagaggcuucucaaaagcuuguccagccaugacucucgcuuuugccgccaccgccaccgccgcagcuccggucucugaacuugggccgcugcugcaaggagaguccucucucucucucucucuuuuuuuuuuuuuuuuuuuuuuuuuuguaacccuggcugucuuggcacucuguagaccaggcuggccucgaacucagaaauccaccugccuccgccucccaagugcugggauuaaaggugugcaccaucacccggccgaaucuaugcuuaauaugaauguuugauacuuguuaggauuugaaugguaugaguuaugguaguuucaaauaaauuacuugguuuuuuugaauagcaauuaugaauuauugagacuuuuuuaagucuaggaagaacaucaaaacuuaauuaacuuaaacauuuuuuacaaucuggagaaaaggcagaaacuaguuaaguguagcuuauaagaaaaagaugggaccuuaggaaagaguauguaauuuuauaauauugcugcacaucuuucaucauuauucuaaauuucuuuagacauugauuuuuaucugugagauuucuaaaacaaguucucuguaaauggaagacauuucuaguuuucguuucaguuguguuaaaaaaaauaacauuaacuuuaucaugcuauuuccuaaguguuuauuuugugugcaggcacaggcaaguacacagggaccauagugugugugaguggagucaggaaaacagccuuugagagcugaaauuccuucuugcauguucuagggaucagggcuuggaguuuuuugucguuucuauccagccuuauccauuaagccaucaugccaguccuuaacuguuuuuuuuuuuaaguguuccuuuaaauauguucauauuguauaacagagcuccuaaacuuucugauacugcaaaaucacaauucuguauauauucaguaccaauuuucugucacucuuguccuucgacuguggcaauauucuuucugcuuucugcuucacugauuuuggcuacuuuuuagauacucgauguugguagaauuuguguuuuguuauuuccuuauuucaccuaguguaguauuuuaaguuauuucuacuuucuaguguguaacaggauuuaacugagacuaccuaucuacuacuccacuguaguauggaauauguagacauauaauaaaauucaucucacauuuugaagucauuuuaucaaacuguaguuuauaugcgugugugugugugugugugcgcgcgcgcgcgggugugugugugugggugugugcgcgcgcgcgcgugcacaugcaaucauacauacuugaguguggcauauguggcuggugugcuugugggucagugagccagaguucaauguugacuguugcuuucuaccuuccuccccugcccccaucuaaggcagugucuaacuauguaauccuggcuggccuuaaaacucauagaacccugccugucugugcuuuucaagugcugagauugaagguguagauuaccacaucuggccugcaccuuauuuuugagguacuauuuguuuuguuuguuuuguuuuguugguuuuucgagauaggguuucucuguguagcccuggcuguccuggaacucacuuuguagaccaggcuggccucgaacucagaaacccgccugccuuugccuccggagugcugggauuaaaggcgugcgccacuacgcccggcgagguccuauuuguuaaagaaccuggaauucacggaucacaccagaacaacuccccacgccacuccugguauccucagcacggggauuaugggcauauaccaucaaacccggcucuuuauuuugcaugggggugggggauaaggaaaugaacucaguucuacaugaagauuggacucaccaagacaucucucagccccagaaaucaauauuuauuuauuuauuuauuuauuguuuuucgagacaggguuucucugugcaguccuggcugucuuggaacucuguagaccaggcuggccuuggacucugaaauuuaccugccucugccucccaagugcugggauuaaaggcgugugccaccaccacccggccaaacaugcauuuucuacuacccuuaacaagcuuguuuugcaguuagaucuuaaaaaacaaucacagucaaaggauaaauacagugucugauguuucagaccagagggaaacuugaacauuuugaggaagauaauagcucuuccuuuguaaaguucuuacauguguuaugaaaaaaacuugaauuucugucucaauuauuuuuuuuaaacuuuuucuuucaaauaagcacauuuacuuuuuaaacucugauguguguuguacagguauguuacucguggugugcuacucaguauaaaagcuaguuuauaguauuuuggguaaucuuacauguuaaauuuauucuugcagacuagcccggggaauggccugacauguuuuugcgugucuguacucaacagaggugagagagaugcuugcugguaguugugagcucccugauguggguguugggaauugaacucggguccucugcaagaacaauaugagauguuuuuccaaccugacauuuucuaacucauuguguuagucgguuucuagucccauguaaugcauagcacaguuaaauuugaaaagguuuguuuauaauuguagaggccucagucuuugaacaguuaguuaucuuugcguucuugggugauagcacauaguucuaaggugugucugguagaguaacacugcuuaucuuagggguucuacuguuucuuucaagcacaugcacacagugacgugaccuaaaaggguuuguuuuugagcccagacuagccuuggacucccauuugucuuaagugcugggguugcaggaguuuaugguauccaugcucagaucuacauugcauuccauaugucuuaguaucaacuauguaugcuaaugacagucaaauuuagguugguaagccagcaucguaccuuaacuccagaacucuuugcuaucugaucauugucuucauuugguauuuuaaaacuuuuaccccauuccuauaacuugauacaguuaauagcaguucuuuaucuuuucaguuauuaaggauaaacccuugaguguuguuaaccuguuugugaucuuguaguuuauuagaccucgucccagcuaucuuuggcuuuaccuucaaaguauuuuuugaagugagucauccuucaaccuccuuaucaauaccccaauuucugauccccuccccucccccucacccugccaucccccuccccucuuccccuccccucccucuuuucuuuuuccuucuuuucuucuuucuugacaucucaguauguagaaauugacuugaaauucacuauauagcccaugcagauccuucugcaauagccucuuuaucguuaguacugcagacacugccaucuuuugcuguaguagcugucuucagacacaccagaagagggcaucagaucuuauggauaguugugagccaccaugugguugcugggauuugaacccaggaccuucagaagagcagucagugcccuuaaccacugagccaucucuccagccccuguaguuuguuuuuaaagacuauguagcucuagugacccaagaacucauuauauagaccuggcuggccuugaauucacagagaucugccugcuucugcuucauagugcugggcuuaaagucuauguuacuauaucugguaauuugcuguaguaauuuauaauaacuuccuaauugcucuuccugugcuugucugcagaccuuauucagcauccacgaguuuauuuuaauaaaauccuauucaaauauuaccacuccuuucaguacuucuuagaauaaaaugugaaguucuuaaacuaaccugcacgauaauguaucauaucauaugguucucuuccuuugccuacuucauuuuuaccucuugauuauauuauauacuuacuguucuccacauugauuauacucuugccauacagacugucuuuuuuuuuuuuccccuucaacucaucaaacauauaucuagcuuguuuuucuuugugcuuuggccacaucugcuccauugccaucuucagguuagaugucaccacacuggcagaaacuguuucuguccacuguuaaaaauaguaauuucuuccuucucauuuccuauuccuccuuagacuuuccucuuccauaucuuaauugcuaccaagugcugccugcuuacuuguccucuccgaauuaaaagguaaacccgauaaauacaggaauggaacucuuguuagcaauuuuuggaagcuggcgagaugacucagcggguccugaguucaaaucccagcaaccacaugguggcucacaaccaccuguaaugagaucuuacgcccucuucuggugcaucuaaagacaacuacaguguacuuauguauaauaauaaauaaaucuaugggccagagcaagcagagacugagcgaguggaguugacuggaggggagccgaucugaguggggccaaccagagcgagcagagguccuaaaaauuaaauuccuaacaaccauaugaaggcucaugaccaucuguacaccuacaguguacucauauacauaaaauaaauaaaucuuuaaaaaauuucuuugcucuuuagaaccuggaagagugacuuaacauguuucaacuauuuauaucuuuguugaauaaaauuacauucuaaacuucaaauuaugaauuuaauuuuuugaagacacccuaaauuucuggguuucaccucauauaagugggggaaagagcuagagaugcaaacacaauaaaagaaauugaaguauaauuuucaggaaauauauaaaucauguacucuuucuuucucuuucuccuuccuuccuuccuuccuuccuuccuuccuuccuuccuuccuuccuuccuuccuuccuuucgagacaggguuucucuguguagccuuggcuguccuggaacucacucuguagaccaggcuggccucgaacucagaaauccaccugccucugccuccugagugcugggauuaaaggcaugcgccaccaugcccggcguacuauaacuuuguauuuuaaaugauaaacacauuaaacacagaucaagaaaugaguucuuccagcaacacacaagucuuccucuauguaguuauccauuuuggaaguaucuucugcuugacugacacauuuguuauguuuggugacuuuuacacugacaaauuaugaccagccagucacacauucuacaugagguuucuuguugguguacauucugugagcuuagauacagaacauauguuagcucauuguaauauuuuuacucccccagaaucuuucccugauuuuuggaacuuaaucgaggagaaaauagaaaauuaauguguuacuuacucauuuaagagcuauaauuguauucuuauuuaggaacaaaauuuuggcagguugaguacaggaugacuucagagaaagagaugaaagagggccuaguaugcacuacaggacuuugcucaaguugauaguuugaguaguuaaguuacuaaugacaaggggauacaaggagguuuguuuggauggacaaaagguguugaguuugaacuuggcuaaguuguugucuguacuguaggaaagaaaacuaaauuguuaguaucuguuuugugacacaucuuuuuuaaaagauuuauuuauuuauuauauguaaguacacuguagaugucuucagacauuuucucuucuugcucggccccacucgcuugcuguagcuguugucagacaccccagaagagggcaucagaucucauuacggaugguugugagccaucauuugguugcugggauuugagcucaugaccuucagaagagcaguuggugcucuuaaccacugagccauuucuccagccucgugacauauucuuuaagcauguuuugaagguucauaaaaagaauuagcaauagaaaacaggaauguucuaaaacagcaguucucaauuugggggucaagaccccuugggggugucaaacaacccucucacugggcauuuuagauauccuguauaucauauuuacauugugauucauaacagcaaaauuacaguuaugaaguagcaacaaaaauaauuuuguuuuuuggggucuccacaaccugaggaacugucuauauuaaaggauauuaggaagguugaggcccacugcucuaagauggcuucauucuuucagucaggugguuuucauucuuuuccaugcuuacuuuugugugcuuauuaucagcuggauuuuaugucuuaguaguucccauucagauagauuuucuuucgguccaucuuuuuguuucuugagagauaggguauuaugcagguccuugcugaccuaccagucuauguaggugccaggcuggccucaaaaucgaagcaguccuccucugucuggcuccuaugucuugggaacacagcacuugguuuagguuuauuguauuucuuuuguuguuguuguugauuuuugagacaggguuucucuguguagcucuggcaguccuggaacucuguagaccaggcuggccucgaacucagaaguccaccugccucugccucccgagugcugggauuaaaggugugugccaccaccgcccggcuaaaaauauuuuuuuuaccaagauguauauauauauguguguguguguguguguguguguguguguguguguguguguguguguguaggaacauggcugcagaugcagaggucagagguuucuggucacaagcuaccuggugugggugcuaggaacugaacucaggucuucugcaagaguagcauguguucuuaaaccauugagccaucucuccagccccuuguuuuguuuuguugugauuaaaaaaaaauuuuuuuuuuuauguagaccaaguuggcaucaaguuuaugaaccuccuguguuaauuaaucaucacagagaccugagaguacauguguauaacaacaugcaccaaauuauacuuaucagugcucucuugcuuaccguuucacuuuuaucuauguguauguguuuguuggugguuggagagagauggcucagugguuaaaaguaaaagcgucuguugcuuuugcagaggacccaaguuagauccucaauacccaugugagguggcuuauaauugccuccaggguucuaaugucguugacauccacggucaccuacauucacauguacuuacauagauacacauaauuaagaauaaaaauaaauugaaaauuuugaauaaguaauuaaguguauuuguguguagguauggacaugugagugcaggcacccuuggaggccagaagaggcuguuggguccccuguaacuggaacucuaggaauuuggagcugcuauaugugugcagggaaccaaacuugguuccucccccaaagcagcacaaccucucacccacugagauggcuccaguucccucaguaauucuuaugucauugauuggcacuaauauccacccugcccaggccagaauuccuucucuucuucucucagguuugguuuuauguuuuguuuuguuuguguagccuuggcuguccuggaacucaggcuggccuccaacucagagauuugccugucucugccuucugagugcuggauuuaaagguaugccugcuccacccagcuuccucuagacuuuaugugaguuuguacuaguguuucuuguuucuuuuuuuuuuuuuuuuuuuuuuuuaauggaguuauaagguacauuuuguuuuguguuuccuggugcuggggaucagauuuugggcacucuacccaagguuauuuucaagguuauuuuguuuaaaggauuagugauuaauaucuaaaauaagauuuuuagcuuuacauacacauauuucaggaauuuggguuuuuuuuguuugcuuguuuacaguuuuuuguuuuucuugagaggauuuugugugcauggcacuuauaucaacauuauauuuuaaaaccacgcuuuuggguugcagaaaauguaguugcuauagauucacuuagaaaaugauacauugguucagguggugguggugauggugauugcacgccuuuaauaaucccagcacuuagacaaaggcagcuggaucucugaguucgaggccuaccagguuucagacuaaguuccaggacagucagaacuacacagagagaaaccccgucuuuggggaaaaaaagauagagaaaaaaaaaaaaagaugauucauuauuguguuauugauauguaaagaacuuuauaacacacauuuuuugcuuuccagucugguuuauaauaaagcacaaacuuccacauauuuccauacauccuucuauagcaacguuguagccauuuuaaguacuugaguaauccuugacuuuaaagcuugaguuuguauguuaaacuaaaaaugaaugcaguuguauguucuguaucuguuugucugcccccagcccccaagugcuugcauggaggcuggcaauugaccuuggguguucgccucaauuauauaucuuacuuuuugaggcagaaucucugagucugaaguguguauccucccugauguugucccuacccucaugacacguguacuguagugcccaacuuuucugugggucuuggaucugaaccuuuugaggcagggcaguauacugacugaggucugucccuaccccuguggauguguuccuuuaccuucauacgguaccuauguagagagugacuacagguuguaagauauuaaagacucgugguaugcugacacaggaggguugcaagcucaggaccagcuugggaaucuuaaucauaacaagucucaaaauaagaaauuaaaauggaaaaaguaaaagggcuaugaggucccaagaucucucugcgcccccccccccccaguaacucaguugacuaauugacuauauuugaaauuucacauuucuuacuggauuuuuuuaaaaaaauauaagcucuacuguuagccauauuccaucuucugcugaaauuauuguuaaaaacaauauauauguauauauauauauauaucuuugaaaggaaaaugaacaugcuuuacaaauaguugcuuuuuuuccuuuauguaguccucuaacauagaaaagguugaaacuaauguuugucuuuaaagcagugggcuccaucucaugugugugugccgaccuucuuuuuaucuuuagauauuaggaucaaggaagaggaaccugacccugaagaauggcagcucaguggugacucuacacugaacaccaaugaccuaacacauuuacgaguacaagugguagaugaagaaggggaccaacaacaucaagaaggaaaaagacuucggaggguagcuugcaccugucccaacuguaaagaagguggugggagguaugcauacaucaaccacauguuguuguuuuaaggagugcuaauaucacccuaauuuuuaaaauauugcaugccuugucacuuaauuaugauaaauuauucauuacaugaucauuuugggugagugacuguaugaguggccgaaguuagaccaaaaaaaaaaaaaaaaugcccuuuaaaguaaauuugguuagucuuuaaaagaauuuaacagguacaauuuuauaggccccauuuuauuagccuauuugcuaaccagcaauaaguuuggucuaaauacugaggaaaaaaaauuacagcuugagaaugcuauauaaaaguaagaaauucacaaauaguugauaaguguaaauacuuaaauuuucaacagaaauggggaugaaaggcuuuaaugauggggauuuauuguuuugaaaguaaccacguagcauuuuacuucauucuuuuugguuuuucgagacaggguuucucuggauaguccuggcugucuuggaacucacucuguagaccaggcuggccucauucagaaauucgccugccucugccucccgagugcugggauuaaaggcgagcgccaccacgcccggcucccucauucuuuuuuaaaaagauauauauauauagacaaaaacacugugauaggaaugaguucagaaugguuggugauuacuuuaaauguagcuacaguaagcuuauuaagagauggacuuagaucauaaaaaauacaaaagccauccugauguuauuauaaguaacauuucaaaugauugguacagcguuacugaaaaugagauuaaaaaaagauuagucaaauguuagcaaaaagaaacuggauagcaauuuugguaucaagcaagaugcgauuaaguuggaaaguauuaaacaggcaugauuaugucauaaugacaacaaugacguuucuguuuagauucaauagucuuaguaucuguuuguccaguuuugaguauaugaagcaaagacagaauccuaaagcugugcuaaccaaaucucuagucauuguugugaaaggcuacaaugccuuucuccuauguacuaaaguaugcaaaaugcacugaagaacgguauuacuauauaggaaugcuuaugguuauaaacuugauuaucuuucagcucucugguugauccuauugauugauuuguacuuugaucaguucauuugcaacaauaaugacuaggacagagauauuucucagugaggcccaaaaaccacaaaaagggaaagggacugauagcuguuaacauuugaaaacuuacuauguucuuacaagugguacauauguaucacacauagguggauuacuuaaacgcacaugugcagucagugagagagaauugccgcuaguuugaggccagccugagcuauaguguaagaccaugucugaagagugagaagggagaaaaaaaaccccaaaacauuuuacaacuagauuuuguacccauuuuauauauucccaagucuuuuuuuuuuuuuuuuuuuuuuuugguuuuuuugguuuuuugagacuggguuucucuguguagcucuggcuguccuggaacucacuuuguagaccaggcuggccucgaacucugaaauccgccugccucugccucccgagugcugggauuaaaggcgugcgccaccacgcccggcucauauucccaagucuuaaccuuauauuguguugcuaacucaggggaucugcuucugaaccugaccuuuagauauuuauacugaauguuuaacucugaauagguaguaacucugcugaaaauuacucucuuuuaguggcacuuucaagauccauuauuuaucaaaucuaauugggguucaaugcuuggccuugcgaacauuuuaaaguuaaacauuuuuaauuaauuuuaauuaauuugcuaaacuaacauagccccaaaauuaagagaccaacacaaaaagucccacaaauaauacacuaccucaggguuuaaccaccauaauauuuuugugcaauauuacauauauuuuaaaguagaaucaucuucuuuucauuguuuaugucucuuguaaauuuuuguggccguauuucuaagucugaucugugucacuuuuuauucuauguauaauauauuguauguggauaaauaauaauuuaacucacacauauguccuugcacaucugucugauugucuuauuaguguauguugacagaaauagaauuguugggucaaaaggaauugucugcuaaauagcugucuugcuuucuccuuaacacuagcagugucuuaguuaccauguguaaccauuucuuacuuuuuacuuuaaaaaaaaaaaagcuuuuaaaguuugauaggcaagaauagcuauuuuagucuauuuuuauuuuauuuuauuuuacuguguguuuguuuuauugcuuggugagauugaacauuuccaguacuuuuuaaaguuuauuuugugaguggucugucuugugggacuguuaauuuauguguacuuucacacacaguguauuuucucaguucuuucuacauugcuuucugucagugauccauccgcaggcuguguucugugaaugaguaauggagcuugcuuacaaguaacagacauucuuaaacaacaaaacaaguuagguuuuuuuagaggcuaaaaauuaccuaugcccaaaauuguagaaaguaauccucugauagugugcuuuuuuuuaaaaacugcauugucuuauuaguguacuaauuuuaagcgauaaaaaauaccaagguucuuaggauaguaguuaagaguugaucugagcagaauucaauaaguaucaaugcaguaggccuacuguauaaauagauagugucuaauuauuagaagcauuaacauagucuaagaacauucugcaacuuaagauuuuuauuuuuaaagacagaauauuggcuuuuuucucaauauauacauuuauauacauaaauggauaagauaguauuuuuagaaaacuaauuucauucaucuuuagaaaacuuucguuuacuuuuuuuugagccaacuauaaaagaaacuauugucucaguaauuaagagcauugacucuuucccgaggacccagauuuauucucaacacccauauggcagcuuacaaacauccauaaauagaaucccagggagccaaauaccuuuuucuggccucuguggucacugcaugcuuguaguguacagauuacaugcaggaaaaggacucacauagacaaaaauagguuuaaauaaaagaaauuaaaguugucaguuagccagucuuuauauaguagaaccaguguaguugaagaaacaguuguaguaaugaaaaagugaccuaaaggcauuauuguuucauagguuuugcacgaauuuagcaucaauccauuacauuauuugcaaaguuuguuuugucagcauuuuucagcuuguguuucugccaccauaaguagaacagguagucguucuuagaacuugcuuaacucuggccagguuuuggauuaauucuguguugucauugaauuauugggggauauuuuuaggcagucagaaacagaaauuucaaacuguuuauuacaugggguuauauaguggguauaauguguucaggaugggaacaugauugcacuugaaggccucuuucccuuccuucauaggauuggccgugacaacauauggucuauuuaggucuuccuugggucagauuucuuuagguacuaacuuggacuccagcaagcuaagcauuuacccuaaauugugguauaguaguaugcuacuugauuuuuuuccccuuaggugcaugucccuuuguuuuuguuuuuguuuuucugagacaggguuucucuguguagcccuggcuguccuggaacucacuuuguagaccaggcuggccucgaacucaaaaauccgccugccucugccucccaagugcugggauuaaaggcaugcgccaccacacccggcacaugucccauuuuuaaugacuaaucuucauuuggcauacaauucaacagaaaaaaacaaguucccuacuguuuuucucagugcuuugagaacccguguuuguugcuguuuauuugucagccuuguauuuuguuggugcucacaggcuaaauuuugcuaaguuuguaaaaugacaccuuugaguuuauagaaucccaguguuuuacccaagggguagccuagcagagggaugugaagucaugagugaacugaguuggguuuccugugaaauugcuauggugagcgcaauauuuauaccaauaaagacauuguucuuucucuuaggucuacuuaagagcaaagcaaaauuuaaaaagcuaacuaauggaaagacuugagcauugaaaauaagccagaaaaauaccuguuuuucucaacucagcucuuuaaagagacuuagcaaucggggguggacuggagcaggaacuagaauguguuagauaugacauccgugcccugagacaacagcaugauuccuccuugucuuugcuuaugcuauuccucugccuggaaugccuucccuccuuucuaucuaaauccuacccaccuccuccacgaagccuucucuuacuaccggagcccacauugaugucucccuguucagaacaccuauggcaucuaacagccagcacugcaccguuuagcacuguuuguccuauggcaauuucacaugcuacugagugugaguacauuaaaauauaaaugugggggaauaugcguuuuuccagugaaguuugaaaaacgauagguauauuguguugaggacuuagugacuguggaaaguuuacaggcuacacuagacugaguugagggaggaggggaguugggggagggguuaaagguagcuuuuuuuuuuuuccuuuuuuugguuaaaucuuagagaaacacuguaaaguuuuaaugguguaguuuugauaauuauguccaaaaagucaugguuuaaaaagaauaauuuaguaacaauccaauuuuuguuuucaagaaauguuuuuguaguguuuaaugcuaucgaaauacaguuucuggauucaaaaaguuucuucuuucuuaaacuaagaugacucuguucacucaucuaagaacggcucccaaacuguccuuuguaucaaauacuuaaguguauuguaaacuuauccucuguggagaaaaugauauuuuguuauauuuuuugugaauaauuuugggugucugcaugguuucugggggaagauuuuaacaguaaagacaauuuugauuuguauuuguugugugggauacuaggaaaguuaacuuagcuuuagcuaauuuuuaaaaauauggaucuccaaaucaguguaugccagggugugaccguucgaguacuuauauauucuuaaauuauguuaauuuaaaaaccuaacugucuaucuaccuucuaauuguaccugugaugaguuuuuguauauuauucuuuggauaauaaauuauuaaaauuauaucugacaucaugacuuugaauaaaacuaguuuccuauacuauuaauugaauugguucugugcacaguauuugcgaacgauucugaugggauaguuaauagcuuuauugugcauucuuuguguaaaguguccuuuuaguuauauuuuuauugaauauagcuauaucagacaacagucaguucugggauaaaauuaauacauuaaauuuguguguauaaaagccauuaacucucacuuaaauagacuuaaaaugguuuugguuucugauauguugaugauaauauuuccuguuugaaauucaagaagcuauauggcauaaaugguuuugaauccuuugauauaaauguauauuauucuguguguuuuuuuuagagguaccaaucuugggaaaaagaagcaacacauuugucauauaccgggaugugguaaagucuaugggaagaccucacaucugagagcacaccugcguuggcauucgggggagcgcccuuuuauuuguaacuggauguucugugguaaaagauuuacacgaagugaugaauuacagaggcacagaagaacacauacagguuacuaauauuuuuauguuuucucuuuuccuuccuccucuucucguuagggauuaaacuccuguuuacuaagaacacuaaguugcaucccuagucucuaauaguuuuaauagacgaaauauaggcuacagaacacacuugacguuuuuucagcauaccuuucuugaucagaucuuuaaaaugggauuaauuaaaucaaaaauucacugucaguaacuaaauguuaaaggacaaaccaguguauacuuucuugugaaauaguuuuuuagucuauguagacuuggguuagcuucaaugacuguugaaugucuuaacacauauuuguauugucaguugacaaauuuuacauuauuugcuguugcuuauuaugcuagcaaguagaaucuucugcuaaauucugauauuucaucuuuucuguugaaaacauacuguaugugaauaaaaggcauuucagugaagcucaucacauuuccuguguacagugucucugauugugugagauggguauaggacugacucagacaaaucuaacauaauccaguguaguuucuucugcuaacaguaacugaucagaguguccaucagugucuauguaguggugaagaauugaaaacuggcagugugagaaagugcuuuaaaaggaacauggcuaaggaagggaacaacauggguuuugaagucugauccauuuagacuccuuucaguuuucuauuagguuaagcagauaauugucucuugcuucccaacuauuaauugccuuuuaaaggucauacaggaugaguucaggucugaggcagcacaugcacauuagguuuuccgcuuguuuuaguuucuuguuguuauaaagacagaagaugagaguaacuaaccucuuuggaacuaccaaaagaguauaccaguagcaagauuuucuguuacauuugugcugaauaugcucgggagagaaaguuauauuaacauugagugauuggaguguagacccuaaaauggcucccaacagaauuuuucccaugguauuuccucaguagguugugaaaaagaauaauguauauggagaagaaaagucugaucaaauaagugaguuauuuuaucacccaauuggguagauuaaagagagaacuugaacuuagaagauaaugccucuuaaaacuuuguuacugagugcucaguaaacauaguggcuuagguuaguaguguaauguguuagcauuuccugauuuccagaguguaugccgggacaucucuucugauugguguuucaaaagagacuuuaggaaauacuuccuuagaaaaacggugguauagugcugaaagugagaacuuuaucuuaggggugacacagaggaaaguaagcauuuuuacaugauccuuacauguuaauaggacugagacauagaaagccggaugaauuagguaggagaaauuugaacaggucaguuagcugcaagucacccuuucacauaagcaaucugaagagaaaagaaaaugcuuauuagacuuaacugccuuacagcucggaggaagucugcuaggcuggcuguuugccuuuucuucuaugaacuugcauagcaguucuugaacaugauggagggucagugucuuuuguguuuuuuugguuuugaggauuuauuuaagcuggaaaauaagcuagggcuagcauguguuaacaugaauauuuuaauaaacaauagacuuugcuauguuaguuugcccuugaugcucagcuagcuaucuccuuuauucuugaauuuaauaucauugaaugcucacagucugccauugcuuuaaucuauagcuauucugauuuuuauuugaauucacaauuauugaagguuuaauauaugacauaguaauuucuuuuaaaagaauauagacuuuaaaguggcccagauggcuuuagcaaguauuuaacagguuucaguucagagucuuagcauugaguauuaaaaucuuguuugaauauuaaacuguccaucauacaguauguuuucaucaaaccauuuaaugacaaauauuuugaguagagcuacuucuacaagggaacucuuacggggcagcucaugaaaccaguacaguuuuaauagacccuuuguuuuaggagagaccauauuaaucugaaaaauuggaauuuuaaaacuaaguuacugcuuuucuuuacaggugagaagaaguuuguuuguccagaauguucaaaacgcuuuaugagaagugaccaccuugccaaacauauuaaaacacaucaaaauaaaaaagucauucacucuagcaguacagugcucgcaucuguggaagcuggaagagaugaugccuugauuacugcaggaggaacaacacuuauccuugcaaauauucaacaggggucugugucagggauaggaacugucaauacuucugccaccagcaaucaagacauccuuaccaacacugaaauaccuuuacagcuugucacaguuucuggaaaugagacaauggaguaaauauuacacaaauacuuauucauugugguuauuuuuauacaguagugagaagaauauuguuccuaaguucuuagauaucuuuuuauugaugugcaaaaauuuuuggauugacaguaacuugguuauacaugacacugaaaugccuuacuuuguaugauauuccauaguauauuaaaaaugguaaaauuugcauggauuuuguagguacuuuuggaaucuagaagaaaugaaauuuuaccaaguuauauaaagagaaaauugaauuuaacaaugcgaaugguagucuaaccaaaugcaucaauccugugugguuuaguguaaaaaugagaaacuguugguauuuaucuauuguaagauaaaaaaaguuggugggugaaagaaaucauguuauaaauuuuuguaauuuucuugaugacuggaauuuuuauuaugcauaacugacaaaucaaguuuccaagcaaauguuacauaguguaggcuuuacuuagcuuaucaauuugucauuuugaagcuaauuauuuuaauuagguuaacuguacaauauuuuaagcauuacucuuguaagauuuugaaaacuacauuuuaacauggaccuuuagggauagucaccuuuuaaauccuguugaaaagccauguuuaagauuuaauuugccaaaauaaugucuuguuaauauucuuucaauaaugaaguugggcaauauaaccgauguuuuuaaaaaguuuaaaauguguagguugaagcauuugggugguaaaauguucuagugaauuaccccuuuuccugaaguuuggaggaccaaaaaauaauaauaagguguauugcgucuuagcagagaauuuuuuuuuuuuuuuuuaaauucaaucuugguuccaaaaaaaaaaaaaaaauaugucugccagggccuuaaaagccaucguuguaaauuaccaauaaaguauaacauaugcaaacauaacaaaaucacuuccacagugacgauacuccaaccauauggauauuagucauagaaacuagaggcuuuaugauauuuuuuuaaguuuuuuuaaucuagguagucugcacuuaaauaucaaccauuuuccuuuuuuugcuucuucccuuaaaauuuauauguauccaauacauuuaauugagaaauguauguuuuuuauuaugcuguauuuucuuuuuauuuuuuaauuauuguuuauauuuucaauuaaaaauguacaaaauaaaauuacauugcuggucuuguaagagcucuacacuuuuccuacauguaccuacaacuacagcaguucaucuauuucaggaaguugaauucuguucauuuguucucuuuaagaccaccucagauaaaaggcuaccuuauuguacguuuaaaguguauuauaacagugugguaguuaauaaaacacuauuuuuuuuuucuuuugaguuuguuguaguccgaugcaucuaaaauacugcaaugguauggauaagaaagccuggcuuauuuuucuuuacuuuagacuuuuauuuuuagauucuugauuucagaugcugggauuguaaauaaauauauuuacuuaaaaagagguguauagaggugcuggcaauuaauuuuucacuuaaaaugaauuuauuaaauauaacuugaaacuugaaaaauuua

SEQ ID NO: 850 - RNA, 9824 nt, Mus musculus
agggcgaggggaggagaaagcggcgcgcggggagcccggccgcgcucagccgcuccucaccugggccgccgccgccgccgcgccguuuccgugcugcugcuguugcugcugcugcugcuguagauacucgccguggccgccgccgccuccgccgccguccacguccaaggcagccauuuccucuuguuucacgggcuuuucgggagcugcaggcacagcgcggggggaggggggaggaggagggugggguggggaggaaggcgggugcggggagggagggggcccgcgagccgcggccacauuagugagcgccgggcggcccgggcccugccccuccccugcccuccccccggccgcggcggccacggcggcggcggcgcgcucccuccuccccuccugcugcccccgcccgccgcggcuguaacccuccuccuccucguucccuccuccuccuccccgcgcugccccugcccccucuccucuccucuccucuccuccccuuucccuccgcggcgcucgcuccucucgcaccgucagucacucgcacacgcccgcccgccgccgccgcccgcgcccgcacacaggggggaugcgcucccggcggaccgggccgcccgcccggagcccggcgggcacucggcgcuggggcuggaagggcuggacagcuggcuggcggagaugggagugcggcuuucugccuccgccgacacucggucgcacgcucccggaggccgggagccggcgguggcggccccgggcuggcugugggcggcaguggcagcggcggaggcagcgaggguugcucucucucggcuuuacguaccggucauaguguguuuaggacagcucaggcggggcuccccgccgccuuacacauggugagaagcgaaggcggcggcggcgggagaggaugcgggaagcggcggcggacacggccggagcgguccggggaauuuuuuuuuuccuauuuugauugacugugcgggaaacacaaaagguggagccuccagcccaaaaggggggaagagggcgacagcccgcccggaaguuccgccccucuucccggcucucauuugccgcuaggcucuccgucagcucuguucauugguccggacgccuguccgucgcucggccuggcggcgggcuuccuguuugcccccggguugaaggggagagacaaugagcggccguggcgccguagguucuccagaacggccccggcucgcgcguuaccccgcugugccagccucguuccucggcugcggcugccagacccgaggcgcaggccucuuccacuggcuggcccugugugcaggccucgccaggcugucggggagccgagcuggggaggaaguccguccccgguggcuccggcuccacucgacgucuccuccauccuggcagccgaccggacuggaucuccccagggcccgggcgcucggagcugcgucuugccagcgcugccaggaggccaccgccgcucggccccagggcugcugcugcuacugagcaaaccggacccgccccacgagcccugggggagggagcugguauugggggagacacccccuccgaggcuggaggaggacguuuucacacacauucagcucuuggucgcaagucggauccaucaccuucucauccucccgagcuuagcccgugguuaccaaccaucuacuuuuguggacccuggaggcgggcacuuagagcaaaaagauaucuccagucccuucauaaagaaaaaagguuuuaguucuggccagugauaucaaagcaggcuuaguuauguuuuuauucaaugagauacagucacccuuuaaaaucaguuugcugcacacacaaacuaccugcuucuuaaccaagaaagucagucaacauuuguuaaaacaguacaucuaaaaaguauccuuccucuugggagcguuuaguuacuuuuuuuuuuuuuuuuaaauuuuguacuuagugguguauuaacaccccuuccuuugacauccucaaugccuugcagucagucauucaggagaaaaaaguguucugcaaacaacagacagaacguugucuauuaccucuagauacuuuugcuuaagaaagguugaauuuaagaguaggaaacacuauccacaauacuuuuauuagaaaucuaccucaagcaagaauaaacaucccaauuauuguacuuguauguuuuguaugagguugaaggcaaagcauuuaaacuagcuuuguauacacgaacuugaaaauucaugggggggaggggcagugcauacaucgguuucagaagccuuuuuggacuuguuuuuuuguuuuuugguuuuuucucguugguugugguuuuuguuuucaagacaguuucauguguagccuugguuguccugaaacuggauuuguagaccagguucaccuggaacucacagaaacccaccugccucugccuccugaguacugggauuaaaagugggggccaucuccgccaacuacuucgugguaauuuuuaauacagugacacauguucucuuucucuugugucaugcaagcaagaacagucuuucagggccaaaaaccagauaacucaaacuagcuguuuugaggcaaagcucuuaaaaaugcacaucagugcugggcgguguugacacacgccuuuaaucccagcacuugggaggcagaggcaggcggauuucugaguucaaagccaaccuggucuacagagugaguuccaggacagacagggcuacacagagaaacccugucucgaaaaaacaaaaaccaaaaaaaaaaaaaaaaaaaaaaaaagaaugaacaucagcaagaguaugacucagcauaaggugagauucaguagacuucuccaaccacaguugagucacugugacacccuauguuaagaugaccaaaagcaaaauggucucuugcaagaauacuuauuucuuaacuagugcaaauacacuaaaguauaugcaaagcauaaagccgguauuuagauaaauacauguaguaacauacaguauaauuuacgguggauuaauauguuuuuguacagucauuaaaugagaaucaaguauuaucaugaacaaaucucgaaacaacaguaagaucuguuuuccccuguccccacgacuuggcccaguuucuuguuuucucucaagauuuucacaagcuauuccuggccaagaaacaaaaccagaucacccuauuccccaguagacuaggacaaaguugguaauaacaucagcuacaacuccaagagaaggaaaucaagcuuagucuguaagguaccucacugacuagcuagaaacguuauauggugucauggucagcgauuagucuaccauaucaaacuaaaauggagguacuauggggggggggggggguuugggcucugaauuuuuucuucaucuaaugaguagguucagaauauguagaccugugcuaauuauuaaaggauauuuuaaaacauacuaaguugugacuauauacggauauacauaauaacuguuaguguuaguuuuacuugucaauuuaacacaaucuagaauuaccugaaaagacagucuuaaugagggauuaucuggauccgucugaccugugucuaugagggacugucuucauuaaauuaacugauauggaaagacauaguccacugugaguggcaccguuuccuucauuuauuuggguccuggaccauauaagagcagagacaauaggcugagcuguaaacaugcaagcauucaauucucuuuuaguaaggauucgaugugaccuaaaguccaauaugacugaaguuccugcuuccuuggguucccuucuagaaaggacugaaauaaauuuuucuucuuuuaaaguuguucuuugucaggguauuguaucacugcaaccagaaaugauagcaauacagaaauucacuguaagucuucaagaugcuaaguuuuaaacaguuaaggacaaaagugaggaccagccagauggcuuagcagaucgggagggcuuguagccaaaccugacaacacuucagucgcaggaauccacaugauggagaaacugucccucaaguugucaccuuaccaugacacgugcuguaguauaaagcacaaauuccauaaaugaggaaaaugagauuuaaauggaauuccuagguguugugcuuacauguccaaguuuuaguuaaguuaggcugaggguaucaccauacuucauauuguguuaauauuacgcaauccuguuuuaaccuuuuuaaacaaaugaguaccugucgagacaguaaaacaagcauguccugacugaccaggaagagucagugacuccauaugacgaaggcuccagccuuagccacuagaaaauuggacugaaaugaggacugggagcaacucggagacaguugaggcauacaggucugggugccagaagauggacauggccuauggguggaaggauuuggaugcauggauaaaacaaggagggggucacugcgcagacucgggagccuuugccacguucuuagaacucuguccaugaacaaguuccuuggcaaaaaaaaaaauucugccaggccugguggcguacaccuuuaaugucagcacuugggaggcagaggcaggcggguuucugagugugaguuccagggcuacacagcacccugacuuuaauuaauaaauaaaaaauuuuuuuaaguuuaaaaaaauuaaaaacuuuuccauguaggucaggcuugguauaccuuguaaucccaggacuuggcagguugaggcaggagaaucucaaacucaaagcaugcugggcuacacagugaaacugucucaaaaugagagguaacaagggccagcuguaaucucaguggucacggacuuaucuagugugucagcaccucuguguucacuccccacguaacccaguguauaaacccuccacgggauggugcagguaccuccggggcuguucuguuucuuccuuaugcaagcucuccagaacuugccuuccugacaccaguuucaacauacaacccugaaacacuuccuccugagaaugcucuccucccuaaaccucagcugcuuucugguuuucucucaaaugaagucuccauuuuugcuacacuguccaauuuaaaaaaaaaaaaagaaaagaaacaaagaaaaaauauauagggcagugaaaaugcuuguugucuguuccuuacagcacccacuaaccacacacaaccauuagugcuggaaacaugaccgaguggcugggcaauugaguuauuuuaaugauuguaaacuuaaaugacugcacauggccaagggcaaauguauuggagagcacugcuuugaguaucugccugcuuccaagcccuacauauaaauaccuguccuucccuggggaagcucagccuuccugcaaccccuggccaucauuguaaacucaggcccaugccugaccuuuaguagucugcugucugcuguucaguauccguaggcaccauaaauuccuccuaaauguuucacuuagccucaaacugcaaacucgcaaaauugaacuccagccugucugacacagcuccgccuucccuuuggacacucuguccccaacaaugaugcugucauucucucagaaguccaggcaggagucagguuugauacaucuccccagccuucccacuagcagaagccauguaguacuggcaaguuuuccugcauaaucucucuuaaugacuuguuuguuacaaccacaagauuuauugaccccuguucugcaaaacacugcaacgaucuuacccucagcaaauuaaaauguacacaaaucaaaaucacagaaaugaaaaauuaagucuaaagcacacagugguuagaggacucaccuaggguccugcacucauuucccucuaccacaaaagauuuuuaaaaaccaaauguauugccauagaaggucucucgagugucucucagaccaauggcugaugcagcaaagcgugcuuugcuccacacccuucccugucucaaugucugccacucuauucuuccuuuuccgagcuccugcaccuuuguggauccugugcaaggacaucccuccuaaacccucacugucccacaguuaaccccucuugugccuugccaacaggaguucccauccuggacucucuguguuucuagcaacucagacaagaauuuaagcucaaagcaagccuucccauaaagccaucacuuccagcuguaauucccuccuuuuuagcuuuccauugcacuucuaggguacccuucaguggcucuuguaacucaugauuuacaugauaaaggcccuaucuguauguaauacggucugagcccuccaaguugaagaagacagcuugcaagucccaggccaggcugggccacaagucuaccauucaacucaugauauagagaugugaagucaugaccuucagguguguacccuuucuucagugagccucuaggcuccacugcauaguuccauacuguugggcaagauggcccuuguuaaacuugucacaaaacaaaagacaugaacaagggagaggaaccuauagggacaaggaagggggcagccagccugagaagacaagggagagugugggaggagaauaauuagaauaaauuaaauacacuuaugaaauggucaaagagccgggcgugguggcgcaugccuuuaaucccagcacucgggaggcagaggcagguggauuucugaguuccaggccagccuggucuacagaguaaguuccaguaucagccagggcuacacagagaaacccuaucucguaaaaaaaaaaaaaaagaaagaaagaaauggucaaggaacaaauuucauugaaaagaaaaauuuuuaggauacauaaaauguauagauacauauaaaauuccaucuugguguauagaaauguuucaaaacaugcaaaaauuguaaucauaccauauuaacaaaaccaaacaaaaacaaacugauaaaauaacuuacaaagcaauacuuacauaucaucuaauauuaaaauauguacuauauacaagucuuaacacauaauaauuaaauggcucugucuaugccuuuaggccaucuauaacucaagcauucugucauccaugaugacaagugaccuuaauuguauauuccugugaguuguuuuucuuacucuaucaaaaguguguuuaauuucucuagucaauauuuugccuuaaagcucuggaauuauuccuauuauucuaguuuauugauaugcuuuuccuucuccacucuuugaauguucugacuuuacacuccugugagauaaucuuucuacuucauaucuccucuacccugaacugaauuaagccauuuaucugcuuauguuccugggcuacucgacucauuucguucuuucuuuguauugaugaacccucccucuaguuuuguguaacaagcuuacuccauguuccuucuuccaaaccauuggaauaaugaauaaaauugguccuaauauugaucgcuagagcuucaugguccauccauccaaaccauuccacacuuugauaucaaaaucaauguuuaaucgacuuaaguaguucaucccugugccauacucagcugacauugagaucucugauuguacggugucauuuccuggcacugugucccaaagucuuaagucauugauugguucuuggcuuccuccaauauuauuuauuauuagauucagcaauuauuuccuaacaaugagguagauaagaugaauucaugcagacucucuuuaaauuaaaucauaacuuucugauguuuccaauuguugauuuccuaaaaaaaaauccaccaauaccuucgguacagacacuaaucuuaauaauucuaaaucuuguacucaggguggggaagaggguacuuagugaauuuuaaugagaguuuugccuauuauacauuacacauuauaacugucaaagacauaagauaaaacauuucaaguccccuuuugucuuuauggaagaaucugaacaucuauuaagaaucaagaagaaaauauuugaaucacaauagugaaaacucaggagcuguaauccauaaaugauguucuacuauagauaaauuauacuugauuuuaaaauguauuuuaauuuuauguguauggauguuuugucugcagguaugccugcugcucauggagggaagaagugagcuuguaaucccuuuggagcuagaguuacagauggcuaugaguugccacagggauccuggagauuugaccgagguacuuuggaagaguauccauugcucucgacuucugccaucucugccaucucuccagccucuaguuucuuugaugauacaaauaaauacaucaguaaauuccucacucuaaaaaaccccagcugaaccccguuggaggguggggugauacagaucucuagagaguaucucaucggcuauuucuuguagaaacuguggaguuucagucuguugguauguauuguaauguuaaauucugccuacagcagacuugucaaguuuacaaacuuuuguagugcaaaccuuguuccuuaauauaauauuucacguuuacaagcuuuuguugugcaaacucuguuccuugcuuuaaaacaguugcuuaaauaaaauuggcuacagccaauuacaggaaggauuagagguagauggcuuuugaguuaccccaggggacugaggagagaccagcaagaaagaagggagaauuagaggagaggaagccaccauggggagagauagaccacgagcacauggccaggagaagcagcaaguaucuggggacauagccaggccagcaauuagaagaguuagguuaggagugacuacccaauaauugucgcagccaaagaaaauagccacagucugaaucucauuuauuuuuaagcuagucagagauaagcuuaaauugguuguacuacagcaaaucuuucuaaaauuacauuuacuuuuuuuauuuguauuggugcaugcccacguggagccagaagaccacucacagguugauccucuuguuccacgaugugaguugcagauaucaaacucagguggccaggccuggcagcaagcucuucuggccguucagccaucucacuggcccuguggaaaucuuuugaagaagauggacucacaugagcacaaguucagaaaugaauaguuugaaaguagguucuuggaaaauaaauaaauaaauaaauaaauaaagacaauggaauggaaagaagcaaaucuccugcaagcuuguuuaauauacacuaacagugaauacauuagaaggccagaugaauaaacagaguucccuguaaauagcacacacuugcaucuccuuuaauacgacagcuaaacaagacaggacacuaaugugaauuggcuugauuuuucugaaaucaggaaaccuugcacauccuaggaccacaguaaauguauugaauugauauuuaacuucuucagcucaguuauccuguaagaccccaacucaauguguuucuuagaccccuagaaacaaagcccagcauggaguucuuuguucuuucgccuucagccugagagaacgaugaccacuggguggcccacccaggugccugacucauuguguaagggaccaagaauguuugccaaagauagccuguaaccuuuccgugagagaugagcuguaauucgucauccccauucuuaggauguuuacucagcuuccccauucuuuguggucuuauccuccccucacuuugcgguuuauucuuuaaaaacccucaacugcaacugcaggguuggggguggagguguugaucuccucugccccuguacaguuacgagcuuggccucagcaugcugauucccgaauaaaccucaugcgauauugcaucaag

SEQ ID NO: 851 - RNA, 5496 nt, Mus musculus
auagccacagucugaaucucauuuauuuuuaagcuagucagagauaagcuuaaauugguuguacuacagcaaaucuuucuaaaauuacauuuacuuuuuuuauuuguauuggugcaugcccacguggagccagaagaccacucacagguugauccucuuguuccacgaugugaguugcagauaucaaacucagguggccaggccuggcagcaagcucuucuggccguucagccaucucacuggcccuguggaaaucuuuugaagaagauggacucacaugagcacaaguucagaaaugaauaguuugaaaguagguucuuggaaaauaaauaaauaaauaaauaaauaaagacaauggaauggaaagaagcaaaucuccugcaagcuuguuuaauauacacuaacagugaauacauuagaaggccagaugaauaaacagaguucccuguaaauagcacacacuugcaucuccuuuaauacgacagcuaaacaagacaggacacuaaugugaauuggcuugauuuuucugaaaucaggaaaccuugcacauccuaggaccacaguaaauguauugaauugauauuuaacuucuucagcucaguuauccuguaagaccccaacucaauguguuucuuagaccccuagaaacaaagcccagcauggaguucuuuguucuuucgccuucagccugagagaacgaugaccacuggguggcccacccaggugccugacucauuguguaagggaccaagaauguuugccaaagauagccuguaaccuuuccgugagagaugagcuguaauucgucauccccauucuuaggauguuuacucagcuuccccauucuuuguggucuuauccuccccucacuuugcgguuuauucuuuaaaaacccucaacugcaacugcaggguuggggguggagguguugaucuccucugccccuguacaguuacgagcuuggccucagcaugcugauucccgaauaaaccucaugcgauauugcaucaagaacaguuucucucaaguuauuggggugucgccucaucccgggacuugggcaagggucucuccugaaacgaggaucuuucaauccuaucagcuguuccugacuuguuuaggauuuuucuuuuauuccucccuucccuggugcccaugggagucaaaagggcauuggauccuguggaauuggaauuacagaugguuucaaaccaucaugugcgugcugggaaacaaaccuggguccucucacaagagcaacagauguucugagcugcuacacuaucaucucuccagacugcuagaauucauuuauuugugcguguuuuuguuuuuguuuugcuuuuucuggacuucucuguguagcccuagcccuggcuguccuggcacucacucgguauccaggcuggccuagaacucagagaucuaccugccucugccuccugaguacuggaauuaaaaugugugugcaacagggcucagcuaggauuuuguuuauauaagagcccaggugccuuuggaggguaggugaggacuuugaauccucuggaccuggaguuauagcugguugugagcugccaguccucugcaagagcaguagguacucuuuaccacugaaccaucuuuccagcccuaggaaagaauuuuuuuuuuuuuuuagaaugucccuaaauuugagucaucugauauuuucaucauguucagacugugucauggguuuuggguccugacuuauuuuuauagucagcaaaugucagcacuuauuuucaugguuacauuaaccauuacagacuuuaacuccacagaacaccauuuaaguaaaagggauuaaauuaaaucaguugagcaagaucauauaauuagagugaaucuucugauuugagauacaguucucacauuacugucucaaaaagggcaacaucaaaauuacuucauguuuuaaaaaaauuauuuaaacuuagaaaaugacagcacucauugcccaaguuccucuugaagcuguaaggcauuaguuuucuuucuauagacauacauuuucuuuuguaaaaacuggauuauagacauaauuuucaauauaucauuuauauccuguuuuaguugguuuuuaugcugugaagagacaccaugaccauagcaacucuuauaaaggaaaacauuuaauuggggcuggcuuacauuucagagguucaguccauuaccaucaugggcagaagcaugguaguauccaggcaggcauggggcuggagcugagauuucuacauguugaucuacaggcagcaggaggcugggugccaaaugaaucuacaggagccauagcuaaucaaaccaugacaccuccuauauaacaaacauugcuggcaucauuuuuaucgcuuguguaaaacuucauggcauagauaguaucugugcagaacugugcaaacuuccaggggccaaagauuaaaugucuuuaagcgugcaguuaagucaaguuucuuccuuucauuccuuuuucuauuguucuuuuauucuuuguuuggaaaugaggucucccuguauaugccaggcuugccuggaacucucuauacagcucucaacaaccuauccuuacaacucuccugccucagucucccuaccacaccuggcugucaacucuauuuuuaccuuuauuucuggcaaacuugauaccacgaaucaauguaccccuuccucucauuuuguugacuuccuuugaguacugaguggaaggagcauuuuuuuaauuuuucguaagguuuuuuuuuuuuuuugguugugguuuuuuugguuuuuuuguuuuuuguuuuguuuugguuuuugguuuuucgagacagggggguuucucuguguagcccuggcuguccuggaacucacucuguagaccaggcuggccucgaacucagaaauccgccugccucugccuaccaagugcugggauuaaaggcgugcgccaccacagccuggcugcagccaauguucuuaacuguggaucccccuucauuugcuucuugaagugauauugaauuuucucucucaaagaugucguacuauuaggaagugugagcuagagucacuugguuuuggucugugggaggaguaagauuuucuuuuuuuuucuacauuuguuuuauugcaggagggcggggcgugcagacuucaaggacaacuugaugaagucaguucucuccuccuaucaugugaaucccagguauaaaacuaugcucauuguacuuggcuucaagcacccugacccacugagccagccaucccaacaggccugugcuugguuuuacuguggagguuuguucugaaucuuaguccccucaggacagccacugagcccuuggguuccccugcucuccggccaggcaaggcccuggucgccacagcuccaugcuuuagcagaaaaaaaagaaauggcaaauucaaaggcacacugcuuuggacacugacaaauccaggcugcauucuaccuccaaggaaauacauuccaaagacaguaguaacaguguugacucugcugugaaaagcauaucuuuagucagguggugguagcacaugccagcccuagggaggcagaggcaggcagaucucugaguucgaggccagcuuggucuacagaggaaguuccaggacagccagggccacgcaaagaaaccauguuuugaaaaacuuaaaaaaaaaaaaaaaaucuagucugcaauuagccccaaagcuucgugauagccuuggucuuggugcugugguaaauaagaauuccuaacacacugacucugcccucgccucacauccaggcgugcuuucccagaaaggaaucaacuccagagucucaaacccagcucagggaagucaagauuucucuucugguuuccucuucucuucaguuccauuuuaggacauuuuaaauaauggcaccuugaggguagauggcaaggcuaaaaacuaacagaaagauucaaaaggaaagccuuuauuagagacugcccucgucaguuccuagccugauaaacaccguuuccaaaaacagcaugggaaggaaauucuuucauuuuacagcucaaagcccaucaugaagggaagucagggcaggagcucaagcaggaaccuggaagcaggaacugaagcagaagccauuaaaggaacagugggguuuuuuuuuguuugguugguugguuuuuuuguuuuguuuugguuugguuuuuuuuuuuuguuuuuucgagacagggcuucucuguguagcccuggcuguccuggaacucacucuguagaccaggcuggccucgaacucagaaauccgccugccucugcgucccgagugcugggauuaaaggcgugcgccaccgcgccgggcugggaacaguguuuauugacuuguucauuuugcuuccuacauacccaggaucaccuggccagagauggcacuguguugugggaaauauuuuaaaagacaccauuccgugcuaaugccggcuacucucuggccccagacaccucgcugcugccguggcuagccccaagcagcgaccgcccaucuugcgguucucuugcugcggguucugcucacacucucagucaucuacccccugugguuagcagucacaaauuccaguaacccaguaaaaucaaaauucuagaggcuuguaauuuaucagucagauuuauauuaguaaauucucaacccacaaaacgccugcacaaugaacucaaaacucaacugaaauaaacacaagaaucacagcuagauggggcaaaugcaccccacuuaauauuuaaucaucuaagaaauccccaauacuuauggcucccaagacuaugguucuggcuccucuuucucuccuauagguuccaucuuaucucuuucucuccuucccuucugucucuccucuccuucuucugucucuucuccucuuuaaaauucucagcccaccuuccuuuuccacuguccaaucacaggcuucuuauauuaauauuuagauuaauuggugggaaauucugcuacagcacugcccacagugagcuggaaccuuccaugucaaucaagaaauguccccacagacuugcuguaucagucaggguucucuagagucacagaacuuaugguacucucuacauaguaagagaauuuguugaugacuuacagucuguaguccaacucccaacaauggucagcagcagcugugaauggaagcccaaggauuuagccguugcucagucccacaaggcaagcaggcaaagagagucuucuuucucccaauguccuuauguaggucuccaucggaagguguggcccagauuaaaggugugugccaccaugccuggaucuaggccuugcuuugucccaggcugaccuugaacucagagauuuucuuggcuuagucuccucagauucauagccauuaugccucaagauguccaugucaauauccaggucagaaacuuguaucucccagccucaagaucaggaucacaggggagccuuccaugccgggcgugguggcg

SEQ ID NO: 852 - RNA, 7857 nt, Mus musculus
ggaggagcgagcaggagggcgugggcggugugagagaagaaaggugaggucggggagccuaaaggagcccagcccuggcgccggaugucucugucguauugguuucugacuucgcuagggauaugagacuaugaagggagaagcgcuucuggaccacucuccguguaccgagaagccagagcuggagagagagcuacgcuuaagguuuuggagagucgggguuugccagucaucaccuccgcccccaugugcacacugaagcaaaauaagucagcccugcguagaaaauagaaaccuuuucuuagagaguucuuuguucggauuuuacuaagccagaacuggagccgaucuuccccaccacccuaugucaaguauaugguauauuacauacgaguauguucaaaggcagugaucaaaaggaaauacaccgucuuccacccccaugucaccauauuuuaaaacaaagcaacgaucuuuuuccuagagaaaaauucuuguaauuaugaguguuucuuuuaucaaauuuccuuuacuuaguuagauauaaaaauacaaauuucagggaccgaagagaugucucagcgguuaacaguacuggaugcgagccgggcgugguggcucacgccuuuaaucccagcacucggaaggcagaggcagacggauuucuaaguucaaggccagccuggucuacagagugaguuccaggacauccgcaaguaacccuuaagccgucuauaacuccacuuccaggguaccugacguagaauuaagaaauuaauuaaaauuauuaauuucaauagaaucacuucauucauuuaaagcuuaagagaucgguauuaauuuuuuuauuuuuuuaaauuuucgaggcaggguuucucuguguagcccuggcugaccuggaacucacucuguagaccaggcuggccucgaacucagaaauccgccugccucugccucccaagugcugggauuaaaggcaugcgccaccacguccgguuugguuaauguuuuaaggaggacuaaaggacgccaaugagaacccagcagagaagaggcauucuucccacaauauuuuccuuugcucuauaaauuguagugccaaagaaaugccuguuaauguaggaaguagguuucaaaaaaacuagggggcggggcgggggaaggaacuggacagaugguuaggagugcuugcugauguugcagagcacccaaguuuaguuuccuaucaccacauaccugcucagcugcucauaaaagcgggguggggguggggaucggacaaccucuuccagccuccgugggcauguggugcacauucguuuaugcagucaaacacucauacacacaaaguaauguccuuaaaauugggggcaagaagaaggacgacugauuaguguaaugacaaugaaagagacagaccuuuacagaccuuuacaauuccauaacugguucaggugcacuacuccuaaacauacuuauuccuacugaagauuuuggugcuuauuuuagggauguugguuguccaauaaauauguacaaguugcaaaaugugauuaaggcgccugugaaaucuugcacugauuuuuaaaaagcaagccuuuuuuuuuaguaucaugcuuuuccauuuguuaaaugcguauuucuaauuuagauuuaugaauacaauucgugucuuuacauaaaauacacccaauuucuccacgccaagugaaucuaaaauuguaaguuugucuggaauaguaucugagaguuaaugagccugccgucuaauaaugaugccuagcaugaaagugaaauuguaaugucacuggaccuucuaauagguugcuggccuguauacauguacgugagccaacucaaucuuccuuuaaaacuagcuuaauuacuugagaaaccugaaagaaaccagauuauuaacacugucgguucugaaguuagaaagaaaguaccaucuuguaaacuuaguaacagugcaguaaugucaauagacuugaacacuaauuauaucagcaaggugucagcugcucauuacugguuggaaggcuaacagacaagaauauaggccugccagaucauaaguugcuagguccagaugacugucucuaagaugcugcuuuccuccagccgacaauaucuaacccaaggggaaaaaaaccuaaaaauguuaaagcacuucaaaagaacuuuguccauuagaauugaguuuuuacauugcuuuuucaccauguauauuaaaacacuuuuuguuuguuucuguuuuuuacuauguaguccuaacuguccuggaacuugcucuguagaccuggugagccuugaacuaacagagaucugucugucucugucucugccucugcuggguuauagguguguguauaccaccaccaagaccaccaccaucaccuggguaaaaauggaaauucuugucuccagauugauuuauuuucaucucaagugacaguagcuuuggcauuagauuuucugcuaucaaguuauuaucuauaucaagauauuaucuauaucaaguuauuaucuauaucaaaauaguaucuauaucaaguuauuaucuacaccugguacuguuagaucucaaacccagcucuccuaagcuaaaugucuccagucuaggggcagggcugcccuccccuauauaauccagccaaagccuguggcagguagggacugagggauacugaaagagcaugguggccagguccacuguaauauguuacauaggcaccucaguuagcucucuguccuagguuugaugccuagaaguacuagaggaacaugugauucuaaggaaaauauuuucagaauucuuuuauauaagcaaggaaugugauuuuuuuucuuuguuuugaacuuucgguuuuagcuaacucuaaagaugccuaaagugagaaaaaacaaacaaaggagaucuacguggagagcagauccagugcaguguccuuacuuaggccugguggcaggccagagguacacaaaggcacuccuuuaccucugggcuauaacagcccuuuuaccauagcuuuccuacaaauggaaacaagcuaaguguggauaauuacuaucuucaguucugaucuuauguaccagcagcucucacuguuuccagccgaauaaaauguaugcuuccccauuuccccucucagauucccaucugccguaaaauucaucuuugguuacaaaugcagggaacuuccuguagggcccuuauuuucaugguuuucuuguugcauacauuaucuaccucaucuccaaggaggguuagucuccuuuaagaacuugauacagaggcuggagagagaugggucuauggguaagagccauggcugcuguaucgugaaaagcagauucgcggcuugucagguggcucaaaaaggacugugguaacuucagcuccaagggaucugacacuguuuuuuggucuuuaagagucccuacacacacacacacacacacaaacacaggcacucacaugcgugcacaaacaugaaaauaaaaauauuaaaaggaauuugaagugaaaugcuaagucuggaaaccuguauuucauuuuauuccauguguuauuuuacauuuuucuuauuuggugcauugauacauagggacugucugaaaugucuuaguguccuuuuguguaaaugccuuacaagcaucuuuacugaugaggguuacaauaucaauguauauuugucccuauaugcaagauacauuuauuaaccaacaaugacuuuuuuauuuuauaugcaucgguguuuuguccgcauggaugucugugugagggugucagacuccuggagcuggaguuccagaccguugugagcugcugugugggugcagggaaugaguagcuaguacucuugacugcugaguaucucuccaccucacccccacagcuuuuaguuuuggauuuuagaaaugggguuucacuguguagguguggcuguccuggacucagucuguaguccaggucggccuccaguucacagagauccaacucccccuaacuccugagugcuggaauuaaaggugugugccaccacccgguaacaaugauuuuuuuuuuuuuuuuuaaagacaaaaagggagcacagcuacugagcaaaguaauaucauuuaaguacaagaauagguuguuuggggcuggugagauggcucaguggguaagagcaccugacugcucuucugaagguccaaaguucaaaucccagcaaccauaugguggcucacaaccaucugcaacgagaucugacgcccucuucuggagugucugaagacagcuacaguguacuuacauauaauuaauaaauaaauaaauaaaucuuaaaaaaaaaaaagaauagguuguuuggggaacacucuuaucuaucauaaaagugcucuuuuacuaaaugcuacaagagucagcuguuaaugcuuucaaacuuaacagcugucauggaugugcuauuucagccuugggauggggcuauuuuaauccccuagucuguuauugcucauuuaaaagucuacuaaaagguguauggacacacauacgcauacaugggaggggguauuuaacugauaaaacaccuuuuguauguuuagcuaagcaaaacagaauacuccagcagcucucgugucugucuuauacaacuaacuugaagcucauggaaaaagcuuccacauucucaugguaucaacauacauccuacuagaguggauuagcuuagacuuugccaguugggccaagugggauguggcugaugugauguaaaaaguauggagaaagugggggcacguacacuaggccaaugucuaagguggcacaaagacagcauggccucagauaucccagucucuuccauaucguggcaggucgucuuucccauccucugacggcccagggguuuccugcacauugcugaaguguuaauguuuuaauuaccucuuagcaucugucuucaccauagaggcuucuauucagaacguuguaaguacagaguuguccaagugaaaccaaauccuugguuucuuaaaagaaugguagcuaauguugugugacauugcgggggaaauuaaaaggcuaugcuucaucuucaaaucauaaaaguuagcuugugagagaagaaaauggauauucagagcuuuguuuuuauccuugacaacuagugucuccucuugucuccaucugaccugauagaugccauauuccacccucucaaguuagcaauaaaaguagaugggacuauuuucuagcauagaaaacuuggcccugauucuuggcaaaaauguauacuuuccuucccugaaugacaaaauguaucuuagguaguuugucucugggaaauuuaaauacugaggaacaauaaugaauuuuccaaccauuaagagaccuagccaaccuuguguagcuguuugagaaaacaauuccauuacuuguccuuaauggucccccacaagucugucugucuguuaaccugaggccuacauaauaccaaagccauggauuucuuagcccagaaacuuagggaggccucuuugucccuacugucccacuuagauucuuagacuaauauacuguucauuccaggguccuucuuaccuuggacacgaccuguaggaucaacugucaaucaaauucucuagcucuuuacauguagagcaucaaugcuucucaagaaugaacauucuaagcacugcuccugccugagacuacaucccuggagaaacucccugugggccaaguggaccaugccacgggucagaagaauuaguagaguugagugagcucaaacuccguaaaccucagaguugagaaugguaggaguggggccaacccccugccuaacucuacgugcccugaaucaugaugccccacugaguaccauggcaaucagucaaguagcguacagaccuggaguucuccaugcuaauaagguaucuagguagaucccgagcgcuccaccagugagcuuuccuuuuuggccauucuuucccacaaaagguauuuaauccuugguucacccugaguaagguguaugcauuacauccaucaaauaaagguuuggacaagcaaggauggucucuucuucaaggauuccagauaaggccuucucucuuccaaccucucugcacacuuggcaaucacucagcaucaaacaugguucuacccccgucccaggcucuuccuucccuuccugccuggcauguggaugcucugagggaaguaugggccgaggaccccauucccaacuccaggugcuuuacuuggaaagcaucaaggcuucucaagaaagaacauucuaggcacugcugcuggcugagacuacaauuccuggauagacaaccagcagcgccuggguacacaacaaucagccagacucugcugcuucccacccaggaaaacacagacugggagcccccauuauggacuguguugucuccccuacguggugggcugguggcuccaagcacucuggcagcaaggcagacacgcagccuagcaacuaccugauaagacuccuguacgaaagcauacugcauagguuaugauuuuaugcuuuauuuuuuuaagacgaggucucuagugguuugaaugaaaauggccuccaugggcucacagggaguagcauuauuagaagguguggucuuguuggaagaacuaucucuaggcgaucggcuuucagguuucagaugcucaagccagaccagugucauucucuuuucuugcugccuguuaacccagauguagaacucuuaacuaccuuuccagcacauuucuacauacaugccauccuguuuccugccaugaugacaauagacuaaacugugagccaaccccaauuaaauguguccauuacaaguugcuauggucacggugucucuucacagccauaggugccccaacuaagacacacacucucucuauagcucugguuguucuagaacucauuaucuauacuagacuagccucagaccuagauauuugucuguuucuuccaagugcugggauuaaagguguacacuaccaggcccauuaaguuagauucuuuuucccaauaaaauaaguguagagauauagcaugcaauguaacaaacucgcuauuuuuauauaauuucagaaagcuugagaguagcagauacuuuagguaucucuugagagaugggaaaauuugccaauucucugcuaaauacaagacuugagggaauaauauugaguuguccagaagccaagagacccagccaaucuuauguagcugcuuaaggaugcaguucuugggacugaaaugcaagaaauggaaucacuauggcuggaaagugcauauuuaugccacuguugaaaauuagcuguggccaaggccuauagguucccuugggagucucugccaacaucagcagaaugcuagcucuugcuaacaggaagaacaaacaaaggucuuugguuuaugagucucucuugaucuuaggucaauuuuuuuuuucaguauugaaacucccuggaggggaaaaaaagagucuaaguuacuaaauaucucagaggagauaacauuuauuuaugagauucaggugggaaaaaauaucaguuucugccaggcagcagauuaggaaguauaaacagauuaauagucgaaagaauguaaccuagagagauaggguuacaaaauuuacaaaacugaguugaacagcagacucagccaaccuguguaccucucuauagaguucuaaguaaaguguaagugaaauggcuacaaaguugaaagugaaauauuagaguauguuucucacugauauuaaaucugugguucucuacauuuuuuugguuugaugucuuugaacaccaaauaauacacaacauaaauaaaaguuuug

SEQ ID NO: 853 - RNA, 3960 nt, Mus musculus
cugccuucuuccuucagcuauucucagcucugucuccagcaccgugucugccugaacacugccaugcuuccugccaugcugaaaauggacuaaaccucugaaacuguaagccagccccaauuaaauguuuguuuguuuguuucuaagaguugcgguagucguggugucucuucacagcauuaaaacccuaaaacaggggagaaccuaugagauuauauuaucucaaaaaaacuauuuuaaaaaaaucaauaagaagaccagacguugaacuacagccauuuaucugagacauuucugcauccaucugguuuguucaaaguuaucagaacugggugcugaauagauuuugaaaacuauucaggcacuuuuuuaguccgaaaugaugauacauuauuaucucuuaauucucccaguuauaaugguggaaggcagcagaacacagugguacauggcuuuaaugucagcacuuggaaaacagaggcaggaggauuucugugaguugaaggcuagccuagucuacagaguugcaaagcucuugaaccgucauuuguucuucccaggacuucuagguaggucuucugagaaaagauuugucgucuuaaacaaaagcaaacaaacaaacaaacaaaaaacccuguuuuagagucuuacaaagaaauaaucccgcuggaguugguuaugaagaagcuaacuacuuggaagggugaaaguggacgaucaagguucucccuaacuuacauacugagcucaaggccugccugagcaacucacccuguuugaaauaaaagccaaaucagggucggcuuguagcucccugggagaaccccugccuggcacgugcaaggagcgaggcucagucugcgauagcgacaacaacuaaaaauuaucugcaccguuaguaacacuaacaaagccaagagucgucuucagugugcuuuucauuucacuggccgccagccggucacggagggggccugucauuguccuccucugagaguuaccaauaaaguuguuacaaagugaccuugagcgucuucccccgccuucuccauccgggugcugcggcgcggauaagagccgcaccgcgcuugcgcgcccagccccacugcuucgaccucugccgccgccacugccgccgccucgggagguaagcgaagguaaacggagggcgcggggcccgggccggggcggagcgggucucccggcccuguccaccgggcuugcgcuucccgggcacgcggccacgcugaccgccugcgcggggccccucggggccgggguggcaaggacaggccccugggggggacacuugaccuuaagccucuuuucgcuccgcagagaggaagcgggagaggagcccacgucgccugucaccuagauccacgccgcgccgccaggaagaaagauguucgccugcgccaagcucgcccgcacccccgcucuggugcguaacccgggccucggcccagcauucacgccgagggaccggcucuccuucacccuugccccgauguccucuccucccucccucccucccaacccuggggcccgcagacaguucccggccaugugucccccccgaggccuagcugacaggccuucugggcguaggucacagccuccuugcucguggagcgcgccccucccccaccgcccggucccuauggaguuggggucgacgcgaaggucggggugcugagaagucaggaaggggcagcugaggccuaguugccugcacagcguuucccgugcgcgucuguaggucaaacucgccgcugcagagggagggacuuugcuuccuugugugggcggagaaagguguuggggagccccgaagcuugcuuuuuuggaggcuuuaagugaagucugaaucuaaaagauuugugcuagagaaucggguccugguucuggagggauuuucugugaccuuaguguccguggacacucaagggcagagaagccagacugccagauguccuuauagugagaguauugcaacggcuguuaagcugacaucaaaaugcuuaacucuauaguaaauuuagaauuaguggguauuuaggaauccuuugaaaauuguaggagcuucauuagcugcuggacuguuguaaaugaucaaaaucauagcgacacccuuaugagcccacauaacuuacuugaauuuacagcacuacaguuacugaaacuuccacaacacucagucacuugguaacuaauuggucuuaggauuuuuguuuacagauagauuaaauagaacauuccaugguucauuagcauaaaauuuuagguuggcuuuguguaugcacaaugaccaaaggccaugcuaauugcagagauaauaaaucuguucguucucuucugcuuucuccuuuagaguuuaaaguugcacaagaggucacugaagacuaauguguacucuuuaguacuugaaauucuuucuuuuccuuccauuaauagauccgagcuggauccagaguugcauauagaccaauuucugcaucaguguuaucucggccagagacuaggacuggagaggugaguauuaauaacagaaauuaggaaacacugucaauaagucuuacagaguuguuaucaugaagggguguauuaaugggugguuucuuuccaguuuuauuaaauaauacauagaaggugagccacugagaggaacuuuuggccagcacaaccuucugaauuagcaaauaaauauuuuaggcuguauuuauaguuuugaguuaucuguguuuaaaauagccacgguuauccaaaaaagccugcuuuguugaaaagcauauucauuauucuguuuuauacuuuuaaaaauccuaagagguauaggucuuguuaacuaucuuauacgagauaagaauuauaucaagcucuugguuuucuuuuuccuugagccauacaauuauuuauucauaccaagcuauaguauaaagaaguuacugguuuuggcacuauaguaguuaaaaucaaugugauuacugaauugaccuuugccuuauuuccucuucccagggcucuacaguuuuuaauggggcccagaauggugugugucagcugauccgaagggaguuucagaccaguguaaucagcagagacauugauacugcugccaaauucauuggugcaggugcugcaacaguaggaguugcugguucuggugcugguauuggaacagucuuuggcagucuuaucauugguuaugccagguaaucaugucugucagaguaaggugaagacucagugggaaaguagacguggaaagagggaaaugaugaaauaaugguagcccuuuugaaugaagugucugcugugucuugcauuauauucugagcugugugugcacuggucacuuaaauaagugaggauagagcuaggggcuagggaacacgccuauaacuccaaccagucaggagagucaaggagaucacaaaugucaggaccccucaaggugguguaaacugaggauuuauauuugcauacgaagauagcucccugacuuuaugccacaugauuaggaguggguaaaauacucugagagacaaaagcaaagugguauaggagauagcacccccaugagacuugcaaagauccccauacuagauaucugacucuaccauuuacccaaugugcugacaucaacguugcuucacaguaacagucaucuguguugugucucuuuuagaaacccuucacugaagcagcagcuguucucauaugcuauccugggauuugccuugucugaagcuaugggucucuuuuguuugaugguugcguucuugaucuuguuugccauguaacagaaauuacugccugaaauguuggcauucauaguaauuacggauguaauucuguguaucuugcugugacuccgaagacuguaguacuggugucauggaaauauauguuauuuccacagucauuucauuaaagaugaaaacuuuaauucuugcu

SEQ ID NO: 854 - RNA, 64601 nt, Mus musculus
caggagguguuauguaugaugucugucugucucucuccacuugcuuggcugggauggcuucugagcuaugcaauguaaacuuuuuugcugccuucuggaugacagcugaucugggaucucagguacccucucuuuuccagacacacaggucucgaccuucaacgucccuccccuuuguccuccccacucuucucucgcucagaaggucugggacaaucaggaucaguuucuuuucuuggcgagacuggggcgugggaguuguucaugagaaaaggaggcagaacuaguaagagucagucggaaccgcccuacccuguggugccccgaggaccgacagccuacacuagcgcggaggauacucagccuaaauccuccugccacacccgccgcucugaggcaccaacggcugggccggccggaucacgugaugggggagcggcgcgcgccggcugcagcgcccauuggcuggcggcaggagcgcgggguuugaugggaaggcauuggccgggcccagcgcucuaucuguaggugcugcugccugcuccagaggcucuacgcgguggcgacccaggcuuccccgaguggacgcccaggccgagcggcgcccgcuuuucucagguaggacugugaagggagggccgcguagacggaggcgcuccggacagcgggaaccagucuccggguuccucggcgcgccggcccgggugccuccgccccugccaaguggccuagagcuugguggcggcuggggaacacgccgcggggcugcugcccuccguacacuguugccgccuucucucguggaucgcccugaacagcggcccgagcggcuccggagcgcacgagacccggcucugccuccccugaggccgguguucuuuccggguauguucucagggauuccgcgcaguggcuguuuagagcccgagcccuugggcccccccuguguuaagaagugucagaaggucccagagagcacaucccuagcugaaauauccacccugagagccccgaucaccuccgcguccaccugagcuggcacgacgggaaggucugaaaacugucagugucaugcugcuccguccgcgugugggcguggauugugagcgacuuagaggagcugcuccacaaccauuguccuuacuuauuggagggacagcgaccagucugaggggugggguaggacgaaggugcguggugacaggagcgacccgggaaaagcaacuccaaggggcaucaguagguuuaauucuuugaugguguguuugcggacggagaguucggauuggugaauuuauuucugcgugcaguuuuaagcaacaccugcgacucacugaguuuucaguguucuguucuuacuuuuugguuucugguuuguggugcuuagagccuauuguuuucugucucuguggccucagucuuagcguugacaacauugucuagaggugugauggaugugaguaaauuuaguuacaggcauauauauguucaagcuggcaggcagggcuaauaccuaguucccaaaggucuccauagugccuucuuagaagaacaaaguugauuucgaauacgaaccuuaagcaagagugguucauuuaaaagugaaguuuuaaaaaguuccuugacaucuauuggggucaccauaguaaugauguuaauaaauguuuaugguguuuauauguuggaagaaugcuuggauaggugacucuaauaaagguaugaguucauauagaaaucucccugucagucuuuuuuauuuuuaauuuuuauauuuauuuauuuugugguggucaucucauauuaaaagugcuuuuagaagugugcuuaccauuuuuuuuuuuuuuuuuuuugggcaauaaaccugguguaagauauuucagaguugccuauuuggacauuugaaagcgauuucgaacaaaucacauuuaaacccaaauuguguaguauaauguggagaugcuguuaaaggugacuaguuuauauuuaaguuuggaaucaaagguuaaaaaccacaaaacuccauuucuuuuguuguuuucuaugaaggcuuauacguuuauuauaaugggaagugcuugaaaaauacuccauuuauuuauuuccaugcuaggguaaaugagaaaaauauuuuuaguaaaaacacaaacuuauuuuauacuuacagauuuuaaauuaugaaauaauuaaaauaugcacucauuuaauggaauguuaggcacaugcuucauuuagauauuacaugugguuuugguaacagcaauaguaauggcuaaaauuaccuaaauacuaugugcuaaauacugugccaagugauaaauaaguucacuaaauuuauacaauuccaaggaauguaaauauucuaacugcuuuauuagccaaagcucagaguuuaagaacucucuaaguuuaagaucauauagcugguaaauggcugagccauguuuugaauccuuaucccauuguuuuaaugugauuugaagugaguugagaauucaagaaaaacacuuaggucugagugugaauaacaguggaaaacaucaucaguaugguagagggcuggagagcuugggggcacucagaugacccauauggugggucacagccaucuguaacucuaacacccacuucugacuucccugggcacaaggcacacacauggugcacauacaugcaagcacaauacucauacacaugaaaauaaaucuuaaccccccacauuuagaugcacucagcccuuaaggucauacaugcuaagucccauugugauaucagagcuggaaagagacugcacuuguuuggggacaagcugccugaggaagggagugauuuaugcuucagaaggaaaugcuagagucaagaaagugagauggauuagaaaauggcaauaaguacaucaagaaaaacaauuauggguaaugacuauguuaucagguacuaggguaagucaggacagaguuaagccuuucaacacccuagaggauucuaucugucuuuugcaaauaaggaaauugagaaacagggauauuuaauguuuuggcuccuuuuuuuuuuuuuuuuuuacaguaagugauggucagucagaauuggaguaaaggaaaggacagcagcaaugggugugauugagaaaugaacucaguacuauagaaaauagccaaucuuccuguguuuuacaucuguuaaaaaauacuaucauauguacauuauaguaaaucagcuuuaauacuacuagaaugugauagaaaaauuucugaagcaguaagaaucgauuguugcuaugcuuaugagagcauggauuuaaugacuaugacuuauaucucagaggguaaauguaaaagcacaacuucuugcuucagggagccuggaggcuaaaucauuguuuuuuaacagcaaaacauuuuccaaauaaauaacugacauaaaauagguauucauuaugaauuacgagcauauuucauaugcucauuuaaaaaauaauaugcaguaaagacuauuuuaggcuaguugaucuaaaaguucuaacggaaacccuaggaauuuagcaagccauuuagcuuuucucaaaugcaaauguaagcacucagauuuaaucugguagggauugggcuaccugaugcauucauugccauaaacacugucucuuguuuauaacucauuuucuauuuuaguagcuuugcuuaccuacuauuugagaagguucaaggaacucucacauauuuuauuuaacuuuguuuuuauuuuucuguuuuauggugcugagaauugagcuccgggaucuacauguacuagacaaaugcucuaccucugaccagcauccccagcuguuuauauuguauacauagacauucuagccuauagagcuauauuccagccuaugcuauauaaguacucuucauuucugacuucaugcuguuuggaaugauuggcugcauuaaaaaaaaaaaaaaacuaaaauaaugugucugacuuugcugccuaguaucuuuggggcuuagcauauuacuucuguagcuucagggucuuaauuugugaaguggagggggacaguaucuaaaugauaaaauucuugggaaucacuuguuuuagggcuucuuagagaucuugugccaaguguguaacugauguuguuauuaauuucagacaguaaaaggucagucuaagccaggugggacaugaugguacacguuuguaauaccagucaguacucagaggcugaggcagaaaaguaguugaggguaggcuagacuauauaggaaaacccugucucaaaaaauccagcccaaacagaauuuggucucaagguaugauuguuacaagcuuggaaggauacacuucuuuuagagauggaaauacgcaaucuaguugugcaugaaacacugucagauaucaaaagccaguuucaaaauaguguggcaaugacagagaaauacaaauaaguaaucaucuaaauuucuuuacuucuaucuuucuuggugauuauuuuuagaauccuaagauuuuaagauuuguuuaaucuugacucagaguuuauacuuuuguucauuagauuuccagaauaccucauaaucacauuuuagaguuucaaauacugaggaauaucuaucuaucuaucuaucuaucuaucuaucuaucuaucuaucuauauauauauguauauauaucuauaucuauauaucuauauauagauagauauacauacacacacaauauauauauguauauauauauauauuaauuacuggauuaauauuuaguuugcaacuuaauuguaguuuguaaaauuaaguuagcaugcuucagaguguuuuagaacagauaauauuuuugcccguaagaaauuacuuuguaaaugaaaguacuuuauaauuaggcauucauuacuuuucuaaaaaaagaaacucuuaaaauagauaugccuugagauaauucugacauauaaauaguauugcaguucuuacugggugcugauaauuauuuugugauuauauuuaugguuaagauaugugagauacaccuaugaaaauaagugugugugcgcauguguguauauguaugguuuuacacagauaaucauauacuuguagccugauaacuaucaauuuuagaguauaauauuaccauuucaacuuaaaagaauaagaaauuauaaaaugauuaucuguuaaguugauuuaugaucuuacuauuucugagucuuuauauaacauuggagaaucauagauaaacaaagagaauacacagcuagcugaacuuaaauucaccuaacuugagagucuuagaaguuuaguaacacaugcuuaaauuggguguugaacagcaguauucagaaacagaagucugaagauagaaggacuuuaggacuuauuucuuaugugcugugggggcaaaucacuagcuuucuugcucucuaauuuuuuuuucucuaaaguguuuauacuaaaaggcugccuugugauaaacuauugacauuacucacuuuaauucacaaaaauauuaaggcucagauuauugaaugauuuauuuuuuuuuauaacaagaacaacauagagaaacuauuaaaaagaccaggaaaucuguagguauguguauacuuucuaaagugauuugucauuaaaauuaauauuuugaacucuauuuuuacuuuuaaauauguccuuacuuugaauauaccaaugacuaucuggauucaaguuuuaaguggaggcuaacaaauaauuuacuguauuuuaauguaguauugcaacauaaacaauuuagagagaauguguucuguauuuaauuuaaaaauuuaaaauauuuuacuuuguuucuagcugugacuucuuuuggacaacucaugauauuuauuauugugccaaguuucugcaaauaaaagauggguggauuauuuucucgauggaggguaagaaaacuuuuucuguauugcuaauuuuuaaaaucuaacaaaaaguauuacaaagauuuucacaaaguuauccuuuagaguauacuuuugaaugaguuugaaaugauguauuuaauuccauuuaaguccauuagaauuacuucuuuggauauuauuuugguaguucuauuuauuuuauggguaucuaauaugucuaguaauuuauuuuuauuuauguauuuuauacaaguaguuuucuuacaacaguuucauacugcccaaguuccaaguuuauucuaaaaguaguugaaauuaaaaauuuuauaccauacuuacgguuuuuguauacuauucuaucuaucuaaucugucugucugucucuuuuagagacaggguuuuacugugcagccuugaacucagaaauuuguccugccucugcugguauuaaaggaauuuuuguuuguuuuguuuugcuuuuuuauuagcaugucacauaaauuuacugauaccacauuaaauaugcuuuugagaguuauagguagaacaaaauuaaaaaugcagauuuuauuagauaagccuuuagagaaaguaucucaaauuuagagauauaaaauauaaauuauauugauaaauacucuucuaauguaagaagagauaauguagucuaagauaaacuaauuaccuuauucuuuaucauaauaauagagucuaguaauacuugguaaauaauuuagcuucugacuuguuagauccauguuuuagauuuguguuauauugacuuucuuucucuuuuaaaaaaucccccccaaacaaauccacagguaaaaacaacauauuuauuguauauuaacaugauguuuuaaaguguauacauuacauuguuuagcuauagcuaauuaacauaugcauuaacucauaauuauauuuuuuguugugagaaacauucccucuguuagcauuuuucaagaauauaguauauagggcuagagagaugguuaaguggucaagaguaccuguucuugccaaggacuagaguugaguucccagugcccacaucaggucauucacaacugccuggggcuccaguuucaaggaucuggcaccucuagccucccaugauaccuaaauucgcauucgcggaacuacacacagaaacauauguauaugcauacuuuaaaaugaaauaaacucacaaaaagaguauaguuaucuuuauaagcuguagucacaacguagaacuugcuauguauuuuguaucccuugacccccaaagcuuucagcucuucaacucucuaccuccaguucccuuagauuucuuacuuucuacuugaugggaucucauuuuuucauuccacagaugaaugaagugacuccucuuuaaaagucuuugacagagccagguggggggugcgggcacggugggggugggggaaggggcgcuguuuaugccuuuagucccgcacuugagaaaaggaggcaggugaaucucuguuaagugagaggucagccuggucugcaaaguggguuccaggacagcuagggauguuguuacacagggaaacccuaacucaaagaacaaaauaaaacaaaaacaaaaacaaaaaauuuugacagacugagauuuaauuuauuuuuuuuuuaauuugguugaauuauaugaaguugcugauauucugcuuugacauacaaaaauggcaauuuuucaugauucaaucuuacauuaucaacucuuguagggauauaauacuguuauaaauauuuucucaauugccauuugaaccauucuggcuuauauagaaauaccuuuggcaaauaaucucugcuauuagaaaguauuccuauauacucuuuaacgauuucauuuuucaaaagcuguguacuuagggcuagagagauggcuuagaggauagagcacugauuguucuucuggaggcccuggcuccauuuccaggaccucguugguagcucacagccagcuaugacuccagcuacaggagauccagugcccucuucuggccucuuuggcaccagggaugcacauguuauauagauacacacagccacauaucuauaaucauuuaaaucaaucaaucaaucaaucaaacaaacaaaugaaaaaaauccccucuggaacuuugggaaucacaggaagauagucuauuuuuuaauuuuuaaaauuuauuuuuuaccuccagagccccguggggcgucacugcugaaaccaguugguagcugcuagcacagagccugggcacuacugaacuagacucucuuuauuuaguuccucaaucuuuugguauaugaaucccuuugggugaaaauauguuucucucuauaaaaaucuguugagguuaagacugguaaaaguagagcuaucaaaagucaaaaguuauuucaagaaucuuacauaguuugguaauuguaguuuuucaauuauaguuaugaacagauagcuugguaacauugagaaaccuaguugagaauuaaaauggucuuuaaggacuacauaaguguguuuuuaacaaaauguuuguuguaacaacuuuuaaugccaggucuuauuucugucucuaaaacaggcaaaaccuucaacaguagaaguucuagaaaauauagauaagguauguucuuuggcucuaaaauauuuuaauuauuuuagauguuaauauuacuuuaguaauuuuauauuggaaaagagauaugggaaccuaaagaugauauagaacagugcuucucagccuuccuaaugcugugacccuuuacuauaauuccucauguguggugacaccaaccagaaaauuguugggagaacccucauguacugugucaacuggcuaugauuugugucuguauucucaguuguuaaugucugugccucuggugccaggcuagcagaaaaaguaaaguaaauguuuguugcucucuuaccugccccaaaagaaauggcaaacugccauggacgaggucaccuuguccucagugccaagggggcgagacagagagaugggucagguguuguccugcugcugauugguucagacucgaggaguaaagagugagucuuuuugcauaaugaacuggcagcuggagcugggcgggagagaaagaaccugaacagggggagagcccuguggagagaaguugggugaagugugauggacaagcugagggacuucccagcaaacagccuuauacuuacagaugucucccugucuuuauuauuagaacccaagcaggacccaagagccuaacaacaucaaauuauuuuguugcuacuucauaacugcaauuuugcuacuauuaugaauuauaguguauauaaucuauaucugauauauagaacguuugauaugugacucccucaaagggguuguggugacccacagguuaacaacaacuaauacagaggaguccugagaacuaugaucugaaagaaaaaaaaaaaagaaaucugaagucuuuuagugacuuaggaagccuguaucaaguaguaauagaacccguuagaaugcaauuagagcuaacaugguguaaaucaauguaacagguagcuuaauaaagauugcaggcuacugugcaacaauuauauagcuuuaaauuuuuuucuuauuuauguuuuguccuucaggauauuggaaguagugacuacacugugaaaugauguaauuucaaccacuguuuuguuuuguuuuguuuuguuuuguuuuguuuuguuuuguuuugagauagucucaccauauucugucuucuggccgaaaacugucuauuuauaccagacuggucuuagacuuggagaaaucugccugcuucugccucugugccagaauuaaagauauaggccaccauacuuagcccaacuauuuuuauucuuuuuuuucuuuuuucuuuuuuuuugggucagauuuuuaaaggccauauguggagaaguuuuauuuuuuugacucuauaaauauuugcugaugccaauuucauuucucuagucuuuggcaauagacugauagacagauuaaaaauaguauuuaggggcuggagagauggcucagagguuaagagcacugacuguucuuccagagguccugaguucaauucccagcaaccacauggugacucacaaccaucuguaaugggaucugaugcccucuucuguuauguaugaagacagcuacaguguacucacauauaugaaaaaauaaaacuuuaagaaaauaguauuuaauauuucaguuuaaaaaguaauuguagacuuauuuaguuuuuaacuucacuuuuaguuuacuauuccauauguuugcuuuaaaaugucagagcauugaauuacauugaauuuuaggaaucuuauacaaucuuucugucauguuaauucuuucaauuuuaauuuuuaaauaauuuaugagacuucacaauauggaauacuuuucucuuaacaggaaauucaagcauuggaagaauuuagagaaaaaaaucagagauugcaaaaauuauggguuggaagauuaauuaucuauucuucaauucuuuaccuguuuaccuguuuaauuguguacuugugguaucuuccugaugaguuuacagcaagacuugucaugacacucccauuuuuugcuuuuccuuugauguaaguauuauuuuuguugaucuuuuucuuuuuugaccagauuuuaauuuuuuauuauaaaauauuaaugucucagauugaauaaauucauuuuugcaguuugauaauuuuuuuuaaauuguaggauaauuucuacuuuauagcccaaaggauaucaccauuguuacuaguaauguauaguuuucugauagauggcaugauuccuguaggaauugggcauggagcaggggagguauugaguggcagaggcuuguaaaacugaaauaguaaguguucagaugacucuaaauauguaucuuucacccaaacuccuuucuuuaauuauuguuacaaucaauaauuucuuccuuaaguacuucauagucugguauuuuauaggagguauaucucaacugaaaauuuuggggaacagguuuuucauuuaauuagcaaacauuuauauggauaacaguuguguagacauuggguuauaauuguguauugugaacaaaauugaaaaaucuuugacuauagcucuuaggcuauguguaaaguaauaaauaugcuaugagaacaggggccccaacucaggcuuaguguggggggucuagaaagagucuugauuguaaguuuucaauuggucugaagcagcuuaaagcaacacucauuauuauaucagagcucugaaguuugaaauucaggcagcuuaacugggucuuugcuuagaaucucagacuggagucuccagggaugagacagugaguggucuauucagaaucccaggagggaggaucuauagaccuaggcuguuggucaacuucugaugcucugauauaccuggguaaucuaugauaaucucccacuuuaaaaucaguaacuuugaucauagcugcacaguccuucacagcaguugccuagauuacugugugauugauuauauaaccaaaggcugcacuaagaggaaggaucucaguggaauuguuuacuacagacuucugaagaauugaugucugaauuugagacuugcagaauggauuauguauaaaguagucugacaugguggcaagaacagugguagcugugacuguaggagugucgucacauugcauuugcaguugggauacagaguaaggugaaugcuguugcuacacuuguguuuaccuuuucauuaagucugggacccagcccagagugugggucugucuacauuuaguuaagccucuuauacaugucuggaugucuguuuccugagugauucugaaucuagccaaauugacaagauuaaccauggcguuauuuuagccacugagaguguagcuucuaauaaauuagaaggaaguaagaguggaucuggaguaggaagcuggaaggauauuguaguugauaagggaaaugaugaaugcuuuguauuuggugggugggagaggagcagauggauugagugaaauugauggauuggagauuuaggaaguagaauugagagacuugguaauuggauauggggugaagaggaggaaucacuucaaggauaaaauucagguuuauaguuuggaauauuugguugagggcauuaucauucaucaacauagugaauaacacaagcgggaggagguuuggugaaccacuguaucuuccuauuggaacugucaaaugaauggcuaaguaugaguaugagguuuagagaaaauucaguagcuaaaagucaggccuguaaucccagcuacuuggaaaaccgaggcagaaggaucacaagauuaagaccugccuggacuguaggggaauugauucaggcuaugcaaccuacugagcaccugugucaaaaacagaaaauacaaaaggucuagggacuauaguauauuaguagaacauugcuaguauaugugaggcucugguuuuggcuccuaguaccacucacaugcacgcacacacacacacacacacgguuaccaaagccaucaucucuuuauuuauuaaguauuagguaucugcaauguguuaagaagugauccagaucauagugaugugaaaaguagugguaagauucugcuccauguaacuugaauuccugugauugggcagauaaaaauagagauaaguuaacaaagacauacaguuaauuggagagaaauaugugcaauaaaggauaucaagugaugugauuuaaaauagguuucuuuacaaggguccuggaaggccucuuuuuaggcagugguauuugaguugagcauugagugugaagaacaaguacagaaaaaguugaaguuuaugaagacuauauggagcauauaguggcacauauaccuagaaaguucuauauaagguauuauuuaaaaaauacuagugguaauucuuucuaauggagugauuuuaaguaguucuuuuauucuauauguuuucugguaauguuuucauuuuuuuuaaacaccuguguauacuuuauauuguuaaaaacaaggucuaggauuugaaggauuugcuucuaaaacuagaaaauagaaaauguguagacugagaauuugaguauauaguuuuugaggggcaaagaugacaggcauauuuguaaugugugauggagagauaaaugcugaagggagguuauggaaaaucaagccugggaguaugaaucucacaguaggugacgugggaagaagcuugauauauagaaauuauagcaagagggccacauauaggcuguuuuauggagacaaaaguagaauaucuaggaagcugcucuauaaggucuuuugcuugauuucauuuuugagacuggguuucacuauuugacagugguuggccugagacucacaguguacaccaggcugaccuuaaaccuacagagaucugcuuguuucugcuuccugguugcugggauuaaaggcuugcaccaucauugcuuggcuuaauaaauuuaaucuaaagauaaagguaaauuggucugcccaguaauaucagauguuaauagauaacuuagaaauauuuugaaaguuaaaacugguaggauaugacaggaagaaaugggauauagaaaaaguaucaagacugcuaggucagguuuugguuuaaucuuuagugcaggacauauuuccaaauuuaaacuccaaaacucauaaucaacuuugcauguguagagugaacacauuuaugugugugcucugugagaccugaaguugaacucaggucuaacauugcaguuaguuuucugguuguuggccuugagccucauuauaugcuaggcaagagcucugucucugagcugugcugccagccucucucuuaacaucuuuauuucccuuucuuaaaaaaucuuuuggauuuuuuuaaaauuccaaaguagaaaugauuuuauaaugcuaagcucuuuuacauugcuuccuuucuauuuuucacaaaaaguagggagaaaauaagauuaaaaguaugagauacuucauugauuuaaauauuuuaauaaaaguaggaaaaauacucgaacuuuacauucaauucgauauagcaguuugauuuucugaauuuaaaauguaauuuauaaauaucucauuagaacuuugcuaauucuaguuguugccccaaguugugcuuugcuggaucuguuacuaagucacaagaaauacuuuugagacaaauaaaucacuuauuauuauuauuuuauuuuauuuuauuuuauuuuauuuuauuuuauuuuauuuuuugagucagaaauucucuguguagcccuggcuguccuggaacucacuuuguagaccaggcuguccucgaacucagaaauccgccugccucuaccucccaaguguugggauuaaaggugugcaccaccacugccuggcuuuauuauuugugacauugggaauagaaucaguggucaaguauuaaauguuuccucuuagccagaaucauuuuuuagaguuagaaaaacuuuauuacauguucaaguauauuuaauuaucaauuuggcauagcccagagucaucugagaagucucauuugaaggauugucuggaucgauuggccuacggauuacacucuggggugauuaucuuguuugccaauugauuaaaagggcccagcccacuguugggguaucuuccuuaggcaggugguucuggacuguauaagaaggcugcuacguguuagguuaggagcaagccaguaaacaguuucuccaugcuuccaaccuucuuugaguucuuguuugaguucgugcccugacuucccucaaugauggauugugauaugugacguauaaacuaaguaaagcacuccugucuucuguuacuuuugguuaguguuuuaucagcuauacagaggaaacuagaacagucacauugguuguguguguguguguguguguguguguguguguguguguguguguguguguguuuugggucaagugacuucuuaaggguggugguuuuuuucuucuaccguguggguucuggggauugaauuugugcuaucacgaucuaugcuaagagccucggcccaaugaaucaucuuuugugggacaaaaaauggggucccgcaucgacuugggacuagggccacugggugaggcagacacagggaguuugacugugcagaccccaggccgcuggcaguguuggacugugagaagccgcgggauccggcuuuggaauggggaaggcacagucugagguucccacggacccgcuggagucgggcuuauacucucaggcaccacagaagagccgauucuggggucccuggucugcauggaggccagggacgucagguucucacucuuggacaucccagacgccacuguaugucguggcagagcugagaacugguggggaaccuugggcggacucuggccugggggccuaagggaaaaggguaggaggagagcucuggcagguuaccgcggggaguccuaggcagggcggguugguuugguggagaccuuggcuguagugcagggaggccucccugugggagguuagacaugcagcuuguuaggggaagaccuccauugcuccagcacguuggguccggaugagaagagacaguccaugguuuuaaggcguuuuuuuuuuuuuuuuuuguguguguguguguuuuguuuuguuuuguuuuuuucaagaaaggcagagagaggaagaaaguagggaaguagaagccggccauggccacauagagagaggggagaagggaagagagaggggagaagggaagagagaggggagaagggaagguggagagagcggggagcaagggagcaagaguaaaagcaagaggguaagagguaagagauccaggagggggcaagcaacuccuuuuauagugggcugggcuauccuggcuguugccagguaacuguggggaggagcauaccuggcuguugcuccccagagguccagacagaauaccaggagcuuggggcauugccuuugugacugauggccacacaccucuguguguguugggguggggaaguggggagggguugugggaggugggcccaggaggcguggcuagacaccuuccuucucuuaaggucaccaggguuccaggcucaacugugcacggcucacugccccauagucgucccugcccaugaagcauuugaguguguguauguagugauuuaacccagugcccaugcaugcuagacaagcacucuucucgcuuagucacaccuucggccuauuguaucauuuauaagcagucuuagcuauucuuugucucuuucuuuucuacccucuucuucccucccuccauccuucacuucauuuuuccuuucucaucuucaucuucuucuguuuugauuuuugagacaagguuucucuguguaacccugucuguucuggaauucacucugaggcaaggcuggccucugacgcacaaagauccucuugccucugccuucuaagcacugggaucaaagguugguuuucaccccucaacccccuaguacuaagacucaaacucccugggcuuuuucacauaugcuaggcaaguacucuaccacccucuagccccacuaaauuauaaucaaaaugcaacauuaggucauagacaucauuaggcuuugucacagggagggaaggucuggguauacuuagacuuuuguaaccauauuauguugacagauauguauugcuuuaggaauuguuuuuuuuuuuuuuuuuuuuuuucuuugaaauagugucucaguauauaguccaugggaccucuaaguaguaguccucuugagugacaggaauauaggaguguaccacaugccugccagacuuggcuacauagacacacauacacacacauacacacacacacacacacacacacacacacacacacauacacacacacacauacacacacauacacacacacacauauacacacacacacacacacacacacacacacacacacacacacacacacacuuuuuucccaguuguucuguguguguuagacaaucauucuaucucugaguuacauccccaacccuuucuuuuuaguuuuuauuuugagacagggucuugcucagugaaucaggcuggccuugaagucauccuguagcuuggacaaauccuggaacuuuugauuuuucuacuucagcuuccuacguggcuggauuaaaggccuguaucacacauauacaucauguaugugagugucuucuccuccuccuucaauuuuaugugguguuuaagaucaacucaaggccucaugcaugcuagguaaauaauuuacagcuaaacugcauucaguucuaguugguuuauuuuaaagugaacuccuuuuaaguguguguguguguguguguguguguguguguguguggugugggccaugcaugcuagacaagcacucuuccacuuaguuauacuuccagccuauuauaucauuuauaagcagucuuauguauucuuugucuccuuccucccucccucccuuccuuccuuccuuccuuccuuccuucuuucuuucuuuccuuccuuccuuccuuccuuccuuccuuccuuccuuccuuccuuccuuccuucucuccuucucuuucuuuuuucuuuagacauuuuauucucuauaauuucagaaauuaguuacuauaaaaguugauauucccagaggaguuaccauggguuuccuccaugguguuuuuguuuguuuguuuuuaaacuaagaucuuuuuaaaauuguuuucucuuacaaugggacucuggggaaggaauuuaagcaagggaauugagaaaggugcucauguuccuguuucuuuuuuuauagcccuacuuuaauuggaagcuguuaagaauacuuugaucuuaguuacuuuucuauugaggugacaaaacacuaugaccaagguaauuuagaaagaacuuaauuuggugcuuaugguucccaagguuagaguccaugaugaucauggcagggggaacaugguagugggcaggcaggcaggcaugcauggugcuggaacaguggguaagagaaaacaaccacagggcagagagggcacaguggaaaugacugggcuuuuugaaaccucagagcucccuccacugacacaucucuaauaagaccacaccuccuaaucccuucuaaacaguucuaccaacuggggaccaaguauucaaauauaugaacuuauggagaccauucuuguucaaacaacuacauacaaauuucauucuuuuuagcuacuggauauuuccugaguuuaguuagaagacuggcaaacacagcuuuuugaaauaaguucaaucagccaaccuacuguacccucccuccaucucucucucccuccuccuucccucucucucuuucucuccacguaaacacccagguguagagaucagaggacaacuugaaggacuugaucucuccuucuaccaugugggguccuggagacuguauuccaguccuuaggcuugaugcaagugccuuuccccacugacccauuucaagggucccauaacagaauguuaauuuuuucuugugaugagauucuauuugucauuuuucuuuuuauggaucuuguuuuacuuggcaaguauaagaaccucuugcuuaguuaugugccccaaagcuuccuucugugucuuuccuucuaagccuuuuaaaagaaacacuuuacacuuaaguuuguaauguauuuuuaauugauuuuguauagggaugagguguugguugaagucucuuuaaccccagauacugccuaguggcugauuuauuagaaaggagcuguaccuuuaaaaacaauuuuaauagaucuucuuaaaguacaguguguccauauguaaggaaauguuauaaugaaacccauuauuuuauacaacuaaccugugguaauaaaauuaaaacgauaaguucucuuucucuaguugucuuuuuuuuugugguguuaacauaugcaccuucuauuuuauuugucccuggucuguuucuuuucauuauuuucagucagaaaaaacaguuucaaagucaucuuaaauuaaugauuauauuuuauguuaugaucuaguauggcagucucccauugaguuucuaguuuucaguugagugcacuuuccugauaggaguuagguuuaguuuugaaauauaauguacuuuaaaaagaaguuuuuuaauaaaagaagacuuaccauauguuuauuuuugugccaguuauuugugggagacuuauuugggauuaauggaauguguucuagauugacuggaauuuucuuuauuaucuagauuuacaugugaaauuuuaucuuuucccagcuagugaaguuaggcaacuguauuuucucaugggucagaaucucuuuucuccuucccugucauagaaauacugacugcucuuuagaaauagagcacuuuugaauaauuuauuuuuuuaucucuuuccuuuucuuuaguuauguuucuuaucauuuugcugacaccagcuguagacuguacacuugggaagguuuauccugcuggccucucugugacuauucugaaguucggguuuuauaguugcaacuccauucuuaucagaaaaggcgacuacaguuuuauucuuaucuuguuugaaugauuucuaaggcaggaauugggugagaauggagaaugugcuauuauuagcccuuuuacacacacacauacacacacauacacacacacacacacauacacacacauacacacacacacacacacacacacacauacacacacuuucaaaaccaugucuguuuuuccauaaauuucauuuaauuacuaggagaggaaagccuuagaugggauaaguagagcauagaucccugaauuacuguaauuauguuucuaaauucuauaauaaaauacaaaauaauuuccuuuaacuuagcccuagaguaagaacuuguguaugcaugaaaaauggcaacagaacauuuuuaagagcaaggccuuuguuaaucuuggaaaguggacacaagaaguauuguuuguuagcugauuuuucucaggaguaguucugauaaaaccugaaaggauugacuguccagaaaugggggcaguuuugguuugaggagaauauaucccaauuuuuauaguuacauuuuaaaaguuauguauacgauuuaaaaaguauauacucauuuaagagaaaucuguuuuuccaucuuuacugucucugcaaucccuuucugguuucauuuccucucuguacuuuuuuuucccuucuaaaucuuucucagaguacaacuguuacucuuaucuaugauuuugcuuucuauggcuucaguugucuacggcuaaccacaaucugaaaauaacuaaauggaauauucuauaaguaaaaaaggcacaacuuaaauuugcuggucugaguaaugugauggcauuuauaccacacugcccugcccagaauaucagccauccccuuguucaguagaucuauacuauaauaugugaccugucagucucuuaguggcggcccucuugguuaucagaucgauuguccacgauaucacagucuuuuagcuaacucuaauuuuuacucuaauaaugagcccaagccacaagaguaguacagcaaagaaagcaucaaggaggccaaguuaacgcuguucaggguagcagugcucgauggcaucuaagaaaaaccaucuguacgguaguucucaaucugugggucacaauugcuuuuguucuugcacaccagguauccugaauaucagauauuuacauuauaauucacaacagcaaaauuacauuuaugaaguagcaacaaaguaauuuugugauugugggucaccacaacaugaggaacuauauuaaagugucacaacaugaguacauuaguaagguaaugaugcaaaggauucaguccaucuguguuucagguaucacuggggcggggguuguaggauuuuggggagcauauuucuuguaaauaagaggggacuguuuucuggggauucgcugugaauaagugguguuuaacuuuucuccuuaucucucuucccuugaaaaagacaaugcuuaauagcucuucacugcuuugguagcugcugaaagaaucauguuggaaucuaguguuaguuauuugguguauucuuaucauaaaacuacaucaucacaguuuagagguguguaugaauuaucuauagcuauguagcaaacugccccagaauuuaguugcuuaauaagucccuuacaguugcugaaggacaagaaauguugggagcagcuuagaugggugacuguuucagaguccuuuguucuuauauaaauuacaguuaagcuguuggcuugggcugcagucaucuaaaggccuaauugugucugcagucauagcagauaaagucauugcagaguuuacgccugccaccauccaguuucuggcuuacuucauuuauuuuugccuucgcucgacuucauucuguuuuuauauuuguuugcuuguuuccuggagaucuuugucuuuuuauuaggccauaucuuguaaaucuaugcuuauguguggauuuauuuuccuugcugcaguuauaaaucaugccagagcugauuguuuugccacuuucaaaguagauucugaaccuaaauacaaugaggacaucuggaauaguuuuaggcauuuuuugguaaucuuuucaaaucugauuucagucuugcacauugcuuagcaaguuucagccuuucauuagguguuucucacaggcucauugacuuucaaagucacugauccaagagagaaagacaaggagagggacccaaaucugagcucugucugacuuugucuucacugucaccucugucacaucuagucagucaugguugugagaggaucuguugaaggucugagugugaggaggcccgacugauagggcgcugggauuggagcuccuuuucuccugacagagcagccagugcuguuagcuacuaagccaccucucagcuguguuguugguuucuuuuuuuuguacaaugugagaaauaauuaucuaguuuccauucuaacuugaggauguugaguuuuuccagugucauuugcuaaaaaggcugaauauuuuugucaucuuugucaagucaggugguugucacuguggguuuauaucugggucuucucuauuacacugauuuaugugcuuuuuucuuuuuuuuggugcccguucagugauauuuuuauuacuauagcuccguaguuaacuuggaauuagguaggagagaccuccagugccugugcaugcaugcguguacacgcagugcacauguaugcacacaggcacacacacacacacauuuuugugaggaaugauguuggaauuuugguagggauugcauugaaugagucuguagacugcuuuugguaauauagucauucucacagucuuaauucuucuaguccaugagcgugggucugggagauagcaugucuuuuagugucuuaaauuucuucaguuuuacaaaguuuucauuguagaaaacuuuucauuacauuucuuuggcuaggcuuagucuaaguauuuaauuuuuuucuugaagcaaucguaaaugggacuguuuucccaauuguuugucagcucccuuccuaagaaggcugcuauuuaaaaguuaauuuuguauccugcuucuuugagaauuuuuaucaguuuauugggggaguuuuuagggucucuuauguauaaaguucuaucaaauacaaauaaagauacuuuggccuuuuccuuuccuauuuguaucuuuuguuuccuuaucuugucuuaguacuguagguggcuuuaaacaguacucgauuauaucagaguagagauaguagacaacuuuucuugcucuugauuuuagguaaugcuuuguuuuccuuccuauaguguuggcuauagguuuguuuuauauagcuuuauuauuuuuuuauuacuacuuuccucagauuuuuaaaaucuuuccaugaaagguuauuagauuuuguuaaaagcucuuccuguguuuauugagaucacaugguuucugucuuagaguucauuaaugugguguauuauauuuauugauucuauauguucuugcacuauccuuacauuuauggaacaaaaucagcauggcauggcagaugaucuuuuugauacuuucuugaauuguauuuuaaauauuuuguguaauuuuuauauuucuguggucuuuagggagacuauggccuauaauuuucuugcuuucugcuuuuuguaucaagauaauacugccuucauaaaaaaauugguaguguuauuucccacucuauaugauguaguagucuaagaagcauugguguuaguuuuuuaaaagucaaauagaauuuauuaguaaauccaucugagucucuuugauuugggcgauuuuauuauuauuauugacucaauuuaauugccuguuaugaucaauuuuuaaucuuuucauguguuugugugugugugugugguggcagacaugccaugauauacuuaugaaggacaguggacaguucuguggguugauuauauguggguucuggugguugaugucaaguugucagguuuucacaguacuuugacaagcagagccauguggcuggccuaugguugccuguauuuauaguagagaugaccuugacaaccuugugauaggauuguuuucuuaguuucucuuaauucuuuuaauauuauuggauauauuuaguagugcaaagucuaaaaaguuaacuaccauaacauuuuaaaaggaguuauuuauuagcuaaauuuuauuuauuauuuauuugaaaguaaggcuuuuuuccgccucugaauuucauucuccagauagcuuauucuauugaauaaagaucucuucaauguuaaaugguagggauuuguaauaauacucuuguuuggaaaagcaaaacaugcuugccuguuaacacaagggaacagauaggaaacaguuuuuggaacuuauauuagaaagcauucuugggguuggagagauggcucagugguuaagagcuugugcugcucuuucagagagcuugagugcaguucccagcauccaugucaguaggcuuccaacccuaacuucagcugcagggaguugcacaucuucuggccucuuugagcaucuccacacauacguacauacagaugcacagacucaugcacauaaauacaauagcauggaauuaauaaagcauucuauaguacuguucuuaaugcuuugggggauuuauagacccuuuggaaauuggcagaagcaaugguuucucuagagaaaugaauucgauaguuccugaggaacuccagggggccccugggauucagguugagaacucaccuauuggaaugucagugauccucugguauucuuaacaaaacagucaggguuugauuuuugauacauacagagaaaugucuaacucuaauugaaacuuuauuuuugccuguagauucugauuuaucucuuguaaugauggauuuuguuuugaacuuugcuuccucucuagcaucuggacauuaagaacuguacuuauuuucuucuuuuccaagagaacagagagaaauaguaaguuuaaauauuuuuuauaaaucuauauuaaggaaacaaacaaacucaucuuacugugugcuauuuuguaagccaauuaugaaaugguuugagauaguguggugugucagauuguuugcuguacaacauaacaaaggucaugaguauaagaagguucugucuguaugugucaauucuuauuuaggauuuuuuuuauacaaaacauuuuuaaauaaaagcaaauuguauuuguuaaauuaaucuuuguggacaacauugguacagaguaaaauauuguacauacauacuuguucuuuuuauuaauuuaauuuauguacauguggguucuacuugcauguguguuccugguaccuauggagucuaggugaggucaguggauccccuggaucuguaacuagagucacagaugguuaugaguggcugugugggugcugggaauuaaaccuggguccucuucaagagcagagagugcuuuuaaccaccaagccaucucucuagcuuuuucuuuuaacuguauuacucucauuaacgucacagcccuuuagcuugguuuuaguugaaauauacaaauacaaaaaucugcuucuauauauguuuuauauaugugcaaguuguaaagauuuuuuucaggucuuaaaaaguaucuugcuggguggugguaccuuuaauccuggcacucaggaggcagaggcagauggaucuucaugaguuugaggccugcuugauguacagagugaguucuaggacagccagggcuauucagaaaaacccuguguuuaaaaacaaacaaacaaacaaacacaacuuaaagaaacuuauuaauuaaaaauuguuuuaggcaauauauucugaccacuguuugcccucccucaacuccucccagauacucccugcccagcuccauucuuucucucuuuaggaaaaaaaaugguuaaaauaaaacaauaaaaaaagcuaaacaaagaaaaaaaucacaagaaacucacacauacccagauauauaaaaaacaaaauacaaaacccacacaaaaaucacaaaucauaauauagaagcaaaagaccaguaagacaaaaaagaaaaaguucaaccaaagcaaugagagccaaaaagucugcaaaaauaccucuaaguuccuuuuguguuggcuaucuccuguggggcgugggucccauucagugagacuccacuggagaaaacucauuuccuuugcaagaagaugucauuuggagacaguuuuuuggauagggacagggagauuguauucacaucugccuuucauguaugccuuuaauccgugcaagcuugguccaugcugcugcaagccucugaguugauaugugaaccuguccuguuuggaagacauuguuuccuuggcucuaacaaucuuucugcugucccugccacauuucucccugaguccugagagaagagguccaaggaagacaucucauuuaggacugaauguucugaagucucucacucuuucacaugguccaguugugcaucuguuaguuccccgucuacuacaagagaaaguuucucugaugguugagugagguauugaccuauggguauagcagaaugucauuuuauugcucuguuucuauagcucagugguucucaaccuuccuuauucugugugacuccuuaguauaguuucucauguuguguugacccccaaccuuaaaaauaguuuuguuguuacuucauaacuaucauuugcuacucuuaugaauuauaauacaaguauuugauauacagauggucuugagcaaugccugugaaagggucauuugaccccccucaaagauugaguacuguugcuuuagcagauaguaguauuuaguuuuuucccuagguccauggccugucucuucucaggauuuuggccaccugagcagugucaggcauggaaagggccuuaaagccaaucagagugguugguuacuccuacaacuuuugugucauuauugcacuagcaggucaugcugagaagucaccauuguagugcaaaggguuuguagcugaguugcuguuugccuuucucuguagugugcaaaggaccuccagugccaugaacacuagugucaccaggggugaagucucuagcuaugcaccagcucgacugcucuguguucaaugagauauauacuuuauauaucuauaguuuaucuuaaaugaacuuucuauaugauauguuucuuuuuauuuucacuguacaaguguagucuacugaacucuuguguaccuaugauugacuuaaauaguuaucaacucauggucucucuuaauuuuauuuugccuucaccuucuucacugccuauuauuuugagguauauuuuagagaaauaaaaauacaaauauaauauauuaucauacuuagacaugaauaaaauauuaauauaaaauaucaaguuucuaguaguuuuauaaguacuacuugauuuaaagauuuuuugcuucaguauauaaguaagguuuuaugaauagauggccuuuaaaguauguaugcuccuugcauauaaucucacuucuguccuguuuagaauaugugcucuagcacaaauaaccacuuauuuucagacacuuucacacuuugccuuucucuacuuauuugguagagccuauucuguuuaaauauaauuacaugcuuaauuucuaacaaacacuauuugaauauacuuuuuuucacuuaaaacagcuuuauuuauuauacauguauguaugugccugcauguguuuauauaucacauguauguacagaugucugugaagguuagaagagggcauuggaucucuggaccuugaguuacaagugguuguguugugcccaauacaggugcugggaaccaaacucugauccagugcacauguggaggcaagauaacaacuugcaggaguuacuucuuguuuuugcuaauuaaguauuucuacaggaaaaaaauagaaacaauauauuuguaaaaggaucuuuuuuuguuaaggaauuauuuaauguauguuuugccuucauauauguaugugcaccaugaauaucuggugccuguggagaucagaagaggguaucagauucccuggaacugcgauaaaggaugguggggagccaucaugugggugcugggaauugaagcugaguucugugcaagagcaacaagugcccuuaaucucugagccaucucucuaaaccuuccuuuuuucuuuuucucuaaaauuauuuauuuuuaucuaaaaaauuauuuugggggacagaauuucagccuguagcccugacaucuaguaauuguuauauagauuagguuggacuugaacucacaggaaucuuucugucugugauucuucccgggauuaaaugugcagcaucauaucuggcuuaacggauauccuuugacaugauuguucauguuccauucugcuaacuuaaauaaguauguacauuuuagaaauccuuaaauuugaaaagcuacugauaauacuuuggaagucucuucucagguauaauaaagauuuucaaaagucuauuaaaguaagugauauacuucuuauaaacaaagaauauuuuuauuauuaguauauacaaggagauuugguauuuguaaauuaaugagaaugaaauguuaaaagaaaagaaaaaguauugauucugaaaaaaauauuaagaauuauguuuauauaaaguccauuuaaauuuuuucugaaucuugaacuguauaauacaggaagaauaugagauguauggguaaacauaaagauaauuuuuaucucuacauaugggauaaauuuagagaaauucugaacauuuuuugguguuugcuucacauauaauauuuaugaugauucuuauauuuaggcauuuuaauauuugauuuaaaucuuguuuucuagaugaagcauuggaugauuuaaaaucccagaagaaaaagauaguaaguuaaauuuuauuuaaaguuaauuuauaugaaucaguuaagaauuggguaauuaggcuggagagauggcucagcgguuaagagcacugacugcucuuccagagguccugaguuuaauucccagcaaccacaugguggcucacaaacaucuguaaugggaucugaugcccucuucuggugugucugaaaagagcaauaauguacucaucauauauauaaaauaaauaaaaucaaaaaaaaaagaaagaaaaagaaaaaaaaggaaagaaaaggguaauuaaugcuuauauauuauaccuuagugauucuccaaggaacccuuuuugacaguauuuuaauguugaaauuaaauuaugauuuucuuaaguuaauauacaggaaaaaguaguuuagguguguggauuuuugaauucugagaauuuauguuaauuggaagucaagaagcaaguaaauaauucacauuggagaacugaaugaggcauggaggguuagagccuagauuguguuagagccccacggaagaaacaugcgagagaaagagagagggggggagagagggggggggaggaagaggggaaggagagagaggaaggagagagagauuagugugagguuggcaucuaaaguuuguaacaagugaauugaucuugguguuugucuuaaugauuuuacauauuuucuuaguauuaaaguauggaaauggucguaguugcugauaguaugauauuaaguagaaacucauaaaaugaaauuuaaucaaguauauaugggcaguuuucuguacuuuugccuagaguguaauaaauugucuuaguuuucuguugaugugacaggguaaucaacuuaaacugaggacaauuuauuuugguuucuggcuuucaagguuuuagcccuuggucacuugccugugguggcacaguaucucaugacagaggugcauauuguaugaaaauaauuuuagauaaauugaaaaacauaaaggagaaugggacuggauuuauuaguguuuaaauuuaaucuuauuuaagauaaauaaaugaaacacagacacacaggugauuguuuccugaucugucaggaauaaaguuguugaaauagcauuuugacuuugaguuuucuguuaaagauuauaguuguaucuaauuuuaaaaaauuuuuaaaaccuuuuuaucuuuuaaaaccuuucccuacauauguucauuauuuauuauguuccauaggaucacuuuguacaaguauauauuauauguugagcacguuccaucucauacucccuaugguccuugcuuccauuacuucccuucguucccauagacaguuccacuuucucuucuugucauguauaggguuuugugugugugccaaauuuaggaaucacauaauaggagaaaauguacaauguuuuucggagacugacuuaauuuucuuauuaugccaaucauaaaccuagcaauagauuuuaucuguaguuaugcugaucgaaucaguagcuacuugucacauuugacuauuuacauuuucauuauuuauagugaaauagaacuguaaacuuaauuucuaggucacaaagcaacauuuuaaguguuuauuuaccauauucaucuuaguaacuuuacugugccgauguagaagcauuucugucauuacugagagcucuguugcauaauauaggucuaaaagucuagugagagagucaauuauuuaauauuucaugauguugauucggggauguauuucaugauacucuuucuuuaccuccauuccuaauuuuucacuagcccaaaauaaauuuuacguaagaaaauuguucaucuugagaauuuauuauaacuuugaaauaacuaguaaaauauuuuuguuuuacuaaauugugauuuauaaaucauuccucuaaggacuuaaauuuuuauguuuaaugggcagucuauuaacuauaauuguggcaaggcauuucuuuuaaaacuaugcuuuaacuaaguaaaugugaugugagcugcuuauuaagauaagugucuuggaaugaauaggacaaauaacaaauauaacugguuauuggucaccaagaaggaaagggucaugcuccaguuuuuccaaaagcauuuuauauugcacacuaauuauuugucauaacugacugucuuguacuaaaauuuugcuuuuucugauauuggaccauaacuauugaacuauuuacuagugauuccuuacuuuuaaaacugcacccccauauuaggcuuacaaagugcuauaacaaugaagcuuuuaauuacagucucuagcgugagcauagauagaacuuaguaaaaacuuuacuuaaauuccgugauugguuuuucuucuucuucuaaagauguuugaaucuaaguaagaaaagaggauggggggaagguuuguuuuugagucacuugagcaaauuccauggcuguucccucagcuagaguuuucaccauguuugcagcaagcuaauugcuucugcuaauaaauaaucuaaaaucgaugcugacagcaguuaauuggcacagagauuuuauuuuguaaagcucuuggcuaacgaccuucuuaaauuaauagcauuaagugcugugaggaaauaaaucugaggaauugccugucauuugcuugucaugucuaauaacuuccaauaaugauggcugauagauuuuugcacauuccauuauugaaguuggugcauguaauuauucuccucauuauauguaaacaauuagugauauuugguauuuccuugcagaaaagcuguuaaaaugcaaguaacauauuagaaguuagacacuauuuuaaaagcuuagauuuuuauuauuugauugcaggaaaaucuuucgauuuagauacauuugcuagauauaaguacaaaaaggaaggagugacuuuaucuuccuuaauucuaagauugauacuuuaauaccuuuugaauaagauuuauaaaaaauuaauaguauauguuucaaaauuugacaauuaauggaaauuuuuguuuguagcuugaagaagucauggaaaaagaaacuuauaagacagcuaaguuaauucuugaaagguuugauccagacucaaagaaagcaaagguaaaacugauaacacuauuuuuccauuacaacuuauccauuguaauaggcuacuguauaauuuaaacauuauuguaauugacaggaguuugagccgccaucugcuggagcagcuguaacugcaaagccaggacaagguaaauaacuuuguagaaacugcugcugcuguuggaaagauccguauuuauccaagugaguuuacaaguguguguuggugguguguaaaaguuaaaugcuuuuauguuaauguauuuuugguaaucugacauauuacuuaggguagauaacacuaauuuuauuuuguuuuuguuuugugggaauauguugauaaguuggaauauugaauaagauuaaaguauauaguugguuuuaaucugaaaauguaaguauuuucaccuauauuuuacaagauuucaccuuguaaauaauaauaaucuuugaaauaucuuauuaauaucuucauuuuuaugauuuccuucuggagaaugaagguuuuugcaaaggcuaaauuuuuuucuaaaagaacacauuuacuuaauaaaaaaguaaaauaauuuaaaaaugagaaaaaagaaaacugaauuucauauaacagcaaauuuuugaaguauugcguaccauauaaucaucaaguauuaaguauuauguaaauuuucaagucauuuuauuuuaauuuauuauuauugugugugucauguaccaaggcuuucaugucagaggacagcucuggaguugacucaguccuucuccuuugaugugggucacagggauugaacgcaggcucucagacuuaggaaggaagugccuucaccuagugaguuacuucaucugcuucuagaagucauuuuaaaugcugacauaaaauaucucuuaaaguagauguggaagauauuuugaguuugcauuagcuuuuaauuuuuguauuuuuguuuucacuugaaucugguaaguuuuuuuuagguuuuguggccuugaagaauaucaaauacauagaaaacugcaguucucauucuugcaaaggcugauuuaaaguuacacuagcauuuauagcuuugagaagguaaucuuuucuaaauauccacaaggacugugcagauuaaaugagucacaguuuuacguuuucuaauugauauugcugagugagacgaauuuauucucuuggacuuuauaacuaggauuuuggguuagagaaauauuaacuuguucuaauuuucuuuucuuuucuuuuuuuuuaaaauugcucuuuugguaaaaguucauauaccauuaaaguaauauauauauguauguauauauauauguguguguguguguguuucuugugaaauucccauuucauaaucaguauaguuuuuaaaucuguuaagcaaucauagaaaaacuucuguuauaugugaaacauuuaaaaaaauuuauuuauguuuuacuuacauguacaccugcaugccagaagagggcuucagaucccauuacagaugguugugagccaucauauguuuacugggaauugaacucaggaccucuggaagauaagacaguguucuuaacugcugagccauuucuccagucccaaacaauuuuguguauauaguacuaauucuuaaaagauaauaaauucauagaagcagagugugaaauuguuucccaagauauaggguuuaagagagcaauagggagguauuggucaaaggacacagaauuguaguuauaaaggugaauaagaugccuggacaguacaguauggugacuagaguuagcaaugcuguauuguguacuugaaacuuagaaagacuggguuuuauguauucucuccacagacagaagaacugguauaauggauauggcuaauuagcuugacuguaggaaucauuuaauaguguguuaagaaaucuuuugaauaaguaauacugcuggccaauauguuuuguaaugugcuacuuauaggaagcugggguuauuaauuuaaaaaacauucuuagguauuuuaucauuuaguuaaaauaaguuauuuugagaauuuuuaaaaaaagauuuauugauuauuauacauaaguacacuguagcugaugucagacacaccagaagagggugucaagucucauuacaagugguugugagcuaccaugugguugcugggauuugaacucaggaccuucggaagagcagucagugcucuuacccgcugagccaucucaccaggccuauuuugagaauuuaaguguuacuuagacacuuugaagaaccaaaugaaaauuuucuucugacaccaaaucauaauuauagaaaaauugcugauauuuucauuugcuuuggauacuugugcugcuucuagauagucuuagagagaauucauauuuaauucuaauaugaucacuuauuugaguacacacauugaaggaguacacaggccagaggaggcaguggguaaagcaguugcugccaagcaugauguccuaaguuccaucccuaggauccgcauguuggaaagagagcugacuucugcuaguuguccucugacugccacaugugcaccauggcauacaaaucccuucaccucaaauuaauaaagacauuaaaaugguacugaaugcuuaauaggcagauaccuuagugaauaaaggcaucaguguaucauuuuuuaaccuuaaaauauuaacuguguauguggagggggaugcuguugugugugcagcugugcguguauguggaggccagaggacacucaugcugucauauucuuuagguggcauuuacuuuguguuaagagacagggucucucagccucuccgagugggcuagguugguggcuaacaagcuccagagauccugucucugccuucccagcacuggaacuccacgccuguguuuucaucuuguggguccuggggauugaaccugagcaacacacauuuuacugcucuacuuuuuucccagucccacccccuucaaaaauuuuagaacuuaaaauauaguauuucuuuuggguauauuguaggauaucuuauucuuagcauauaauuacuguuuucgauuuuuuucuuacauuuaaaaaguucuagaguucuguuuguucuguuuguucuugucccaaguuucuucugcuaccacagcaagaagguaugcuuauagcuauacgauacauuacccuuuucuauucuaugaucccauuugagucuuaugcuauguuuaguugucuuuucuccuuagacuucuuuuaauuguaaugguuucuggauuuucuuccuuucuuccuuucuuccuuccuuccuuccuuucuuucuuucuuucuuucuuucuuucuuucuuucuuucuuucuuucuuucuuucuuucuuuuuuucuuucuuucucucucucucucucucuuccuuccuuucuuuuucuuuuucuuuuucuuuuuuucuuuuucuuuuucuuuuucuuuuucuuuuucuuuugauaccuugaaggaucuuccccuaauauuuuuuugguaaggaauuuuuauugucugaucuuuuugauaugaaggaauagcauaaaaaguaaaaaaaguagggaucuguguguauacauauuaaauagaacuauuugcugccuagaugcuuguauuaucauggaauagaagauggaaagauuuuugucucauauuaaaaagcaauaaagcuuggauggaaauguaaaaugaaauuugccaccauucacauuccuggcaacucucuguaucauguaaaaauguguguuugagaauggugaaaaaugaaauuucuuucaagagauugauuauacaggacuaaauuuuuuuaaggacuaaccuuuuuaauuuucaagaucuugaaguacaggguuauauuuaauucuaauguacugucuuaguuaugauaaaacaccauaaccaaaagcaagucgagaaggaaaguguuuguuuauuugccuuacacuuccauaucacuguucaucaaaguuagaacaggaacucaaacagggccagagccuggaggcagaaacugaugcagaggccauggaggggugauguuuuauugguuugcccauuauggcuugcucagauugcuuucuuauagaacucaagaccaccagcccagggguagcaccacccacaaugggcugggcccuucuccaucaguaaccaauuaugaaaaaaauaugcccuauagguuugcccacagcuugaucuuauggaggcauuuuucucaguugagguucccuuuaaaaugacuucaguuugaaucaaguagacauaaaucuguccagcacauguacuaauaucuauuucucuuucaacaaauguuuacugaaugucugauggggauacaauaguaaacaaaaaguacagucucuuuguuccccauguaauaaagagguagacaguaaauuaguauugguagaauuaaauaaagguugauaaguagcaaaugccuacagucacagaauauagauuuaagagaaaagcacauagauaccuuccacccuguuuggggggaggcagauuuagggcuuuguuuguuuguuuacuugguuuuuuauuuauaaggcuuuauuuaaaccugcuacauauaucuuaauauagauagcagaaacauuucugucuccauguguuuuucaguauucaucucaagcacuucaaaucuugucuauauuguaucacugaguuuaaucaaucccaguugucuuagacucuaguauacuuuguuaguucuaugcuuaugacauuauguauaguaguauauuguguuuuugcuucccacugugggcaauccaaaaucucuuucauagugcuaaucacaguaucuuagccuuagagauuacuuuuauuuuuucuuuuucuuuuuucgagacagaguuucucuguauuguauagcccuggcuguccuggaacucacuuuuuagaccaggcuggccuugaacucagaaauccacuggccucugccucccaagugcugggauuaaaggcaugugacacuaauauguugauugacaaaaguuaaugggaacuucuuuuucuuuagaauuucuaaauuuuguuuaaauuuuucaaaauaauuaccaaaugaggcauugauuaguuauaaaguguaaguuguucagaguugacuuaaaaaacaaaucagacuagaaauaagacaucaacaugagaaaaaaguaaauguuaagauaaauaucauacagaacagaacgcacauguaauuugaagugccagagcaaauggcgagugagguaagagucuccuaagguuagucugagguuuucagugcagugagcaaacaccaggugagcugauuuguaauucuaguuccaauuuuauaaggccuaggaauguuguuguagguguugggggcauuauucuauuuaucaugcaugugaguugaguaauggggaguuggaaauuuuaaauggaaauguaggaagaaaauagaucauuuucauagaucuuuauuaagcuuauacucuuugcccguuaccuuaucauaucuugaaggaauaagguuguaguuccuacuuaagugcucuucauugaaaggaguauacuacacacauauaaauaguugguauacuuaggaccacaguagaagguagaaacaaaucacaauaauuuucaaugagaacagaugugagaaaguacuuuucaggugauagaauauaaaaaaccugugccuugaaggacugcuaauaugcuucuuucugcgcguucaugucgucuuguugauuuggaaggccuuguuugcuuaguguccucuauaccuucugccucuguauccuccuccucuucugugggaguucccugaucccuaaggggagggauuugauggacagauccugguuagggcugaauguuucaagucucuuggcugacuuuagguuucuguauuuguucccauuugcuauaggaggaaacuuuucugaugauggcugaucaagguacuagguauagcagaauguuauuagaagucauuuuaucgcuguguucucuaguagagcaguaguauuugguuucuccccggguccuugggcuaucuagucuuagauucuuggucacccaagcagaguuggauguggguuucaucuuguggagugggccuuaagucaaaucagauauugguugauuauuuccuuaagcuuugccccaccauuguacaaucaucuugcaggcaggacaccauuguaaaucaaggguuuguaagcuggguucauguuuacauuuuuccguugguagcauguguaguaccuuccuguaccaaaggggauagcauguagggguaaagguucuauguaggcaccagcugggacuguucaucgcccacugaguuauguagguacugucuucagcaauagggccucaccauuaguuuguagagaacaacuuacaguguuggcaacagccugcguuguuuggggguucccaugggacccauuuggccaagaagcuuccgguacuggaagcuucauuuagugacaagagauguccaguuggggcuuuguuucuuccauuauuugaugauucauuuauauauccuucauauauuuguauauuuauauauccuucauauauuuguauauuuuaggaaccuucuacuauauuaggcuuccauauuauaccucaaaugguccuucaguuuagaugucucuccucauauucccucccuuguccagccuucucccgccucuccccccaacccacuugaucuuccuguucuaggucucccauccaucuauaauuauucuauuuccuuuucuuaggaggaaucuagcugucccccuugucccuuacucucuaccuaaccucugugguucuacagauuauagcuugguuauaauugauucaacagcuuugucuuucuuggguuaccucacucaggauaauuuuuuuuccuaauucuacccauuuaccugggaauuucaucauuucauuuuuuuuuuuuuaaaacagccgaguaguauuccauauuguaaaugcaccacauuuucuuuaucuauucaucuguugaggggcaucuagguuuuuuuccaacuucuggcuauuaugaacagaggagcaaugaacaugguugaacaacugucuguggaagaaugaguauuuuggguauaucucaagagugcuauagcuggaucuugagguagauggacucccaucuuccugagcaacuuugccacacugauuuuuagaguggcuguacaaguuugcagucucaccaugaauggacaaguguuccucuuacuucauauccuugcuugcaugagcugggauuuauuuuauugcuccuagccauugugauugguguaagaugaaaucuaaaucaagaaaacuguuuuuuaagcuuggagauuggauagaacagagaacaaagcugagauauauaaaucaauuaugauaucaucuaguauaacuaugagaagaggguaugcaccaaacaguuauggcaacauguggauaaagaggagacuagagcagugguucucaaccuauggguuucaacccccuuuggaggugaaugacacuuuuauaggagucacauauuagauagauugcauaucagauauuuacauuacaguucaucacaguagcaaaauuacagcuaugaagaaacaaaaugaaaauaauuuuaugguugggguuuacugcaaaaugaggaacuguguuaaagggucacagcauuagaaaggugagaaccacuggauuagagagagagcucaaggguagguugauguacuuugauggugauuaaauuuggaaaguagaggacaggaggagucaucaguaaaucaccccaauuauuuaccaagacucuugagaggcauuauaaacauaaugcuugguaauauagugcuuuagaugugccacccuuuccaugagagaaucagcaagcaacuaugugcuugcacagucucuucuccaguugcuaaggagauaacucugugaauagucuauagcuuccagaugcugggaguuguuauucaaguuacuauugaagaugccuuggucaguuuugaaaaauaaaaauaaguuacaguuauuuuuauuauagaauauucauaucaagaauuauuaacaaugcagaucuuauuguuugcacuuagauuuucacuaaagaaacucauaaauaacuugagaaguauuuaauauguaaauuaauguucguauuuuauuauuuuauuuaauaugagugauugccugcauguuuaucuugugccacgugcaugccuggugcuaggagaggacagaagagcaucagauccccuggaucuggaguugcagaccauuguaagcaugggugcugggaaccaaacucagguucugugguagaaccagcacugcucuaaacugugggaaagccaucucuccaguaucccuaauaucuguacuuaaaaaaaauguuuaaggucucaagagauggcuaguaaugagaagcacuuguucuuacagaggaccuaggcucuguucccagcaucacuuacaugguagcucacaaccauuucuaacuccaguuccaggggaucugaugaggauaccagacaugcacauagcagaccuacauacaugacugccaaacacuuaaauauaaaauaaguaacuuaaaaauauuuuuauucuauguauacaagggcuuuguuuuuuucuaauuuuuucuauuuguguaagugugcuacaugccuuccugggccuguggaguugaaguuaaaguacucugcaagggcaucaaauauauuaauugcuaagccaucuuuucauucccugaaaaaaguaaucaccuuguaaacuagauuacuuaagacugcuuacauuauucuuuuaguuucccuuuucuaguauuagggacugaauccagggcucugcaaguucuugacaaauguuucacuacuuaacuauagccucauuccuugcuuauuuuguuguauuuuuuuuuacccugggucuccccuuguagccuaggcuacguaaugaauaagugagauaagagaugccauugauuuagaaaaggcaaaaugcauaugaaaauaaacaauggagcuaaaagaagaugcuccaauguauaguaaggacacaugcuccacuauguucauagcagccuuauuuauaauagccagaaacuggaaagaacccagaugucccucaacagaggaauggauacagaaaaugugguacauuuauacaauggaguacuacucagcuauuaaaaacaaugaauuuaugaaauucuuaggcaaauggauggaucuggaggauaucauccugagugauguaacccaaucacaaaagaacacacaugauauacacucacugauaaguggauauuagcccagaagcucagacuacucaagauacaguuugcaaaacaaaugaaacucaagaagaaggaagaccaaaaaguguggauacuucaguccuucuuagaagggggaacaaaauacccguggaaggaguuacagagacaaagugugaagcagagacugaaggaaugaccauccagagacugcccuaccuggggaucuaucccauaaacaaccaccaaacccagacauuauugcagaugccaucaagagcuugcugacaagagccuaauauagcugucuccugagaggcucugccagugccugaaaaauacagaaguggaugcucacagucauacauuggacugagcacaggguccccaaugaaggagcuagagaaaguauccaaggagcugaagugguuugcagccccauaagaggaacaauaauaugaacuagccaguauccccagagcucccagggacuaaaccaccaaagaaaacacaugguggaacucauggcucuagcugcauagguagcagaggauggccuaguugguaaucaaugggaggagaggcccuugguucuaugaagguucuaugucccaguauaggggaaugcuagggccaagaagcaggaguggguggguuggugagcagggggaggguagaagggauggggguuuucagaggggaaacuaggaaaggggacaacauuugaaauguaaauaaagaaaauaucuaauuaaaaaaaagcaauggguagcaaaguagugaagucaaguuuucaauagcauuuuuaugacuacuuggauuauuuuauuauuccagaauauuuaugauauauucccucacuaaaauuacuauuuuuaguuuugaaagcaaaucuguuuaaaguuucacuaauucugauguuuccuuuuuuguaucguaggaaggcuuauuauuaaaagaugugacacauaacuggguggcgauguuauuauauugaauuuauuuuuaaaauguuaguagauagacaaaucaaauuuuguuguauaaacauacaguugaauuauguguuuauaaaaagaguucucuauguagaguuccauuauaagugguuaaaugcagugucuuuuguugccacaaaauuuuagccaacaucauuuguggucguggcuaauaugguguauuggacauuaagucuaaaauaugcuuauuauucucagagauucgucagcgaacugcagcucaaagaaaccuuuccccagcaccagcaagcucuagucaggguccuccuccacaagguccagugucuccugggccagcgaaggacgcuucagcuccugggggaccgccagaaagaacuguugcuccagccuugcccaggcgccuuggauccccugcuacuucaguuccuggaauggguaaacagagcacuuaauguuauuuacaguuuauauuguuuucucugguuaccaauaaaaugggccauuuucagacaguauggaaauggcauuucauuuggaaauagcagagcaguuaucugauuaagcaggaguuccauauucaauuagcuauaacucuuuacagcuggcaccuugugauaccaaaaccuauuucuugagcucauuuaacuguuauggcuucuuuguuuaaauggcaauaaaacuuuguagcauucuguagucuacaguguagcauuaucuuuuuauauucaauucuuagaauggcuccagauuuauauaugguagggauagaggggaacgcuuuaggaaguacuuauauuccuugcuaauuccucauauagacaguaaaacaugacaauuaccauauuucaggaaaauauucaagcauuguggugccugauauuacuuuuguaaauaagagcuaguagauucuuuuccuucuaagucauggaacuguaguaguauucuuugauuaggcuccuuuaaguucuaccaggagugugauagaucuguagauuuuauucagggguauaacauacuuuguauuuuucuuuuuuuuaaugugugauugggggcauggaaauccacucacugcuuuagcagguggcauuauuuauuguauuuccccaugucagauuauuaaauaagaguaagcuauauuuaugguauuuaauucuaauucagguacuguaguauuucaugacugacuguuauauaacuagaguuuauaaugauuugagaccagauacuacuuuaaucagguggauaauuuauguaaauuaaaaaaaaccuaguguuacuuaugguagauucuuguauuccuuuaaaaacucaacugagauuauagaagacuaggaaacuauugauuuacacauuaaaagaacugacuacaaaugaaauacauaaaaauuuuacagcacuuaagaugauuuuaguaauaccucaaaauuuuauguauaaauagucauauauuuugugaaauugagacaguuaaauggauuugaaauaauuaauuugagauaccuauaacuuguaaauucaaguuuugguuguuuaauguaagaacuuuggguaagagucuuuuaacucacaugcaacuugagcacucccauagcuguaaggacugcguuauagcacagggcuguacaagcagcuggaguuuaauaaagcauguuuugcccaaguuuuuaauuagauucuaugaaaauacuguuuauauuguacauugccaaaaaaugugaaggaguuaaauaauuuaucauagagaagauuaauaguucauuuuucuguuuuaauauauuuguaagagaaucaauuuaauuuauaugaucacagugcucccauaugcuugaaaauuaauaaccagcagguacuugauaauuugccaaauuguaagaaugccccguguucccacgauaauuccuuuugaugguuauuuacuguugcccacgcagcaugaguauuaagauauacuauuuuuaacguuaccagguuauuuaaccaaguuauuaccaaguugcagaaaacuuaaaauacuuaaaaacuuaaaaagccuuaauaaaggcuuuuaugugcccagauugcuuuguggacauguucaguuuuaauauguacaagacugaaauacuccagcaaguugauguaaaugcuuuuaacaucuaacugggaauguagcucagugguagaauguuugcuuacauccucuguuaacuguauacauauuuuuuauaguuuuuauuuauuuuuauuuagcuaaguauuuucuaauuucuguuuugauuugcuuugcauacugaguuauuuagauauaacuuaauccuaaauguuugguugaguguuuagcuguuuucuguugcugauccuaauccuuuaaucagaaaauggaugcuguuuugaaacugauuaaauguauugaaaccuguuuuaugacccauuacacaguaucuuuguaacugcuuucugucugcuugaguaaacauguauuuauuuauuccuguugggcagagcagguaugaaaguccauuaaguaaagcugggaguagugaguguucaagucuuuucuuuuuuccuaauuuuaugcagaucaaauuacugauagaaaaauguuaaaacugucaacuauaauuuuagauuugucuuuuucuuaaauuuauuaaauuuuuguuaguuuuguuuuguguuggaagcuuuguacgaugcacuuaagugcuugguauguuguucuuuaaugaaaaacagucacaucuauucauuuaugugugggugugcaugggugugugcauggguauggagguuagaggacaacaugagggcuuagguucucucuaccaugugggcuccagagauugaauucgggcuaucaggcuugaggguaggcaccucugucuacugagccaucaugcuggccccuuguucuugauaaguugaugcuuuugucauggugaacuuuguagucauucaaguuuuccuauacuuaguguuagcagauuuauauauuuucuguaauuuuuaacuuaaauuuauuuauuuuuccuguuuucauuuaaaaaguuauacagagcguuuaaugaacaguugcuuuuuuuuuuuucagucagacagacaguuucaucauaggagugucugaaauuugaugcaaugauuaugugugaguuugaguuuaaauguucucuaugaaguaaacucauugguccuaugugugugcuauccugucccucauuuucucuaucccuuugagcugaaauuguuugacuacauuuaaccuuuucacugccauauugcugcuaacacuuuuuugacacgugauuuuagugguuguacugaaguuaaguaaaucucuguagucacaguuguucaacugauaugccaucucgcauacaguuuuaaagaucugacaauaauauacuuauauuuuucuucucuuggccuugauguuauuuauuuagcauuauuuuuuaaaaaaguuuauugggguuucagauauugcuggggauauuacuuuuauacuuuucacuuuuuacacuuagucugcuacuuuucauuuccuuuuugcuuuuauuuuuacauuuuauuacuauacauauuauaaaucucccuuuaauuuuuuucuuuaaucaguuauacagucuuacuauguaaauuucacuggcuuggaacuuguuauguaagccauaguuaaccaugcuucugccucccaagugcugggaucaaaugugcucacuccaagcucugccguauauauuugugcaccuagcucccgcgaggacagaagggaggcauuagaugcugugagccuggaguuagagaugguggugagccuuugugugggaccuugcaggaaccaccaaagcuaacaggaguuaaccgacaccaagaucugcugcagcccaagucuuuuauauuuuuaaucuauugucacuuucuuuggucuuaaggacuucuaaaaaucauucccauacuguuguuugaccaaugauaaauuuuuguguuuugaacaucugagaaaagaccucauuuugcauugccuucauuuaaaaaagacauuuuugcuggauauauauucuagucugacagcuuucauuuucaagaugucaaugauaaguuucauuuuaguuugcaccugaugaaaguuggcugucauucuuauuuccuuuccucuauaaugcaccuuuuggccuucuuuuaagcaguuugcucauuuugggaggguggggugcaaaauuaugucuuguguuugggauuuguuaagauucuuugcuaacugguuuuaaaacuuucaaauuuggaaaaauauguauuucuuaauuguguauauauuuuucuuuagauaacuguuuauuugaauauuugauauuauucuacaacuuacugaucuccucugcccccuuaauuuuuggucuuuuucuauuuuaauuuauaugguuucuauugcuaugucuucaaguacacaaauauauauaauuauaauuauauuauuaauuauuaauaacauguuauauuacauauuuaauaaugucuaaauacuuguuuaucccaucuguugauuuuuuuuuuuaaacccuacauacuguugcguucauguuugaaauuuaguuuugguauuuuaguuuuuucuccaugucuuuauuuagcauaccuagucuuuucacuaaauucucaaacaugucaaguuagauauaauaaguguuuuaggacuuuugccugccaauucagucauaucugaaacaauuuuuauuuuuuucuuacuauaguauuuuuguuucuuuguuuacauggcuaguauuuuuugaaugccagacauugcaaauuuuacaauacaauacaagagguauauuucucuucuuccucuccucuuccucuuccucuuccuccuccuucucuuccuccuccuccuccuucuucuucuuccuccucaucuucaagcuuuucuucuuuaacucuuggaaauaggcaaucauucuguaaauauuguuuccuuuaauuuuuuugaaagacaauuuucucuucucaguuuccucagaugcauggcuguaaucuacugagugauagucccucuggagggguuucuccuuuucuuuccuccacauugaccuccuucucugucacugucuugugaauugagcuucauugucuucuccagaauuccggugcuaucuucucaacucuagggacagcuaccgcuccucuggguuuagccuuuuaccucugcuuacaaauuguaagaaaaggcugggagcagcaauugggauguaaaauaaauaaacgugaaauuaauggaggaaaaaaauacccaaagcaaaacaaaacaaaaaagacugaaacaguugcaagggcuuaucuugguuuuuaguuuguaagugaaauuuaaccuauauugccugacacacauguuguuaauucuucauacacuucauauauuucucauagucuuuugggaagauaaaccugaucuguuucucugaguccaaaguggaagucuucaaauucguaucauaggcuuuuaggaguaggcuauuuuaaaauuuaguuaguacagaacccaacauaguuucauacccuaaugaaucauguugguuguuuugguguaguacauauguaguagauuuuuauaguaugguagguuuaaugaauauuuaauauuguacagagauuuauaagaguauuuuguugcuuuguuaaaaucuuuuaaauguucuaacaaucuuagaccacuuuggaaguugaauuaaaucuuguguaucuucuacauacagguuucacguguuuuuauuuauuugcuaggccuucacccuccagguccaccuuuagcaagacccauucucccccgagaacgaggugcucuggauagaauuguugaauacuuaguuggugaugguccacagaacagguaaugcuaugcuaguaguuaaaggaauaugagaaaacauuggacaauggaugugugugugugugugugugugugugugugauguuugguuuguauuuguacguuuuaauucugcuaucauauuagagaaauugaauuauuuguucaaauuauuauaugaaguaaauuuuuauaugaaucacuguuguugguagugauggaaauucuuccaauaauaaugaagacaauuugcauuauuuagcucuugcuguuuuucaaauguuucucagauuauuauauuauuuguuccuuacuauaauucugggagugugcagagcauuugucauuauguagacuuucaaaaaaauucaugagaacauauuugacaacuuuacuagcuguuaucaguuucauaaagggacuauaguuuaauguuuauaugaguuguauauucaaaacagaaugaaugauuuuauuaagcuaagaaucucuuaaguucugauuagagaacagaaaaugagaccaauacguacguguuacugauaagugagaaacacacaggagccauaucguauaaaauuuuacuauuggucccaauuauacagaguuaaauguauuuucuguaagauucuuuaggacuuuuuuuuuaauuuuuaauuuuuuaaaacauuuguuauaaaucucuaagaagaccccauuauuuccagucuuaucuaaucacaaauuuggaagccauuauccccaggaauaaaucauugagaaaacuguugcugaacuuaaaauuuucucuuuuuuuuuaauauuuuauauuguguguaugugaaugcaggagccagaggcaugaguccacuggagcuguaguacaggugguugugagaugcuuggugugggugcugggaauuaaacucaaguccucuggaagagcagcgcaugcuaugaucuuaacugcuaagcauuucucaaguccucagacuaaacuuguuucugugaacuuaggauauauucagcuguuccuuaguuuauuuuuaauaucaucuauacgguagacagaugucuauauguauacaugcauauauacaccuauuuuuguguguguacuuuaugcuuuaugcccugcguuuauuuuauuuuuaaguacuuauuaggugcugggaaagaacucaggaucuugcacaugcuaagcaagcaccucccaacucuuaaacuaccuuccauacugguuguuaaugauuugguaacauuccuuuauuauagcacagccgaguggcgucucuggugagcucuaucuguaacuggagucuuauuuucucugugguguagguacgcccucauaugucagcaguguuuuucucacaauggcauggcuuugaaggaagaauuugaauauauugguaaggacuuauggauaguuagguaaacauuuuacucugaaauguaucauucuuguccauccuguguaaugucacuuuauuuuagguacugccuguacauacuggccagguacauugucuccuuauuuaauacuaaaacaaagcagaaaagauaacucaaguucuuucuuauaaugcacagccuccaggccagcuauucucagauguuguucuaucuacagggagucugaauuaauuauugggggugggaucuaagcauuagcauuuacaguugaggucaucaauuauuuucacaugcagcuguuauaaaugaucacaugauaaauuuugcuucagaaauuuagcauacuacaucuucuugaacaagauucuggauuucaaaauguacacuuauuuuauugauuagaaaugcaaguucugucaauuacuuaaauaauuuuauauaauuuugcuauuguacuacuauuuaacuuuuuauacccuuucuacuuuaaaaucaauauuuacauucucauaguaauuaugcaauaugcuuuaaaauuaaugucgauuugaauacuuuuuauauauaauaagguaaccaauucauguuaaaaauuuuaacuugaaucuggcuauuuauaaaaguaaucuugugaguugucugauaaauuuuugaaauuugguugacuuuuuuuuuuucuuuaaaaaaaaauucuaugcagcuuuucgaugugccuacuguuuuuucuugaauccugcaagaaaaacgagaccucaagcuccacggcuuccagaguuuaguuuugagaagaggcaggcaguggaaggcucaagcucaacuggucccacgcuacuagaaagugugcccucagcagaaagccagcucauugaagguauaaauauguuagcuaaaguguguguuuugauaauguguguagccgaauaauauaagcacaguauuuauuaaagaugauaaugaauucauguaucagauucuuaagcaugcacacguacgugucagcuauugcuaugauggcuucuucugugguugcuaugauguguuucaguuuucaaaugcagaucauguuaugaucagcagcguuuagcaccaguugguuaagcauugccauuggaaugaacucuuguauaguuugagagacuuggcuagugaugcuuuucuggaauaauuuugauguaucuaacucaagcauuuugaagcaauuguuguaaggacaaaauauuuagaauauguguggauagaauacaugugugucuaccacgccauuugugagaaaugaccagaaagcagguaacuuaggaguuggaaagucaucuuugcauguuuuggacaacuugguuaauaauacugugcuucauuuggauauuuuauuauuagaggcccaggaccauaacauugccuaugacaaaggagucacuuuguuguguagaaguaagauuuaucagaacuuguaguuuagaauucauuuugcaacucuaucuuaagaauucuuaaggaaguuucaugaaaaaaauggacaaggugaaguagaaaacuuccaacuguuuauuauuacuaauauucacucauuuuuuuuuguuauucaguucuaaauuauaaaaauggcuaaaauuaugagguagaccauaauauuuuggugcucuaccuaguguauaaaaacauacuggaaauugacaaauuuaguagcaguuauuauuuacauauguuugauuuauuuucauaaaagcauuuaauugcuuuaucuggauuauguacacaauaaauagaaaucacaagguuaguuaguaugagauucaaguuuuuauuuuuuaacuaugaagaaugacccugaaauauguguggaauugggcuuggcuuuuggcuuacuaacaaguaucaaugugaacgugaauacagacagcuaugacugagccuguguacuuccaucgcugagcgaaugcaucuucaucuggaagucugcagcaucaacuccaaacagugucaaccuuucucuuuugcuuaagucaugcucugagcugcaugcugacacaugcaaaccagcugccuuggcauugcggccucuuggaauugagaauaaaggauuuuauacugaagaugccuaaaggaaaaacugaaguccguuccaugaguaaccuugcuuaugaaagcuaaaguuaaugcuuaaaaaccaauaguauuuuugguuugauuuuuuuuuuucaaagaggaaaaaaaagccaacaaaauauaaaucuugauaauggguccuauuuuuuauuucuucuacuaagaucaagauggauaguuagcaaacaacauacagcuauaccuuuccuucuuaucuaaucuaggaggaacaauaccucagaugucucauuuucuaucugaaaucuccggagugaagucuaacuggcucaaagugaaccccaguaagguaauguuaauaggugaagacaaacuugaaucagggucugaugacuccacaguacugaaagcugaagcagugauucuuuuuuauuaaagacguuuuuacaguaguaauuuuuucauacuucucuuuggauucaucagaguggcuggccaucuuuuuucuuuuugguucuucagaagacagaaacuuuucuccaagucuccuauuacacuaugauacaguaucagucuaaagcuggauccuauaguaaaugccgaguauuucugaugaacaagggagcugcauuuauuuucacacugguguuacaccauguaguuaaauugagcuauuaaauaaggcaguguauuuucagucaucuauuuugugcucauagccaauguagcugggagauuaaaauuuuuaucucuaaacucaucaguguuguagaagauugagaacuggaccgacaauucuguuuucguuuuguaucuuuaaacauauugcaauagcuucuugauagcagaaacuguacagauuguuauuggauuuacagauacucugaaaagauaacuuccuucugaaauuuucuuucaacagauaucagcaaacauuuauauaaacaaucuagaacuaagacuuucucuuuccagucuaugccaugugucuuugcaguuaaguuuggucuggauucugauaaagaauuugcauuuaggauaagguuuuuaaaauuucugaaucacauuuuagaacagcauguggaaucuuaacaaguuuuuaccagagauuuagaaaaaauuacuguuaauccuugaauuuuuuaaaaauucuagaauuguacauccagauacuuugauaacagauaacagaaacacaagaaacuagggaaauuaauugcuuuaucuaaaacuguacuagguauggcauaccaaaaggacuugcuuucuuuuaaauucuuuauuuccuuuuaugauuaaaugauaacauauaauacauaauucauaaauacauaaaaauuaacucugcuaacugacauuaaaaugguugauugauuuuuuuuuccucccccucaaaacuggggucagcaagaugaccuagugaguaaaaguacuugucaugaaaguuggauaaccugagugugaauccugugagucuacagaaaggcagaaagaggcuccacaguguuggccucuggcuuuuacaggcaugcugugucacgugcaccuccccacacuauuaauaaugaugauaaauaaaaugcuuuccaaaauacuaugcuauucaaaugaauaacauccuauucauagcuguaaucagagcaaggagguaugcauucuugcauaaguuuagugauucuuuuuugcuauguuugaaacaauauuguuuccauuucucaguuguguuuguuuggagcucauguaauugcguuaguuaaaauuagcuuauauccauaggauaauaugaaaauucauggcaucuauucaggauuggcagaaauuguuaaguaggcuaauauaauauuugccugauaaucugauaucuguuuuuuucuuauaugcaaaauacuguuacuauuagguuauauuggaugaauaagaauucuguuuucaguauuuaucuuaugcucuaggaaauuguacuguuugauaaugaagauuucauuggcuccuguuuauauauuagucuccucaccaaagcuucaaucuuuauguugaacuuucugaauaguauauuguuguaguuuguuuuagacagauauaauuuuaucuuuugacucauuuuuuaaacauuuucagaugauguuuaguuuuagguuauucauugcuuugcaaugaaccuuuuuguuuuaauuuauucuucugucauauaguauaucaugaccacaaccucccagucccucagcgccucaguucuccccacacccacugcuccuccuccuccgacucccucuagaaaagagcaggccucacaaugauaaugauugaacauagcauagcaaguuguaguaagacuagguauauaccuucauaucaaggcuggaugaggcaacccauccaggaaaaaaggucucaagagcagacaaaagagucagagacacccucacucucauuguuaggaguccaucaagacccccaagcuaaacaaccacagcauguaagcagagggccuugcauacaaacacaugcaagcucugugguuacugcuucagucugugugaacucuuuugaguccugcuuaguugauucugugggccauguucuccugguauucugggccccucucccaucuucucuaguguuaccccaagccuugccuaauguuuggcugugggucucuggaucuguuccgaucagaugcuggaggaagccucucugaugacgauugggcuagacacugauucuauaacagaauaucauuaggaaucauuucauugacauuaaaugaaacucuuuguuuaauugaauuuuuaaucaaugcuaaauggcuaaauaguacucuguguuuugaauuuuaguauguguguguguguguguguguguauaaacuaauguauauuuaaaaacugguuaucauuuagugggauaauuaacugagucauuguuaugaguugagguaaaauucguuccauaaauauauugacaaaucuugugaaaaaugucaucuuuacaaccuaugaacuugaagacugaaauuguaauuuuuuuuaggagcugggauaaaaaucuaaaacuuagguaaagaucuuauauauuuuugcacauguguguuuauaggugaagcaauaguauuuauuauaguuacauucaguuuugaguuuaaauugucuagcugagcugaggcuuagucugaauagccaguuaccaaucacuauuauuugguggaagaacacuguucucucaguaauauuggaguggaaguuaguggauaggaguggguaaugaaacagaguguuguauuguuuuuguuuuaucacguuauugguauucuguuuguuguuuguuuguuuuuguauuauagaagcuaaaccugauuugaauuauuuuucuugcauauauaauuagguuauugagguuauuauuuuaagucuuagucuuuugguaucuucuggucaaauacuaacaucuuuuaaagcauauuuuauauuucaaaacuauuuuaaauugaaauaaguauuuugggguaguacaugguuaauacauggucuuguuauaaugcucuaaucuuuaguugugaaauuguuacagaucuguuaauacuauguacuugaucauuuagaacuuguuuguaugguuuccuguaagcauaaaauccuaugauugugucauaggcaugucacgugccaguguguguauguuuguguguguguguguuguucccaucaagauuguuuuucuacagaucaacccaagggaagaaaagucuguguaaauaaauagccacaucaguuuuuuuucaagccccagucauuguuucauuaagugucuacuuuucuauauauuuucugaauauauaauuuugacugucaugucugaaauauaggaaaaugucauguuuucuaacaauugagauauacuguguuucuucgaauuuauguauuguagauguuugaaauuuuuaguagugugguuccauuuuuuuauauuagcuuuuuuauacaaaccuagaauuuuaaaauuguucuugacuugguaaaguuuugaaguuaauacaguuuaauauaauaaacuuugaaccaugaucccuuugcuauugugucauucucuuagaaucuggccagugguuuguuccuauguucacuuaaacuugguguuuuugaguuguguccuauguuauuagguuuuguuuuguuuuguuuuuuccacuuuauaugacuuaauaaguugguuucagaaggcuuuacuaagcaaauugcaaaguucuugccaaguaaguauugcuuuaagccagaagaguuguggaaaaucaugacuuuuaaaauucugugaauaaguucuaugagacuuguauuacaaaugguuggcaguuucuaggauucccgcagaagaacuuguuggcuuuuauagcagcaaugguuuguauauauucacaguuucauuuguccuuucucuuuuccucucuuuccugcucauuuaacaaaacuugagugacuuaauacuuuucuucuuuggguuucaguugugauuucaaguagugcagcaauggcauuuagguucuguauuauaacaagguaggguuccuaugcuugugugucaccguaugauuuaugaccacuccacacugcuuuuugugaucagcuacuuggguugucauacaguaagaaaucauuauguagcugccccuaacugaaaucucaggcuuuuauucuguaaaagaagaaaggaguuguaacuaauccuguagauggggguccaggauaucuguguaaggagauacuacuucuaaaauauuuuauaaguucugacaaaagcaguauuuguguuuauuaaacuaguaugcuaaaggcauggauuucuaauacuucuguacuacucugugcauaaugugcauaguuucuuugcaaaacuauuuacuuugugaaauuuuggccauguuacaggcauuuaacuagacucuuuucuuaugcaggcuggccuuccccaggauuugcuuuguuuuguuuuguuuguaucaguagcacuuaaaguuuauccauaaagagcauuuaugaggaaauugugcccuugauaagaucaugugcuuuaauuauuuuucugcuagcaagaauauuagauuuacuaugaaaaaauacuuuaaagcuaaauuuuuaucuuugacuuggaaauuaggagacucaaagcaucucugcuuuuaucacucccuucuucugucucauuuuuuaaaauacaaagaauuaaaguuuaauuaguaaauuuguuauuaaauuauuaagugauuuaaguuaaaacucaaaaauagaauuuaaagggaguagauuuucaggcagggacuaagaacacaacuuucuguuuauagagagaaggaagaaagcccuuuucuuugucuuaguacuaaaggaugcagccugaucuaaguccuacguuuaaacaaggaacccuuaagacauacaaauagaaaauguggauuuugacuucuuucuucccugaauaauagagauguauauaagauuacacauacacacuacauacgugcauacuuaucuauuaguacuauaugcauauacacaaaagcauacauuuauacauugcuuacaguuuugcuuagguguaagaaaaaugauuuucugcucaguagccugggugacuguauguuugcuuuguuuuuagacucuuccuuguuguucuaguuagguuccucuauugcugugauagacacccaagcccuggaagaaagggucggucaguccaucauugaggggcguggggcaggagcucaaggcaagagguuggaggcaggagcugaggcagaggccaccgaggagugcugcuuacugccuugcuucccaugacuugcucaacuugcuuuuuuuauacaacccaaguucacuugagcaaagguggcacuguccacaucaaucaagaagugcccugggcacacaggccaaacucauuguguaugaaauuauuaaaguauggguuuauuuccuucaguuauuuaguuauacuaauucucuaagugcuaugcaauagagugaaaauuaaaagguaauguuagaccauucugucguuucuuaguauguuuguauguuuaucuuuggcuugucuuauuuagcaguuuugacauuuagauaucccugaaaucuuaugucuuuuucucuuuucagacucuuuagaagaacaagauguucuugauaauaguacugagcagagagaugacaaaauaccaguuacagagcagacaagccaagugauugaaaaaacaucugguccagaggagccagcagagaaccaagaagagacugagaacgaggaaaccucaacaaacgaagccaagucaccuguucucagagcugauucuguuccuaaucuugaaccaagugaagaaucuuuggugacaaaguaguaaauacuuccaugugccuucaacuggauauuuguagucuuguugauguuaguuacugcuuuuuuuuuuuuuuuugugguacucaagaaaaauuugccuucuagauauacgcuuaauauuauucauauucagauugcccagcaaguucaguguauccaaguacuaccacuagguauugacaguaaaagcacgugguaucaguuaauaugcagaggcauagcugugcauucuaaaguuaaaaaaauguuuuuuacauguauaacuuguaaauaauacccacuuugacauaggaacaaauuuggcuaggaauaauuucuuccauaguauuuaaggguugaaacauaauuaagauuuugaauacuucaucauuaaauuuuaacuuuggagauauuugccagugggaaggaaauaucuguuuagguguuuacaccaaguaaugcugaaagcuguaaccuuaauuacauacgcauugguacgaauucucaguaagaaugcaacuaaacagucaagugcaguauuucucuugaugucuuuuauuuuacaacugggccaaaggcacauaauguauauaguuaauguuuacauaguaauaggaaauacaucugcacuugacuguacuugaauucuugguauuauuuauauuuguaauauaaugaugauauauaaaugguuuuuguguguguguguguguuuuguuaaggaaaauaaagaugaccuggcagcguuuuucuuuguuaaauaucuagacuuccucacauaguauguugauggaugacuuggcuaucugaaaaauaccuugguagggaaaacucacuguaugaaaacuauauagcaaauuaugauguuuuucuuuucauuuagacuuucaaaaucagugacauaagagguuuaguguuucuaaucagaaguuaaauuuuuucugauuuugaaacauauuauggcauagguaguuuuuaacuuugagagacaaauaaaugcauuuuuaaagauaagacaguuaaauuuaaugaaacucacuagacugaguauguauaccaaguaucaggugggaagauuuuugauguagacuaguuauucuuaaacacaauaugauuauuuguucuaguuuccuuuuaugugucuuauguugaaacaacugaagugaauuuacaucauaggggagacauguuacgauaguguuucuggcuaauccuuuagcuaucaaauguuuaaauauacuuauuaucauuuaaaaguuuauauuuaugaguaauaccucaucugacauauauaaaagaacccaguuuguuaauauucugaggcauuuuaguguagugccuguaauugaagcauguggaacuggacuugaaugucagcuuugcaaucgugggcauuucaccuaaccucucugcauuuauuuaagcuguaaaaugaaaagaauaauauguuuuccauagguacugggaaguuaaaaauaaguuauaugaugugccuagcuuucuugcuagauaauuaauuaauagguauuagguuacaugguagaauuuauugguauuauugaaacccuugugaaauauggaaggaccguagauccuuucuuugguagauaaugaaauuaaagaaaacuaugagcauucaauuuauuuguucugaacagaaauuuucugcauuaaugucauaugcacgugucaaugauagauuaaagaaauggagaacugaaacuagaauauaaucuuuuuauaaaaagauguguuuauuuuuauuuuaugaguauaaauguuugacuugcauaaaugucuguguccaacaugucuugacagguaucuguagaggucagauaccugggucauuugaaaugauaguuacagauggcugugagcugccacgugggugcuagggaucaaacuuggcuuagucacuacgccauuuuuccagcuucauauaaccuuuuuuuguuuguaaauuuuacaagggguguguguguguguguuuguguguguguuaguagcaccauauuaagucuuguuaaaacaucugauaugcacugcucaaaaaugaguaccucagagaaaugggauuuaaugaagaaaccaagaagauauuauaaaaacaucccccaaaaggaauauaaagggggagcuagagaggugucucaguguuaagaaugggaacugcucuuacagaaugccagagugugcuuuucagcucccagcuuggguggcuugcucccuccuguagcucuagauccagcagaauugauggcuucucccuggccuccuaggacacuagccuaauguguacucucuuccccacagauacacauaguuaaaaauaaaaauccaaaucuuaaaaggagcuuaguaaaauuaacacaacagguggguaauuguugguguauuuuaaaacaaaauauuauucugauauaguagacaaugucugaagugaaugagacuccacauuucugauuauuaagauuaguguaaaugagggagaacuucccuguucacaaaugcucagcaugucauuguuuaaugucccucucacuguguccucaguguggccugaagacagggcuuagcuucucucucugucuuuccuacccacaccuuucuacuguagcuauaggacucucgcucaguucuguggcuaugcuuugccuuuucugccucaaugucagcuucauuuuucucugacagagagagccuccucuucucucugucugaagcuaacccuuuuaguccuguaucaggucacuuugucuuugcucugaauucuuacugcaggguaucuuguuuucccucaacugucuucacaauuugcuuuucuucugucuguauguggagugccugcucauuuuucauguggauaacguaccagauccagggacugcucagugcuuaacucaugcgcuugcuuggcagauugacuuggcugaguguucuuuuucugagacaccuuuauccuuuagguucugcaugugcacugcuguuaccuucccuggcuucuuguuuucagcauccuuugaagacuuccucugccaucuuuaaauguugaugcucucuggcuuccagcuauugucaguucuuauucugugcauucauucucaagcccagggacuuaauaguuacugucugucuaugaaugucagagcuuaguguggucuguuucuuugccuucguagcuauguauuuacgcaccuacugccauggcauagugaagucaguauuucuuuaaaaaacaaaacaaaacaaaaaacaaaaaccccuacuuauucaaacuugugugucauuucaccaaauaccaucaguauuaaaaccagaauuuaaaauauauucccucuuucccucugacuuuaaaguauucauucccaguuucuucccccacauccccaguagaauauugcaauauagcccagccuggcuuggcuuugugacuugaggccucagauuccuaggugcuggaaucauucuaugaguugcugugccuugcucuccucuaaacauuuuacacuuauauuauuuuucuauuucuuuugaauuauauuaaugauaaaucugcauuguuccaccaaacaaaugcuaccugcuguauguaugugugcuuacacacaauuuuguuuuuggggggaacaguccuguggagauuuuguaucuugaguaugggaaagaaacaggauguagaaagacuaagcagccuuccuagaggucucuauugguguguggaaacgucugagaucugacuguaagcagaucacuugugaugccguuggcauugaagccacagccucauacaugcuaagcccugcucugagcugaacuguuucuuccacucccaaggccuuacuguuaaucaucauuguauuaccuucuaauuccugccucugucaccucacgggaugaaagcuaccuuuuaaacucugucugcgaucaugcugcuuuccuauccauucugugcaguggguccucagaccuuuguggcugucuucagucuuucuguguuugagagaggacaucugaauuacuguauugacugauaaaguccggagcaguugucuuuccaguuggcucucacagcaacuuuuuugcauuacaacuacugucgcugcucccuccccuccacugcuuacguccuuucaguauacauagguuauuguuuucagugcugcauauaugcaaaguuucuccuaguugccuacauuucucaagcucuuccuccugaaauaccucguuuauguaauaaauagcuuauguaaucaauaaauauauagcugcugaauuggaguagcaccgcuuggaacccaagguuggaaauguuauuauuuauuauaaacuaugaguuuuucaccauguacucauuguacauauacaucuucacaguagaaucaagucuguaacugaauguguuacguguguguguguguguguguguguguguguguguguagggagagagagguagauggguggggggaggagagauugcuuuuaauuauguaaugauugucauuaagauaauauaugcugaguuccagaauguuaaaugauugucaguuuuaggucagggauacuuggcaucugagccaagucagauuuaaugaaggacuauuuauauuguaccaugaauuuucacuguuucaauauuaauacguucaugauuucguuaacagguuaauuucuaacugacaguaccuaccuuaauuaccuaccauauaccauguuagcuuuuuguaugugucacuuaaggguagacugaggagaacagcuguuuugagugguugugggcaauggaacuucucuaggaaguuagcagaaaaaauguuucuaugugguauaaaaauuguagaugacauuagauacaguuccaaguaaugaugaaucaguguagaaaugguuaugaauuaaaaccauuuauaauuugacuuauuucaaguuuauuaaauuucuaaguguuuuaguacuauuggccaucagauaaaaauauucugaaguuagacaaacaauuauaaauauggaaaaauugugucuuugaaacaaugaaaacuaaaaugagugcagaauuaaaaccuuauugaauugcaucagucuuuaggcaauuaauuugucucagcuuauuuaaacuaauugucauuuucuacuuuuuuucaaacuacuaccuuuaaccuucuuuagggcccaagagacggcccagcagguaaagguaccugcugccaggucuaaugagcuaaguuugauugcugagagccacacaguggaagaugagaaccaacucccucacguugucuucugaccuuugugugccugcuguggcacauuugugcuccccccaccccccccacacacacaaaugaaaucaauguaaaaauaaaaugcuguuuaauauuggugaaguggagcugagaaaauuguguaagcaggagggccugaguuugugucugcagcaccugcguaaacgcauggcaugguugguugccugcugcugucaccccauuacuaagggguggugacagguggauucuagagcaugcuggccaucccugccuuuuucccuuggcaucaaaacugauaaauguuggaaguauucugagaagauuaaaaaguguucuuaaaaacuucccucaguccagaauucugugaaaagaggccaaguuuuuagcuacuugaggcuuuuaccagaucccugccauuugcuuuaggaaaacugagaaauuuuauuuucauggaaauaaauuucuuagucugcuuugcccgguguugcaggcaggauuggugcacacaaugccgcuuguuggucaggcuuguacucuagguacaaucacacuauuagaguucuuccagugacuucagggagacaagugccacauguagauggaauucauuuccuaaagcugguuuauagagcugcaaauaggauuuaaacauggugacuaugauugcuuucuuuacuaucugugugcucuccuuugcuagcuuauggaguuaggcuaaagcccuucaguuucucaugguuggaugguaucucacaugucauuuguaugggagaacccugguugcuuauuaggucugcuucucaguucucauggaauauugaacacagacuauguuucuuaguuauauccuucuugaucucaaaccaaaguaaaccaguacuuggcacagacauauuacauaaauaaucagaaagcuggauuccaguuacuuagugguggacuugccuuugcuaacuaacacacgagguuggugugcuguuucugugugaagcuccuaugaaugauggauuugggacuagagagggaacaguaauugagggcuagaauauauuguuuuuguucucuuggugccugaaacaggggagccucaauaauaugagugaacuaagcuggagaugaccuaaacacacgugaugaggugggagagucggcagugcucagaagagccugauacuuggguuggguuuaagaauuuuguguaagaucauuugaguucaacaauccuuuuccugcuucuuaugagauauguaaagauaucagucuaagaguauacauaguacacuacacacacacacacacacacacacacacacacagaguuucacuauguauuccuugcugaccuuggauugcuguguagaccacgcuggccuuaaacucacagagaucagccugccucagaguacuggcucuguacugauuuucacuuaccugccucuaacccaucugaugcuaugacugaugcuuagagcuuacuuacauuucuacuuuuugacaucugcgucuaguggggccuagauacacacacacacuuuuaugcaagauaaucuaagacuauuuccuuuuucaauauauagguuagcauauagacuuuaaaguuggguucuugccucaacgcaaaacagagcaaauggaaaugggucccgugcuuuuauuaagacauuugguguguauuuuaugaacuauaagcuguuuccaaaacugaaacuggcuauucauguuuuacugucuauuagcaagaauuccaaaggcuuugcucaccuaauaaaggagagcgucuuuuaaaaaguugcaaugguuugcuuuauagaaacaaucuuucaaaagaaaucaaauauacuuggaauaaaauuauucucaacuauguguucacauagcuacaguguaugcaguguauggauuuucagaauagaauacuuugaguccuguaauugaaauugaauauaaacuggaauaaaaucaauauucuugagaccua

SEQ ID NO: 855 - RNA, 5471 nt, Mus musculus
ugaguauccuccgcgcuaguguaggcugucgguccucggggcaccacaggguagggcgguuccgacugacucuuacuaguucugccuccuuuucucaugaacaacucccacgccccagucucgccaagaaaagaaacugauccugauugucccagaccuucugagcgagagaagaguggggaggacaaaggggagggacguugaaggucgagaccugugugucuggaaaagagaggguaccugagaucccagaucagcugucauccagaaggcagcaaaaaaguuuacauugcauagcucagaagccaucccagccaagcaaguggagagagacagacagacaucauacauaacaccuccuggccauaccccaugagggcuuuaggcuuguuucuguugcucuuggacgucaaaaaggguccuuucaugacuacgcgcuuaucucaccagcaugagaagaacuugaaaugauaaggauggucuuuucaagcuaagggguagcaacaaaggcugagcuuuccaaaauuacacucuuaacaaucuccaaaaccucugaauaacuggggccccuuaaacaguagugcuguauuucccuaagaauugaaaacgaccuaaagaaggcuguauuccagucaacugcaaguaucaauaacaaaacuucaaugggaggggugggggcgcuccauaggcaaaauuaggagggaaacuucaacaaaagcuuuuauguucuguguucaaucacuuuuacggguuuuucuucuuuaguuaaggaagaaaauguuucugauuuucaaagugcaauagauauaauaauaugcuauguuuacacugacaacaccagcagagaagaaggcauagacauaguaucuacuuuguaagauaauccccuaaauucuaagaucuucaguuacagcuuuguaaacuuaaaagaauaggagagagcuaaacuuuagugugccauguaucgccucaccaauguggaagaaaguaaacagacauuucaccaguuuuuauuuggaaaauuagccauuuuauuucccagccuugguaguuucuaagaacauaaaacucgugcugccucuugucucagaucuuuccuaaagggaacaggaaaguuuuguuuguuuuuguuguuguuguuguguuuuguuuuguuuuugacucuugcuaauacuuguccuaggguuuuucauugagcuaucagggaguuuaaaaauaaaacaggacagagagaagagagcuagcuagaggcaaagauucuaaaagaucuaauccugaaaaaaaaguuucuagggaaaucacaugagaaaaaauguuagccuagccagguuugaaagggaaacauaaagucuaaaucaucucucaaaucuucccaaguauuuuucaagugaggaaacaaaguagaaaaauauguauagugcuaaagacagcacuauauuuauauuugucuuauaaauggagaggauauccaccgaggauauggcuagaugguaguaagcuuaucuaguguauacaaggcccaggauuuaguccgcaguaccaugaaagaaaugaagaaagugaaaaggaagugugucacaggacaaugcaggaaagacaaacagaacuaaacaugggauauacugcuaaacugcagacuccaggaugauuuugaguauuuauggacuaggcccuucguuaaguacugaggaagcauaccauagcuacaauaaagcauccaacaggagugggaagaaaacuacaaguuaaaaaguguucuauguucacaguguuagaaggcaucacagcagccagggaugaugggaaagccaguggagcggcuguucuaacaaguccucaagaguggcucccuacuaagccuaaaccguaacaggacagcaucuaaagaagugaaauccagagacuacuuugagagaggaaacaaacuguucaagcugauagaauuuuaagacuaauuuaggaagaggguauucaauuuucuuagguguuaugaaaacuuacagguggggaauuugucaaucuagccagagguguuagaguaagcuuucuuaaggaggucacacucaaauuagauccaaaagauaagaaacacaaucgugaagaaacacaaggaguguccuauguaaaggccuuuuguuugaagcaagcauugcaagccuaagagacuaaaaggaggccauugugacuggacaaggagacagcgauacaaugugaaacugggcaccacacuaaaagaucaguuuggccuuguuuucuaaaaaacaaaacuuaauccuuuucuugagaaaacaggagucugauaagaucagagcaaaaucauuccagcuacggugugggagcacaaguuuggccaacauuggaccaauuaggaugcacaagugaugggugaaguuaggcauaguuuaauugacagagggaggaaauaaaaauaagaagggcaaauggaacaaauuauaaagugagagaccuuggugacagacucauaucaagguuucggguaagagaaaaaucacuggagaguccuggugggcccacugcuaaugccaucagugagagauagggagcacuggaaaagagccagacuuagagggaaauggugauuuuaacuugaagaaagaguuuaggaugauuuuaugacuucaaaaggaaguguaaacacuuggauuuaugggucugaagcaccaaaaggucuaagguagacaaaaacguguuacuuuauaaucggcccuuuucugcagagugggcccuuucuuucaaaugaagccauccuuaucuaagucagauauuuuguucuguucuuuacauuuagaacauaaaauuaaaaguggaaguguggagagccuuugggggugccacuuggcaggaaucugauauuagccaugacaagucaguccaggcacggaaucugacuuuaggguaugacaaagaaguaaguacaggaagguaccugauguuggccacggacaaggaaguaagaaucugacuuuaggguagaacaaagacauaggcucagauaucuugaucauccuuagaaacauuuaucacuggcgugaucacgggacuuuguguuuauugucuuacuuguuccuugacuguugucuugcuugauuccucauuauacuacucucccaccugcauguaauuaaagugguauaaaagcggauuggaaaaaauaaacccaccuucagucucagaauugacugaacccaugccacaguguuaucuaauucuuuuuuucuuuuuaauccaaacuccugcgcuggagaaccuguugaccgacugagcgagcuuggucauggaagucaccauaguaguguccagguuuccccacgaauagccaggggcccuuguuaaaaauccaaauuuucagucuucccuuagaaaugcuuguccaauauggaaacuuggauuuuuaauaaguagcacuguugauucuuuuuaucacuaaguuuguucaagcagugguccucuggugccaaagacuaacugcaugggaaguuaaauacuucaccaaggcgcuuacuaaaguacagacucuucucacugggggcaaacuacugcagcuggcugcacuaaggagcucaauggugccuuuucaagauuccuugccucagacugcccugucauggcuuuuccuacuuuucuauuauuuuuuuuuucuccuuucauccuacagguucuuucuguaucauagcuucgugguuuguguuuuuaugggauuccugauugugccaacaagugggucucugugucuauaucugcuucuugugcuuuuucuugggucuuuccugcugguuuuugguuuuuguuuuguuuguguccuacucuaauuuauuuguuuuguuuuaucuuauauauuauuuuauuaccccuuaggugcuuguuuuuaaugauuuguguagccuccuugagcaggcuggcucagaccuguuccaccacugugaaagagaccaccuagauaggucuguuguucugccaccucagccaaagaugccacuaccugcugagcagcugaaccuguucuccugacacuauccugacuaugggggacuuuugggauagcauuggaaauguaaaugaggaaaauaccuaauaauauauauauauauauauauauauaaaaagaagauccuggcauggugggggaugggauucccugcccccccccuuuauaagccaucucuucaggccccaccaguuuguauucuaaugagagacaaaaggagggagguggcuccagaugagaugagaaguagggagauucugggagagagggaaauuguaaucaauguauacuguauagaaaaucuauuuuucaauaaaagaaaaaacaguuauugagauacugguaauguagcuuguuagucaaucacuugcugaguauguacuaggaucuagguugcauucauuauaugcuauaaauaaauaaaugacaaguaaaauguaguuaagaaguuacagccauuucuccuuauuuuggauucuuuugcuuuuguguuuuuucuugauuuguuuugcuuuguugaagauucuaagccucaaacaugauaauaugcaaucuaucucugaguuauauuaucaauuccuauacauuuucuccauaaacuugaagaaaauuuuguuuuuguuuuuguuuuucuuaaaugacuauucugcuuuguuaguaucuuccugaucacaugauugcccucauuacuguuaauuacuguaauggauuacuuagaguguuuuugaggaaugaaacagacuugcacugugagaauaaaucucacuggcuuagcuaugugcuucugugugugugugugugugugugugugugcuuuuuuuuuaacauaguugauauaauuugguaauaauuuguuuggaauuuacaaauuuaaauucauaaagaauguugacuuuuauuuuuuccuuuguaauaauaaugccuuccucuggccugagcacuagacugcuaaguauuccugaccucauagaaauaccaaacacuguuuuaauccccaguacuagaaacguuuuuuuuguuuuucauuuuaugauaaaucaauccaaauccuggaaagcuaggcuacagaauacucugaagagagaaguucugguucuuuacuuagaagccaucacuuguaugauaaauaaaaauccaccaagcuuggcuuccuaagguaaaaauacuugaagugagaucuaccuuuguuccuauuugcaggcauggcaggaagguuguccuaucacccagucauggguuaugcagaagcacucaagagcacuagccuugcaaaacuacaguuccaaggacugcaugugauauuugaaauguauguuuuaugaacucuuaaagaaauaccacacauaaucucugcuuauauuguaacauacuauaaacaacugguauaauguuuaccucaugggugcuguuugaaccauagaagcucuauccuucagaauaauuuaaaauuauuuuuaaaauuaau

SEQ ID NO: 856 - RNA, 671 nt, Mus musculus
cuuuuuuuuuuuuuuuuuuuuuuuuuuuuuuuuuuuuuuuuuucuccacaaagaauuuuuauuugggcuugucagaaccacugugcucacuagggucugugguccaaauccugcugucauaggucauaggccaaaccaggaagggauaccagggcaccucaggucgcugcuuugccucugcugggguagcuccucuuccagagguucuggagaacggggguccuucucuggaaaaagaucugggaaagugaaggucugcccaugggccagcugcacguaggccacuuuguagucugguuucuugauccucacauucuugugaucccuccuccuguuggagccaugcugcacccgugugcgcacggcagccacgggaacauuguaaaucugcucaagguaauuccgaagguccacccuggucaucuccauggggauccggaacugcacgguaucuucaggcugugcaguaccaggccgcaccagcugaaugaagaaguuaguucgaaauacacggagcugggggccacccaguugguaaaggggguacaacacauuccgcgccauggcagccgcaccuccucagucaguguucuuaacuacugagccaucuccccagcucuggaaaaauaguuucuugggacaaucccacucuuuguugucuggauaccagc

SEQ ID NO: 857 - RNA, 671 nt, Mus musculus
gcugguauccagacaacaaagagugggauugucccaagaaacuauuuuuccagagcuggggagauggcucaguaguuaagaacacugacugaggaggugcggcugccauggcgcggaauguguuguacccccuuuaccaacuggguggcccccagcuccguguauuucgaacuaacuucuucauucagcuggugcggccugguacugcacagccugaagauaccgugcaguuccggauccccauggagaugaccaggguggaccuucggaauuaccuugagcagauuuacaauguucccguggcugccgugcgcacacgggugcagcauggcuccaacaggaggagggaucacaagaaugugaggaucaagaaaccagacuacaaaguggccuacgugcagcuggcccaugggcagaccuucacuuucccagaucuuuuuccagagaaggacccccguucuccagaaccucuggaagaggagcuaccccagcagaggcaaagcagcgaccugaggugcccugguaucccuuccugguuuggccuaugaccuaugacagcaggauuuggaccacagacccuagugagcacagugguucugacaagcccaaauaaaaauucuuuguggagaaaaaaaaaaaaaaaaaaaaaaaaaaaaaaaaaaaaaaaaaag

SEQ ID NO: 858 - RNA, 15551 nt, Mus musculus
cagucagcuuuuacgagagcugccagacagugucuguucacguucuccagauaccaggggcgcccugacaaaguuaaggucaaguuagugucuuaucuuggguggcucaaaauuaccgcaucgcgucuacgcgcugcgcagaaagcuaucguucucggagcugcuggccgagccccgaaggccgugagugcucccaguguuucaaguaggaucgaauaagcaaggacaaggacacaacgcucgggucuucacgguagguucucuagcggaacgcgcgggugcaggggcuguggauuuucauggguuuucggggugaugaccaaagcagagagcuggggcuaaagagcaaagcggguugggucaaggaugaaugcuguggggagaauaugggggcgaguugcacgcuaaggcguggaggggggcccaucgccccuuccccuaugugcuagcgcgcugcugcagauggcgcacccuccccugccaaagcgcggcucccgccggagcugccgucgccaugucguugaacuugaaugguuccuccuuuccauuucccuuuucggcagccagcagacuucacuuuaggggcgacggucgguggggugagcagagagaagguggggaaauuguuuugcaucccaagacaugcaaagauugggggggggcgccgcugccuuccguccugaacgaccccaggaacacugugcugugucuggggagccauuuuaggagacagaucuaggggcgucgaccaggguucagaaagggagaggcuuggaacugagauggagauagggaggcagauaaaaauacgcugugugucggacuccgggcuaggagaauggugccaacaggaaucugggugugugugggggggggggguaguugcagggaggggucaccuaggauggacagcuaagugggagagagcuuggggagcaccagucgucacugccacagaccuguuugcgcaguuuuugggggagggaagcagacacgggugagggcggaggaaagagaggaauggagaaaggagggaggagaagaggaaggggcgacggcuagaaaauagauagcaacucagaccaccggccuuuucucuuaagucggcugggugcgcaaagagcacaggacccgaaccgcagcggucuggggaaaggaaggaaaccagaacagagcugccuaacggggcauagcgcugaagcccaggccucugggcugaauccuggguaaaggaacacugaggaaggaggaaggcugcugccuuugguucugggauuuggauuuggggagagacuaaggccugguaagcuggaggugggagccuaggccucuuuuggacuccaggccugagaggauugccgcagcccaaugagugaggcuuuggagcaaguggcugggggccuggaaagucuaccucggagucagguggugcagauagacuccaacaggcaggcagacgcuauugagggccccuggagaaccaaccgaucucccugggagaugcuaugaccaucaaauucaagggcuccagaggagucuuggggauaugccacgagauugcucagggcuuaguggggcuccaacacagugaaagcuccaagagacuugaacacagaagacgaugagaggaaggccaaagcacaagggguuugucugugggcggugaguagggaccuuauucugugagagugggacucaucuuccuuuuguucuucagacccucgagcuuugaggaaagccagaaaaccgggaccucuguguuuccacgcuggcugaguauugagaggagagagaaagagagagagagagagagagagagagagagagaguaaagggaaaggauggagguacuaagaaagacuggagaaaggagagaaagcaggauggaggcgaggaaaggaagagaggaagacaggagagagaaaggagaagagugaggaguaagcaaagaaaggagggacgggaacagagcggaaaaaccuggaagaagaaaggccgaauggguaccaaggcccacgccaagcuagcuccugggagucguuuuuuccagggucugcacucuugucccuggugucagaacccaagagagccaaaucccuaccagccggaacgcacuccgcagagaaauauguaaaucagggcucccugcgcccuagagagugucgcaauuacgccccuugaacaagaagcaacaagcucccagccggugagcuacggaggguggcugugucgcgggggagggagcggcugcaggaaaggugggggugggaaccucacacucucacaccuaguccucugugccagggccggggcuccccccaccaccaccaccaccaccgcucucgacugcucucccuucccccuuccucccccuccucccucccuccuccuccccuccggccuagguccggguacuuaaagcagcgcgggcgggcuaaggcgggcgggcggcccaguccgguggcggcagaugcgcccagcgguggcagccgccggcggcgcgcaggugaccggccugcagcgcagccugcucagggagugcccugggagagcuggcgggagcuggaggccgauccgcccccagcgugcgcgcgucucggcgccaggagccgucccggggcguguuggcgagcgcugauauagauauaaggacauuucucuccauggcgucacgugacauaauuaccaccagaaucaaucaagaugaauugcacgucagcgcccgguggggauuuuugcuuaguugauccuggcccaagccucuugugcaaucgauggcucagguuggaggcgcggggagcggcccgaggcuugccggcgugcacgccgcgcagccaugaacgacuuugacgagugcggccccagcgcagccagcauguaccugccgggcugcgcuuacuacguggccccgucggacuucgccagcaagccgucguuccucucgcagccguccucgugccagaugacuuuccccuacuccuccaaccuggcgccacacguccagcccgugcgggagguggccuuucgcgacuacggccuggagcgcgccaaguggccguaccgcggcggaggcggcgguggcgcggggggcggcggcggcggcggucccggcgggggugguggcggcuccgggggcuacgcucccuacuacgccgcggcagcggcggcagcggcggcagcggcggcggccgaggaggcggccaugcaacgagaucugcucccgcccgccggccgccggccagacgugcucuucaaggcucccgagccggugugcggcgcucccgggccgccgcacgguccggcggccgcagccucuaacuucuacagcgccgugggucgcaacggcauccugccccagggcuuugaucaguucuacgaggcggcgcccggaccccccuucgccggcccgcagccccagcccgcucccgcgccgccacagcccgagggcgccgcugacaagggcgaccccaagccaggggcugguggcggcgggggcagucccugcgccaaggcgacuccgggcccagagcccaagggggcggcggaaggcgguggcggugaaggcgagggccccccgggggaggcgggggccgaaaagagcggcggcacagguaggcgcggggcgcgggccgaggggcuggcccggggcggcggagggggggcgguggggaccucccucugcuugcgccguuuuaugugcuacuuuauaagcauucgaggggguuuauacauccuauaagauuucccgggucguuguaaagcguguuuaugauaggaaaccaauuuaggugggcuuaagguagacuucgaagaggacauuaaucgccguagagagcuuucccucuauuuggguggggggggggugggugaguugaggaccuuagaggagggaaguacauuugcagccaguugaugagugggaacacgagagccuccugccuuucagggagaggguaagugaucugccgcacuggacuuaaccccaaccucuggcuggcgcucagcucggaguugagcagaugcuccugugggcgcgcucuugucucucucccuucauguuccaguucagagccugccuugccaucauccuuuuuccuaucucagugccagccuagaguguguguguguguguguguguguguguguguguguccgggcgugaacacauguccacgcccgcacucuacugugcccgcccauauaucaucccccacgacgcaggcagggccuuucaacggcggcaagggacgucccuaacugggccaaggccuggcccuagcucaguggccagagugggugggggcaagcaguagccucucucaccucuugguuucuuuuccuugcaguggccccccagaggucccggaaaaagcgcugucccuacaccaaguaccagauccgcgaacuggaacgcgaguuuuucuuuaauguauacauaaacaaagagaaaagacuccaacucucucggaugcucaaccucacugaccggcaagucaaaaucugguuccagaaucgcaggaugaaagaaaagaaacugaacagggaccgucugcaauauuucacuggaaaccccuuauuuugagaacuccaggauguacccccuccccagagccccacucacccacccuccuccccaccagccugcucucagcaggcccaauguccuuggguucaaugacgccucuucucuguggaacuucacgauuucuucucgccuucaacucgggaccucccagcgaccacuacagccugaggaagaggcccggaacuuggcugugcggauccuaauaaggggaacaugguaaauguaaacaucccuuuccaauuuuaccgccaaugcgcuguuguuccucuccucccucucugaguccucaacgcggcgagaucuguaggaaguuaggccauggggcuagaaggagccaguguuuuguuuugaguuuaagaaaucccuuucuuucccuucagugaacacagauuauuuaaacucugggaaauguaccuuugggcaugagucacugucuuuuugugugugaauaaauguuuucuagcaaaauggaggucccagcuucaauacacugcaugaauuuuacuguuugaagaaguuuaguggcugaucaggcugucuuagugaccagaaaccccuuccucaugcaacugaaagcccgcugggacacuuuuuaaucucaccauaguaggaauugguccuucacacccccuguaggcuacacuggcucuaaaaaaucauguuaguguuacauuucugaauugaugcugugauccagcagugcugguugucuuuucuucuucuucuucuucuucuucuucuucuucuucuucuucuucuucuucuucuucuucuucuucuucuucuucuucuuccaggcaaugagauugaagcaguaggagucuaagagcaaauucucaccccacccccaccucuagucuaaugaacuuggaauuuuuggaaggaaaaaacaaauuuuaaacuuaauuagaggauccaaaugaucucuuaacauggugacaaggagcuagaguuucuuaagaagaagaaggggguaaaauccuccuugugaggcgggggaaguuuguuaagaggaaguuaauaggugcagggacuuggggucuuucugaugucaugaagcagggacugugaaccccccucacuggacuaaggcugcaaaacugcuucucaccacauuuaucgcuuuaaguuaaagaauguggugagggcugcagugcccuuuaugucacaggaccaagccaggcuguuuacaaaaccuugaacugucuagacaacaccauaaaacccaaaguucuaaacagcuuaauuggguuauauuauacaccuucuggugggcccaaaagagauuuccgcaaugugcaauaaacuggagacgugagaaaaccuccucuugaucugaccagagugaaguggaucucaugacucuuaaccucucagaagcccaaagucuaaaaauaaauccauaagaugcacagcagcucaugccucuucugaggaaguaugcuuuuuaaaauaugaauuuuuuaaauugccaaagcuuugggggggguaaagaaaaacauaaguguauaaguguaugccuuugaacuuccaaaaugucaaggucaucaccuuuaaccucucugaauaauuaggcgccuuaaaguucuucugugauuucuaaccaccgcccaggcucauacauccagacccacacacauauuuaugaccauacagauucauacuggggguucaccauaaaucuaggaaaauuccuaauuucaggaucaauaacuauaauuucccucccaacauuugaguaauuuaauagcaacugacuucuuaggaaaaaaaaaaacacuuguuagauuaaaaugcccauuaacuauuacuagagcuaggguguacugagaauuugggaagaucuuagaaagaguuucucuuugcuguaaugaagagcugcaguuuuuaaaaagacauuugacagaguaaauucugauuagacuuacaucaucucuagcauuugaaagcaauuugccacccugcuaaauaaacgcuggcacuuuauaaaauauagaacaaaguaaaauauaguuauauuguuucguaaacgcauuucuaaaucuuugguaaaggauaaaauagaaacaaagcagacaaucaaaguauuucacucagaaagugauuauuuuguuuagaauucugggcauugguuuaccuguaaauacccuaauaauaugaucuuucugggaucauacuguuuguuugaaacaaaccauaaaacugguuuguuucuuuuucuuuaucuuucuuuuuucuucuucuuuuaacugggucuaaauguacaagcugugugccagccagcacacuccaggcaaacgagagaaacacuauuuuccauuuguaagaacuucuacagccacacgagggcgcgcucauguuccagaaaccuuauuugccaagaggcugcgguaccuuuuuuuuuuuuuuuuuuccaauccuagagucuaauaaggaaucuuggcccgcccguuagaaacaggcagucguuaagguguuugcuauuugcuuguuccaaccagcugugaguuugagaaguuguagagagacagaggaaaagaggcaaccagucuuccgaaacaggagaucccccuaaucguugucuccuuaaagucgcuaugaaaaagaccuugguauauaaccugauggugucaagaaaauaguuuuaaaagacaaauagcugugguuugaaauacgucauagccacugggaguuaauuaauuaggaaaaucuauuuucauguugauuugaguguggagagcgaugacaaauauaagaccccuucccauuucccccaaaccgcacgcgucuugugagcuuucagauggcugggaugauuaaacggcuuuuguuuaaaacagauuagggcguuggcaacuuagcugagcauguacuuagaaaaaaaaaaaaggaaacucuuugaggaucgugggcgucguuuggggcugaggauuccaguccaugcaugacuugggugcuaccccuggcuaccccaggggcaaagagggcuagaaauuggggugcgggugccagacugaaccgaugcggauacuggagauaguagacucuuugugaggacguuuguauuucaaagugucgugaauggaaaugcauuugaaguaacaggccacuguacuugacugaauccgggccaccuuuccuagcugcccgcugaccuugaagugcgcaguuugcuuugggcacuggcucuuacaaacaguuaaaauugccccugugauucacuguuccugcaaauuccgggacauuggggaaugucuauguccccuucccuugcauccuugcccgcgguccacaagugugaagaaagggcucccggacgugggcggcucaaagggaggauggcggcucccucucccuuucaccccuaaguuccuuguuaagagccugcagccccugaaauuugcacugaccucugucucccuccauccauucgcugcaccacaggcucuagggcuuucuuguccgcuaguucuccggguuucccagaguuggcuuuggcuugcgggaggcuggggcgccaugacuccccggcuaggcgccagagagaggcguggguguuccccgcgcggaugcccggcucugucugucuugcugccgugccgguuggcuuugcuucuguaaaacgaccuuucucagggccuaacuucgguuucagucuaauugggugagaccccccuccccaaaugucguuguguuccuuuguaggcagcuucaucgaccgcgcaucuggcugugcgggggccccuuggccuuggguggcagccgccgggcggaccacugcugcugcgcgguccacagugucauuccucccagccgcgcucgcucaaugugguccugauacggggcaggggaugagaucagggacuucaggggcugaaaaccuccccaucuuggggccggcuagaaugcauggggcucuugauagaggcuaccgauacugaggcgccaaauuccucagauucugaaguagagagaaaaugcgccaaguaggaaggagucuuuugugucuguguagagaggcucggcccuucuccaucucuuaagcuuaucucuguagauccuuccguaguagucucccaauuugcuuuucaaaagucuuuuccaauugcugccacagugcucagugcaacccagaugggcgcccuggggaggcagcuuuuaauuugucccuguccacucucuguccaaaaagugacagaauccagaggcagcucacggcucuaauucagggagaccauaggaacccauagguccucuuaggcccagagccuccaccuuacccuucugaagaagacaagagagugaagauacaagccacuuuauuauuauuauuauuauuauuauuacaaaugguaauuucuugcuaaggcgaccuuuuagguuuuuuucuguggaaaaaaaaacugccagggagacaggcgucuugguacaaauauggguauccaucuuuuuuacgaugcaauguugacuuauuauuaauauuaacugcccuaaaagaucuaaagaugacuuuuaaaaaaccaccaaccacuacauuaaacacucgaagcaaaauaaaaguuggccuuuaaagcuacugccuuucccuuccauuugcuuugugucagcucuaagaucuuaaggcacauuuucuguccucccuucuuacaguauuuucauuuugcucauguuuuaaauucuagaaaucuaacauauugacaguuuugaccccgaggaaucagucuggaagcaaaaauucgaaagagaaaaaaauaaaauuuugagagaauagauuccauuuuuaaguuggcauacacauuuccccccucugccuuugagugaaagucuauuuaaacuccaaucuaauacgaggugacuuugagcuugaagccauggaacacugaaacagaaagacccacacagagaaaaggcagagcuugccucucccacuucacugcagacuuaccagcucuguaaggaauugcuuguuuuuagacuggguguuuucuucguguauaaauaaagauuaugaaagggcauuugaugggcauaaaauuccugauuagauugaacagcucugcauugcuugggauuaggaaaauuuggcaguggaaaccugggcagcuagcucuccuggccgagaugcaaagcaacacaaugccuaagcgccaagcuggcgucagggggacugccgagagcugugcugcgggcacauuguucagcucugggcauauuuagcuguagcucagaauuugaucgccacaauguaaaaaggaaaauuuugaggugcuaaucagugguuguuagguuugaucaagaucuuagcaacuuaggaacaaaaguucuuuuucccccuaugccuuacuuaacacccuucauccccuccccagcuuaaaaauagccaccccuguagaaagguaauguuuaaaucuccggcuccaccaccggggugcagcagccagagcagugagaggcuccaggcuuuaaccugacaaugauguuguauuugaacagcugcguaaagguuuaaaaggucugucucauugccaccguggaguuuuuuaaaagggguuauuguuugggcgagggcacugagaggagacuagccaaucggucccaaggccgaaaauaaccuccaagccuguuuucaucaggccgggagaaauuccuuuaggggagggagggggacaaaggacuuugcuggggugugagugauuuuuuuuuuuuuuugaaaagagcaacuaggucccccagaacgcugagggcuccuuaaagagcaucgaaccccacagaaauguucuguugaggggaaaacagauuuauccacaaguucagucucugggccugaaauccaaggccagcccauuccugggcgaaugugggagaagggaacacagaugucuuuuccgacugggagcugguucacggucacaguuuccggguccguuuuacuuucuugauugccgggaacgggacccggaaggccgaaggacggcucccacacacaggcagggccucugguccagggcaagucuuuggaaaucaagguuaaagcucccugcugcuguccuaaggccccgggcuuccgcaaggcggcucgccgccugcaaccaaagaagaagggaggaaguuguucaaguuucucauaaaauucugaguuuccacggugguuguggcagugguuguucuuuaaugagcuggaccacaaccccagaccauauccucuuuauaaaacuuucccucaccagaggaaacggaagacuuagacucucccucuuuauucccuucuugcccaaacaaaaccuugucaaagaauuuuagggaucguccaaaacuauaaaauuuaacuucugacaaaaguauagcuuuuaauauuugacgauuuguguuaaaacaaaaauugaccuucuugguuaguagcggaggggaaaaaucaauaguauaauuuucaauaauucauaaagcaaacgccauuaugcuaaaucuuaacuauuaaucuuauccuuuacaaagucucgauugauuuguuaauaaaauaucuucccguuuguggcaacagcggguauaacucuuuaaaaaccuucagaagcaagaaaauuaccaaguagcccaagaauguagaugagaauuuuauugaucgcccugauucuucuuaauauguauuaauaaauuccacaaccccuuguaccuugcacuugucagaaaccaaugcuuuuacaaaauccauaaaaggaaaacauauuuuucuuugcagaagaucuaaaugacaaguuugcuuugcucucuccucuuuuuauuuuuauuuuuucuucuggcccgguuuucuaaaacuuguggaguccggggaucagaguuuucccuuuucuuuugaaaaaaaauuucuuuuucccuuccuuucucucugcccuguguuaucaggggaaggaaaucuggcuuuagcuguuucugggagccggagagacgcuuucgcgaauagggaacggcuggcgaaggauuaucuccaagcuaggaagcucccagcggccgguccucaaaggucagggugugguuacucucagagucaaggcuccaggagcucgugggugccgauucccccccccccuuaguucuagcagaaagaucuaaggaggggguagcuacgggcuggaaccaucauccgagcuucggguuugcccagcugcgugguggccucucgacccucggggcccuauucgccagugcuuccccgacaccuugguccaaucuuugcacugaagauuuucacacagcccccuuuggaacccuagggagggauguuuccgaacuagagaaaucggacucaccuuccuggcugcccaguacuaaauuaaccagcccgcgccccuaucccuuccugggaaccggcccucuugggcgcguucugccuggguaugugcagggagagcgcuucugugagcaggcgccacagcgcucugacuuuccucaguacgcguguccucccggaggccccucgaaucaagccuuuccuuccgcuggcggggcccgguggccgggugggggacucgaguggggcaggccggccggccaaacaagccccgggagacaggcuggccggcagcagagcucugggccgguugucuccaacgcgcacuaucacaggcgcuuaguagaugucgcuguuguccgugcuuacgcggccagccggccgggcuggggaacacgugaccugcaaggaggcugcggcucaaggccauuuucaaaucucauuggcuugguugucauguggucggcagaggcauccacaauuacaccgggaauguuuuccuagcgaugucagccuacaaaggacacaaucucucuucuucaaauuccuccccaaaauguccuuucccaacagcucuccugcugcuaauacuuuuuuaguagauuccuugaucagugccugcaggagugacaguuuuuauucgagcagcgccagcauguacaugccaccaccuagcgcagacauggggaccuauggaaugcaaaccuguggacugcucccgucuuuggccaaaagagaagugaaccaccaaaauauggguaugaauguacauccuuauauaccucaaguagacaguuggacagacccgaacagaucuugucgaauagagcaaccuguuacacagcaaguccccacuugcucauucaccgccaacauuaaagaagaauccaauugcugcauguauucugauaagcgcaacaaacucauuucugccgaggucccuucguaccagaggcugguccccgagucuuguccuguugagaaccccgagguuccugucccuggauauuuuagacugagucagaccuacgccaccgggaaaacccaagaguacaauaacagccccgaaggcagcuccacugucaugcuccagcucaacccucguggcgcggccaagccgcagcucucggcugcccagcugcagauggaaaagaagaugaacgaaagcgcgagcggccaggagcccacuaaagucucccaaguggagagccccgaggccaaaggcggccuuccagaagacaggagcugccuggcugagguuuccguguccagucccgaagugcaggagaaggaaagcaaaggucgguaugaacagaguugccaccccagcggggcgugcaguccgguaaaaccucgaaaagggagcgcucgggugcccagagcagagcccgggcagcggagcccagagcccauacuccgcaggugcugcuccacccggcuuuuagaagggauaucccugccuugaaagggucggggcuucucucccgcugcuccggccagaccuggccccaagcugauggcgccugggcagaggacaggcuugccggguuuaucagucuugagccagauccgaaauacaacaaaagagcuaaaaggagaccagccguuuguaaacagggcuccagugcccgcuuuucuuuggcucagauuugcagcccuaguuuuugccuugaacccagggaucauuuuaagguagccuaagacaccguguuuguguucaaggguuugcaccccgcauccugcgaucuaagagggaaaggaaaugguuuggccuguuggugcuuggguggggaagcagagguaaccuuggcuuugucuggcgaaagugccgcaggcuuugcaaucuucuacaaagggggcaaaggcggaggagggggagaacagaucugcauugcccaccuagggcugggguaaugcaaagaaccagggauauggguuucuaagaaggaaucuugagcccccacgcccauuucugcagucugucccucacugucuaccgggugagccacagaguuacauuucuggaggaaggcuuuugugugagagcaaagaaaaauugaggaaauucuggggggaaggggggaacuguaacaaugcccagucaggguggagaagggaucccugcuuccucauuaucucuugaaacagccugcaucccuauaaaccugguuguggaucuccuugucugccuaggagggguggguaagaagcggccgacuuggggcccuggagcaguagugagauacugguagaugaagcaagcuaugguucuuucugguggccugacggcuuagaauguuuuuggggggacggaggaauccuguaaaguuugcuauuauagucacauuuugugcaagccagaaaaguuguguaggagagagagagagagagagagagagagagagagagagagagagagagagagagagaauaugaggaggcagccucuggcacagaauauccuuucauucaucguguuaaguauuuaguucuaaauugguaccaauuuacaauccccuucaugcccaccuucguaagugauguuuaauaccagcauuguccaaagcagcccaucuggcagcagggucauggccaaggguauauuugaauggacugagagaaaaaaaaauucuugauuuuuuuuucuucucccuuuaauuuuguuagaggaaaucaagucugauacuccaaccagcaauuggcucacugcaaagaguggcagaaagaagaggugcccuuacaccaagcaccaaacgcuggaauuggaaaaagaguucuuguucaauauguaccucacccgcgagcgccgccuagagaucaguaagagcguuaaccucaccgacaggcaggucaagauuugguuucaaaaccgccgaaugaaacucaagaagaugagccgagagaaucgaauccgagaacugaccgccaaccucaccuuuucuuaggucugaggcccaugugaggccaggauccgagagggggcaccgaguuccaggccugagugcuggaggacuggcaaggcggaaacaaacccuucauugcucuuugguuuuuuuguuuuguuuuguucuguucuguucuguuuuccugcuagaaugugacuuuggggucauucuguucgugcugcaagugaucuguaaucccuaugaguauacauauauauauauauuaaaaaaacuuagcacguguaauuuauuuuuuuucaucguaaugcaggguaacuauuacugcgcauuuucauuugggucuuaacuuauuggaacuguagaacauccaucuaaacguauccaucgcaucccacccaucuaucccgccagcaaugugacuuuuccauguuuuuccuaacauaaaaguucucugugugugguuagcccaugaacucauggcauuuugaaaacauccaguauuuaaaaaaacaaacaaccuauaucuauauauauuucaaaagauuaagaaaacccacaagcuuuggggggagggggacuuuaaaaagcacauuacaauguaucuuuucacaaaugaacuuagcaauuguccuuggugaaauggaauauugaugacuuaugccuuguagccuuuccuuguggugcaucugugguuugguagaaguacaagcgcaaccugugcuuuucugugcauguucuggucgcauguguaaugcaauaaacucuggaaauggguuug

SEQ ID NO: 859 - RNA, 1849 nt, Mus musculus
gcucuuggugacuucuggcuggggaagccaucuucaggggcuagguugaaacuaguaaugcccaccuggaaccuggcuggccuccauugcaggaacaagcaacagcuuagcagggcacuggauccaauugugcccccccaagucccuuucucuuucccacccgccccaagcucaagacaaccagacccagugaagccaagguugggugaguuuucucauuuuauucuaccuugguuccuuucugaaaaggauuaauauucugccauugccuuugaguggcccacaguaacuauuuaaaggaaaaaaaugaaacuauucccccagucaaaucucucacuauuuaauuacaaaauguucauuugcagccacugugucugagcugucaggugacugaaagcaguugcaagugaccaugacugcucaacaagucuguccaaugggccuuuuacauacauggguuggaaaauucaaaccaacgucuguagaaucccugucauugagcccacauucaucuugugcuaccaggaaaaagggaagaggugacugaacucguugccccaagucuggccugugguuuuuaacccaucuucaaagaauuucacaaaacaggauccccccccccccaacacaggcccuuuuccucccaaagaacggugcauucagcgucucugagcugccucgccccauccagacagucuuugggaugcucgguacugauuuuuuuaaaccuccucucccagaccccaaauccucucaaauuccaagacagaucccuuuagggacguauuuuucugaggcuagcagagagagagagagagagagagagagagagagagagagagagagaagugucugauuccauucuagcuugagaggacuggaauaaauuugccccugacuuaccuuggaugggcaaaagaaguagagugauuuuaaccucugcguuucucccagcgauguggggagcgccauuaguugcugauggggggaaaccugugcuacaggaaagggcaggcccccugaaacaaaaucagaaagccauucgccaaggcaaucaaucagguccuaaguagccauuuacccccuuucuuggcggggcuagagguggguugggagcccuccaagggugcucugggcaacuuguagagcgaggaauauguccucucagccgccgcuggcgugcggcuuuugucucggcucccaggcaggcuuuguaccauggauuugggagugacaaugggcauuucucucagauucaaggcugcccggccuuaccucucaaggggaaaacuggaaaggggguggaucaaggaccuguucuuucgucuggauuuugaagacaucuucagaauccguuugcaggcacgugugaaaggcacgcagcgaaccuacccucggagaugcgguuccugcaggccucucugaggcugggcuaauuccggcuagugagaaccggucucacuggccuuuagguuuuccccucuguggcauguuuucuugcagggccauuccagaaggcuggggaaagaugaggcaccauggccaucacugucggcuccuugggacuccagugcucaccacccaugcgagggcagagagacagcccuuggaggccgccccuuggaagccaugcugagcuggaccaggcccgagaguccaguugacccagcucacccccugggccucggggcgugugccuagcuuuuugucgaggguuuacauguggcugccccgggagugugagcgcgguagagggaggggcacuccgagcugcuccauccguccguuuuauuagggacacauuaaucuauaaucaaauacaccucauaaaauuuuuauugaaaggcau

SEQ ID NO: 860 - RNA, 2531 nt, Mus musculus
uggagaucgcaggacccagagaggcaagaagagaugaacaaauaguccccagcgccuccugcggccgcaguuaggccuguggccgccgccgccaccagggcgggcugagccgggccaggccgggcuggugcguggaccugggcccggcagcucuaauugcaacgcuccuguugaugaugauuuuuuuuuuuuuaaaucacagcagcccccaguuuagcggacugauuuacuccggguauugguaaauaugaucacgugggccgcgcgaccaauggugguggcugcagccugcgaacuagucggcggcucgggcgccggcgaggagccgcucggcggugggcaguggaaccuugggugggagcgagcggcgccucaccaugucguccaguggcacccucagcaacuacuacguggacucgcucauaggccaugagggcgacgagguguucgccgcgcgcuuugggccaccggggccggggacacagggccggcccgcagguguggccgauggcccagccgccgccaccgccgaguucgccucguguaguuuugcccccaaaucguccguguucuccgccucgugguccgcgguggccgcccagcccccggcggcggcgacgaugagcggccuguaccacccguacguguccccgccgccccuggcugccgccgagccgggacgcuacguacgcuccuggauggagccgcugcccggcuuccccggcggcgcaggcgguggcgguggcagugguggcggcgguggcggaggcccgggucccguucccagccccgguggcccagccaacgggcgccacuacgggauuaagccugaaaccggagcggccccggcccccgcugcagccuccaccuccuccuccuccuccaccuccucguccuccuccuccaaaaggacugagugcuccgcggcccgcgagucccaggggagcggcggcccagaauucccgugcaacucguuccugcgggacaaggcagcggcggcgacagggaacgggcccggggugggaaucgggaccgggccaggggcgguaggcucguccgagcccucagcuugcagcgaucacccgagcccgggcugcucgcugaaggaggaggagaagcagccgccgcagccgccgcagcagcaacuugacccaaguaagugcaaaagaaauugcccccugauuuauugcugaaaccuguaaggcucgaaugugcaaaacugauaguuuuacuaaccuauaaaaacgucuagacgccuacccaagccuaggcgagcaacacguauccauaaaaagcuucccauaaccaccuaccuugggcgcgcgguuuguacgguaaacagagcgcgggcauuaaggcuuuuuaugauaauucccccaaguugugaaaagcguccauccuuggugaaauuaauuuaacgaccucucuuccccacccugucgucucucccugccuccccuccgccccucgcucccuugucugcaaaccccccucuuccuagacaacccugcagcgaacuggauccacgcucgcuccacccggaaaaagcgcugucccuacaccaaauaccagacgcuagagcuggagaaggaauuccucuucaacauguaccucacccgggaccggcgcuacgagguggccaggauucugaaccuuacagagagacaagucaaaaucugguuccagaaccguaggaugaaaaugaaaaagaugagcaaggagaagugcccuaaaggagacugacccagugcgggucuggccugcagcacucaaaaggcagcggguuuuuuuguuuguuuguuuguuuguuuuguuuuuuguuuuuuguuguuguuuguuuucuuugugggugcuugauucagaaacucugcagcgacucggacuuucuucuuuuuuuagguagaagugacugugugguuggucucugugaguuaucugggggacacuguauuugcucgcauauguauuggagaaaccaaguggcuuuggagucuuguccugucccacucccucccuucccugcuccccugauuccuuaggaaaugcuauauuuugugagugcacgcaggcuugauggagcccuauucuauguaaaugucccucauguuucugaaaagugcuguaguuuagucucacccuauccagccucccaaacagggccaacgaucuaauuccgagaaucugaaggaagacagaguguggacacccccacccugcucucccaacuaaaauccaacucagcugcucaaggcaggaaaaccccuuuccucggggagccggcggacugacuuccacagaggccuaccgagaaaccuugggcccuggggcgcgagauugggggugggguggggauaggcuuaguccucagagcaccggggaagcuacuuucuccccgggagggcugagcucccauugggcggccucgggagguugccuuccauauuccugccugaggaccaguuguaaauguuaccgcuuccaacaaauaaaugcugaucugaacaaauggagcccagccgcuggcccugaac

SEQ ID NO: 861 - RNA, 13026 nt, Mus musculus
acgcgccugccuugcugccaacuuagccaaaguggcugaggggccuccgcccagcucgggggagagcggcgccggcggaagggcggggcgagagcccuggacaucagcuccugggacagguauugcgggagaaaggcagggaagggcgagggaugcagcggucagggcuggucccucucgggaccccuugggcuauuucccggggaaugaugggcgagccuggaugaugcuggguaacaguauugcuuuugcccugaggggacucuacccagcccucccucugagaaggucaaguuacucuugccccucuuugggggggggggggugcauucggguuuccuugacccagaaaucccucuuguccuaaaccuagaacagacauuccuugcaucuucccucuuuucugccucaccaaugacuccugggaccaccuaggccgggggggggggccgcgggggcgcggggggugaaaucauuuucacuagcuuuucuuugcaccauucccccccgcccccagaauuuauccucuucagcuccccuuccaauuuguggcgacguggugagaauggauguuuguagugucagugucgauuugggcagaaaauaaguuuggauuuucccuucugaugaggucaucagaauacggaauccacucuguggcagaaaggcccuuguacacuauuuagaaggcuggcacgcgagcugcgcacgcuuucacugagacucuuggcuggagggcgcugggcauccuggggacuggucagaucucagagcuuuggacuggcuuguaccuuaaagcaauuaaagcuucuguuccaucagauaagugcugcgucgucucuugcgaguguaaucugagggcucacgauguuaaugggcucacgucuuucccuugauaauaugguuuguuuacugaguguagagagccgggaaauaaaaguguaauuggcacaggaaauggagaggagaagggucauacagacaggcuuuacacggacaaacuuuccagcuuccuuaaccaucucuuuucauguuguccucuuuagggcaguagaaaaacgccaagagaaauaaauacagguuauuugcacacagccauaaguaaaugaaggugguuuucuaaaagccucuguauugacgagucuaaagagucggcuccagguuuauucaagugcccuugaaaacuugaucuuuugcagccuccaaguuagaaugagugagguuuuguuauugcuuuauguauccacucgucaugagacagcgauugagcacuugccuaaaauuccacucaggccucauaguccaggagugagccccuuucagggcuguggacuuguaaguaaauaaagcuacagcaaacgccuauuaugcuagugagguggaccuggugcagcuuaagcaccuagacuugggaauggucacgugacugagcacaccguuacaagaguaugggguucuugacaaugaacggaaaguagaauccuucuacuaaaaacagaccuuccaccuaaaacuacccauuauuugcuuucccugaagcauauuuuuuggcgauucugucuuugcuugaaguagaaaccguacuaaaaugaaaugagcagcuguugguauuuguauuauuguugcuguuuuguuuuaacgguuguauugagaguggacaucagauguggagguuggaguaguuuuaguauuuguucagacccaauuguagcucccugaugaauccauaccagagagcuauggucuguuuaucauccucucuucuuuuaguuuuugaguccuugggguuuccuaugcucuggagcucagacugcugucuucuuuuauuuugguuuugaugugcuggguauccaacccagggccugacaacgugcuaagcaagcacucuaccacugagcuacauacucagcccuugaguugguuugcuuguuguuuguuggaagccaaaccucuggucauuucauuccaugccugaauucagcagauguuugccauuugcacuagguaaggacacuuuauuaugccuagaaaaagauauccuuaaggaaaaggagcaagauucauuccugcaagguucauccuguuuccguuugcuguacuucaagucuaagagaucgaucucucucccccccccccccucucucucucucucucacacacacacacacagagagagagagagagagagagagagagagagagagagagagagagagagaauauauacccaaaccucacacagauuaggcaaaugcucugaaacuaucuccagcucauacuucagaguaaucucaguuuauaaucaucugaggagaggcuggaagguauuauugggggaaaugugcuuaaaaauaugugaauagagaauauuuuuaguaacuacccaguuugucucuagugugaacagaauaggaaggaaaugucuuacaaauuauauuaauguguaaguccugaaucccuaagggccacuugccccucugagucuuggugcugugggcucuccaugggaggugacagccgaggggccccauugccagaauguguuugauguaggaaugcuuugaaauagccugccugcucaccacagcagccauccacauucccacccucccccacuaccuuucucucccaucccaauaguaagcuucucuucugauagaagcagcuccugguggccuaucuucuguguguuuaaagcuggucuuaagaaacaccaggacacccucugcuguaaacacugcugugcuaaccccugggagauacuuaagcacacacacaaucaaacucuugacuccacagaugcaaagcagaggcuaucucuuuaccuaugagaguaaauuaagggagccaaaauguuuaugccagacuaagagaaaagagauuaggguauaguaucuucugcaaucaaaggauagagguaaggauuaagagguccuaaagauaggaauuuuaaaauucuuagcagucuaauaauaggauccucccuaaggaaacagacgaaugcugugccuuuccccgaaucucacagaugagacucauggaccaagccaagccaguuuuugacacagaaacagugguauauucuaccacuauuuaguacuagcuuaaguaagaguacccucaaguuacugacacccaaaacuacuuugcaauuauggaaugaccacagagcagugguucucaaccuuuuaaugcugugacccuuuaacacaguuccucaugcuguggugaccccacauaaaauuauuuucauugcuacuucauaacuguaauuuugcuauuguuaugaauuguaauguaaauaucuauguuuuccaauggucuuaagagaccccuguggaagagucaguccucccuccaaaagggucgugacccaccgguugagaaccagugccauacagucucucuaaagguaguuucagguccuagcaaacacagaaguggaugcucacagucaguuaguggauggaucacagggcucccaauggaggagcuagagaaaguacccaagaagcuaaagggaucugcaacccuauagguggaacaacauuaugaacuaaccaguaccccggagcucuugacucuagcugcauauguaucaaaagauggccuagucggccaucacuggaaagagaggcaaacuuuauaugccccaguacaggggaacaccagggccaaaaagugggaguggguggguaggggaguggggaggggacgguaugggggacuuuugggauagcauuggaaauguaaaugaggaaaauaccuaauaaaaauauuuuuuuaaaaaaguacaguuucauuggcacacuaugagagguuuugauccuacuggucugacucaggaacauauauauauauauauauauauauauauauauauauauauauauauauuuuuuaaacaagccucuuguuacucaaaacuacaccuugacauuuucugcuguggaacaugggacugggagaacagaacagcaagggaaugcuucuguaggggggagggggacagugagcagaguaaaagaccagugucaccuggccagcugacacaugaguauuccugaagagugucuacaugaguagcaguguagaaaagugaguguaaaggucaaauuuaaggcuaaauggucgacagcuccagaaaaugucuuagagacgugcucaguuggggucuggagaguucagagguuagagaugcuugcugcucuuguagaccugaguucagaucccaccacucacauuggacagcugacaaugaccucugacuccagcuccagaggaucuaauauguuuuucuggcuuccuuggauaccuacacaugugugcauauaugcacacagacauaaauacacaaguaaugaauggauggaugaaugaaugaaugaaucuuaagugaucaguaggaaauucacaaauuuuacugaccaguuaguguuucccaauggcugaccaucugcugcuuauucccuuagcuaccuuggauguguaggaagugaaauuugcuucuuccuuccuuuagagagauccaggagugcuucugaagcgguguuguaaggagaggaauaaggaugggguuuucaacucucauuuccguccaucucucaacuuaucuggaaggggccucugagccuaagggaugcagaaggggugaaauguaccuuggccuaacuuccucuggcuaagggaugaucuuccauagcguacgauggcaaagcuagaagacucuuuacacauagaauuugucaaacucuugguccuagggagaacguugcuuuacucaggaguugaaggagaaugcgauccuaucaaaaaaccauggaauuugggcuuuccagucuuccugcagccuggacaaaggaagaacgaagguagccccuuucuggcacuggcacuacggcaccaauucugagcaggcagaacaguguugagggugccuuccuuucugggagagcucuucuuccuuugagaguuugcuuaaccugugcauucgacuuguguagcuccaccuugagucuccgaggagaauagguccccauccccucuaccacacuucccauguagggugacuaccaucagaaccuggaaggaccauaagaaaugacccuaaaucuauuucauuggguagagcaaguacaaaacgcaacagacaugagauggccuaucuuugguuuaauaguucuauuagaagguuugugucuucucuuuaugaguuauaaacccuuugucacaugcuauaaaucuucuuagcagaaggguugaggugugucuggugguagaauauuuaucuagcauacaaaaggcaguaguuugaucccagcacugaaaaaacuucucagcauaccauucuuuucuucuuuguuuggcauguacaagauggacuuuucaaaucuacuugugguuucugucuuugauaguguaaaggccuuccauucuccucgguuguauucauauuuuuaaaagaugagugcacaaggcauauacuaauuugauacauauuuacuaaccauuauacuuuguugcuuaaauuguuuuuuauauacauagauauuuugccuauauuucuguuuaucacauggguacagugccuaugaaggcuagaauagggguaucauguccccuggaacuggagauacaguuguuaacugcuaugcgggugaugagaaucaaauccagguccuuugggagagcagccagugcucuuaccuggugagccaucucucaaccccuaauuuguugcuucgacaguugggauguagcucaguuguauuguacuuuguuagcauucacaaugcccugggguuccaugcccagaaucgaugaugaugauaaugaugauggugguggugguggugguggugguauguugcuuuauuuuuaaaauaaguaauaaguugacaauuauaaggcucauucaaaggaacaugcacucuuucuccuacccuuguccccagccaucuaguccuucuucauauaagcaaccaguuuuauucauuucaugaacauuuuuuaauuuauuuucuauuuuauguguauugauguuuucccuguauguaugucugggugagguugucagaucuuggaguuacagacaguugugagcugccaugugggugcugggaauugaacucagguccucuguaagagcauucagugcucuuuaccacugagccaucucuccagccccucagagacacuuuauacaugaacaguucaugucucuccauauuuuuaacccagugguagccugcuagucagagucuaugguucuuguguucuuuccucuguuguaucuuaagaucuucccaugcaaaauacacacagaacugcauagccaacuucugaaacuucacacuguuguacuauguacacuuuccaaauugauuuuacugguuccugaugaugguucuucaacuguuucaaacuuuugcuaauaaauauguauauacaaauguuuacccauuaagaaauuccuugaagcuaggcagcagugacucaugccuuuaaugccagcauucaggaagcagaggcagaaagaucucuauguguugaagaccagcuuagucuauagaacgaguuccaggacagccagagcuacauagagaaauccuguuuccaaaaaaaaaaaaaucuugaagugaaauuaagucaaaguacguaugugcugacaccuuuaaaugcauuuuguuaaguuucucauuuuaaaagcaaagcgagauagauucgucuguaugugcguguaauuccagcacucaagaggaaggaagaugaagaguccagaggcuggaaagaugguucaaugguggagagcacuggccucugcucuuucagaggaccuggguuugauucccaguacccacguggcagcuaacgacuauuuguagcuccaguuugaggagauuugauuccgucuucugaaguccuuagacaccaaauauauggugcgcauaucuucaugcaaacuaucguauacaaaaaaaaauaaaauaaauuauuuuaaaaugaaggaauacaaggcgcagucugggcaauugagaaacauucugucucaaacaaaacaaagacucaucuuguauuucuaucaguaacuuacuuaucaggguuccuguuucuuuacacccuuaucaaaucauugggauauuaaagguuuguuguguguguguuuuaaucugauaagcagaaaauuucaucuuuuauuuauccuuacagcauuccauaaaaugucauuuucccccuaucugaucuauuucacagaugauaacugguacagaaaagacaagcaacugguagccacaucccugugaacggccaaggucagguacccaauacucucucuauagagugccguuccucagagaacuuauggaacucaagcauccccugguuuuuuaugauauauauauauauauaaaaaaaagcacaaaagcuuucugacaucugcuaagaggccuccucuuuaguggucuaauaccaagaccacauuucucuaucaauucuccugagagcaccccucuggaaggagagggcucugauuacuaaucugaucugaccucguccugagcauucgcuuggguucaaucuuugggaaacaguagggugguguuguuuuuaauuucccugggacuuauuucacccaggaucucaguauugaucaacaugaugagggugggaguauguuuccccuagguuugagcuuuauagagagaauuuacuugaacuuggagaagauaacuguagcuugagugcucacaaacacacacacacacacacacacacacacacacacacaccucaugaugaaccuaugagguagauaucuuuauugacuguuucauugaugaaaguuaaguucagaaagauuaagugaaucacucagggucuugcagugcaucagccgcaacaugggaagcgcaauguagaccugaauugagcauacuagaugaccuuccagccucuuccuccuccucuauucauuguagcuaauggcuugacucccacucuggcccuggaaacagaaagccagggaguuugcccaugcagcuuaucauuaaguccuugauacccaaccucuuacaugcuucuucuucucagccuugcuccuuucuccaguuagauacagugcucccaauaguuagcuuuccagucagauaaugaaccucuugucccauauuaagaccugguucaacagcuacuccccacaggagagguccagacccuucuauggguaccuuguagacacacucuugccagccauccugcccuacuacaaccauuguucuuucuccccccccaccccccggcccccuuuuuuuuuucuugcacaauuugcuuucccugcuuaggauguuccuucuuccuugaccugcaaagcucuuaacucuucagaaaaccaaaaucaccugaguagcugguuggacaccacaaugugguugagggcauuuuccuuuauuccggggacccugugagcaaaccuaucagguugguuuuaggaggcucucuuucccucaguagauugaagggcaccuccuguaaguuaccuagccuuguaucuaucccaaggcaggaugcaguguacacaggaacugcucagugguuuggcagaucaagagggcaggacaaacuguaacaaaagaagcaagguuagcgguuuuguuuuguuuuguuuuguuuuguuuuguuuuguuuuguugcucagcgaguugggguauuguguucaaaugccucaugguaggucugucugaaacaaaaugguaguaggacuuuuuuuuuuccaaaauaaguuaauuuccacccaaaauaaugacgacaaggaagacugagggaaggaaggacauucuagaacuuugaugaaggcugaguaaugcagcuuacauaacugaagaagcauuucagccagagaaaagggcacaaaggggaccaggccaaagcuuuuguaauuuacagagagcauuugucacuccggaagugguauaggaguguguuaccaccuacucgacccaaaacggaccuggugcaaacaacuccaagguucgugacugucuguagaaauuuccagucuuugcuuuguaugucuagaugaacuuuccaaaaagcugaaguaaaauacuuacuggucuugcugcugcauuagacaggaaagauguugugagugaugugaugaauauauacauacuuuuauuguaacuuuaaagggaauucaaguuuacuccaaguucaguggccgcuuugaccuacuuacucccacgcagagaggccugcaggcagacuuggggucaauaagaaaccuugauucauugggacuguucuugcccugccuucagaaagaguuucccuuucuagaaauagagcggcuugugugagugucacugggauaggagggagaaugccgggucacaaugggucgggggacagcguggguguagauuugcuaugaaguucgagguccgugcuggagggcugcgguuagagcugagaaguaagcaguggcccucccuucggugccgcacagagauguccaccgaccuuccccuccugcgugccuggagcgcuauccugggcagccgcaggacugugugucgcccccucccucagcgcucacccggagcgcccgcgucuccuucgcuugcgguuucuggucggcucccagcuggcccagacuugcucuaaaguaggaggaaccgcugucgagcgaaaagugcacaccgggugauugaugaacucuuaauaggacuaaccuuucccgccccccaccccagacacacacacacagaggaaccccacuccccaucccgccuccagggcgggcgcagaggacgcggccgccagccgguagggugauuaacucaccguuugucuuucucgaagaguuccagguggacgcgggaacaccggcgagcgacggcagccgggucagcgcgcgucguguggccggccgcgcggaccaagccggcuuugugccgagcguccgaccucccgggcaggcggccgcuauuguucccgcgggcggccggaguucugagacuggaaaacacaccagccuccugcuuacagugacccuaagguccggggaccgaauagggguuuccuuuguguucugccagccugggauggcgucggcucuacucuaaggaauggcagacaggagugagggacacggggaccaacuccccagagcaauccuccugugacccacuuuccugcguggcacagagaagaagguggggagggcuaggguauuugcaggccaaggaagugaacaauagagccauuaaagggucuuccagucuccuuucuuuaagaaagggccuugucugcuuuaagucucugccccucugguccaucaucuauguaucuguacaaaaagcucuccgugaauccugacuuauaccgcgaucugcuuuuccucugguucucuuuaauguuaauccccacucuggcaauuuuuccaaaccuuauugaaaaaugagccagacuagccagaguaaccaaucgaguguuuuugucacaggcuguggguguagcuuagugguagcguguagauuugccauccgccauauuuaccaucaguccaacuuccagguugcuuuuaaaaagugguuaucauaagaugaagaccaugaagacacaugcaauggccuccacccccacagaccugaugggauggcgugguggcauuuauauuucucugcuauggcaaaagauuuggcauccuugggccuugagccuccugccagucuguucaguuuggacacacuggacaugaccuaaaauggauugucuuugaacuuugcaacuagacaggcaggaugugagaccugagggaaauguuuaaggaagggcuucagaucagguuuauaaauccacuugacacugaccuuggaccccaaagguaagagcauuuguaguggaguagaaaacaagguaagcuaugguccucuccaucacuuuccuucagcaccaacaaagcaggaagggcagaggauucauccaucaggccuugugcuauccauccagacuuucugagagagaaaucuacaagagccagcccuuaaaaguguggcuuagguaagguuagauaaggcuuggcuagggacaacucagacucaguugguuaaguggcucaacacccaaaggucuguugacccagguucuaaauauacccuaucugggaaauugcaaagcccaagggggugaggggacggucugagccaccugccuuucuugcauacucauaaaccucuguuauuuucuuuaaguuucucaaagaaggaccaaaguuuugucaagaacacccagaugaagaccuuccuagaccuguaaacugggauuaccaaguucuugacuucacaaggaaguuucaaccaauucugguaaagucaaaacagaccugugacaaucccuggguguaaacaagcuuguacccgccauggggucaaauacuuggaaggaagaguuagccucuuuguuauucaaacucucucucucuccucucucucucucucucucucucucucucucucucucucucucucucucucucauguucuccucuuuaccuucucuaaaggaaaaccgucugggcuuccaagccugguggcugaggagagcacuucacucaugaaccauuggagugguacccagugagggagaaaggacaguagcuagcuagcguaggagaucacugcuaguaguucuucuagacagaaaugugaaaacucuuguucagcaagguuagcagccucuggggccucagaaaccaauguagcugacacaucucugauagggacuggacuuggggcugaaccaagggaaguacaagcucaguauccucuuccucucucccauuugaaagccuguacacagaaaugguacaaauggaugcuuaacuuaaugauucuaucagaggcagauuuuucucugucaguucccuggaugagguuggucuguaagcuagaaggcagaaucuguacuugauuucccuuucuccuuuccuuuccuuuccuuuccuuuccuuuccuuuccuuuccuuuccuuuccuaaccuccuuaccaguggccagggccacccuccagggcuuuccaugacaacuucgcacccucucgcuaggucuaggcauuccacuccagaauggaccccgagguuuacagggaugcuaaggaaacggucccucuuccuccacucccaccuccauuuugcagcagggccauaccucugccugaccgccauccuacguuaauccacauuuguuugccuagauggaacaaccagagaggcccaaaugacugccacccaugagccaaggaccugaucucuuuccuuuagaccuaauacucuaccggagauccacaaccuuccuaauccccacccccuccucgucccgcccccgcgccucaaaaacuauggagaaaaagaaggugugcccaaggcuggaccgaagucauccugccccuucuucaaaagagagacaccucccaaggccaacgcccuccggaggggcccaggugcuccucccuucuggcaucuauuccgucuggcaucuauuccgucuggcaucuauuccucugcaaaggaucagaaaggaagccgcuggcucaauggauucuggauuucggguagaccugacugcuuuggggcauccucaaucgggcggugaagccucugggggcagaggagcgucgugggagaggagcgucgugggagaaagacaagcuaggcugcugcuucccuacccaugccaacuucccgggucucgucuugaaacaagagcagaggccugagacccgggcgccauugcuggccaggcuccccucccccacacuccuuucuuugcuucucgaagacccgggagggaggaggcggcgagcgccucgguggauagagcugcuauugugaccuucccgggcuaagcggggaacccagcggaguguguacugcccgcgguggcgggggaggaggugacugugugcaagccucgagugcagaggggguggcacccgggaauaaauaaaggcuugcaaccucgggcac

SEQ ID NO: 862 - RNA, 1063 nt, Mus musculus
ucuucucugugccacgcaggaaagugggucacaggaggauugcucuggggaguugguccccgugucccucacuccugucugccauuccuuagaguagagccgacgccaucccaggcuggcagaacacaaaggaaaccccuauucgguccccggaccuuagggucacuguaagcaggaggcugguguguuuuccagucucagaacuccggccgcccgcgggaacaauagcggccgccugcccgggaggucggacgcucggcacaaagccggcuugguccgcgcggccggccacacgacgcgcgcugacccggcugccgucgcucgccgguguucccgcguccaccuggaacucuucgagaaagacaaacggugaguuaaucacccuaccggcuggcggccgcguccucugcgcccgcccuggaggcgggauggggagugggguuccucugugugugugugucugggguggggggcgggaaagguuaguccuauuaagaguucaucaaucacccggugugcacuuuucgcucgacagcgguuccuccuacuuuagagcaagucugggccagcugggagccgaccagaaaccgcaagcgaaggagacgcgggcgcuccgggugagcgcugagggagggggcgacacacaguccugcggcugcccaggauagcgcuccaggcacgcaggaggggaaggucgguggacaucucugugcggcaccgaagggagggccacugcuuacuucucagcucuaaccgcagcccuccagcacggaccucgaacuucauagcaaaucuacacccacgcugucccccgacccauugugacccggcauucucccuccuaucccagugacacucacacaagccgcucuauuucuagaaagggaaacucuuucugaaggcagggcaagaacagucccaaugaaucaagguuucuuauugaccccaagucugccugcaggccucucugcgugggaguaaguaggucaaagcggccacugaacuuggaguaaacuugaauucccuuuaaaguuacaauaaaaguauguauauauucaucaca

SEQ ID NO: 863 - RNA, 878 nt, Mus musculus
ugacacauuuucuuuuuuuuuuuuuuuuuuuuuuuuuuuuuuuuaaagauucaaggucauuauuuauuuguugcucuuaaagacucauuuuugacuggacucagacuuagaaguagaagcucucagugaggacagccuacgucucuuggcaaucuguuccuggcgcuuuucuuuggcuuccuucauucucuuggccaaaaguuuagcguauucugcagccuccuccuuguucuucuuagugcguugcuucuucagagcaauacgucggcguuuguguugcaggacacgaggaguaacaagucgcugaaucuugggugcuuugguccugggcuucuuaccuucuuuguuuaagggcuuccugacaacauacuggcggacaucaucuucuuuggagagauuaaaaagcuugcggauucuacuagcccuuuuaggucccaaccgacgaggcacaguagugucugucaguccaggaauauccuucucuccuuucuuuacaaugaccaaguugagaacacugagauuagcguccacaaugcauccacgaacagacuugcgcuuccucucuccaguucuccuuggccuguaacaggaaugccccuuacucaacagcaggcgcacucugccaugggucagaacaccuugcuucaugggaaaaccuugcuugucauucccaccgcugauccggaccacauaacccuuccacucuucaccaagagcaucagcggcuacuuccguggccaugcgcuucucauagaaggugcggagcuugcgcucgucauccaccucgaugagcuucugacagccgguggcggggaaggagauguucagcuucaucuugacacagccgagcgccugggaggcgucacccacauuuucua

SEQ ID NO: 864 - RNA, 593 nt, Mus musculus
aagagaucggccgccgcagccaucuuccaguaauucgccaaaaugacgaacacaaagggaaagaggagaggcacccgguacauguucucuaggccuuuuaggaaacauggcguuguuccuuuagccacauacaugcgaaucuacaagaagggugauauuguagacaucaagggaaugggcacuguucaaaaaggaaugccccauaagugcuaccacggcaaaaccggaagagucuacaaugucacccagcaugccgugggcaucauugucaacaagcagguuaagggcaauauucuggccaagaggaucaauguacagauugagcacaucaagcacucaaagagcagagacagcuuccugaagcgggugaaggagaacaaccagaagaaaaaggaagccaaagagaagggcaccugggugcagcugaagcgccagccugugccacccagagaagcacacuuugugaggacuaacggaaaagagccugagcuguuggagcccauuccauacgaauucauggccuaauguacacaaagaaauaaaauaccagcaccaggaaaaaaaaaaaagagauuaagagaaaacagaggagu

SEQ ID NO: 865 - RNA, 29153 nt, Mus musculus
guaguuuaagucaugauauucuuuuauuagugcuagcuccuuuuaauuuuuaugagcuaaacaauuuaauauaaaaaugucauuuccuguucauacaguauauaaaaaaguauaguggucugguuaguuuucaauaguuugcuuuuagccagaugucauauaagucuaugacuguaacaagugagaacaguauaaauaaguucuguaguauuuacacuuaaacagaaacucucccaaauggugccuaagaaauuaacuugagaguuaaaaugaaacugauucaacauugagacuuuaaugcuuuguaaaguuucauauuauugcuauacuagcuuuggcuauaauucugcauaguuacuuauaaaguguuucugcauuucacaucacaguaggaaguuuuagcaguacaaaacaaacacuagcucagaaaaggcuccauccucccgaaccuaguuuuucuuuguaucuggcuucuugcuuuugggaacaaggaacacauugccaucucugguuugcugcagagaguauucacugggagaguaaggcuuuccauccucaucacguaacaugcugaagacuucaagauacaaggugcugagccgccuuuucaguagauggagguuucugucguuuucucccuuuucucugaguaguuuuucucucucgucuuuuaaguggcccaagucuugcuccagcucgacaauguucuccagcuuccuuuuccuacaguucugggcggcgacuuuauucuuaccucuccugcguauaucucggaucaaugcgagcugagcuucauugaauugcuccuuggacaucauuucauugaagucaucaacagggagguuaaugauuuuuucgacagggaauggaauauggagagcuuuugcccuaagcucaucucgugugagaugagccucuaagcggcuugaauguuugucuuuugugaauggggcuuuuugaugaccaggacucacgggaacuucuuuuuuuguuguauuuucacauugggauucacgcauaggagcacugugcccuugagcuggugacagaggcuguacugugucuccaggagaaugugcuggcugugcuuuagggccguucuguuugacacuuccaggggcacuaucuagcuccuccauuuccgagucacugaacccaggcggugggucuccguaaauggaagacuccacggagugcucuggggacgcucggcugggacucguguucagugaaaugccagagucagagucauugaauuccauugugccuucagcgugcuucggguugaaagcuuuacacagugacaggucacagccuucaauagucccguccaggaguucagagagugacugacugauggcagcggaggaaggcaugcugccaccgucacugggcucugcuaugaaagcagaauaaaauucaucgccaaaaucuguguuuaaggugggauuugagucuaaggaggucagcuggcuggcaucaucaguggagaggaugcugcugaaagaauccucaaaaccaugaaggaaauguggaccacaguugcccacuucuuuuuccagcgaggagaucgaugaguaaaaaugguaauugcuguccauuucugucaguguggcuucugggcugggaacagcgguaguaucagccagcugcuuguuuucgguauuaagacacuaggaaagaaggucacauuguaugagcagaggcuaagugcauuuuagaucaauucccuacccccaaauccaagguguucuuuucaauaauuccuucaacucccauuuuucaauagauaaguauuuuaucuuugucagaacucuaaauuagcuuucagucuuugaaugaauuuauccagaaauauucagucugauuaccuaaaaacuauguguguuaagugagucugggaagcucucaugaguaauuuaaaugcaccaucaauuucuuccuuugaggagguagcauguaaauaauaaauaacuaggaugacuaauuuaaaagggcccgcagaaaacagcacacuccuagagcucucuuaccuguaauucgggaauggaaaauagcuccugccaaacuugcuccauguccugcucuaugcugcuuaaaucagucauggcugccuccagagagcuauugagggacugggccugaugaggggcagugaagacugaacuuucagcguggcuggggauauccagggcaagcgacugaaaugcaagugaagaaagccaagauugacgugacauugauucaugugagugagaaccaaggcaugaagaacagacagcagcagggccuacagcucucaggcugcuuuuauaaaaugaaacauuuccuccucccagugacuccauauuaauacacuccuagguuauuucacuccauguauuuaaaggcagacuucaaaauggauaaaaacauucauuaggacuuaaucuguacccauaauaucuagcagaaugcuucaaacaacagauuaagauuuuuuuaauccaaaugcugauuaauaguuguucuuuacuagucaaaauauuuuauauaccuauauccaguuuccagggaaaauuauucugauuccuguuuccagcuauacaguaaaauggacuuguaguuuacaggccuuauuuuuuuuuuuuuaaagauuuauuuauuuauuauauguaaguacacuguagcugucuucagacacuccagaagagggagucagaucuuguuauggauguugugagccaccuugugguugcugggauuugaacucuggaccuucggaagagcagucggguacucuuaccaacugagccaucucaccagcccauacaggucuuauuuuuaagcauuguauagcucucauacaguuuacuugacaauuucuuugaucaauuuuuuccuucuaaaauuuucuuuucuucucuuaauuggagacacaugaaaggaacuaauaucagauaagggaguuuugcuguuaaacaaacauuuuuauaccucauggucaucuacaaaugggaaugucucugccaaaagcugcauacagucuucaaaguacaaggcaucuuguuugggaaugugggcaaccuggaggaaggggaaaggcacagagagcaucauuuaugaaauguucuaagcacagggucacaacgagcaauaagacuuguucauaaaauaaccuaugguuucauuucagaaaucgauuugcauagauucaaaccagauuguguucaaauuauuagucccuccccuuuaacgaacagcgcugggggacugaacccagggcucugugcuaggcaauaaccucccuucauuucuuucugaguguucugggcgaaugcuuuaguuguuuagacaugggaauauaaaaugggaaucauacuuaacacaguuaagucaguuacccauacaaucagggcccugccuaccacaaugagcaaugccuacuucuuuuacucccaacaguauuucugcugcuguuucaucaccacagaggauguuucuguaacucacaaaguccucccugugaucuguguccugauuaucaagaagcgaaguuugagaacuucuccuccucacaaaagacacaguaaauggcagaccaagaacucaacuccagagagucugcuuucucacuagaguuuuccuuagcucccaccacgacgaguguaccugggaguagcuggcggauccacuggugucugucuggaugugcugggccggcugaauugggaggaauucuccuguuucuucauccaguugaaacugagcaaaaaaggccuucuccuguuccuucuggaguugcucuugucuuuccuuuucgaguuuuuucuguuuuuccagcucauaguccuucugucgcugacuaaagucaaacacuucucgacuuacuccaagaucuaugucuugccuccaaaggaugucaaucaaauccauguccuauguuuaaaacagaaaaggaaggagaagccaugguuaagaugguccacacggguuaguucacuacauguuaucacugauggggaagaacacaaacaaacugaaugagaauacagaagacugucaauuccauucacucaauauauauucgcuaaaagcaacaagaucuagcuacccauucgaauuaguuuggaucacugaugacugcaaaacaacagaaauagcuaaacuuaugcauauugccauacuuuuaagacucccacaccuucccccccccuuuuaagauuuauuuauuauguauacaguggucugccuacaggcaagaagaaggcaucagaucucacuauagaugguuauaagccaccaugugguugcugggaauugaacucaggaccucuggaagagaagucagugcucuuaacugcugagccaccucuccagcgcaccccccccccccgccccuuuagaagagaggauagcaaaugcacugagacacucaugucugccaugaacccugucucaauaaacagacauccgcaaauaaaaaacaauauucgggggguuugcuuuguuuuaguugagacaggguuucucuguguagcccuggcuguccuagaacuugcucugcagaccaggaugccuucaaacucagagaacuaccugccucugccaggauuaaaggcaugcgccaccacugcccaggcacguuuuuguuuuuugaaaugggaucauguagcgcaagcuggccuugaaccacuaaccacccucuuccuugaacuacuaaugcuccugcgcugcuaaccaagggcuggggugugccaccacuaacaccgagcuuccagcuauagcuauguacuaacaaggaguaaaacaaagucugcuggacuucucagccaaaggacgggaugacaauuucuaauggaacuuacccuaaaaucaucagugucaaacaugcuaagaguugauuuuaacacaauuauuuuuucuuguucccaccaaaugauaaugcuucaaaacuucagaaguguucauuauucuuuccugccccagcauacagaugguuaccaaaggagacaaauuucuucacaaauauaaaauaagccagaguuagcaaauguucacugaugggagaccugcuguaagcaccaaacuccacgccaaugcauuuguaacaaauggaacaguggugggcuguaacacugagacuagcugaauauuacucccaaaucauggauggugucacaaugaagcuucuagguccuccucugaaacaugcuaacauguacuuuuguugucuuuguucuuguuuuuugaaacaggguuucucuguguagcccuggcuguccugacacucacucugcagaccaggcuggccuugaacucagaaauccgccugccucugccucccaagugcugggauuaaaggcgugcgccaccacugcucugcuugucuuuguauuuuaagggaguugagacauccauaaauuagagcauggaguuuaggugguagcugaaauguggagagcggugagcaccuccuugugcuguauauuagucacaggcccauucagucaccaacaguuuccuaggaugacuuucccucaaugcacauccuaaaccaucccagucugucuuuguuuuucguuuccuguaacaugaucagaaaagaacaccuugggggauccuuaucaaggcccaggaaggcucagcucaccuggaacagcucugagcuaaaacuguggcccccacagccuagcaugcauuuccagcaggaaggucaccaagagguuuuuacacuuaauuguucauggguugcuggucacaaacuuauuaugugccaaaaagauagccuugacuccuaucuucuugccugcaucuccccagugcugggauuacaggcauaugccacccauaccuggcugucaucuaauuguuccagugggccagggacauccagugugaucccugucuggcacccacacaggcuucauagaguccgggaaguucucugcacuuucagagcugugcuauaaagcgugcaaaagaaaaagaaaacugcuuuuuaaaaccuagcuggugaaagguucagcagugaagaccaugcacugcccggaggaccuggcacccacgugacgcugcucacaacugccuggaacuccagcucuaggaaaucugacaccucuagcuucuacacacacacacacacacacacacacacacacacacacacacacacacacacacacacacacacgauuaaccuuauaaguuuuaaaaaguaaaaacaagccgauuuuaagcaacuuuuauacuuuggauuccuaaacagcacacaucuuccuaucagaguacaagccagcgcugauccugcuuagcaucaaauagcaccagcccauguucagagugaucuggucauaggucugaauucagacauucuuaucugaaugcagcaacagugaguuucuuccugugcccaacacauuuugcuguuuuagauuuccacacaaguuucagaaggaaaaugucugaaauuugauuuuuucccucuuuuuuuuuuuuaagauuuaucuauuuauuuuauguguaugaguacacuguagcuguacaggugguugugagccuucaugugguuguugggaauugaauuuuuaggaccucugcucacuccggccaaccccgcucgcucagucccuguuugcucuggcccaagauuuauuuauuauuauacagaaguacacugucgcugucuucagauguaccaaaagagggcgucagaucucauuauggguggcugugagucacuaugugguugcugggauuugaacuuaggaacuucagaagagcagucagugcucuuacugagccaucuugccagcccaagagcauggcacacuuuaucuuuuguaauuuuuucuucagaggugaugaccaaacccagggccuugcacuugcuucccccaccucucccccgccuuuuuuuuuuuuuuuuaaagauuuuuaaauuuacuuuauguauaugaguacaccauuguucucuucagacacaccagaagguggcaucagaccccguuacagaugguugugaaccaccuugugguugcugggaauugaacacaggaccucuggaagagcaggcagugcucuuaacugcuaagccaccucuccagcccccuuuuuucccucuuuuuuuuuuuuguuuuuuuaaaaauucaugucauguaugaguacacuguaguugucuucagacacaccagaagaaggcaucagaucccauuguagaugguugugagccaccauguugcugggaauugaacucaggaccucuggaagagcagccagugcucuuaaccucugagccaucucuccagccccccuuuucccaccucuuaagacaaaauuucauacugaagcccaagauggauucgagcucacagcaauccuccugccccagcuuuccaaagcuuggauuacaagugugugucacaaugaccuagcuucagagacuggaugagacuguaugaaacagucaaagcauuacccugggaagaaauacuguacacaagucuguuaacccaaagcacugccugggaggcccacagcacaagugcuauuuucugcaaugaacaaagcacucagcauuuccuguaaggaaccccgugacuggcgcaugacuuacaccacaaagaccuauccccgaaccacugcuuugugaaaccugaacagcaucucagaggaaaugcuaggguggagccccuaacaagcaagaacaagacagcagacagcggggaagagaagcaucuaaggaggacuaacacugcucuugccaaaguucugaaaagcagcuagcuguccgacccugaccgugugggucucccaggagggaaggccacauaaacagucugggggacggggggacgacgacccgaaagcagacaacagcuagcacagcacuccaacagauauuuucuuagacuggaaaaagcugcccaaggguagguaaccuaagugccagggugagccucgugguguacggggcaaaugcugccugccacuuacggauuccugagugugcuccaaguuccacuacaaacuuagcuuacgcaagagacagaaggaagcagaauguuggacaauucauguucuaccaccaucugcuccaacaaaaaguuagauucaaaauguguaauaauuauuugcugucuggguaauccaucacaggccucguggaaggguacaguuugacaacaaagucagggcauuuugaaauaaacaucucugcacaaggauaaacagagaccuugaacacugaagccauauuauauuucaagccagucuuugaacaaacauuuagcaaaagauuuuaaaaugauucccacccuacaauaaaguucuucaguaaacugagaccuuggcauauuauugaaauuaaaaauuguaucuuuuuuuuuuuuuuuuuuuuuuugguuuuuuuucgagacaggguuucucuguauagaccuggcuguccuggaccucacuuuguagaccaggcuggccucgaacucagaaauccaccugccucugacucccgagugcugggauuaaaggcgugcgccaccacgcccggcaaaauuguaucuuaaaguacggauuuuuauuacuuuuuauuggggugguagcaggaggggugggaaccagacacaugugccacagaguauaaauagaggucagagggcagccugcaggagcuguuucucucccucuaccaugugugucucaggcacuaaggccaucaucagguugggagcaggcaccuuuacccacuaugccaucuuucaacuaccacaaaaacaguagcucaacaagccgcuaacaauaagaaacuguacuugucauuuagcacagaauaaaaugggucuuuacuccuaacucuauaggaaagcuuguucuccccccacccccuuuuauuagggaucucacuauggaggucaggcugaccucagaugcauccuccuccuccucacucaagcucccaaaugcugggguugcauaagguguacgcacaccccaaauacccaccuuaguuuacccuuugcuucucggcauucucuucuucaugcacacauucguuacuagaacaucgagagugaagaacacuuggcuacagugcccauccuauaucuccuaugaugcccagcugaauauauauuauucaccuagaaaguaaaccugguuuagcuccccugucaacagacaaugccuaaguauuuuugaauaaaaccagauagaaaacaagacucauguucuacagucugaaagucacccaggggagggcuggcagcgucugugagugcacugaaggaaugcccaaaccuuaacaguugaauaaccagcugcauaauuaaccuucauuuacaaagcccuacucuguggucuuacugccuaauaaauaaacacuuuauuuauuaauaccugcaguauuacuuguaguaauaaaugacuccaggcagaugugucuuuuaaaucuaucuuacuuaugacuguugcauuucuaaauauuugcccauuuacuucucgaagguuccugucccacacugcauuacaugguagacaauauaaugccaucugcuuuucaacaaagacuccaaaggcagaagacaggccuauggcucacuguagucagccccacaccaaguucuuuugguuuucacggauuaauuuucuaauucuuucugcuacuacuaugaaauaggugauuaaaauauacggaauaauuaaaauacagaauaguguagggucacagagggccuuacagucaucuaaaucagguacacuauugcuguuuauguguguuaccucagcaauauuagaaagaccuaguuaaacaacucauauauacuuggcagacuauuaauacucaacaccagccaacccaaguuuuccuccuacagaaauccuaucucaauaaucaacaacuagagauuuucaccacauaaaaauuucugaauucguaccaaauacaaaucacucagcaagguuaaagccccggucacgaaagcaccacuccagaggccuggagacauccuccacuuggucugagcuagaaagugucugcuuccucagccuggcaggcuacauuaccaugcacagaaacguccaugggcugcuuccuguucucaagcaagguucuuaggaaugacucacucaaucuaagaaauaggacccggccagcuuacuggaacucucacccauuacgcagcccauaaccugcaacaugaugcaagacuacgcaaagcuggaaagugaaggcagucagaagcccgacuuucuccagaggcauagcuguucuguggucaaaaugaaaucaccaaggacauucacuuuucaaacccuggguaaccccaccuaccugguggagaaaccaccaagcucugacuucuccacaaguuucacacuuggcuuucaagaguuacaaucuggcugugcuggugcaggguggcccuuacucugucaggagaacagcaauccuuaggauacaguugcuggacucugcccauucugagugagcaagccacacagagaaagcacuugaugaacacacuucaguuacuguuagaacacacacacaucauuaccaaaagaaccuucaggaacacugcuuccaucuuccucaucuacuucaccugaggggaaacaaaucaggagaccaggcaggcaacuccgcgccuugcugccuccacccuugaccucucugaugggucagcugaaggagggaggccucgaaucagagacucuucacagaaacugcugauauuucucaaugcuucaagcuccuuuauccauuuucaggguuccccaaacuaaauuauuuaauacucauggucacuuuuggaucuaaccaauuaacaauuaaguaaacauagcaacaaucaagagcauccaccuaggccugagagauagggaagaacugugcagucagacaaagacccuggcucuugaggcauggcuaugcugcuaucaguggugcggaggaauuuuauauaugaauuuaauguacugaauuauauuuagaccacagagaacacuuuaaaaaagccuuuuuaaugagccccggacacuuuuaggguacuuuccaaagggucugcuaacuuuuuaaaacugugaacuuuuuaaaaguaugauucccaccccacccaaaacaaggcuuuuuaguguaacccugguuguccuugaacuugcgagauccaccugccugugccuccugagugcuggaauuaaaagugugugacaccacccagcaaguaugauuggggggauggggggguccuguaaaauauaaggaaaaccucacaaauuuucacauugucucuguacaaaggcaugcuaaccucugugucaguccaauuuuccugcaccugccacaaaggcagcaagagcaagcaauauuucuuaaaaguaauaugcacuaauggcuaaaacucuuaccaaaaagugguaguaacacaagugguagucaagaacagcaagauuaguguacagacuaagugggucauuaguuuaucuaccacugaacaauacauucacacaggucacaggaacagugaggugccaguaacgcaagggcuguuuguuaggagacaugaggagcagcauuaaggaccucuggcagcacagagaaaagccacuaaguaggcagagacacaacagaaguaguaacugccacuucgcacaacagucacgaccaugaacauaaacaagggcuaagucuggacucccaaggccugacucagugaguauuugaaagcaacaggugucaggcacacaccuguaaucacaggacucaggcagcuggagcaagaacaguucugaguucaaggucaacacgaaccagggcaagaaugucucaaaacagaaaacaaggcaguaagagcauauaaagucaacccagcugcaaccuuguguucuuggucuuucugcgugacaguggcaauauuuucucucguucucaacugcgagcaucccccuuccccgcaaaguuccaguucuccagcucaagggaaacucucacccccagagcuuuccuuccuccuuacaucuggaccuuuugguacaugugacucggaucacaugggaacacaugggaccgcacagucauggaauaccacuacagagagggcugucggaaucaccuagacaguccucugcuuuugcaaaggugagauaacugcccagcagcagagggcaaagaacuguaaaacuaccucuagucuacuucucuauugguucuuuguuguuguuguuguuaccaugcuggcagaggaaaaaggauguaccucuauuucacuauuccuuuucaaggggcuccccacccucagccccccagacgagguuucuuuaauguccuggaacucaguccguagacuagauuggccuuuaguagacuagauccaccuuucucugccucucgaguacugggagcccccacaccuaaugugcuuuuaugcuuuuuaaaaacuucauguuuuugugugugggugcauaugccaacacaugggaguagaggccagaggaaggugucuucaucaccaggucuuacggcuuuaagucagggucccuucuugaaucuggaguucaugguuuuuggucaggcuagcaucagugagcuccaauaauccucccucaagacucuggggcuacagucaugcacgagaccgugccaguuuguuaugugaaugcuggauuccaagcucagguccucauaauugugcagcaaucgcuccuaaucacugagccauccuuccagcccccagguucacgguuuauaggagaauggagagauggcucagcaguuaagaguacucacuguuuuuccagaaauccagguuuguuuuaaauuuaguuuauuuauguaugaguguucugugugcguauaugugcaugccaggcgagggccucagauuccacuacagaugguugugagccaccaugugguugcugggaacugggcucagaaccucuaaaagaagagacagcauucuuaacuucugagccaucucuccagugugaauaaacucucuggagucuaugcccaccaaugcucuagccaagcuccuguucagcugccugcacauccacagggauaaaauccagaggauguaguguacaaagggaagaguaggugaaugaagucuuaucagcagcaacaccccagcacagcaagcacaaccagcaagcacaagcaagccucagacugcugaagacaagcuacagaagacaggagacaaguccagccaggcugacccauccauugguucuuuaaagucuagaaagauguccuuucuaagacugucuguuggucauugacugacacuuagaacagguuguaacugacuguaaagaaagcuaacagugauuugugcgaucacagccaacucuggggcuauaaauuaguaauccaaggcucaaaaugcuaaguggacaaccggugacaggcuuuuugugacugagcagaacacaggagaauacaucuggucaaccaaacacaaauaucagacagacuuucuccuuacaauuucuugaaaccuuuuaaaacuuacuuuacacacauuuuguuuacaugauucaccauguccaugcuugauaugccugcugaggucagcagugggugucauauccucuggcacuggaguuguggaugguuguaagccacugugugggugcuaugacucacacacggauccucuccaagauaacugcuuagccauguuuccagccccuccauuacaguuucuucuacuaagaaaaaucaccaacuuuuauggacuucucugaacaccaacacugacaauacuguugccagguuacuagcacacaccucaccauccugcacucagaaugcaggggcagaaagaaguauugcugguaaauuggaagucagccugagcuacagagcaagacucaguccaaucaaaguaggggaaaagcaaaagcaaaaacaaacaaaaaaccaaguaacaaacccugcuauguggacuuaucugugaagcuaaaauaacagccuguaaaauccuguuauuaaaaacucagcugacaucugacuagucagggccuccagggacccugcacccuuccauagaggcaugcaugcuuucaccaccagaagguuugaauagcaugcuucaggagagccucccagcccucagccccugccacagccuaucuagggccuggccucuaggguaaccugaccacagccugaaacuaguguguacucaaaaaagcccgaauuggacaacacaggccacauacccacuaagagcaacacaaagcugacuguucacccccagcuucccaagacuggggaccugggcaauacccuugucguccuugagaaaggcacuucuugggcacuggcucuaacauucaagugccuagaggucacaaacauucacuugcaucuuuaugucguguaauuccuaugccucugugugacgguuaaugaaagaaagaagacacgagacacacaugggcugugucuacggcucgagcugccuaccuccacgccugagcggguucuggucacgaucucaggucaggccugggaaaucagaacaacacaaaaaggccuaaacuuuuaagugaucucagaacucuaucuaaacacacucagucaaauucuuuuuuuuccuuaaggacacaagcuaugggucugcuuuuaaaguguguugcuguuuucuguuuguuuguuuguuuguuuguuuguuuguuuuuaaaucuauggcuuugaguuagguuauaguagcauccccugcucaaaaccuuuaaaucuagagugcaguaggcagacagguggugcaguaggcagacagguggugcaguaggcagacagguggaucucugaguuugaagccagccuggucuacagagcaaguuccaggacagccaagucuacuuaagagaaacccugucucaaaagcaaaacaagggcuggugagauggcucaguggguaagagcacccgacugcucucccgaaggucaggaguucaaaucccagcaaccacaugguggcucacaaccaucuguaacaagaucugacgcccucuucuggagugucugaagacagcuacaguguacuuacauauaauaaauaaauaaauaaauaaauaaauaaaaaaaagaaaaaaacaaugugucuuuaccugaaaaaaaaaaaaaaaaaaaaaaaaaaaaagcaaaacaaaacaucucuggcuuugggaggaaaagacuaaaaguaggaaaacuaguauggagucuuccaacauggauggccacacacaguaugggaauaugagcauuacuguucgugaaaguguuaucacacugcccaggaaugacacacacagugaacaccuacugaacacacucuuuccacuggucagggacagcagccacauuccuuuccaccugcaaugcugucuuuucuaaggacuaaauuucuauuuguaacaggaaaaagaugacuagguuucaggcccuaccuggaacugggcaccaucgauugauagaaaccuucugccuugcuuucugcaccggaaagagggugggacuggaccggaagaugucuaaaccucuaaguguuucagauuuuaucauguccaaacuacaauugaaaauucauuuuaauguaaaaauacacacuaauuuuagauuacagaaugcucuaaaggaacuucauaagaaauauaaugugaauaacauauguaacugauauuguuugcagcucagacacaauaacaaaaacaacacagugaauuuaauuugaacaacguauuuaauccaauuugguccaauagcauuuuaacauguuaacaguauuguugugauauuaaaggugacagagcacaauaaucuuacccacaagacagcgcacaaugcugcccuacaaaggcaggaccaggagccccgagccuccuccugagcuagaggacuaccuaaggcuuauuaaccagaaaagucguuucugcuguuuauaaaugucaugcucauuaacacuaaagcuccagccucuugguuucugucacucaucacauuuccagacugcaaggugacuaguggcugcggugguggacagcgcagcccugcagcgguccccacuauggcccaugcccuccucggguguccucuaagcaaauguguggcuaacaacuucccgaggcuacaacuguggacauuagcccuuccaaacuacucuagguaucauuagcaauuacuccaaagagcuggugugaaucugaaucacaaagagggcucuuaaugacuaaacucaauaguuuuucauauuauuccauaauagcauaauuuacaaaugagaugauuaccauggcuacuaaacacgucauguaaaagggcucuguguucccaauaaagacauaaauuaacccugagcuuagaaauuauauuucaacuacuuucauauguauauaucugaaagugcaucaugguacucacuauuguugcugacuacuacaaugcaauuugggccuauaaaaaggauuacuagggacuggagagauggcuaaaccagugguuaagagcacucacugcucuuacacagaagcuggaucuguucauggaaccuauauggcaacucacaacugucuguaaucugaugcucucuucuggacucugaaggcaucgaguacauguaugguacacagaaauacauacaggcaaaacacccauauacauaaaaagcagauuaaaaaucuacuauagaguugugugagacacuggucacacuggguuuugagaacggaagguuacaacguggggauggucuaaguccagauaaaguagacacugcacugcaacaagagcagccaccucugaucacacacuuucugcgugcucagaaaccuccuuccaaaacuuguaccgccucgucuggacgcacagcaauccaccaagugggcaaccaucacucuggaguaaggaaauggaagcacaaggaacuuuaguacuuuugccagcaaacacccaacccaucgugacagugagagccacagcaggcacagugacacuguaggacacaggcaucuacuucucagcccccuucuuuggggacgcuguuugaacaacggacagacagcacacuacagcuuagaagccuugggcaacucuguuguaaacuguguaggugacgaugcccacucgcccacccuacccucacaguggauuccaauucaacagaaagccaagacaacaccgguccucccucaaaaugaucuuucauaugaagaaaguguguaagugccucuuuaaaguauaaaggagcaggcugggguguggcagcaacacuauuaauaaaucuaucuccuggagcaaaugucagugacuaugaaagcagugccuuuuucuggguuuagccacugcaugaaaaauagaaggugaggccauaacuuguuugucaccagcaccugcauggcaacaaacaguggcaaacgcaaaagccucucagcugugccauugcgcuuccaggguccccagagguuuuccuucucuucacugcucagcuaacuuuaaaagccaaaguuauuuuggaagagggaguauaaaacaauacuuuaaaaccuugaggggggugggggugaggagaggacaggagaugggcugguuugguuugcauuuggauuuagccuuccuccaaaggcagacacucgccaaacuucucuauccaguuguacugacaggacccuagguuccuaggccggaaucccugaguaagaaauucuugugcaagugaagagacaggucuggaagucguucuauucaauggcuuaucaacccacuuaaugacaaaggguccagcaacggguuggagggcucccaggggaaccuaggcaguguacguggccuuuguuggguugagauucacaaaaggccuagccaggagacuucaguuuccaggcaggcggcauauaauaagggcaggagugugagagaaaggccccacaaaaacaggacuuauggcaaagaacacaacagagcaggaagucugagcucugaugaggcuacaaauggacaaggaauuuuguuuucaaguggccaauggaaaccucacauugcuacacauccaaauccccccagcaugacaacugggggugccacuuguugaauaucugugugcuauuuuacaucacaggccaaaucuacaauaaaacccaggaaaacccacuguaacagucugucuauaaggccucucgcuaggccucaguucuucacugaaaggaagcuccuuccaucacgggugcaauagaauugugcccaaggaaaguauuuuguuaaagcacauagcaccaugcccugugcuggggagagcacaagacacuacagcugaggcuaggauagugucuguuucucauuuucccuuuggugaauaauaauaauuaguaugacuggaagccaaggaagggauugcuacagaccacauacacauugaccucagaagggccaaaagaggcacucccuccaugccauuucagagaagaaaugaaagcauucugaaagcaaaggaccaagucugacuggguuccccugacuuuugucaauggaacugagcauucuggcagaugaguuccuaacagaacaugcaaacacaggcccugugaggccaagcacagcugauuuuguguguagacaaugcuauaauggccagucacacaagcuacuaaggguagguaagagacucccuuuucgaguuuccugagcaacuauuaaacaaaagcaaagcaccuuaagaaucuacauccccgaaggauagacggcauuaaugaaauuacacuaaucaccauauaaaacacauccuguaauucaggagugccaagagccaaaggguuagaguaauuagaaagggcaauuucagaaacucauguccuugaagaacaacugcuccacuaucuccaagauuaaagcaaucuucaugccaugcaaguccggauguagaccucauaaauauuugugaaaugaguauguacacauuauuuagucacagaauccaauauuuucauugguucuuuuggguguuuguuugcuuguuuguuuguuuuugagaggccgagguaaaagaaauacgaacuuuaaugaagacuauuucccuuucguauaagacauccaaacuaaaaauuuggcgaccaucccuuguccagaaagcuuacauacagagugagcuugcaagguuucugugcuggccgcagcugcccgaaagcagaagguaggauuaaaacuaucacaucauagucccacaacacugcucagccaaauuucugcucaguugucuuggugaaaaagaaaaaggggugggguacaauccuguccuagucaaggccagggaguaaaaucccaaaaguuguuuaaaaaaaaaaaguuuggaaaaaucaaugaggugauguauaaauuuaauugauuaucauaauucugugcucaaaagucagcaaugaaaaauaaaaccaggaaaauaaaucuacagcccuaaaauguauacauguuuuuuaaaaaagagagugcaguuccagaccugcaaaugguauuggggauugucuacuacuucagucuuauugccuccacaaaacccacacugacuguacaaggcccaagucagacgcacacacccaucccaaaggagggaggcgggaugggguuacagugagggcuauacuuuggcuguagacuauaacacacaugcaaacaugggaggagcaggcuugagaaauguauacagaccccuuggaggaaaggcauugaggucaggaggcacugagcaacaagacagguccaguccugcccuuccccacuaccaucaggaaggcggcucugggguaauuacucuuuuugguuuuuggagacagguucucucuccauagcccuggcuguccuggaacucacucuguagaccaggcuggccucaaacucagaaaucuaccugccuccgccucccgagugcugggauuaaaggcuugcgccaccacaccuggccaauauuuucauuguuaaucauagguaucugagguuauaccucaaaguacugaaacaacaaaggcacauuucuuucauaugauuuaugaccaaauaccgagcacagaaaaauuauuuagcuccacuccuauaacaauacuuagacauuacugaauauaagaaguaaguauugcauccuaaggauauuagcacacacucuucucaagauaaaaacaucuuuuaggaagaguaggggauguuaccagacauugagccuuaggccuggugcacacuaggcaagugcucucacuauucccaagcuagacuuucagccuuaauucugguuuuuaaaggagaauagggccauaucuugaaauguucacaaagaacucugaucuggaugcuggccgcuuggugcagaccuggaaccccagcguucaggaggaggaggccaugugacugugagcuugaggucauccugggcuucacagagcguucaaggcuaaacugcuaccacagugagucuguuuaaaaagcaaaagucaaacguuugcaaucagggaggcaguaaaagcuaaugaauccgucaaucuaauugcugacuggguguauuuucuucacgacucgagcuguuucccucacaauggucagaaaagauggauuugcacccacaggcugcucuucucuaaagcacuaagcucgucccuaggcaccacaaccuagccagccacgcccagcuuuccaaacucuaaccccauuauucagacuuccuuaagugcaaagaacaagaggagaaacaaauauagcccaguuuuaaacucugccuuccaacacacuagacaagaauaauauuaaaucaucuuuuuagggccaacuccuugcagcuauagauuccuguaucaguguuccagcaaaccaggccacacuguccuuggugggaaaggaucugggcaaguuaugucaaggaaaugugcgggucucuagaacugucuaugcgcucucucccuuugccuccaucccuugagaauaaagguacaagcaguucacuaaggagaugguggguuucccuacaaacaagacaguaaucaucucucaacguucugcagcucugcagccaggagacuuguaugggaagcaagggguggggccuucugguaccgcaggccugcucuggcucuccauggagaagcugggugcagaagcacacaguuccccuuuggcaggaacucucuagcaauacugugaagaguccuucguccuccaacagcuaacaaaagaagacccuuucacuuuuagagaaagacagaaagggugaggaaguaauaagccaggagccagagaguagggaccagggaaauuuguguucccuguucugucacaagcaaagugcuuuacgaacugagccaucuugucaguccuuuuguuaagaguagcagaacauguccagggucugcuacuagcagaacaucaacaacuucaguuucaacuccugcccuagaaauugccagugcagcagugucguuagcccuccaaauccaauaguuuuacauugucgguucaagcaacccucuacugaaagaauucguuaaguuaucuguuacuacguaggcuuuauuacccucuaacgauauaacucuuuaugaagccugcauuagguaguauuggggaguuaaggaugacuuacagaguaaaagcuauguguauuuuacaaggaagauuugaacaucugagggguuuaguacccauagguucuaaaacuacagucccugacacgcugagggacaccagagauuggcuaccuucauagguggagggugaguugguaccagaaaaccaagauugucucuucucucuguuacugucuuuugcagcgcagacccaacacuuuacagccacagccuuaucaagggaacuuuggacacccgaagcacaagacacagaccccuugaacuuuggacuuucagcagagccaggacaggagaaaaucagguuuguuccuaaggagccauuuugacccacaucccuggagacagaggacaguacuugucaaggucaaugagacacaguuaaagugccgggccacaccugccccacuacacagcagggacaagacccuggauuagucagaagcaacugcuucaggccagguagagauuuucaagggacugucccuagagcagaccuacucucagccugggaaccaguaggaacaauuaugaguuggugguacagguuucccuccuagcagcaacaugaaguaaaacagacuauugagaguggcuuucaauguguauuucacuguaauucauuuguaauucaauguguaauucauugggaauugccaccagcaaaaauaaaaccuucuaaacuuggcaguuuuuccuacugcagauaaaaaugucuugauuuucaucaccaagauuugaaugguuuaacaacaacaaaaguucaugacucuucaagcacucucuauucaaagauucucugccuugccaggcguggcgagcgcacaccuguaaacccagcacuagggagcugaagcaggaccugggucuuagugaguuuaaggacaauuugggcuacuguaagacauccugucucaagaaaacaaaacaacaacaaaaaaaccaaaaacaaccaaacaaacaaaauacccaaccccuggguccaguucugcaaaacaaaccuggucacuuaagaaccgcaacgagagcaauugauuccaucagggagucagcucugcaagccucugcucacagcaggcaccaaccacuuccccugcaaccgacugccaggggcuggacagagguuagcuucugcuuccaugugcaaugcuacaaaucccugcuacaccagagcagaaagacugucagaucugacacacaggaaaauuccaacucccccuuucagagugccagucacuuagucacagugacacagcccuaacacucguggccuuccucaaaaugaauucagcagguacuaacccacuccaaaucucaggucuuuuuuauuuguuuuuuuuuuuuuugagacaggguuucucuguguagcccuggcuguccuggaacucacucuguagaccaggcuggccucgaacucagaaaucugccugucucugccucccaagugcuaggcgugcaccaccacgcccggcucagguauuuuaagaauaaaaauaagauacuauucuucaaaaucuuaaaagcaacaagagacaagcuuuuacuaacuuccugacaggugauuaaauuauaccccauuaaggagcuaugggaauggcuaggguaacgccaaccugcucugccuggcagcccugagcaggagaggcaggagugugccaggcgauggcagaggccagcugcaguggucacacucaguagccccccacacgcaguguacccaccaacaagucagccucucguuccaacuguguaaaucagaaaauccuucugggcaacuucaguacugauuccuguggucuggacuacaaaguugccucuaacgggcacaaccaaaaagcggaguuggcuugcccaugccaggguuuucuuugcagaaaagaaacaaaaagcacaggaaugaaguguguacaggaaucuacauccaacacccaccccagcaggaacauuccagucuccuccgguuugucuggagacaggguucuaugcugcaggccaggcuguuuuaccacugacugcaauccucccuaggagcuggaacugcaggagggauccaccacacuccuggcucucacugccucuuaaaauuuuguguggguguauagcuagugcaugaaggugccaggggaagucagagacuucagguccucuggagcugggguuauaggcaguuguaagccaccugauauaggugcgaugaacugaacuuggaucuucaagaacaguaaguacgcuuaaaaauguagccaucuuucuagcccccacuucacagucuuuuuaacaugucauuucuaaauaaucuuauuguaaguuauucacaccccugaaaaaagucauggaaaaguccuacugguucuuuuggggaaagccuguugcuaacacggucaucacccaaaucuucauuagguauugaacauucacugcagacaggaugccuccaaaguucaccagguacugaguuagggccuaagguacuaguucuuaauccucucuggaaucuagugagaugccuuaacacagagcacuaacgccuaaagccaucccuagagauuuugacugaauagaauacagucugggcaucgauauuugacauacuggaggugagucuaauaaauaacaaaguuugggaacauaaaaaguagaaauaacucaaauguuccccuauuugaaaugugauaugccuacauaguggaguaauuaauauucagcaguuaaaaggaauaaugauacgggauaccuguuauaacaaggugaaucuucaaagcauccuaccaagccaaucacagaaugacuccauuucuaugaaacgccuagcguggacaaauucagaagggaaaaaacagguaacugagugguuacuagugugcccaggguuuccuuugcgagugauaaaaacugacucuaggggugauuacaugaauuuaaacacguuuaaauggaugaacuguguggcggguggguuagcgcccacuuacgcagguuuuucaggaggcagcuguugcuggacucuaaugauaugagcgggagucaggcaucaaaggggccuggguaagacaggcugggcucucggaauccagccuaggcccugggauuugucuucccacgacaauggccuggacuaaauaugcuuccauucuagaacagagggccuuuccuagcgaggagguaaacucagugaagagcucauucaugcaggggccugggucuuucccuagcaccccaaccauccauccacccccagaagaaagaaucuaacacagggcuuuguggcaucaguauuauuguucacauguuuaaaaaaaaaaaagauaaauuaacauugugcugcuuccugauaagagaaucauucaaauucuuaacauuauuauagcaaggcauagacagagaagcccaauauaggagucugguuuuuuuuuuuuuuucccugagggacaaacucuuauaagaauguacuuguauuuuccauaaacuuaaacacauuuuugcuuuucuguguauaaaacauaccauugucaacuguucaagucuuggcuucuuaccuuaaagccccccuuccuaaaugcugcuugcacucauggcaauggaacuucaguaccuucuggacaucacaucagccaaauaaacucucuugcaugucaccguaauacaggguaaucauuaccaaacucuaccaaacucaccuccacccaagcgcucagcauauucugaagugggugacccaggcaaguaccuggucuuacacacagaagauucggguacauauucugaugaacccuaaagguccuugguuguauauuuaauucagaaaaaucagacaauauuuccuaacaaaauuuaacagcaaagaccaggaaauaaaguaauuaaucuucaaauguacuagucucaaagguaaacccacgagccuugaguccuuauaaugcugggcucaaccaaugcaggggcuuaguguuuaguuugaaugaacagcuuucugcuaggugugcucaacucacuggcucccaaccccaaaucuaccuuccuuccaacuucuuacccuguugaucacuguacaacacacccucacuuacuaaacauaauuuugaucaucaacccaaaauaaacacaggagaccauaugaaaaacaaggcaaagagacccagcugaaagauuuaacuuuggaaaaggguaaauggucacuggaaaaugugaaacagacucucagacacugcuuuaaaaugauuauuacaggaagaaaccauccugacucuccaaaugaaagccgccuggaccugccucugucuuccuggacaggaccacaggcuccagcccacugccgguuuacucauucuugcuguaauugaaaggauccacucccucucacaugguuauuaacaaccuagguaagugcaaaggguguagagccuagccuuuaucaucccagucucgccuccuggguucccuccagcccucuccaaucuaccaaagcuuugugguucugcuuuaaauguccuuugguccaguuuggaaguaaagacucaaagcccuuggaguuaggcuaaauuugaauucuaucuauaauacaaaacaguugggucaccuggaggaguacuggccucucugcgugcuucucuccuaaccuggaaagggaggauaaagagucuuugggugguggugggguuauugagaaauuauacauccgaggcaauuauacuauuguuugacuugcaagggaguguccacuaaccuuaacaagucucuagcacggaaauucuuaguuuucccugcaucuucaagcuaacccugguucaagacaaaauuaagaaugauguauuuaugaaaaucuuuuaaauaugcuggaucaugaccgaggaaaggucuagaaauaaggguaacuacccaaguguucccuuuuccuguagcuuugcugagcgugacgcauccuaaguaaaaauaaauguauaucuggcuuucaacgcuuccugucaguucuaaaagaggguuguuccucagcauuguguaaggaccgcuguuaguacaaauggaauuccaaagugguccuaguuauuucuaaggcagagagacugauguagcuguguuuauccaccuacacauggcuuuucuguagugucucagagauucagagaugugucaccuaucuagaaagucaaguuuuucuuaaguuguucucucucccuucauucuggagaggccaaucucgaaugugucuuuaaaaauaaucucauaugucuuauucaagaucaacuucaucucuugccuucaacaaaguauuuuaucuuuccuagacaccagugggaaaguaauggaugcccacccccgcaacccggugcugaagaaccauggagucuacuaaccaugagcacuguuaaaacaaaaugcuacagugccacagcugaaucacucucaccaugucuuuaaaucuguaacucaauucaaauccuucuggacuaucaaacaaugcuuuuuagcugaauuaugaucuuaaaugauuucuucaaggucuucaaauauuuaaaucaaugucuggaaagaacuagaaauguccggcuaacaaagcuuucacacggcagagaaagaaagcagcacagcugccauuuuuguaaaugaaauguuauucuacacaggaaagagaaaaaaaaaaacuuuacagucaaaguucauuugcaccguguauccuguggccaggaagcauuccuucugauuacucaugaagagcagaaaucagaaaauacaguuuacuuauucauccuaaugaaaaccaggcuacaaccccaaucauuucggggccaaguucaagggagggguagaauuaaugcacugucaguaacuuaaaaacugacaccaggaccuuccaggucagccgaaagcuuuacauuuaaacuaacuuacucuuuaccgaguuauacauucccuggaguuaaaugguuucuuuuccuaaaaauccaauuccgacucuuuugugugugugugugcgcgcgugugugccaacauaagcauuuacuucuuuaaaacugccugaaguauaaccagaaacugguuuucacuuacauaacaaucuucaaaacuuagcaagaaaguguuaugaaacgcaagcgucccauucgcugucuucaaagugcgcaacaugcuaagaaaauugaggcagaaucucaaacagcaaagaaaaauguauuaaggacacaagcgagggauaauaaauaaaugucuaaaagcaaaacuucugcaacaguauaaaaagcaacaaauucuaaucuauuacucuuacccuugacggcaaggaccagaauauccugccuuauacauuuugguauuacaacucuguaaugcuaaauccaaagacaaagccgcccaggggaaaauaacaauugcgcaacugaucaacagcuccaacuugucccuuggccccagagcagcgagguuugcacgcuauagagcaggaaagggccaaccgagggccucugugacugccaacuggccgauguaagccagccagaagccacagccucgcacacuacguggggccccgcgggucaccauacucagaacacacagcccagcauggggcccacucggaccucggagcccgccgcccaggucugcacguccuugcgcccggcgcgaggccauucccggguucccaggcugaaggagcgugcggagcccugccggcaggccgcccgucggggcgccagagcacgagggccacccggugacuuucuccuccgcccccggagggcugggcuuuucuggaucaagacggacaggcgugaucuuacagaccagcucucgggcugaggccguagacggccgagcucaccaagucguagaacggggguuggggagggcuucgggcggacgccgaggagagaccucagcucccccgagcgcggccccgugacuaggcacauuuuuaccggcaccgaaucagggaaacuacgcugccccggaaaaggccgggcggcgccgguuuagaccgccagcauccaccccccucccgccucugcgccucccacccagcgaggugguggugucucugccuggccccacgaagucagagcuuccuccacaccccaaccucgccgccccuggagaccucaggcucggaccccacucucgucgcggccccaacauccuccguugcccucccagcucggcggggcaguucccaggcccugccgucguaguccuggcucagacugucccucccucccggagccacuauccccucgagcuccugccggcuucuuggcacagcccaggggcccgaagguuggggcagcaccugcugggacuguaguccuggcgguggcaacuccaaguccaucaugcugagggcggacgcugugguagggcuccccgacggcgaggcuacuugcagcagaggugaggcggcggcaauggcuaguccgagcagcggagaacuaggagauagccugcucgcuggaguggcaggccagccuuaguccgccccgcccccgcccccugggggcggaacaaggaccuagggacgggacaagaacuuagaggcggagaaaaggcuagggcaagaggcaagggccagaggcaggacaagggcauggagg

SEQ ID NO: 866 - RNA, 2274 nt, Mus musculus
accccagcauuugggagcuugagugaggaggaggaggaugcaucugaggucagccugaccuccauagugagaucccuaauaaaaggggguggggggagaacaagcuuuccuauagaguuaggaguaaagacccauuuuauucugugcuaaaugacaaguacaguuucuuauuguuagcggcuuguugagcuacuguuuuugugguaguugaaagauggcauaguggguaaaggugccugcucccaaccugaugauggccuuagugccugagacacacaugguagagggagagaaacagcuccugcaggcugcccucugaccucuauuuauacucuguggcacaugugucugguucccaccccuccugcuaccaccccaauaaaaaguaauaaaaauccguacuuuaagauacaauuuugccgggcgugguggcgcacgccuuuaaucccagcacucgggagucagaggcagguggauuucugaguucgaggccagccuggucuacaaagugagguccaggacagccaggucuauacagagaaacccugucucgaaaaaaaaccaaaaaaaaaaaaaaaaaaaaaaagauacaauuuuuaauuucaauaauaugccaaggucucaguuuacugaagaacuuuauuguagggugggaaucauuuuaaaaucuuuugcuaaauguuuguucaaagacuggcuugaaauauaauauggcuucaguguucaaggucucuguuuauccuugugcagagauguuuauuucaaaaugcccugacuuuguugucaaacuguacccuuccacgaggccugugauggauuacccagacagcaaauaauuauuacacauuuugaaucuaacuuuuuguuggagcagauggugguagaacaugaauuguccaacauucugcuuccuucugucucuugcguaagcuaaguuuguaguggaacuuggagcacacucaggaauccguaaguggcaggcagcauuugccccguacaccacgaggcucacccuggcacuuagguuaccuacccuugggcagcuuuuuccagucuaagaaaauaucuguuggagugcugugcuagcuguugucugcuuucgggucgucguccccccgucccccagacuguuuauguggccuucccuccugggagacccacacggucagggucggacagcuagcugcuuuucagaacuuuggcaagagcaguguuaguccuccuuagaugcuucucuuccccgcugucugcugucuuguucuugcuuguuaggggcuccacccuagcauuuccucugagaugcuguucagguuucacaaagcagugguucggggauaggucuuugugguguaagucaugcgccagucacgggguuccuuacaggaaaugcugagugcuuuguucauugcagaaaauagcacuugugcugugggccucccaggcagugcuuuggguuaacagacuuguguacaguauuucuucccaggguaaugcuuugacuguuucauacagucucauccagucucugaagcuaggucauugugacacacacuuguaauccaagcuuuggaaagcuggggcaggaggauugcugugagcucgaauccaucuugggcuucaguaugaaauuuugucuuaagaggugggaaaaggggggcuggagagauggcucagagguuaagagcacuggcugcucuuccagagguccugaguucaauucccagcaacaugguggcucacaaccaucuacaaugggaucugaugccuucuucuggugugucugaagacaacuacaguguacucauacaugacaugaauuuuuaaaaaaacaaaaaaaaaaaagagggaaaaaagggggcuggagagguggcuuagcaguuaagagcacugccugcucuuccagagguccuguguucaauucccagcaaccacaaggugguucacaaccaucuguaacggggucugaugccaccuucuggugugucugaagagaacaaugguguacucauauacauaaaguaaauuuaaaaaucuuuaaaaaaaaaaaaaaaaggcgggggagaggugggggaagcaagugcaaggcccuggguuuggucaucaccucugaagaaaaaauuacaaaagauaaagugugccaugcucuugggcuggcaagauggcucaguaagagcacugacugcucuucugaaguuccuaaguucaaaucccagcaaccacauagugacucacagccacccauaaugagaucugacgcccucuuuugguacaucu

SEQ ID NO: 867 - RNA, 1133 nt, Mus musculus
ccauguuuuuuuuuuuuuuuuagacuuaaacauuauuuuuauuguuuauuuagcccuucacagcucaccccacacagagaaaaagguuauuuguacugggucacucauuuuguagcuuauguggggauaugguucaagcagaacugaugucggcugcugguacugcagagcaaaggggaaucuaggcacacccauaaagguggccacacccagauggguugauuggcaggcuggaagacaaaacuccgaauaaaggcacuuuuacagggauguagcucaguggagaauacuugccuaguaugcacacggcucuagguucaaucucuuguaccauaagcacuuuuaauggggucaaagaauuggcuggaguguuguggaaaccggagaaggaauuguuuuagagacaggaucucacuguguagcccuggccucaaacucacagggauccaccugccucugccuccugagagcuuggaggaaaggcgagcaccaccaccgcccaacaggaggaaaguuuuugauggaggagcuauugagagguagcagagacagcugaaagacgaucaugggccaucaguggggucagugggggcugcuguaugucuuugcugcuuuagagggaaggugauguaugcaucguagccaaagagcaacguagcaaguaagcccaguaucccagcaacaacucuggagcugccucuuccuucuacaaggacaacaauggaggugaucagguacaggaugguugcuaugagggaucugaagaagucaguccaaggccaguugaugaaugauaucuuggagugcaggucacacguguagaagacaaguaagacagcagcagaucaucucaaucaccgacagggaggaguaggccgauguuguagaugcacugaagcaaaucaaaaucaccaggcacaguauaaucucagcaaacaggagaauucccuuuuuggugcucgagaagcugguacaggcuaaccagcagccgggggccgagagacgcucagaauccgccaugguggugugcuggagucccugggacgcagaagcucugcuuucuggcucacggguucgaggucgcugcacacccagccgucugucccgccgucuggccgggaagaagcggggac

SEQ ID NO: 868 - RNA, 99176 nt, Mus musculus
cagucgccgcggugacugccgggaugcgccgcagcgaauggucgcgcggggcgccgcucugagugaccuuucacccgagcccagcggccucgggcggcggcacaaggcggaagccauggcggaggcggcggcgggcgaggcgggcgcgagcgagcgggacccagacgcgggccgcgcgcgccggcggcugcggguucugucgggccaucugcugggccggccccaggaggcuccgaguaccaaugagugcaaagcgcggagagccgcgucggcggccggggcgucgcccgccgcuacuccugccgcaccagagucgggcaccauccccaagaagcggugaguagcggcccgggauggagcuggcggcgggaggccgugagcggccugggcugugggagaggagagcacgggagugggcagggaguuggcagggugggcggaaggcauuccgaucccugagaguacaucagcuugcgggcugggaguggaccagacacaccggacucugucgggaaggggcggcauggcuuggccggauuuuggugucucuuuuugaaggaaacacauuucaugaccuagugggaaaaggguuuaagcggauccccucuuuuggguuuuggaggcuggaaauucauucucuaucuuggaacggguagcaggaggauugucuuaaucuacgacgaggaguuuuaaaauugcacuagauaaucagauuucuacgaauucucaaaagccuggaugcuagcaagcuggagugggauggugguacucuggggagaggugugagugguuucuguaggguagguuaccacuuccuuguggucauggauucuaacuuuaagggaggaaaccagugagugagugagugagauacaguagacugcaagcguuagugacuuaagacuuugguauuccagcuacugauccuuuaagaagcuaaaagacaagagucugaaugaggaauguuuguaaaaccuuaagaccauuggaggagaaucucugucucugaugaaagcugucgagagaugguguuuucugagaugaucaguuuggaaaaacuuggagaaugaaaaaaaaaaaagauuuugcuaacucgaauguguacuuucaaagugcuggagauggugcuauuuccauuacuucuacguuccuaagguauuagguaggugcaguagucuuccauuuuacagaugaagaaauuagaagaaaagguuaagaagugugcugcagguagcagguaccuguguuacaguuuacacaucaaaagcaaaucaaauggacugccucaugaauucaacccauguaauuaaguucucacugcauacacacugugccagaaaugcagggauucugaaaugugcucuucccuguagggcaccaaaguaauaauacaguuuaagaaauuuagcugauaauugaaacucauggucauuuaacccuaguuuugaguauauguauuuguuaggauaaaggcuuuucugagccagggguuucuguguaaaucuugaaguuuguaaugaaaacagcccuggagggggagaaagcucgugguagacaaacagaauggucacagguaaagagugugggggacuagagaacuaccggacucagguguggcagaagcugugagaaugacagggaugcggacggaaagaacaucugaguuacuuuuuagaaaggacacuggaauggagaugaagauucgauuggcaacuguaauggcuggaaacaaaccuagguuugaauuccauuaggcuguuuuaccguauaaacuuucugucucucucagagcuguguccccucccucauuuuaagaaagauguagaaccagaugugguggugguggguaagccuuuaauccaagcacuugggaguggagguuggagaccuguuuuaggaaacggaaacaaaaccaaacaaaaccaaaaaaccaaagaacuaaucccugcuuugcauuuuugcuuuggcaacagaaaacugcagcugaaagauguucaguguacuguguuacacaagcucucaacaaauagcuguaguugcuugugucugaagacagacaguggcugugaaucgccuaacuuuaaugcauaaugcugggacucggaauuaaggcauccgauaccauuuuaagacuacgaggagguucccagaguuugguuacuuggugguaggagaggguaaagccgagagucacuuagccucuggugucacugauguuauaguaucugauuucucauuuuuccuaguggcuucauacacaugacuguuuucucauuugcagguaucugugugacuaaacauuuauaugugcaccuacauuauuaaauuaaguaggcagggcagguuuccuuaagauggguuuaguggccuuugccuucagcauuuagggaagaaauagcaaugcucugauguaauagguaagacuacuuuuuuuuuuuuuuuuuuuuuuuuuuuuuuuuuaagacagguuuucucucuguggcccugguugcccuguaacuauguaacuagcuuuguagacuagguucacuuugaacucagagauccacaucugccucccaagagugcuuggauuaaaggcaugugccacugcugccaggcuggguacgacuucuuaaggcugaggguaacugcucuaaguaguggugauccuugcauggcaaaguguagggacaacugcagcucacuuauggggugaaggugggaggacgcucaggguuagcugaguagugguaacaucuacaccguaacacugcucugaaguuuaaucaaaaugcuugcauuuaauucagugcaaaguauacuacugucauguauuaagggagacauaaaaccauguguuagaugaaacauuagauguuuucucagacugugaucguucuauuucauuauuguugguugggaaacuuucaauucaugcuacuuagcugggucucaacaucuauagcaacaagaacugagccuaaagggaaaaggaggaacugaaguaccuauccagcaaaggugauuauagcugugcuuagugguuuuggaaucuuuuggugauuugcguguuacuccucuuucauuacucuugguggugauauuggcuauugucuuagucaggguuucuauuccugcccaaaacauuacaaccaagaagcaaguuggggaggaaaagguuuauucagcuuacacuuccauacugcuguucaucaccaaggaagucaggacuggaacucaagcaggucaggaagcaggagcugaugcagaggccauggagggauguuacuuacuggcuugcuucuccuggauugcucagcuugcuuucuuauagaacccaagacuaccagcccauggauggcaccacccacaacgggccagacccucuccccuucaucacuauuugagaaaaugccuuacagcuggaucucauggaggcacuuccucaagggaggcuccuuucucugugauaacuccagcuugugucaaguugacauacaaaaccagucaguacaguuauuguuucuucucaugacugcguauacuuaaauuuaucauaaguuuggaguagugacuucuuaacacaucaugcuuucaauccucuuacagaauaguaaugcuauucugaauaaugaggaaaguuuguuguggacagcaaggaaccauggaaguacaaguuguauuuaggugacaguugagaguugguagagaugggagucgaugcauagaggaaggugaugguaggcuuugagggcuuggcuuacagauaaucaguccauccauucauggaaguagcauacagcagugcacaaagcugugcucuuauagaacagguaaugauagcaugugagguggugaaagacagcugaggggcugcagcguggaugugccugcacccuaagcugggcagggacugcuuggacugggaauggucaguaguugcuggcacugagacugaggugcaguaaggacaugguaucaugcaagcaaggcaagggcuccauuccugaguuacagccccaaccuacauaugucauucuuuagaaauauguuauuugagaccaugggaggcagcucaguugguaaaaggugugcccacaagaugaagacauguuuuugagccacaacauccauguagaagucauauguucacugccaggacgguggaggcagguggcucccaguagcuuucuggccagaaagccuauccuauuugacuuacaggccaaagagagauccugucuuggggggugaggguggggucgggggaaaggugaacaguuccugaaggccaacuuggagguauuauuucacauauguuacaacuuugguaaauguucuccagaagagagaaagcuaaguugacuucuuguaaaugcuuuuuaggaaggcagcccauagcuuuauugcuauagcaaagguuauuuguacaagcgacuuaugauuacauucagauuuuuuuuuugaaaaauugaagcuuauuuuguuagcuauaccgaaugaaguaguaugguaugaguucucagcugggaauucuagugauggugcuguuaggaauuuuaaauugaguuccuuaacacccaaggcaccauccuaaagcauguauacacuacauuauaguacaucauuuacagcucuaggaaaaggugguaguauaugucccuuacagacaaugaaguagaagcucagauaauuuuguuggucuagugacaggcagaugguauuucaggucuggccucaucucuacccaggcucauuucccaugcuguuucccuguuuauuauuuauuauucccaugguauuuauuucugggguaaaguugucagguugcuuuccuugugugcuaagcuuaaaaccauuugugacaauaauaguugaauacugugucuuguauugaauguguuaauuauguuguauuauugaaaaauuagaaauaucccaucaaagugaaauucaaaauuuaggaaacuauaaaguuugguuuaagaagauaggcuagcugcuuauaaguuaggagugagcuuuguugcugcucuugugggagaagacaguguuaguaauaaaggagaaggggaacugcaggagagccgagcuuagaugagaagaggaggggucuuagaggaguuacugcuuggcuaggcugcuuggaguaggaaaccgugauguguuagccuuugauuugcacgugacaucagccaggucuucuccaaguguucugcauguccagaguguccuggagccgucuacuccaggcucacuuaguaagacucugggagggaaugcagggaucugcuuucaggcuacagaggaauggaaugcuguuguagucccaugagauacuguauagaagaauuuuaaaagcagauauuuuuuauucucuuauaaugaaaagauuucugcuguuugugugauuaguauguuaauuucaacccuaaauuaaaucaguccaccuugauuuggaguggaguccaccuugagcagcacaauaccugcucucugucuccucuuuauuuguuggauuuuucaggguaaugucuuucccaguguccagaaucagcugagugaugguacaaggcacaauggaaauaaaacuguugguuggagagguuguucaacaguaaagagcauuuacugcucuugcugaggaccugaguuugguccuuacuacccucgugguguaguucacaacgaucuuuuacaacucaaguuuaaggagauuuuacguccucuucuggcuucugagagcaccaagcaggcauaagaaaugcaggcaaaacacuuauacacauaaaacaaaaauuuaaaaaaagaaaugaaaugucaucuuauucuagauagggcauggcuaauguuuacccugaauuagguggaucguguaguaggcaguguuagacuucaagcauccucugaggggagauagcuccagggagcuaacacgagagaguacuuuagagagagaaaaagauuaacccaggugcuugugcuuucucugagaauucacugaguauucugaucuccucuguccugagaaagagugagcaugagacuuggggacagaccuccauacuuguguugaagucuucuagggcuagaaacaggagcuguagaauggcugaaguguuucugaggaaaucagagaaacagguuaaagaagcuaccuagaaccugaacaacagucuucauuuuuuguugccaugugcuacugucaccauugcuguugcagucacaccgaaccuuugacagagcagcugaugacuggagaaucugucucaaucaguccuuuuaggcccguuucucauucuuugaaacaaugguguacuguaguuacauaccauacauucuauaacuggaucauccuuucuucuuccuugauguuuguuuuccuccagaugcaaugcauauuguuugguguugcacagauaaugugggaaugguauauggaucaaaaacuuauuugaauuguucuaaauauauacauguauauguguguucauguguguguaugccuguguguacacauacauaggaggccugauguugauauugguaucuuucuuguuuguucucaaccuuauuuauuuaaaaauuuuaauaauuugugugugucuugaguggggguuugugcucaugaguacagugucuggggaggccagaagacaguaucugauucccuggaacugauguuacuggcguuugugaacuaccugauauagauguuuggaauccaacuugaguguuccacaagugaagugcagacuuaacuucugagcuaugucuccagcacuauauuuccucuuuaaaaagaugaauugauuuuuuuuuuuuuuacauauguguggucuccagcccuacacuuccuuuuuauaaaggccagaagagcacauuggaguguggguucugggaauugaaccuagguccuuugcaagagcacuaagugcuuuuagcuacugagccacaucccagucccuacuuuauuuauugagauggggccucucacugaacccggaucuugccaguuccuguaguuaaauuaccuaagcugugguuacaggucugucuugcuuucccaacucuuuuauguggggucuggggauccaaacuuuaguccuuacucuuguauagcaagcacuuuuauccacugaacuaucuucccaaccugguguccacuuuaugugagugagcaugugugugggugcgcaaacaugugaaggucagagaucagugucagguauccucuucagucauucuuuugcuuaccuuauuuuuuucagacaggguuucuuuuggacacuuacugguucauguaaaaccaguaagguagggcagcaagccccagggauucuucugucucucccuucuagugcuggaaucacacauacauaccaccgugucuaguuuuucauacagauucaaaggauucaagcucagcuccuuacauguucacaaaaaauucuuuacugauggaggcuguaauuguucauuucguucaccuugauuguugaaaaguauuccauugugucuuaguuaggguuuuauugaugugaacagacaccaugaccaaguacagcauuuaauuggggcuggcuuacagguugagagguccauuaucaucaaggcaggagcauggcaacguccaggcagguauggugcaggaggagcugagaguucaauaucuucaucugaaggcugcuaggagaagacuggcucucaagugguuaggaagagguucuuauugaccacucccacagugacauacuuccuccaacaaggccaaaccuacuccuacaaggcuaccccuccuaauagugccacuuccuaggccaagcauauucaaaccaccacacauugcaugucuguugcuauaguuuguccacuuuguuauuaaugagcauuugaguaauugauacuuuucauuuuaguuguuuuaauaugaacuuucuagcagugaauauucuguauauauuacuggaaaagaagaagcuaaacugauuaguuucauauuuagugaguuugguuuucauuguuuacuuuguguagucuccuuaccaugccaguuauuuuagagaauaccuuuuaacuggucacuaaccauucuuguaaacugauuaaguaggacuuuaagaaggauucauugugugggugcugcagauguacgugcauaugcaugcaccugccagagugcauauguggaagucagaggacaacuuuguggaguugauccucuucugaauuuacauggcuuuaagaauugaacuugaugcuugcugacaggagccugauaaagcugucuccugagaggcucugccagugccugacaaauacagagguggaugcuugcagccauccuuuggauugagcacaggguccccaauggaggaacuagagaaaggacccaaggagcuggagggguuugcagccccauagaaggaacaacaauaugaaccaaccaguacccccagagcucccagggacuaaaccaccaaccaaagaguacacguggaggaacucaugucuccagccucauauguagcagaggauggccuugugggacaucaaugagaggagaggcccuuggucuugugaaggcuugaugccccaguguaggggaaugucaggacagggaagcaggagugggugggcuagugagcagggggaugggggauggaauggaggggcuggaggggaaaugaggaaaggggauaacauuugaaauguaaauaaauaaauaaauaaauaaauaaaaauauauaugaaaagaauugaacuuggucccagcucgugugacaaguaagcgccaucauucccugggauaggaacauuaaaaugcuuucgguguugacguauuuguaacuuacaagauuuuggcuaaaagcacaaaucuguuucccaauuacccauuuaauuugaguuacaagcaagucauuacuggccauagucuuaaguuucauaagcauaaaaggucagguuuuauauuguuuucuuaaaauaagacucucagcaucugccuuugauuuucaagcauuuuuauagguaauguuggauuuuuaguaguugauugugcuuacuuacuaaagaaaaccuagguuuccaguaacucaguuacuaaugaugaguguucugcuuccuagcugugauuuggagcuguagauaccaucaugucauucccugaaaaaacugcugugugaguacaugugauauauuguucuuguagcgugcuugaaguuaauuaccagggguuuugaucagaauauccguccuguucuugcuaaucaccucacuauaagucucuguucuuuuuauaguuagucaguuagaaacugcauagcaucaaguaggcaguacuuauguucugaaaccuggaguaaagcaaaaagaauuacccaauuuacagacuucacagugccgcucagaugaccuggucggaaucugcaucucuucuauggaagcuugagcuuggcuagaaccuagcuucagggcuacuaaaauaccgccuaguuugccgggccugcuaaagauuuuauauaauugguuucuucauaguaaaaagaaaucuaguguuucggaacauguauugauuaggaugauugguuuuaagcauuaacuugaguuagaugaaaguggaaaagaugaauuuauuacugguuuuuauuauuguguguguguacacugggaauugaaaccaggcccuugugaauguuagacaagugcuacaucaugaaccacaucuccaggccuuaguuuauucuucuacaucuauuucagccucaucuacuuggacugucauuaucuuucaccagucuuguggggacuucuaagaugcugucucuuccaagacucauuuugaaauugauagcuauuggcugauucuaaguaagugagugcuuugcugcauagucuccaagucugcauacaagugcuguguucaguuauucccagaacuccauuguuuuucuucauacuuuuccuuaucuggaugcuuaaaaccaacuugucucuuuaacagcauugaguuucauccccaacccuuuuucagucugauagaucagggacauuucuuugccgugacuuaaaagaugcuuaucuuugcugauccagcucagguaaaauuuugauuuuucuaauguugggcccuuaucaguggucucuguagcuggguuuucuuucuuucuuuuuuaaaaugucucucuuuuaaaugguuuccauuaugagaccagucuuugugccagggaaacugagugcugcgugaggugcuuugcuuaugcuaacuucuaucauugcacaagugauugacaguccaguggagcuugagagacaaauacgauacagaggauauaauaaauguuauaauuacuguguacagagggagucauaaauccuugagcaagauaggagaagcauuucaaaagaggauuuuggaccaguucccuugauuaguaguucuugagggggagaagggcauuucagagaagggacauggagcagguaugaagauaagcagacaugaaagggcaugaugucccaggaguuaugauaacaguuuugugucuggaaauagcuguuagggaacaacuggagaguaagcaguucuuuaaaguuguugucauuacuauuauuuuauguguauggguguuuuuccuacauguguaucuguguaccacguguagggugccugcagaggcaagcgugagcaguuuuagagcaaaaugaguuguccuuuugguggcaacaugauauguagaaaauacuguuuuacccccgugcuucccauugaugcugcuggcugcugcugcccauagcuuuccugcauagcuuuauacuucauuaguguaggugcagaaacucugugcuuucuuccucugcuuggcuauucaguguauaucaucuccagagaauuggaaguuuacaugcaccauagugaaaccaccuacucuuagcuagaaaggagugcuguuugccugcugcccuggacgacuugguguucacuguggcuguaguuaagagugcuagaaccagacaaccaaccuucuuaguuugccauagugauuacuguacuuagaaaguuuauguuugagaaccaugcaguggaguuaaaacaaaaaccguaugauguuuaaguuaaguuugccauuuuauguugguuuuuuuuuuuuuuuucauaguccuggggacuugaggcccagggcuacaaguuggacacguguagccuaguguaucagguaguguuugaaugaccaaggacaaguuacugaaaauuccuggacccauacccccuauguauuaaauagguguaaaggcagcuguacuccagaaccaauguaagaaggaaauaggucuugauuauaaacuucuuaguuuuacaguaugguauaacaccauggaaggauugaauaagccugguagaaaguaguaaaaacagggugcuggacuaggaaguagagagauauucaaguggcagugauacccuugggagagagagcacaaaccacugacagacacaccaccucugcugcagggagguugggcaguacugaagagcagacucagacaguucuugucacacuguugucagaaucguggaccucacacucagcagauacugucuacucucauuaggaauccuuggaggcgcugaggaaucguggcucauuguugccauugugugaaauauuuaccacacauacuggacuuugaguaaacauucuuguguuagugccaaguucacugauaaacuaauuuaaauuuuuugugcuuguaagccuaacauguauaaaacuagcagguuguauaauagguaacauuuacuaagauuuagguaaaaauuccuuuggguagcuuucauucccuuuucuuaaaauagucagagaucuaugagccucccugcugggaugcacaugucuacucccugucacucuuugccuuuccacucugcccucuuguccuagucauugcugaacucuuugagcccaucucacugcugagugcagugggcuuuuguuuucuuucucucagugauaaucucuggauuuggagaaaguuggucagaauaacuugauuuuauagcacugaccuuacguauuguguuccuuguucagugggugauucuucuguucuugacuucugcggacaccuuaagguagugcuuccuggguguggauggcccugcuggaauauccuaacagugcuuguucagaaaguggauucugagugcccacugccagaaauucuagucauagguuaggguuaggguggcagccagagcuaugcaauuaaagugaguaaugucuaugcugcugaugugauggaguccuuuaaacuaagucugucugucugucugucugucucucucucagugugugugugugugugugugugcgugcgugcgagugcgugcgugcgugugugcgugcgcaaguguguggaugugcagaagacauuggguguuuuucuuuauugcugucuacugcuuugagugcuggguuauaggcauacugccacccuuggcuuuuauguggauguuggaaaagugaauucagguccucuugccucacaugagucuaauacugcucaaguggcuacuacuagagagacagauguguuuuuuguuuuuuuuuuuuuuguuuuuguuuuguuuuguuuuuguuuuuuugagacaggguuucucuguguagcccugacuguccuggaacucacucuguagaccaggcugaccuugaucucagaaauucgccugccucugccucccaagugcugggauuaaaggcaugcgccaccacacccaaccugacagauguguuuuauaaaauauaguuaauuuuucucucuuaagugcuguuaugcugugggucuuauuucuccuuuucuuuguauucaacccuguuuccaaaauuuuuccucauuaauuuuucuuguuuuaauuaauuuuuuagguagcauauaaaauaauggguuuugucauaacauuuucauacauaugucauuguccauuucuuuuauacaccuccuacccuccaguacucucccuucuucuugccaaauagucuuucauuucauuuaaauccagauucugcauagagaaaaaaacaggugcuauuguuuuaaaaaucuggugccaguguacuucagugauucugaucauuuccacauucucuauauucucuacugaagcaaaugugguagauguauuuccuuauggaacagggcguggauuugucucuagcaguuaccaggaguuacagcuggauccauaacugacaucacuugugcauucuuagcacaggauuuuucugcagaguugcuuaguaggggggcacuuguguuuuucuuccucuuaaaaacuuaaaaaguauuuuuauuuuauauaacuggguguuuggccuauauuguauguauagcuguacaccauaugaaugcaaugccuguggagacuggagcagggcauuggaucccuggaacuggaugguugugaaccuuuauuuggguacugggaauuaaaccugggcucucuggaagaauaacaaaugcucuaaacuguugggcucucucuccagcacaccuccuauguuuuugcuaacaauucucugucuuauuaagucccauauuuaaguuuguauuagacuggcaacaaguagcaaacaguuuacugcaucaaaggacuaaauacagcagcuagucauaaaacacaauagggacauccaaggaaguugucaugcguuaaaguaugacauuguagugugcaagguuugucaugaggcauuuuguauagauggcaagaguauuaucuuguugaaccauucuagaacucugaucuuggcagaguccuguaauuaaucauuuagaucauauagcacauuuaucuccaccagagaucaaaguuaaucagcaagcaaguagauuaguugaugauggaaaacaaaauuauuguugcuacuacuuuuucuuguaagacaaaaaguuuguagaacuuuauuacaacaaccauaggcaguguuucggagcccaguucguuagcuuuucucagcacuguugcggacuugacagaagcaucuuuggggaagagagaaauauguccggcucaugguuuauaaagagcacguggcugugguagcaguggguccugcagguugguuuguuuguaccuuucuucugacucagcuuguuuucuacgaauuaugcuuuucaagguggcauggugguauauaagucuguuuguuauuuggaagacaaaggcaggaggaucagaugucuuuuuuuuuuuuuuuuuuccuucgagacaggguuccucuguguaguccugacuguccuggaacucaagcuggccucgaucuacuucccuaaagcucaggaauccaccggccucugccucccaagugcugggauuaaaggcgugagcuaccacuccugggcuagagacuagucuuaagcugcacgaggcuguacaguuuucugagacuacuuauaucuuaaguacagucugcauccauugauucuuuuaacaaguguacauugugaacauuuuugaaagcuuucuuacugaguuuuuaagaauaauuuuggaggguuggcagucuagguaugaaggugacuuaaaauuuauuuuaaaaaaaccuacauuuuaaguugaacuuagaauaaagucaguauuauuauaccuucuaaucuuuacauuucuaaugagaacuccacuucauuuuucuuuucaauaaagaaguugguggaaauaaaacuucauuuguagaauuucccucauuuuuccuuucccccaucccuggcugaccuugaaccucugguccugucugagcuucccgacuacuggcauuauaggcauaugucaccauaccuuggucuacaggaauuuuucauagugcauuuuuucaaguguguguguugcugucuuucucaucacuucuuugucauaugaucucuuugguugucuugaagcagucaaucacaaaccagauaauaaagagcugcauucgaaaaucuugaggaggguuagauuucugcucauuguguccauacgugauugguuuggaaguggcuggcacugaggcuggucagcucagcucagccagcacugagugaggcuucagaggcauuucucucuucacuuuucccaaagcuauuuuucucauuucaaacuguagugaggcuggagagauggcucagcgguuaagagcacugacagcucuuccagagguucugagcucaauucccagcacccacaugguggcucacaaccaucuguaauggcuuuucgugcccucuucuggugugucugaagacagcuacaugcacccauagaaauaaaauauauacaucuuaaaaaacaaaacaaaacaaccccccuuucucaaacuguaguggauaggucgaacuucugaacugaguuagaaguaauuucaugagaauuuuaucagaaaagcuuuaaaaguuauuagcuaaaugaucuuuaaaaagguuguuaaccuagaguaaaaguaggugaaauaaccuuuuccuuuucuugacuuuuccugacuaugcuuagaaaaagcacaagccaugcgcuaaacccaggguccugugaguuauauugaagaggaguggggagcugaugauuugucuccaggggcagacacaaaagugagaucucacuuaagacuaauacuuauggauuaguaauaacaauacuaaaucuagauauaguauuucaccuagugacugaguaauaggccuggggagugggaaaaaauggagugugcaaaccauacaucuccuaggagaacacugccaccuuguguauaugugaugauagucucuaaguacuuauuuucuguuguugcaacacauaauuuuuccuuuuuuuaaaaaaauuuuguuuauuuuauguaugaguacauuguagcucucuucagacacaccagaagagggcaucggaccccauuacagaugguugugacccaccaugugguugcuaggaauugaacucaggaccucuggaagagcagucagugcuuuuaaccucugagccaucucucuagcccaauuuuuccuuuucauauuuguacuacuucguucugcaaguuuguaaaacauguuuuaauaggguaaaaucaagccaaccuucuuuuuggcaguaggaagaaucuuggguuuugacaacaucaaauuuggugugguuagcuucaggaaucugaaagccugggguaugauacuacuuuacuucugguuuaguuguggauaacuuccuuuuaauggaguuugggaaagcuaaggauuuuguuuuuuuuuuugguuugguuuuucgagacaggguuucucuguguaucucuggcuguccuggaacucacuuuguagaccagacuggccucgaacucagaaauccgccugccucugccucccaagugcugggauuaaagaugugcgccaccacacccggcuggauuuuguauucuuuauugcaguuuuccuggugccuugagauuguuauucuuuuuuuuuuuuuuuuuuaauuauuacguauuuccucaauuacauuuagaaugcuaucccaaaagucccccauacccuccccccccuucccuacccacccauucccauuuuuuggcccugguguuccccuguacuggggcauauaaaguuugcguguccaaugggccucucuuuccagugauggccgacuaggccaucuuuugauacauaugcagcuagagucaagagcuccggggguacugguuaguucauaauguugcaccuacaggguugcagaucucuuuagcuccuuggauacuuucucuagcuccuccauuggggcccugugcuccauucaauagcugacugugagcauccacuucuguguuugcuaggccccagccuagucucacaagagacagcuauaucaggguccuuucagccaacgcuugcuaguguaugcaauggugucaucguuuggaggcuaauuaugggauggaucccuggauauggcagucucuagaugguccauccuuuugucucagcuccaaacgagauuguuauucuaaaaggcaaaguuuacucugugauagggaagacaucaggcacuagacuuacugauacagcugcuccuagauucuuaaauguuuccgucagacccagugcagaaugaccacaguaagacuuuagaauagugcuuuugagaaaguauuaaaaugaugaagagggcuuuuaaaauuauuuuggugaccugaggguauaauuuagcagguuuuaaauauugucaugagacuggguugaauguucucuagguaaaacuucuuuaucugggcaaugugggacagggcacuuucuaaggauccuuuuagcauuuggacuuuguaacaagugaagcuuuuacucuccuacagauguugaagcuguaauucacauccagguacuugcagccuuuaaauaggauaauuaggaucaguugcuaaauuagaggugcguuuuggcucgugguuuggagguuuccuucugagacugguaccgguuguuuuggaguugccacugguaaggcagcaagcggaucacccuaagccgcguguggcagggcaaauuagucauucuaugcuuagcuauaagagagauacuagggaugcacaguccccuuuuaggacgcgucucaaugccucuagaccucccacuaggucccaccuacuaagggcucuaccaccaucuuauaacaccgugcucccugggcacaguuuucuuuaguuucuguuuauuauuugucccuggucuuuauuauuuucucacaacugcuuccaguuguuuccuucccuaggaguugacuacgucuggaugugcucugagguugagacaucagcagagacauccaaagcuccuuucucagaauugccuuugcucuaucccagagcuucugauaagguuugguuuuuguuuucauuugagucuagggacuuuuaaauuuccuccuuaauuucuccuguuaaccacaagagugcauuguucaagcuucauuuguuuguagaguagcuaugauuucucuugcuaucauuauuaccuaguaagauauaaauuuuuuuaacuuguuaagacuugauuuauggccuaaaauguagcacuuauauuuuaaaucugcuuuauuaacaugucugcuaguagucaaacuaccuuuuuuaaaaagccuuugauucuuugaauuuuccaucauguaccccucaaacuaccuuauaaauuggucuauuucacuguagcagaaaaauuaaaaauucuuauguuuuucuaacacggguaaaaguaaguuucuuguucaagugcauuccuaguuuuaacugcaaaguuauuuaggccaucuuauguuuauuuacuuacacucuuagggaucacacucagaaauuugagcaugccaggcuaugucccuaccuuaaacucuguauuuaagaugaaacaauuaucuuuaaguccacuccuucucaucuuuuuuuuugagugauuacauuuguugauuguagcuuacugugaagcaugcacagcgcauuacaaugauuuuauauuuagaauuguuaauauguaggcauuuucauguucucauuuuuauuucaacuaguaguaauggacauaaggucuuuuaaaugauugugaaaauuaaaagccaaugauacauugcuugguuuugaaaugcuuagcaaguuuuuuuuuuuaaaaaaagaguuaaaaauuacuuuuaguuuguguguguguguguguaagugagacagaauauuaauauuaguuguaagggacacauugaacaggaaaagacugaaacaagggaauaagauaauucucuuuuuaguauuuuuuacuuuacaccagcuauguugaugacauguauaccuauugugaggcuagcuaagugaaauucuuuggauguuuuggaaagaauacaagaaaaaagggcugaaguuugagguuggcaucuaaagccuguaauaagugaauugaucuugguguuuaucuuagugguuuuaccuauuuuuuuaguauuaaguauggauuugaugauaguugcugauaguaugauuauguagaaacucauaaaaugaaauuuaaucaaguauacacgagagacagagagagagagagagagagagauugauugaacgcacacgugugagugcaugagcaugcaugagagcguuguauauggguauaugauaugcacauagaaucuggagguguugaauucuccaaguaguucugagccaucccauguggauccugauugccaaacucagguccucuguaugagcaucacacacuuucaacugcugagccgucucuaguaccaggauaggucuuguguauauauauacauguauauauuuuuucucacuaggcaagaaguuaugaaauggaauggauggggcuacaaugauuccaaguucuuauugaauaagaagggccagguugagcugacugggaaaagguaacccugcuuuuaaguucacucuuuuccuccuuuuccuuuucuuauauuuuuaagcauaugaaaaagggcaugauaauaugaugucccuccucuaagaaaaaguuaccagcauuuugcuguuaauuucuuuuuauccuauaauauuuuaaauucugaugucaucauaauaccuauacuuuuauaucuuuaaagauaagccuuuauaaucauucauauauuaauacuaucacacuuccaaaguaacaagcuuguuauaauaucuaauuauuuaguccauauucucaucaccccuguuguuuuacagaugacuccuuuaggggauuuucugaaucaggauccaaagagucaccccugguccuccaugcuuuugacuuauuggaagugacuuuauauuuaagucucguaauuuacaccuagguuuggguuauaaugaaagagaacaccuuuaagguuauuccauagagcauuaauuaagagcaaagaggaugcagugguguugcuggagacuguuuccuagggcaguggcucucaaccuuccuaaagcucacccucucauauagucccucauguuguggugaccccuaaaccauaaaauaaucgucguugauacuucauaacuguaauuuugcuacuguuaugauuguaauguaaguaucagauaugugauccaugugaaagagucauucaacucccaaaggcgucauggcccacagguugaggacugcugauuagguaguaaaagaaguagagaauuuaucugcuaguuuagagacuagaagauuguacuacugccacuauagccagcauggguuccuuaaggcuucauuucuuagauuguugaauucugauccaaacacaugagagacaggaagaagagguguauuuuguaagcucucgagguugggcauggagaaggugggugcuuggcaucgucaccuuagggguagucaguucuccccucucuucaaaauuuauacacauggaaguaggaucugggaacucuggaauaacaauauuuaguagacagcaguuagcuaaugagacuucuaggaacugcuugaucauuccuagauguagaccguaagcuucacuuuuagauaacucucuagcauucuuuaucuacuuuguaccuuagguacccacuuaguggcuugguuuuaccaacuuugagagacuggauccaaaacacccuuggaguaagucuggagcauaaaacuaccucuaaaguaagcaaauaauaguuauaucauguucaguugugcuuuuuaugccuaaacaauuaguuauugucauaauuaguuacauuuguucaguacaguuaucuuguugagaagccaugaaguuuuuggcauuucuuuauguugucauuauuuuuauuguuauuuuguaauacaugaaguaguuaacucaucuguccagcuagauaugucaucccauaaguaugggcugucuuaugugauauuaugcaccguauucagcaugugauuguuucuaggagcuggaaauggcucaguagcuaagagcacuuaauaguauaacagagaaccuggggucaguucccaguguccacuugauggcuugcaacaguucuaacugcauugcugcuuuuaauaauuuaaaaugcuaggcagaauauuuguugggauuuguuugguuauuuccucuugguaacuauaggauaaauuuuaugaagguaagaccacagccucccaccucccauucucaucuccauuaacucuaauugcuguuuccauggcucuuagaauagugccuggccuuuuggaguaaaaauuaauacuuaucugaaugaauauaguaucuuaagagguuaagaaaguauagaaauaucagauacuuuuguuuauauuuucuuauagauucuuuaucccaaauacuguauuaauuuucuugauauuuaguuguauauauuuaacaugcuguuaagugcuuuuaauuaguauacuugaucuacuuucuuacuaaaguagcccugcacaugugguuguuaaucuuauuaacaugggaagaagcugaggcucagggagguugaaugacgugcucaguaugguuuaacuuuacaguugaagguuaggcuuuaagauaccaacugaaauugaguaccaaguuuauauuaaaucgugcauuuuuaaacuguccaauaauaguaguuuuauuacuuaauaugaguuucuguacaacauucuaaaaugguccuugaagagucggagaugguaaauuuuaucuacagguaagaaguuuuaauguaaagcacaccuaguaccuuuaaagcaaagguuugagacuucccugucuucucuauuguugauuacagucucuauuguuaguaacaaagggccagucauagaaacaaagagcaagcauugucucccuguuacauagauuaugggauauaaguaccaaaucauuuguacuuugcuacuguuaccaaguuggacucuaguacuugauauaucauauauugaauguuaaaauaaaucugcaucuuacaaucauucuccuagcagaggggaucaagauuuauuauuuagaaauaaguaaaaguuaccaauuuuauauuuuuagacauccauaaauccuagugaagcaccuccuucuauugugaaugaagauuuccuucaggaacuuaaagaagcucggauuuccuacucacaggaagcagaugaucguguguuuagagcucacgguaggcugcucacccugggcugcucaugaucucacugcucacccugggcugcucacccugggcugcucacccugggcugcucauguuuacacuguuuaccuuggggcugcucaugcuaguguugcucacucauacugggcugcucauacaggggcugcucacauuggcuuucugucuuuauguagaagcuuccuauaaguuaaaauuguuuugcauuuuucuuuuuacacaacaaaacaggucauugucuucacgagauauuuuugcucagagaagggauguuugagcggauuccugauauaguuguauggccaaguaagucguuuuaacucuuuguaucauuuuaguauagauguuuccauuauuuuucugaggaauuuauuaaguuuuaaugugaauuaaaugaagguaauggaaccuaguguuucuuugcaugagggcaaguuuugagagaacauugcaguuugcaacagugcauuuugaggcauuuggucaucuuaguuccagauguggagauaguuguuuucuuuuauagacguucacauacauaaguggaggcauguguacuuaucuaugaaaucuauuguaguugucuuuaaggauuuuauuauaugggacuuuccugauuugagguccauccuucaggcaggaccuuuuaccaucgugacugucaaauaguguggauauuuuuuguuuucaugcacugauguaaacuauguuuccacugguguguuuguguguguguguguguguguguguguguguguguguguguaaaacccaaaguuuccuuuagcaaaauuaacuuaaugugcuagugagaauccucagaagauagugguacuugccuuauaagcuugacaaccugaguuuaaucccuugaauuuggucccugaauccuacauaccgguggaaagagaacauuacagagaaauacaaagaagauacuguauaaaaggguggguggugggacaagggagugguuucugaucacacagucaagaacggcuuuuaaauaaguuaguuaccuucauagauuccauucugucuucacacacacacacacacacacacacacacacacacacacacacacacauauauuuguuuuuguccuucucuguguguguccuugucuguguauguaugggauggugcguaauuauguguguguguguaccuaguguaccuguguacaugcaugcagaagccagagcaggaccauuggcuaucuucugucucuuucccuuauugccuuaagagaagguuuuuuauugaaccagaaacucaacauuucugcuagguaugcugguuacugagcucuuaggauccaucuaccuuugcuucccaucugcccaaugcugcaguuauaggugugugcauccaugcuugguuuuuuauguagguacuggggaauugaucuuagguccuuaugauugcaagcaugagcuaauauuuauggagccauuucuuaaccauuaccuauuaucuuuuacacuacuaacaguaagcuuuauaaacuuaaucugaaagcuuaaaaguagauuuugauuaaaaauugcaguggccugaaguuucuugguagaguauguguuuagcauaugcaaggucucagguuuaauccccaucaaauccccaacaauggaacuauacagaggcuaaguauuuacagcuuuaugcaaacugagauaguuauagcauuuguaaaacaaggucugugcuugcauaaauauuuaucaguuugucuguuuuucuuaguacucuuuuuuucucuuuuaggaucuuagcacuuaauauuacaauuuuuuaguuuccuugccucaaaacuuuugucuuccaucugauacauuguuaaguaaucccugccauguugcuuccucuuuaaaacuccuucaugugcuaguaccacagacagcuggaguaggacuaucuuauuugacuuauagucuuccucagagaguuguuauuuagauagcuuuagcuauaaauacaaaggaaaggaauuugugugcuacucuaguuuguguaagauuuuauuuuauuuuauuuuuuuuuaggaauuaagaaacaguagugcuaaaguuaauuggugaaaguauguaugugaacugugcuauuuacgugguuugaauguuacuauucguuuaaacaggagauaaaacguccuuccaguaggguuuccuagcugacaguaccuacugaaccaaaugaucaaaguuaagauuacgagaaaugagacauggcauagcaccacugcugugaggugccuaccaacuguuuagucucuguugaaucucagggaaacaaacuaagagcuuuguuugaaauaacugccuaaaguucuucagaaaugucauugacauaaaagucaaagaaccagugugugauuucagguuugacucugguccgaaaagggaugcuagugggauauuagaggaaggacuguagauuguuuugucuauguuauuugauagguuuugauaauuagaucuuccuuuuaugagcuguuaauguuugggaaugugacaugaaguacauuuuuauacuuuuuccuaagucugaauuguuaaaacuacagagaaucuugcuuacagccauuuaacaugguaugaauaaauaaggaaaaguuagauguucaaaguuuuuuacugaccuuuaguuuguaauaguaugcacauuuuauuuauuuauguacuuauaguuaauauauuuuccuuuuucaacagcaugucaugaugauguaguuaagauugugaaucuagcuugcaaauauaaccuuuguaucauaccaauuggugguacguauuguguuuuucaauuuuauuaugguuaaauuuguccuauuuaaaauauuuguauuuuuauuuauaucccuugaaaacacucuuuuuugugauaacauagugauuguaaaaaauugguuuauaugaucauuuguguuguaaauacaagcugcuugagcuguuuaccucuuaagucauguuuuucuucuguauggaucauagguaaagauaguuuuuaacgcuaaauaagaaaauguucauuuaauaauuaacuuuuuagucuguguuauuuuagucuuuguggggaucauuuuagucuuucaaggcauccagugucaucuuuggaggagcuggaugaucguagaacaccaggagaauuaaaaguuugcuagugcagugauggcucggcaaggccucugacuacagaaagcuagcauuauguuuucauuguaaaguaaauugaucuuugaguuuauguuguuguugacuguaugauuuuuauaagccaaaggaaauuaccuucacuuuuuuuuuuuaaaaagguguaguuauuauauuuagaugaguacacuguagcuguuuuuagacacaccagaagagggcaucagauccuauuauacagauaguugugagccaucaugugaacucaagauguuuggaagagcagugcucuuaaccacugagccaucucuggagccccugaguuuuauuuuguguuugugagugcacuaucgcugucuucagacacaccaucagauccuguuacagaugguugugagccaccaugugguugcugggacuugaacucaggaccucugcaagaccagucagugcucuuaaccgcugagccaccucuccagcccccaaccuucacuuacuguauuggcauuggugaauagaaauuagaccucagcaacucuaggaguccuagacuccuuuccaacugauacugucccuuuaguuaguguacaaaggcaccacagugccacuuacuaugaauuuuccuuuuaccgaaaaugauguucuaaacaagaggugguuccagccacagguacuguacucgccauuggcagccuaaccuagugagauuaaguugauguaugcagauuacuucuuuuagcaauuggauuccagaggcuuauuuuccacauagacuguaugaaaauagcaauuaaacuuuuauauuaauauggggugauuguaguuaaaaacuuaaaauauuguauuauucauuguuaagacauuuauccuuugacacauuguuaagaggaaauaggaguauauuguuuaaauauuucaacauauuauuuagccuauuuuauuaucucuucacuaaagaauaugaaaauuugcuuuuuaguagcaagaucugggcauuuaacuuuuuuauuuuagucuauuaaagcuuuuugcauaagacaguuacuguaagagaaagacaauuauguaauuauaguaggaagaagucgaugguacuucuaguuguucaggacuugucuuuuuucucuuaagcuuccucuucacggugaucaguagcuuagaucuuugcuaauuauguuuuuggaguuccacaaauugcuagggcuuuccaugugugugauauccagggauggagccauagcccauugaguucaguuccauaguagucugcauuuggcacucagcaugaaaggaaggugaguuuguuuucaguguguuagcuuuugcaaaguagaaauaggugucagcgcagcagacccauuuguguucuguguacuggagcuguuccagaaauguagcgggagcaaaguauuuaaacacaaaguuuuguuuccuguuuugacaggaggaacaaguguguccuauggcuugauguguccugcagacgagacaagaacaauaauuucuuuggacacuucacaaaugguauaugauauucuaauugugcuuucugcuuaagcaucauuuucuaaauacacgguuuuacugcauguucaggcaaccagaagcuaaguucuaaggcacagaucuuggugcuuuagugccaaguuaguacauacauugaucaucugagaaucgugauuguaaagcuugagacaguggauaacuugaguaauaugcaaguaauguguaauuguguaccugccucccagacuuaaacugaugcuuuuguacauuugcuguggaugggugugagagcuguaccauguuaaggguuuaaccuggguugaauuuuaccuucauagucccaaguagcaacuuugugguuuuuaaguuugcaucuucuuugaagagcaagguagagguaacugugccuugccccaugagcauuacuaguguuucauugcauucgcucucuuuuaguuuuuagaacuuuaaaaacaaagcuugacgugcugcuuuguaccuauuuucucucucucuuuaaaaagaacccauuuauuuauuuacuauauguaaguacacuguagcugucuucagaugcaccagaagagggcaucagaucccauuacagaugguuaugagccaccaugugguuuucuggauuugaacucaggaccuucggaagagcagucagugcucuuaaccgcugagccaucucuccagcccucugucucuuuuaaaaaggucuuuuucucauuuaacuacuguauuuuugucacucuuguuaagucaaaaucauuuucuuaugcuaauuuauauaguccacacuuauuuuuaaggauaucuuuaugacaguugaugacuucugauggcucucuagaaaagggucucaugaacuuuggauguuucuccuuaggccucacuuucucugcaagugugcuuuccuuuugcccaacguuacugauuuugaagaaaauagguuauuuguaguauggaauggugucauuuaacuacucuuuuaggcccugaauauauauagucuaauagguuccuuccuccuuuccucccgccuucccuuucaucgugcuucccucuccuucacagaaacuuaucuuauagauagauaugacaauguguucuuuaaaauacauuuaauuuuauuuaaaaaucaacacauaaaacuguguaugcuuugggcuuaucauuucgauacauguucauguauccuuuguggugccaaagauaaccuugaauuccugacucuacuaucucugcuucccaagugcugacacaaaggugugugccaucaugccuaguuuuaugcuauacuggagauugaacauuucaugacguaggccagcacuuguagacugagcuacauccuuagaaccuguuuuuuuuuguuuuuguuuguuuuuugaguuguguaguacauacuggauauagcauagauauauauuuucucuagauuuuuuuuuuuaucaaaaaguauguuucaaccucaguugauuaaaacauguuagugcaaguauguaguuaccucaagagccagucuauugauauauacauugaauguaaauuauuaucugagauuccaucaaauuuucaaauucuuucucuuuuauuucuacaguuaaaugcuguuaauuuagcugguauaagacccaaagcuugacuguguuauaguuauauugaaauugcuguugucuuguaguguaauuuuguuuuauauaauaaaacaaaauacauuaaugcuuacuauaacucaauaaaggaaauauuuauguguguuaaauuuuagaauuuuuguauuuuagaauuuaggcauuauacuaauuuuguauugucuguuguauuuuuccccuuucauuauuaacuaaguuuauauuacuauuaagaaauggaauaugggcuggugagauggcucaguggguaagagcauccgacugcucuuccgaagguccgaaguucaaaucccagcaaccacaugguggcucacaaccacccguaaugagaguaaugagaucugaugcccucuucuggugcgucugaagacagcuacgguguacuuacauauaauaaauaaauaaauaaauaaauaaauaaauaaauaaauaaaucuuuaaaaaaaaaaaaaagaaauggaauaugucaaacauacaaauaaaacuuuuuugggauucaaaagaagauacacauauguaauauguauaugaguaugguuaacuaaaaaugccagaaaaauauuuuacugauaguuacuuaguaagugcaguuguugcagagaguauccagcuccucuuccugcuccuuugagacagggacaaggucuguguugcccaggcugaccucaagcuuacugggugguggcggaugaccuugaacucccgacccuccugccuguagcucuggaaaugcaggugugcaccaccauuuuggcucaguuccuuuuuuggagcaugaggcaggaauuuguuuuguuuucuacacauauuucuguuuuuuuuuuuuuuuaucuugggauuuuuuuuuaagugcggagaugccauguauuuauuauauuuaaauauauuagcagguuuuuuuuucugcccuauuuucugauucuuagauaugauuguuaauagucguacaaauagauguuucccauauacuguuuucuauguggaauaucuuauuuauuccuuuagcaacucuguuauuacauauuacuacugucaacauuuuacaaaugaggacucacuaagacuacuuaguuacuagauagcuaagcagugacuuuuaguuuaauguuagcacaaagaugaggguauguuucuauccagugcaugcauaauguacugcucuuguucaaugucacagcauagaguaaggggggguuacuuuccuuacuucucauuacuaccuugcuacugaagcuuugaauuuggaacuuagauauuccccaagaaaauguuaauggcucaaaggaaugagacuucuuuuccuuuguaacagaaccggauucucuggguugaugagaacaaucugacagcucacguagaggcugggauaacaggacaagauuuggaaagacagguauguuaucucuuuaauuaagcuuuuccaaacagugauuuucugugucugaaggaacugccuuuccacaauacauuguucacucagugaauuugcucaguuuuuauuguagguugaauuagaacugagaguacaguagugaaugagacacuauccccuacccucaagggccuuguacugggauagaaaguuggagaaauagacaauggaugauucaggcuaaguaagacuagauuuagauuguuugugucaucaaaaggggccagguaggaagaacuuggacaauuauguaucauagaaguuugacauuuaaaaugagacuucaauaaaagggaacaaauaagaacaaauuauguaugaaaaugccauaaugaaauucauuauuuggcacaauaacuuuaacaauuaaugagauaaaaugagacuggcgaaugagucagaguuaggaaaaaggggcucaguucugagaaggagugugcaggagcuuucaggguagcauuacuuuuggaacccuuaaucuuucuacucuuucucaguguuuaauacguuuuuaaaguuuccaucuauggauucuaagcaggcaguuguuaaaaugaauugauucuugagguuggagagauggcucagaguuucagagcgcuggcuggucuuccagaggcucugguuuaauucucagcagcugugcuguaacucacaacccucugcaacuucaguuccauggcuccaucacccuugucuggccucuaugggcacugcauccauguguacagacauacaugaugcaugugguguacauacauaccugcagacaaaacacccauacacauaaaaauaagaaucuaagaaaaaauaaaaauagauuuuuaaacuucccuaaauauggucaagauguuuguaauccagcuuuuauaaucaaaaauuaggaauugcgauuuguugguugacacaccagucccugaaccuuuaauaagacacaaugugugguuguugauuguauuuuuaaucuucuuucccuauuuuuaaaaaaagauuuauuucuuuauuuuauguauaugaguacacuguugcucucuuuuagacauaccagaagaaggcaucagaucccauuacagaugguugugagccaccaugugguugcugggaauugaacucaggaccucuagaagagcaguuggugcucuuaaccguugagccaucucuccaguccccuuucccuauuuuuugagaugauuaaaguuggccuauuugucacugauucuugaaaaauuuauuacauuacugagaaaaauuuuugaaauauuagaagcgucacuuaggaguaguuuuugugaaauuauagacagcaauuacugagagcugcccaacugaggcuguuuaccuucaggguggaaaggaacuacaccugcuuaaacucagcagacuuguugaaauauugucagagagcuuccaacagcucaagacuuuauauagcgaagauaaagggcugguuugaacuuugauaauauucagugaaagacauccaaaaggccuggauuaguccaccauuagcuugagugagagauguuauugacugcuauuuucuuuaagaacaaagaauggccuuuugggcuuccaguuuuauauccuuuauuauagcauuugauguaguauuuuaaccuuuccaaguuuuccuucuuuuuuuuuuuaaagguuagaaauaaaauucaaggaacauaucuccuuggaauuuaagugacauuuccuccaggaggugcuuuggagauuucacccgauaguugguuucucucaguguaacacagacgcacccaugucugcaguggcugcugcaggccgguagcugucucuacuggauuaccccaccuuaaacuccuguacccuuuagucuauaauucagaugagacaaccagcuuaaaauguccuguuuguuccucagauaaggcuuaaaaugacacaaacagaagcugaguagcagauuuuaaucucuuuaacuuauaaauuacauuggauuuuuguaugcuuaaauguuaaggcaugucacuaaugugccaguuagggauguuaggauuucuuugggguuuauuauagcuuuggugacuuuuuuauuuaauaaucugaggauaugugagcuuaaguuuuuucuuuccaaagauagcaucauuaauaauuucauaguuucuuguuuuguucuuguuucaacuagcuauuagcccuuccuuuaaauuacaaauacagagcuuagcugugugaccucaggcagguuucuaaccuuuaugcuucaaaugcaucuauugcagcagccacugcaggcacaggugcuucugggucacagugagagaagugguagugguaccucucaagguguugcuacacauuuagagcuucguuccauuaauuucuaucaaacauuuuauuucauucagguauaguaaacuuuuauggcuaaagauuuccaaauuuaucaauugggauuucuuuccugaaggguagaugaccauauccaguuccuagcuguucucguuccuugcuuggcuaauaggaauugcaaacucaccauuauaaaagcugaaguuguggggauuacauuugcaguggucucucaaauaucgauuauuuuguagacccccuaccccaucuguauuacaucccucugacuucauacuucccauauccaaggcccaaagcauagaaacgguucuuccaauaaacuuucccuuuccaacauggcugcuaaacuuacgggagaauuagcauuacaacaaucuuuaauuaucacagaacaucgauaaaucaaaauuauaauuggcaaauauguaucauguguucaaucauacuauggaucauuuuuguauacagguuauuuucuaacucugauauauuauacuaauagggcuagacugccaucuuuucaauuagaggagaauuguaagucugaaguuuuauauacuugaauguuuauuaaauuuuuaggaguaguguuguagcaguguggccagcugugcugccuaguuuuaugucagcuugacacagacuagaguucuuugagagauaagaaccucaacugagaaaaugucuucauaaacucagguuguaggcaagccugcagggcaguuucauaauuagugguugaugguggagggccauuguagauggugcuaccucuggguuggagguccugaggggucuauaagagcaaaccaugaugaacaagccaguaagauuuucaaauuaugagucauauuuuuuguuuuauuuuucuaauuguuucaguaagguguauugucauagaauaaguugcugucauuuaaaguguaccauuugacacugaacauuccugaagcacuaacaccaucagggugacaagacaaaccccugcuuagggauucaugaauucucucuuuuuuuuaaauuuauuaauuauuuauauguaaguacacuguagcugucuucagacacaccaaacaucucauuacagaugguugugagccaccaugugguugcugggauuugaacucaggacuuucugaagaauagucagugcucuuaaccgcugagccaucucuccagccccucaugaauucguuuucuucuaauuuaauaaaauugaggaaauaaugucaauguagauuauuugaagacauguaauacauugauaauuuucguuuuaaucuugcuuauuugugauugguuacuaaccucuuaaaaauaaauauauugaauauuuagugaaaaaaguaacaguugauguucuuucaaaucugucuuccuagaagcaaaauuagaaaauagaacuugcauugauggcaugugaaucuaacaauuuauauuuaagguaguggguuuacacacagcuuucaugccauacuuccacuuugauacauggguacaaacauggcuggcauacucugcaucccugcauggcuuaugugagaaauaaaagcaguugcugcacuggaugacaucagaugccaacacagauugaugggcuugagugcaggccacagugagcguacagauggcggugucuguaccauuggacaggagaugaccgagacucugaaaugauuccaguggaguggcuucgguguuguugcaguaaagggcauccauucaaccucaggugcugugcagauggugaagccaagcuaauauagaaaaaugagaaacaagugacuauuuaaugcacaagcaugcuugguccacaucacaaguaaaugaugguauugcaucugggaagcuuagccagauggcuguacauuaaaacacaugacuccuugagagaguuaaguacaggcaauuugcucagguuuucuggaggccugcugcauauuauauuaggguaggggaaagugagagaugaagugcuuuauuuauugaaaguguuaggugaauuuggcaauuauuuaagcauaaucugaucuccauaaguauuaaacauguuucuugaagggguuagggcacaaggaagagucagcuggcuuuaaaaacaaaguacugugaacaguaguguuuuuuugucccauaccuuuucaguuuuaugaaaguuuuccauuaggcaauacacacacacacacacacacacacauauacacacacacauauguauauauauauuuacuuacagguuuuaaugugucaaaaauacuagaaacagaaggaguugaauagauuguguugaaugcuguaugaaaugggaccauuuuugccaguaaaauuuaaaauuuuuccuuugcagcuuaaagaaagugguuauuguacaggucaugaaccggacucccuggaauucagcaccgugggaggauggauaucuacucgagcgucaggcaugaagaaaaauaucuauggcaauauugaggaccugguaaauuuauuucuaguuacugucuaacuuaaaauacacaaauaccuaguuuacaaguuuaucaagaguuuagucuuuuuuggugauauucuugcuguaggagauuuuauauuugccuuuucugaaggaauucuuuuuucucuguacaguugaagaaccucacugaaaugguucuguugaguaguuauauaagcugucauguuaaacaugugccagucuucugggagcacgacaguguugugacucugggccccuuauuagauauuuggugacauuuauugcauuugagcuuuucuggggauuaggugcaugaccuuggcaaauugguuuaccuuucccagcuucacuuugcuuuucuguaaaaucaauaauuuauauuagaacuauuauuugaguaaaggacauuaaaagaaaauuucaccaaucugauguauaguagguucuucaugauuuuuuuguuaauauucaguauuucgauaauauuuauuuaacuugauauuuuccugcaugaucuugcuacuuagccuaggcuggccucaaacuugcaauuuuccuauuuccauuucauuugcugggguuacaggcaggcaaugcugguaguugauuguacuuuagaagaaccuaugaggcuguuuaauugaaguaauauuccuaacauuguucuugguuugcuuuucaagccuaaguucucaggguuuuuauuaauacuuccguugagaggaauaucagauaaauuucacgagagacaguagcucuuaccaguauccaguauuuuacaugaacucuuucaaaaugcuucguauucuguuuaagaaaugaaaaacuacaguuuucuuuuuuguauuaaaucuaaacccaguuguagagaaaacuaauuuuggguuguagauuauuaagagcuuaauaagucaaacaaguacuugauagaccacugcaguguguaguuuacuuuuuuuucccuaaagauuuuuuaagggacaaugauugugcauacaacuaacaugcuuacugcaugaguuauuauguagcauauuauguuuuuaaauuucuuuguaacuuaaguguccuuugaagcucauaaguugcauagcuuuuauguaagugcuaagaagacugguaucuuagucuuuguggcuacaguagaacucacaaaaaguuucuuuaauagacguauaggcuuaaaaauacaauuaagucaugauacuaguaucuaauuauuagaaaaauguugaaaauuauuauauuuauccucaguguacaaaucacuaaaagaugugagaauucugaaggucaucacaacuuauggcuuagcucacuauuuaauaaguaguauuauuauaaagguauaauuuauuauaaaugagugugugugcaaguacagacauagauguaacggguguguggaauuuauauugcgcauuguauuaaacaggugguucauaugaaaaugguaacaccuagagguguaauagagaaaagcucccaaggaccucguaugucaacgggcccugauauccaucacuucauuaugggaucugaagguugguguauuuguaaaguuguuaggaaaauaugaaguuaaugacuucauuuugugaaagucugugauaucacacagucugugauaucuuugaaagaaugguaugcuuuauauauguaaagaguaaugaguuuuuaugacuuacuauguuuuaauucauaaagauuuuaauucauaaggguuuucugagaaugacuuacucaguuuucuucuacacuuuagucuuauauauuucuaaugacagugugauuuuuuuuguuuguuuuuauuuucaaaauuuuuagugaaucuuaaaaacagugguuaaauauuuuaacuuuguauauuacaguuaaauucuaucaggcugacaaagcauuuucuuucucucuuguuuuccuauaauuauguguuuuauuacuuaguguuggaugauuuuagaaacugcuuuaaauuccauuauucguguaucuuuuaaacuuuuguuugucauuuaaauuuuuauuuuguaaguaauaugcauuguuugcuugcuaauauuggauaggcuagaaugccauucuucagaucuuccaaauguguaauuccuucuguuuugcaagcugucgaguaaacacagaagggaaugguaugaguaaacuugggccuguuuuucagauuguggaauaggaacaucccuuaaauuuagagaaauaugauaaauuuaaacaaaguguuucuaacuuagcuaaagaacucauugcuuacuucaaaagaugguuugaguugaacagauagaguuuggaaacauuuaguguuauauucagaaaugaaagaacacuuauaauaacuguuguuccuacucugcuuggggugguggguaggaaguuggagggcagugaggagacuucugcagugagcaagaugaaaaaccaacugacuucucauugagcagcucauuuaagugggggguggggggacaaaggccauuuaaauccuuuggggaguggguagaggcuuuggggugaauguauaucuuuggguggggccaagguggugggaaugccugggaaugacuuauuugaagaaucccaggugcuugcuggaguuaggguuuuucugcugugaacagacaccauaaccagucagcucuuauaaggacaacauuuaauuggggcuggcuuacagguucagagguucaguccauuaucaucaaggcaggaacauggcagcagucaggcaggcauguucuacuccuucaucugaaggcugcuagcacaauacuggcucuuagucagcuaggacaaggguauuaaagccuacacccaagaggcuacaccuacucuaacaaggccacaccucccaacagugccccucccugggccaagcauguacaagccaucacacuggaaugugaccuuaugaggagaaaagaaguuuaaccuguaaccaggccaccaggcuacuugauuaccucaagguuggcagauguagggcuuguaaggcuaugugagcagggacauggaggcccagaacaaggcggaaaugguccaacuucuggcaggcucaagaugagauuuuagacaagccuugaccgcacucuuguuccaggcagccccacccccacccacuuugcagugcuuuucagccucacaaauaauuaaggcauucaugcauugguguuugguuuaggaccugggacuggggacugaggugcauauuuuacauaucaaagcagaccugucuuccagguucucccagcaucccuuaguuccugcucccaaccuugaaaauuucagcugagagguucuucucuauauaauccagauauuuuggucucuuucuuacucucuccccucucucuucuuugcacauacccccuuucucucuuucuuccccuuccccuucuuccuuggcuuucaucuuuagggccagugccuuuaauauauucuaacucagcuugaauugguucauuucauugguaaagaaguaaccuaucaaucaguucugaucuuugacaguaacaacaaagaaagaacaaacaacaaugucugcuaaugacaugguagagaucauaucaaguauuugaugauagauuagcuauuugugauggugguggugguagcuguggggguugguuuauguguacagguagguaggugugucuggguguguaggugauagguuguggguaggugggugcgugaguaccuuugcuuuguguguaugcuugagggugaacacaugugugcacacagucuccuugcuucaucaguauugcucuucuugauucauaccauuuucuucuuuguaguucuucuuuuuuuuuuuuuuuuuuuuuuuuugagacagggucuuuauuauguaguucugauugucuuagaacuuguaugaagaccagucuggccucaagcucagaucugcgugacucugucuccugcgugcuaggauuaaaggcgugcacuaccaugccugacuugcuucuuagcccuuuucacaauuccuuauagguaugugguccucucuaggaccuguauaggauuaugauuuuauauaauauuuuggcacuauuguuguaugaaggucuuuuguauguauuuucuuugucccuuaaauugcuguacuuuauuuuuuuuaaucuuccugugcuccuguuuuuuugguuuuuguuuauuuauuugucugcuuguuuuuagagggucuuacccuucagccuaggcuggcuuggcauuuacuguguggcucugaauggucuuaaauuuauaauccucuugacucaguuuuccagaugcugggauuucagguguuagccauugaccccucugcccucagcucuguuguguggucaacugcuuaagcaucccuucaguccuucucacacuugcaguccuuuaguguugagaacuacaguaggucgaagggaagcuuuucuuuuuaucuuugcuuagagguaauuuaaaguuuauagggcauuuuguuuuauuuauuuaaucuuuuuuuuuuccuaaaauugaagucauaggccuuguacagggaggacagggagaggacagauucagaaucaggugacaccauucuuuuugugccccuuuauuuuuaauuuuauguguaugugucuuugcauauguuucugugcaccauguauaugcgaugccuguggaggccagaagaaaguauugggugcccuggaauugugaguguugggaauuaaaccuaggaccucugaaugaucagccagugcucuuaaccagugaccccucccucgauccccauuaacucuuuuugacacuuucucuuaauaaugaaguuaccugagaguauauuuucaauuuaugugaggcuuuauuuguucaggaaaauacuugcuuuuuaauauuaaauagcauggguuuccucuuauggagugauugcacaggugggcauauuuuuccugauaguuuuuuuuuuguaguucauaggguucacagcuagauuagacuguugaugcuuuuucuaacagcacuugaauaguuccagcuugcuuucucuauaucuugcagcugaggugugaggccuuugagaccuguuuuuuuuuuuuuuuuuuuuuuuuuaaccccccugacuauucugaaucccuugcaauuccauauaaaagaaagaaguuagacccaagcucacaucguauuuauuuuauuuguuuaacuuggagucucugugaaaaccagaguccaggaaggagacaauuauggggaauacucuuaaguaaggcuaacaucuggucuuccaaacucuuacuagaaucauccguuaagucuuguuuauggcauucuaggaccucucuaaacuaccacuucacacucuuccauguucuucucacaaaccauauccaagagcccgagaaccacauggucaaguauagcaaaaccccauuccugaugccaguuuguugucugguuaccuuuuuaucaucuugacuaaauaccaggcacaacauuacuugugggaggaaccauuuguauuggucacagggcuggggagaggggguugugguaauggcagugacuugaaguccuggugccaggaacaugggacuucuugaucauauugccauagaccaagaaguagaaggcuuggguagaaguagggucauucuguaacucucacugcuuagauccugaagguuccacagacuccuaaacagcgccucaacagguagagaccagggguuuagacacauagccuuuggggguauuuuauuuaauaggaacauauuuuauauuagggaaggcuuuggaaaucugcucagguuuauuguaucgccuaguuuguggucuguccugaagaauacuguguguauaccugaaaugaauuuacgaucugcuauugcugaaugguauguuuuagucuaugaaugagggcaaauuuacuuaaaucauuguucagucuuaccuuugcuuaguucuuaaaucauugaaaaugggguuuugagguuuccaaguauucauuauccauuucauuuguaucaguuucugucguauauuuucacuuccuguuaucagcaccaucuuuuaauaauugugugucuucccaguuauuuaucauuuccaaguguuccucacuguguaguaucauucuguuuaagucagucuugucugcuauuaguacugugucugcauggcacaccuuuaccauauuugagucuagguguauuugaaagugugucucuugaaacaaccaugcauuucaauuauuuucaauagugcuucucaaccuucauaguguugugacccuuuaauacaguucuuuauguugugacccccccaaccauacaauuauuuucauugcuacuucauaacuuuaauuuugcuaugauaugaaucaugaaugaaaauaucuguguuuucuagucaucuuaggugacaccugugaaaguuguuagcccccaacaagcuugcuaccuuuggguuaggaacugcugauguauuggguacuguuagaggaaauuuucagcuauuuuuuaaaauaauuguucugcuccauguuuugucucugcucuaacaguacuuucauuauuuaucuaguauuguaauuaaaggguuuugauguuuuucagagacauuguuaguuuuuucuuuguuuuucucucuauucuuuuuauagcacaaugugucacaaucucugucagucagucuucaaguuugauacuccauuuucugccagaucacauguugggcaguuugguuuuuuuuuuuuuaacuucuuauugauucuuugugaauuucacaucaugcaaucccacucaucucucggucccuuuguaucugccaucugcccuugcaaucuccccuacccaaagaaaauaaagaagauagaauaaaaaaagaaaaaaguuucauggaagcuauagugugucacuauauauaucccacuauauacccuuuuguccacacaucuuuacuggcaaauguucauugcaaccagucacuguuaaguuuugaggccucuggcuucugcuauucuaucaauacuggauccucaccaggacuccucuuggauacccuguuguuuucaguugucauagagaucccgcagcuucaggacuagccuguuaccugcuccagcaauucauagaugggguagauguuugggugggacaacucgaagcccuggaucugggccuugguagugugugagccugaguauuggucagcccaucaggucuucugcgcuugcaccaccaggguaagcucgccagcacugccccuggcuagcucacacaaugcuacagccagcaaggaacagacagggucaugcucugacucacccaugccuuugccaccagggauagcucuauugugaugcuaaagguaagaugcagggcccauucucucagagcuauaauuagggaggggcagggcuagcucuccugcucucaugaccucugggccagcucaccugccugcugcaugaggggagaggaaggaaagggaggggaagggcaucucucccuugcucaugccaccucacucccuuguggggccacuucacccacacuucuguaaccaggauuagcugugcugugcuguugugcaacuucuuuaaaugaacuuuucauuguaguuacuacagcuccagaguuuucaguaguuuauugauaguaguucuuugauaugaauaaaugcuguuucaagugaaccuugaaaucauugcaaauaaaaaaaguacaaauggccacauacuaugagauuccuuuuauauaaaauauccagaauaugcauagagacagaauauauuuaugaauaauuggcuagggcgugggucuggaaauggagcaugguuguuuuuuuguuuuuguuuuuguuuuuuuuuccauuuuuuauuagguauuuagcucauuuacauuuccaaugcuauaccaaaaguccccccuacccacccacccccacuccccuacccacccacucccccuuuuuggcccuggcguuccccuguacuggggcauauaaaguuugcguguccaaugggccucuuuuuccagugauggccgacuaggacaucuuuugauacauaugcagcuagagucaagagcuccgggguacugguuaguucauaauguuguuccaccuauaggguuguagaucccuuuagcuccuuggguucuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggauggagcaugguuguuuaauugguacaguuguggggagauuaaaauggucuagauuuaguuuauaguaaugauuauacauacaugugaauacauuaaaagcuacuaacuuuagcauuuucuuuuaaaauaccuuuuauaucuacuuugauaauuugaaacauauauacaauauaucuugagcacauccacucucagccucauacuuucccugugccucccuaaggugucccucacaucucccuugccucugccuccgccuccucguccuccuccuccuugcccuccuccuccuccuccuccuccuccuccuccuccuccucgauuuaguaacucauugaguuaagugaguugccuauacaagcaugggcaacccaccaguggccacaucccugaagaaaaauaacucuuccuccuguagcagccauccucuaccaauagcugcucaacaguagagcccuaaagggcaccuacacaaucugcuggaauuacugacuggcuugauuguguggaaguagccauagcugccucugaguucacgagugcaacaaccacaccauguccagaugacaguauuuuucagcacucacucuagccucuggcucuuauauucucccuguuucucuuccacaauguucccugaacuuugugguguugauagagcugucccauuuagaguugagcacucaacaguuauuuucaccacuuuaaccaguuuugcacagacugaagccuguugcaaaaagaagcuucucugaucuugauagccaacucaucuguggguauaaacauaacuauuuacaagguuguuugucaaugucauguagcgaaacaauaguagucccugcccacccuuguacauacacacagggccuaggaccuuccuagccacuggcuuuuggccaguauuacaguacacuccuauagaccaggccucagauccaaucagaaagcaguuguuugccucccuaacggucauggcaggauuguggccaugcauccaucuugccuggcugguugauacuguaguguucgggguccacuacuauaaaagguagucaacagggagaaaacuuccagaucaguucagcaugauuuuucuguuugcuggacccaaaguguauugugucuucaccaguaggguucuaccaucuaguuaugguggguaaccaauaggauaacaauagccauuauuuuguuuugagggcuucuagaauuauaaacgggugaucauugaaauuauaucccaaagauaugggaacaaaaaacuuuagucauuuuaguuauguuuucuauuuuacauuuguuuuuauauauuaaaauguuaguugugcaaacuuccagagauuuuugugaucaugcaaauuauaagaggcucauauuuuaaauaagauagaaacaacagauauauguaaugaauauaucaauauaucaacaacuaaucagucugauuuauacuucacugacucagacuagucuuuaacacugugcguacaucuuggaagucacucuagggauuccaaacaugaucuggacuuugauuuccagugugguaacuaaguucuucaguuucauucacaucucucuuugcacacuauuuaaaagugaucauugaaauauuugcuaaugguacacuauuuguacaucugaaacuagagguuugaaagcauggaaacauuugauuuuagguuaguuucuuucaguuuaaucucuuuauggcccaaacaguaaagaauaugccauauguauuuuuuucaugcuuccuacucauaauuauuuugugucugaauacuuuuguuaagagugucucaguaaucuguuugucuuucuguguacuaagucugaggacacaaggcaaggucauaguuucucggaauccuucagucauuucagaguuagaaaauuagcaucuuuuuggcccaguaaaucuuuucauaguaaauauugacacaucagaauauaccuuugucaguaugcgugagaugcaucaacuugcuucucuguaguuuucuucuaauguguuauaaugcguaaaaaccauuuaagaguaacuuucuuggugaaagcuuagaauguuuuaaaauacuuauacauuaaaaaaucuaaagucauuuuugaaguuauaaaauuugcuuaauucauuuuagaagacuugauuagccauuauucccuguauagaggagaucaaauaaauuuaauaaauaguagaauuaaucaguagaaucagucgauuaaauagauuuaaauaugguuuuagaaaauugccaugugauaaauguauuauuucccuucuuuuucaggaacucuugguguaauaacagaagcuacaauaaagaucagaccaaccccugaguaccagaaguacgguucgguggcuuucccuaacuuugaacaagguguagccuguuuaagagaaauugcaaagcagguaaaaacaaaguagaagauauauaucaauuauauuuaaaaaauucugcuauaauugugaugcuucaaggacucuuuauauuuaguuguguuauaguuguaauuguuuuaccacauuuuacauagagaaugacccccuaaguacacuuguuucauucaguaguuacacugcucucaccccuaucucgugucugaagaggccugugugauuugggcccaagauaagauaugugcuuugauuccuggcuuuaaaugauucugcuuuguguggaaugcuauauuuuaaauuauuuuggaauaacacauuuugugaugaauugaaaugauauuuaacuuaucuuaaauaaaacauuuauugaaauuagaaguagccacgugugguggugcauauguuucaucccagggcuuggaaagcagaagcaggcggaucucugagcucauagccugguuacacagugaguuccaggacagccaggguuguguaaauagacccugucucaacaaaccaagacaccccccccccaaaaaaaaaaaaaagaaagaaaggaagaaagaaaaagaaaggagaaacuagaguuaaugacugagcaucacuaaccaccaaauuuagaaguuuaaaauguagauaaguguuuuuauuauauagagugugcugguaggugcuacuugguuuuauaguuuaaguaauuuuucuuucuuacuuuuuucaagacuccuuuuuuuuaauaauuaauuuuauuucaugugcauuggugucagauccacuggaacugaaguuacagacaguuguaagccgccaugugguugcuggggauugaacccggguccucuggaagggcagccagugcucuuaacuacugagacauuucuccagccccguuuguaaucuuuaaaaaagaaaaaagaaaaacaaacacaaaaccaccucuugccuucugucuuucuauaaagaaauauauuaucauuuuucccuuuuccuuuuuuuaaaaggacuaaaucaugccagauaaccucuuuauuucauucuaugucuuagugugaaaauaucuuacuuuacucauuguuugaacugcaauaguuuauaauaguuuugacucucaucaaaugaaaguuaaggcaauguacuucaacccuucuugcuuucucuaagacauugaguuccuuagugcucuucaucagguauaugaaggggaaucuuauuccuuuccuuuuucuuuuucuucuuuuuguuagugagucucacugacuagcuuuggaaagccuggaacuugcuauguagaucagucuggcuucaaacucacaagagauccaccugagugcugggauuaaaaacugggacacccacuauacuggaaggaaacuuuuugauaucaccuguguaggucagcuuccuaguuagcacucaagaaaauaucuggccaguuauccauauucaaguuggacuauaagauagugaaaugcauagguauuugaaauuuuugcuuuuuaauuuaaagaaaguaauuggaaguucacuaauuaaaaaauaaaacaaaaaauuuaaauauguuaauucuaucuaucuaucuaucuaucuaucuauccauccauccauccauccauccauccauccauccauccauuuauccaucuauaauuuuuuuaaaaaccagcucucagaauauagccccaggcuguauuaaagacauagucccuguugucuguaggucaaaaacauuaccgguauuucuaguuaaucuauauugccucugguuuuuuagcaaaagaaacaugaaugccaaaauagauuuuuauuuguuuuaagaugcccauucauucauucauucauuuacucauucuuucauuuauauuuaaaagaguagaaagcuuuguuaccugcaucaggcagagugaacaaagagguucuuuccaaaguggucgcuucuucaacaaagcauuucaaauuuuauguuagcaccuauacuuacauaugugggaauacacuuuagaggcggguacauuugcauguguaguuuaaggucauaguucaagaagggaagauggauagauuuagggacauacuuaguuuacaggaugaaacacuuacuggaaagguuaaaaugguagaugagaacauuugggcauguucagcuuauguuaaaagguggcagaccagaauuccucuggacaugcuuacccaccuccccccuguacccuccccaucuaauaugugcucauauuagaaggugucagagaagagcugcuuguauuguugaugagacuccuucuccuucuuguauaaaacaacaaaacuugccccuuaacuccuuuuaaggaucuuagauacuaacuggugacugacuguagugcgauucacuggaacauuuggaauagagggaauaaugauccauagugccaccaugugguugcagagcagaccagccagaaaguaccuggcuggacugaaguuuggaguaguuuguguacuuaguaauaaauagcuuuugcagacgaacuguauagacuaggaagauugucuuauuugaaaccaauuuaaaaaucuggguagauaauaguuuauucucaagcauuguuccucgaauggauaagaaugccauuuagugguaucccauucuuuagggacccacacauuucaugccuuauaaugcaaauguacagacaucauuuggggauggauacaaacaauuuuuuaaugguuuaagagauaauugcccuuacuggcuuacuaaguagaaaccucaugccaauagcaggugcuauauuuuguucuccuuuucuaacaguauuuucagauagaaaggcuuaguugcuuaguuugagauuuggaguuucaguugauagcaugggaauuuaagauugacuaaaguagauaguguauguuuuaugguugugcccaguucuugauugaaaaacauguuuguaauuucacacuuucauuuuuacaauauuuucacuuaagcugcuuucaaaauuucaaacugugugguagaagaguucaauucacagcaaccacagggcagcucagaaccauugguaaggggaucuccucuggugugucugacgacagcagcgguguacucauagaaaagaaagaauuuaugauucugucuuccauguugaaagagggguaucucuugccauucgaagaaaacugacuaguauaaaugagucaguuccuugaaaacuggccccuuggguguauuuagaugacagccucuccuucaccagucauaaggggugcucuuuucugacucucucaccuuuguuuucaucauuuuuuuuuuuuuuuuuuuuuuuuuuuuuuuuuuuuuuuugguuuuuugagacaggguuucucuguauagcucuggcuauccuggaacucacuuuguagaccaggcuggccucgaacucagaaauccgccugccucugccucuguuuucaucauuuuaaguaauuuaaaauuaacagauauuuccuuauguuaauguagaucacaucaggaaagaaauaguuugugagcucuguaaauucugcaggaguucaaauaagcugaaaaaauuaguuuugauauguacuuuaaaaaaaguauauuugaacauaguggagcauauguccuucuuacugguugggacaucuucuggauauaugcccaggagagguauugcgggauccuccgguaguacuauguccaauuuucugaggaaccgccagacugauuuccggagugguuguacaagccugcaaucccaccaacaguggaggaguguuccucuuucuccacauccucgccagcaucugcuguccccugaauuuuugaucuuagccauucugacuggugugagguggaaucucaggguuguuuugauuugcauuucccugaugauuaaggauguugaacauuuuuucaggugcuucucugccauucaguauuccucaggugagaauucuuuguucagcucugagccccauuuuuuaaugggguuauuugauuuucuggaguucaccuucuugaguucuuuauauauauuggauauuaguccccuaucugauuuaggauagguaaagauccuuucccaaucuguugguggucuuuuugucuuauaaguggaugcucacagucagcuauuggauggaucacaggggcccccaauggaggagcuagagaaaguaaccaaggagcuaaagggaacugcaacccuauagguggaacaacaauaugaacuaaccaguaccccggagcucuugucucuagcugcauauguaucaaaagauggccuagucggccaucacuggaaagagaggcccaucggacacacaaacuuuauaugccccaguacaggggaacgccagggccaaaaagggggaguggguggauaggggaguggggggggaggguaugggggacuuuugggauagcauuggaaauguaaaugaggaaaauaccuaauaaaaaauuuuaaaaaaaguauauuuguauauucagcaguaacuuuuggguguacuugcuacuuauaaaacgcaauugucauuauaagcuaauauuuuauaugugucauauuuuuuuccuuucuaaagagaauaacuuuggccagugauuuagcuacuuggguuuuuuacaguugugauccacugaaaugaaggucuuucauuguguggcgugcucuuugccagaguuacuuagaaguagguauugucccuuuauuaaacugaaaauaaaacuaacguuaugauuaggauacuugccuguuuuuguagcucuuauaagcagagggaaauauuuaccaaauaauacauacuucaugcuuaaaaaucagaaauauuugucuuuaagaagaaauaucugguuuauaauauagaucccuaguuauauauaugcaugucauuuccaggaugaccagugaguacuaccaauagcuuuaaauauaugauuucaccuauauuaacucugacauaguuagaggaggaaccugucuauauuuaaacuuugcauuucuagaaacuuucauucaacacauaucuuucauccaccuugaacuuuucauuaaucuaucauuggccuuguguaggagcacuguaaucuuaaugaaauaaguaaugugcaaauucaauagagaaguucucaguuucuugguaauuaaugauacaacauaucuuaacuucacugaguuuaauuuugcauagcauugucaaugggcugaauauuggaacauuuguuucugauaaacauggagaccuuuuauuuuauuuuuuugcuuuuuuaauuaauuaauuaauuaccauucuaaaugcuguccccugcaaccacuccuacccucagaggcccuuuccccauuuccccuuuucucccccuggauaucuugauaggcuuauuuaggaauuugagcaagauguuuggcuuacccuuugaagaaacaaaccauuucaauucaaagcuaacucacuagcuguggcagcccagacagagggccauucagugagauucccuuuuaauucaucuuuaagaacuuaaaguagcagccgucucagggggaauuagaaggugcauuacuacugaacuuugguaaaugcagucaagucagagacauccccacucaugugccugaucucagguggaugcuuuucccuagcaaggggaguggguuaguguaagaaaaacauuuuccaugaaucuuuugagguauuucuuaaauaauugccuuuuuaaauuuauaaaguaguuagauugagauaucuguuaaguuagcacagagaguaaugcuaaauuuuacuuuucggguuaagguucaaguaaauuccuaguuguaauacucuuaaaggaaagaaauuacuagaaauuugucuuagucaaaucuauacucauguuuugaguucaguguuuuuauuuauuuauucaucaagacaaaaugauagaugguuuuaaauuagugcucagcaguuauuuuuauaccuuuugguguuauuuacugacuguauggcauagauagguggugcaagucagauguacgagaaauccuaguaagugcacuuaauuauuuucuuaacuuuaguacucaacuuuuguuugcauauuguuaacauuuuuuggauuucuuaaauagcccauuaguuuguugaaacauccccucuuagguuacuucugacaccuaccagcaggggucacuguagugccagggcuccuugcuugccugcccuauaguuucaguguugcuuacuggaugguuuggugugacuuugaacucuuaacuguucuuagagaguuuauagucucuauccuugaaagaggauugagucugcuuucagcucaaccucccaguuaguuuugaaagcaguggaaauaaccugauuggugcaggguuugaugucugcguauaggagcuucucuuugauuaguugcugugcuaaccuuuuuuuauuuuuauuuuucugagacagcccuggaacucaauaugcagaccaagcaggccucaaacucauggaguucuuucuguaugccucugccuccugagugcugggauuaaaggcaugugccaccacuaccaggcugugauaacuaucaauuauuuuaaauucuguuuauaaguauauuuagaaugauauguaauaacuuacaaauuaucaguugccaaaguccagcauacuaaccuacacacuauuguuuuuauuugaauucuuugcucaugagaauuuacucaagauagcaacugaaaauguauuucuugacuuuggaaaaaaaaaaugaguccuugacuugaauuugacaauuucuaaaauucaguguuaaaagcuugguaguauuugcuuauguaauucagccaccaaguuaagaucacacaaaguuuauaugaauauugguagcugcaugauuuagcaagugcucucaaccuuccuuaccuuuucccccauuuaauuuuuuuuuauuuugaaaaauuuauacauagaaccuuggaauaaauauuguagggaucaccugcauauucacuucauaggucuaauguuuucuguuuguuccuuauguacaugauuguggacuguugguaauuaaguugcagacaccauagcacuugacuccuaaguauuucagcagucaucuccgaaaaaaauuaauagggaauagcauuguuuguaaccacaauuauaggaaaugauaaucaagauuaugauuucuaaggaauuuuagcaguuuauuucuaaacaauauuuuuauuugcauauuuacgaaaguugcauucuaauaauuaaaucauuugagagauagaauggcacuccauucuguauccuccaggacaccuucgaccauuuaguguuuuacuguaaucucgcuuacuacccagcauuucccuuuaccaccugacaaauuuucuucccugcccaccagauuggcagcugcgagaggcaggccugaacuuuguugucaguaguccuugaugggcagcauagcccaaccucugcaucuuaaaaguuugcccuaccaugcuuuguuguagccuuuagguacacuuuuaaucccaguaccugguaggcagagggaggcggaucucuguaaguucaaggucagccuggucuacauagugaguuccaggucagucuggcuacacugugagacucuguuucaaaaguaagaucaaagcuggauagaauggguagagaacaauggaacugcuuccagcuuaaggagauaaaaucaaaugcagauucuaacaagggaucgagaauaaucugugguuucuggauguguuucuaccucagagagacccaguagcccagcucuccuccugaccacagcauuuacugagaguugucuuucuuccacuuccuuagcaugcacuuguguggcuuguuuccaugaauaacacauacccuugaagcaggugaacuggaaucuggcugauggccacagguagacuguacacuucucaucagaaauuuaacaccccucccccaaagucucugaauucuuuaauauuuuguggugugcuuaugucagaacauauaaacaugucuguuuauagauguuaucuugugcacaccuauagauauuuucugcuuauuuuaggaagaaaggaaauuugaccuaaucagcuuucauauauuuuauuagaagucacugcauucauuuuauuacaggcaucuggauuuguaaaugugaagaaaauugacucaccuuuaguguggaaacugguggugauuuuaggaauuucuaaccaaacaauaauuccuuuauaccacacuuaaaauuauccugauuguaauuuuuuaaacuguuaauuuuuuaguaagaccacagaauggccaauauaauaguuuugauguaauuuuugauucaaauaugaagcuaagaacugugugguuagugauacuguguguguguguguguguguguguguguguguguguguguuacuugaaacugcucaucaguagucaggaucuuggucucugcuguuucguaguuauucgaccuuggacaaguauuuuaacuucauccacucuuguaucuaacugaaaaguaguuaauacagguuaugcuucugugacaguguuguugauaagcagggcagcaguuugaaaacagcacccuggauagugggaguugguggguugucaccguguguauuagaucaucuuuuacugucccuacagaccugccagugacucugaaaagucacuugaacuauuucaucuuuaguauuuagaugaguaaauaaacaguuuaagcuuuaaaauaggaaucuuauuaauccuuuuauuggguaaaauuguguuuuaugcuuuauaauaauuaaagacuuguucaacuaaaagcaaguaauagcaaaaauguuuuaaugcauauuuuaagcucuuagcuaguuuugaaacuuuauagauuuuauugauaaacaauacuuugaugacagauguuuggaaaguuuauggcaguuuuugaaggcugagcaaguaggauugcugagcggagguuggagacaucuggucaacauagcaagaugcugucucaaaaaaauguuuacagcauuuuuuaaagcaucugcucuaaaaacagcccuugguagaacuuuaguggucuuaaaaucuuguguaggaaacaauaauccaguuugggccucauacccuuuuauagcuuggucgucacaaaguuaauagaaugcaagaugaauguauugucugcagucucaggguuagugucugcauucucuucucauguuuccauucguuccuacuuggacaucugcgucugcaaauccaaauacucccaaaucugaaaugugguguugguaaguuguuggugaaaauaguuggauuucagggcguuuuggguuucagauccacagcugaagauuauccaccuugcaccugcugucuucacuuugcguuuuguguguuguuuucuuccuuguaacacuuaguuccuagauauauaugacaccggaacagccuuuuauucuucacacagaucuccuuaaccaucaaaguuuuacugcuucuuacauuacaaguaacccugaacgaguguagagcucugucugcgugucuguauguuuuccuuuuaaaauaguguggggaaggagguaaaggaaggaauggcuccuagaguugucuuugaagauacugcagauacuuuuuggaaguucuuuagcauauaaaaauuuccaucaguguuuuccucauuuuaaaagugugcaagaggcuggggaugcaucugagugguagaacauuuacagcagguguguguauggccacaaccuggauucucagcccuguuaaaaaaaaaaaggaaaauggaggagaugaaggagaaaaaaaccugcaaaaaccuacuacaguacuacaaaauuugaaggacucucuauaaagcagaaaagaaaaacuuucuauauaaguggcagcagaggaaagagggacgaguuuucaggacugcugugaccuaccugccggguggcagcuuagggaagauugagagcaucuccaggcauucauugguugauugugcaauguuuuuuuguuuuuuguuuuuuguuuuguuuuuuuccuuuuucuuuuuuugacaggguuuuucugguaacccuggcuguccuggaacuuacuauguagaccaggcuggucucaaacucacagagaucugccugcccaugccuccugagcacugggaggcacacaccauuugggcacgggccaaaaugugcaauucuuaagauacauuuuuacucuuugaaaaaaaaaaguucuauuuugcuguaaaauaguccauuuucaggacuggcauuucuuuuuaaguuauugccaggcaauaaguauauuuuauugcuaagauuaaaagucugaauauguaugcauugcuuuuauauagaguucuucaaauauuuuuguaagcuacugguguuuauagucuucaugaaaugauauaagccauugagauccuuuucuuuuuaugcgucuuuaggagcuaaguccuuacauaugucaacagucagguccuguuggugugacauuuuaguuagugaguugaguugacucuccaccuucucuuucuuaaacagagaugugcuccugcaucuauccgccucauggacaaccagcaguuccaguuuggugaguaaaguacagcaguuuggaaaugugcuguuagcccaggguuuccagaggacaguggcgcaugccauggcacugcccgucacaggcucccagccuaaggagaacucagccuuguaagcgagggcagcaggggaggagggcugugggcagcgcagggacugggcuuguggggaugcuaggcuucauucacggagcuuuuccaagguggaagaggaacgaacacaaggaaaugcuucuguaagaggcugcacgugaucugcaucuaaggggagauggaggucugugggagccgucugccuuaccaggcuugauccccuguuggcagagcuggacuugugagagcacaguagcaugacuuagagcuuuucagauguuugugugguaauuaaccugucugcaguaggcuuucucuguggagggggcgucagucaucuuugccucagaaagcucuuucugacggucuuacucagggugaguuaggaggagcuggacuggaggugaagcuucaggugguguaacaugagcguggugagucugaagugcccugagcagagugacagccgaggaaaaggggcaggucuucaggaccgccauccgccugcuggguggcaagcuuaucgaagacugagaacaucuccaggcauuaauugguugauuggcagugggguuuuggaguuacaguggauuugggguguugcuggaauauuuguaaccaugcccuggggucggcuaugauguuuuuguuugcuuucuuuauugguauauaguuauuaugcauuauauuggcuuucauacugagaaugucuuucaacuauaucauauuuugaucauaugccauauaucccuccccuuuggccauccccuuuuccccuuaggcuauagcauuuuuaauuccuugguauccauugaagauucuguuuguauauucucuaauggcuucaugauuaagcaauuaaaagagggauucuuagcacagcaaguguaauccaguguccugcaccagccauguugcugauugaugaauguuuaugucauacugguuaaugagguauaaggcuuauuauuaauugugauguuuuuuauuucuccugguucaacccuuaauaaaauauacugaaauugucuauuuucaguauauugacaugaucuacauauuuacuuuauggaugaggcuucucaaauguaaggaauaguuuuauguuuuuguaucucuugcccugaucacaugucguacauuuaaguguugguugaauuaaucauugaacuggcaaaauagagugaacaacuccucgguagcuauagcacaacacugagcacauugguaauaucacaguuucucauauaccaccuuuuagcugcacuucaguguugaaucuacaggcuaugagugguagaguuguggucaaacucaguuugucugauuccaaaguuccaugcuuuagcugugucacgucacuucagaaauacauuguuaacaaauccuuuaaaagaauuaacauagcaccaugaaguugaugcuguaugcuaaucaaugcuacuuauacuuucugauuaagaaauguagaaauuuauuguaaaguuaaagaacacuaaccaaaauauauuuggcauguaauaguuugauaggcaacaauaacaauuaaaaaaaaagguagugaugucuucaaguuauuauugauggucaacaccguuaguaucacuuauauaauaauugauuuaauucaguauuauguauacguguggcugacuucuaucauuguaagggcaaugaugccguucagagucagcagauuaaggugaucauggaucccuacggauuauuuacauagaauuaguaacauuuggaguuuuagugcauuguaaaaggauaaauggauuugaagacuuguauaaagcauaauuuaagucuuuuguaagaaagacauacucaguacuuuagugguacuggugauaaaagcuaggcuucaggcuugcuaugcaaacauucuaccccugagugauaucucagcccuccuuuuacuuuuugaggugggaucuuaaguugcccagccuggccuugaacucaaucuuaguucagguaggccuuaaacuuucaauucuucugccucauccccuggaauaucugggaauacagcccugagccccagguaguacguuuauguguuuaauuucuguuauuaauauagaauggguccuaauuguuuaaaaagaaaaaagaagcauucugaugaugugcuauuuccaaguuuauaggugcuaaaauuauuuuuaaaagcauaauuauccuggagaaacaucuauaaaaucuuucaggaaagaaaaaauuccuaaacaaaucaacguuugauucaggggcucagacacacugcugaguuggucucuguccacuccuguucauuuucuuugcuugcuaccuuguucaucuccucuuuuuaacugucucagccagucagggcugucucuuggucucugcauaagaccuaguuuacuuagucuuugccuaaccuaguuuccucacuacaauuagcaaaaauguagcaauuaaguauuauauauuaaauuuuucacuuaaaauguagaugaauuggcacaaaagauuggcagugauugguuuagaaacagcuaguuugccaucugcauccuuuuaaaggaaggcuuaugcuucagaauccucagccuuagaagacuagaaaaaagccgggugugguggugcacgccuuuaaucccagcacucgggaggcagagacagguggauuucugaguuugaggccagccuggucuauagagugaguuccaggacagccaggacacagagaaacccugucucgaaaaaccaaaagaaaaaaaaaaaaaaaaaaaagucuagaaaaaaacuuuauuugaagacgauuuuagguuugcuaaauacucagagguuuuuuuguuuuguuuuguuuuuuaaauucugcauaaacaggauggcauguuuuucugaauugggcucauagcacuaaggccagaugugagacuugacuggaaccagccccagagcugagaaguuucuccucuuugaaaugaugagaaaacaguagaagguucucauucaauuaggcuuaaucugcaacagcgauguuaauugagcaggcucugaaaugccguuuguguuauuuuggcaauuuuaacucccugagugugauuaagaaagcaauugcuaguuuuaugcuaagaauucuggaugaguuaagaauuaauuaagaaauaacuuuaaacuuacguggauuccauauuugguuuuaguucugugugauuucuguauaauuaaaaaauaauaauagcaauaccagccacuacuggguuuucuuaaaauaaaaauuaaugaggugauuuuacuggguguaaacaguaccauugaaagauaacugaaauuaugcauaguauuaguuacaugugguaauuugacuggaaaacaagcaaacacugucauguuugaaagaauguagagguaaagaucuuaauaaacauccauguaacuuacaacugugaaaacucgcuuucccuuaggguacuaaauuaaagccaucuuuucaucucaaagacacauaaucugcuauuaauuuaaacuguaaccuuuucccuucuuaggucaugcucuuaaaccucaggucucuucuauuuuuacaucauuuuuggauggauuaaaaaaguuuuauauuacaaagguaagacuaaaaaaaucuaaaauugugcauguauaggacaugaguuuucuucuugccuucuggccauacauaccuccccaaaggcuuuuuuuccaugcuguguuguguuuuauguuggagcugguauguuaguuagcaacuggacugugcaguccguuucaaaagccuuagucugugcuucucaagucugaaaagaguccugcauugagcagucucgagcugaccacauuuucuguacuuugaauuuucuuuacaguuguacugagaagugaaaugcggguggguucauuugcucauuuaaccuuugauuucugagaacugagaaguugaaagugguuacuaguguguaucgccauggcaacagugugugucauuuuguuguuguagccauggggcuuugcuacuauuggacuuauuuaggcaauacuucuggaaacucuaagagauugaaccaaucuccaucuuugucuuuucaugguauaauuuuguguaaauuaguaaguguaguccuugugcuagggacaguaacuuguuucucacuguguuuugauacacacccuuugaguaauggaauuaucaggugcccuuugcauggauuugguaaauaauguuuuuccaaucaagcaccucucuuuuuaauaguuuuuuuucuuuuugaugucauggauucaaguuuauguauuuuccuaugacugaucacuucuaagcugagaaaacacuuucucuucuaguaugcugaggacauuucacucucccacccccaucauguucuuguuuuguguuguuugugcugcaaaugaaacuuagaaucucauauacuaaguaugaggucugccauuaagcuauaucauaucccuuaccugguuuaauuaacacagaguuuuguugugguugguuuuuguuguuuuuguuuauuguguguguguuguuuuuauuuuauuuugagcacuugcuacuagaugaagaucuagauugaucuucaccuccuccuucccuguugcugacccuugugucaccacuagugacugugaguaaugccugcuucuuuuuucauugaugccuaaggcaucuuauuauauacacuacuaccccagaagacaccacuuugacacaguuccuaaugcuuugaaauagugucuguuuugguuuugaaaaguuaaaaagauacaagcuuguuuuuucuuuuucuuuuauuauuuggaauuuucuuuguuaccaccaucaccuguuuuguucauuauucuaaaaaaauuuuagagauuuguguuuuuuaaaugaccgcugggauuuuuauuauaaucagaauauucuaguguaucaauuuggacaaguauuggcaaauuugaaauuauucaugcauccaggagcaucuguauugucuuuuuuuuuccauagcgaauuuacauaucucucucucucucucucucucucucucucucccucucccucccucccccccuuucuuucucucuaaagauuuauuuaugaguacacgguagcugucuucagacacaccagagaagaggguaucagaacucguuauagauaguuguaagccaugugguugcuaggaaucgaacugaggaccucuggaagagcagucagugcucuuaaccacugagccaucucuccagcccuuuuuuuuuuuuuuuuuucuuuaaaauuaguuugguucuuugcacauacaaggucuuuccuguuaauguuauauaauaugucaugguugguuuguauagauguuguuagcuccaaucagcuguuuggcucuacuaacgaguuuuguaauuuguguuugguguuuucaauuacaguuaaaguucuggcaggcuaccuguuguauuacuauaucaguaguauuuauagucccagaguauauuuggaaaugugaugauuuugugcaccguaguuucuuguguuccuauagugcugggcaucaaaccuggggcuuucugcaggccaggcaagugcucaccaaugagcuguucuuccggcaguuagugcaguuagugccugccguuccuguuaauggaugugugaagacccaaagcucacuauuuagcaggcugcuguaauugaggccauauaaagaagaaaagagcaaaaugcauuucuguuuacuguuuuacagaggcuaaggcuucacuguaauaauacaguuuuauuuuauauuuuguaguuuaaaggauuugauccaaaucaaauaaguguagccacauuacuguucgagggagaccgugagaagguucuucagcacgaaaaacaaguguaugacaucgcagcaaaauuuggguauggcuuauaguucauaaccaagaggaaguguguucaaggugugggggccucacacagacugcuuguguugcauuucuaauuuggauuggcuauuaaauuaaucuuaguuuaugaauaagccuaaaaaacucuucuuacuccaaaauuuguaggaagaccuaauuuuauacauacauacaauaugugugcuuauuauauaauguuagauuuauaggacugaugugucacuuuuaccuauuuuuauguaauguauacagguuauacagugcuaaauauuuugcuuuuccuagauuuuugcaugaaugacaauuuugugaccuguuauuuguuguguaagaaugagacaaaauugucaggguauuaguucauguauaaaguaugcugcuaguguguuuuuaaaaggaaauuauguuuagucugugguauuugauaaauuaucuauacuccaccccagucacuuacuguuuuauguugguauaaagaaacagaacacuucacaucuauaaugaagugaauaaugauagggugguuucugucugcuugauggauuaugagacugaugggugagagcucagcgggccugccguuugucaggaccacguuccccucccuucucaggugcagaagccaaaucucucugacccagcccuucccauuuguccaggguuuggggagaccuaacauuacacuagcucugaacucuauaaacauuuauucuuuucuuccuuucuuuuugucuuaaacucacuuaaguuggagauaagugcuuuacaauaucccaacuuguguauauguuaacuuagcucuuuauaucuaugauuguuugaaauuaguauuaaaauaaaauacugucuuagagugaaaaacagucuaauguuagacuuacuuuuuacugucuuuggauauugaaaauaagucucucuuuuaugauugcucuguucugaaacaagcagaauuuuaauuuucuuaaaauucuauuuucuuaaaaauuucuaauaaaauauaacauuguauuaccuuaaaauaaaaucaccccucuuuucucuaaucuuccaugguuguuguuauuguucuuuucuuuuucuuucuugaauugcuaaaguucuaagaaugucuaaguggauuuuaagccucucuagcuuuugaauuguauauauuuucuucuaguuucuaaguuauauagaauacagauaaaauuacuaaaagacuuuuuucucuuuaaaaaaagaguacuaguuggccgggcagugguggcgcacgccuuuaaucccagcacuugggaggcagaggcagguggauuucugaguucgaggccagccuggucuacagagugaguuccaggacagccagggcuacacagagaaacccugucuugaaggggggaaaaaaagaaaagaaaaaaaaaaagagugcuagugagaaaggauauuuaagcuaaauuuuuuucuauacuuguucuagcuugaaccauuagaaacugaaguuuuaauuuuuuuauuuauguauuuccucuuguucucagccaaaacagcaacaaagcaagaucaaaacaacaacagauccugggaagugaugcauauguauuaaaauauuaauuggggugucuaaaauuucagaaguacuaagauggaaagggaaaaaacguuuugcccuaauguuugaguugcuggcucugcuguuaggguuugcuuagcuccaccucaccuuucucccauuucccagcaacacccaccacggcugugugaguaaggcuguucauugcuggccagagugacgcugaagauaacuaguagcuaguaaugcgccacauucacuauguaaugcugagggcuagugauguaaaauggcugcucuaucuacacuuagauuuuguaagacuuaggacgauuuaaaaaacuuuuuaaaugaguuaaugacaugcaauuuuuuucugcucuguucuuaauuauuauuuuauuugagaaguuauauuuuaaccuuuaggucuuuauuagagccauuuaucaguuuuacuugagcuaccaacuguuuuguuaguaaugccaguuuucuccacaagaauuuucauuuacaauuuaaaagaaaaagugaaucaugugugagauaccaaguucaaccuucucaagauaauguuggauaauuguaguaaucuugcuugcuuucaguaaaugggcuucaguaaaugggaugaacuuaaagaggaaaggccugagugcgaugggaggcucgaucucucuuuacuggaucugcuccucgcuuaaacuuaaguccuaguccgucugucugguugcccucguuaaauauacaaauccgugucugagcaauccagaccgucauuaggaaaaauacuuggggcuauuucgauuuuuuuuuuuuuaaauccuuagaaauacauugucuuuugguuuucuggcuuuccuguuuucaguagacaugaauuuuuguccuaguuacuaaagacuuguggauauuuucuuguuugaaugcugcucuuccgacucagaauccacagucacuccuuuuugugcaucaaggaggaggaagguuccaccacauugcuaacauucuuauauguuaguugugcuugcauauuuuguuuuuaauuagggcauuguuaaucgguccuuuauuuucuuucuuuuugucuuguguucuuauugcucauuaucuaaaauugacuguuuuuacguggcguggcguccucccaucacauaguguguuuuacuuguuaaugugcucagucggccuccuuuuacccccacuccagcacuguugaacaugccucaacacccgugacccuauggacaugauagccagaugcugaaagaaccauccucugauuguguguucaugcuugcuaguaaacuaccuguauuccuuuaggagcugcguaagcgucaccugccagcaggcaggacagaugcuuugacauuuuccaugggauuuaagccaauaccuuaucauuauuuuuacaguguccuugaguugucugauauaauucagcauuugagugauuagcuuggccaaauggcccuuuaacguagaaugggagucuggcuuuccucucgaaugaccuacgccuucauuaaauauguuuaagaaccuugugaauugauguuugacauuugugagaauaacaaguaguugauggacguucuacuuagaaauauagcaauuagaguguaacuauaauuuuuuuuuuuagaauggcugcaaaauugacaguuuagaaacacuucauuucuuaguuuugugauugccuacauauuguaucuuaauuugguuugggcuaaauugauaguucugaaacaaccaccaccaccaaaccaaaaauaaaaaaaaaggaggaaagauuccaaaaacuaaauuugcuagaaaaauuaugauuauaaaguugcucuuuauucucuuuuaggacuuaugaguauaagauggauaucuaguuacagguuuuuuuuuauuuauuguuguuauuucuucugauuuuuuuaaaucguauuuuaaauucuuauuuaugccugugugugcgcccagcgugcaugagcacuuggugcccacugaagccuugugucaguuuguuuggagcuagaguuacaggugguucuaagugauucaguguggguguuggcagccaaacucugguccccuccaagggcagcacgcucucggaccuccugagccauuuuuccagcccuucagauuuuuaaaaaaggcauguuucuauggguguuuccccacuggaucgcauccagugaaguagacaggcuuguucccaccacaugcucuuggcucacuguuucggagguucccagaacagguguuugacagcaucuuccgggcuucacauucuuuccucuguacuaccagcuccugugggaacugcuuuacucccuagcucuguacuguuuuuucucauuuagccccugagccugacuucauuuuuggugucuacuuaggcuaggagcugaucugcaucccucuaaguucucgacacaguuaauuuugugguucuagaacuuugucugucucucugccuuaaccucgcacacaacccagaauuaacuuuucacuuugagucauuugacuugagcugcaucuugcugguucguuagcauugugucuauaacaugauguucuucguuuugccccagucuuaagugauuuuuaaaauagacugcucagucaguccuuugcaucuuccguugauucuggcuagauucugaaggccgguucuuucuggaugucccuaauuaguguauaaucaccuguaauuguggauuuuaaaauccagagaauucuguuuaagccuaaauucuagcuggagauagucuuaaacuguuucuguagaauagcuguauaucauuauguacuaugucugucaagucaaacaaaacaggaaaauaaaucaagccaaacaaaauucaagggaaaaaaaagaauuuaguuauaaaaugucaauugaggcuauagaagugguuuuucuuuuaauuaacuaaaacaaaauaaacuuuaacuuuuguccgauaauagaaaaaguauaaauaaaaucuauuuucugaagguaguagaaagcaguauucauugacuaucuuuuaaaaaguuuuacaauuauuuuguuuuauuuuuuuauguguaugaauguuuugccuacauguauguacauguaccacaugcauaccuugugugcgcggagcagaagagaacaucagaaguagaaguuagaggagguuauagaacagcaggcaacuaaauccuggugcucugcacucuugaccacuaagccagcucuccaaauccucauucguugucuuuaaaacuaagaacucuggcaaaccacaaaacuaggaugagauuuuaugauauauaaauuaauuuuaacuaaaucacaucacacaguuucucuagauaaaaccauuuccgauugagaguuaauuuguacauucauaguauuaagacuugaggugcuauucuucucuacuuuucuacaucugcauuauaaacguaaacguuaguacuuccauguguuacgucucugguuuagacaacgaguuccaugaacuaauaucauguguuugggaacuuguugcuauuugggaauuccuagucacuagccacacaguuuuacauauaagacuaugugagcaucagaguaaaaauccaauuaugguucccucauguuuaggaccagcuguguuucuaguuuuggaauuuuuuagauucuaaaccauuuuccauuuauuuaaugagaugucuugaggaugagccauguguuuaagccuagcauugauuuguccacuuuaucuaaauaaacuggaguuaauuuuauacagcauuucugguaugccuaguuuuuaugcaacccucuggguaaaauacaccuugugcucguccacuguggcauucuauuagcagcagaauguuuugaucuuuguagcaucucagauuucagauuuucagauuauggcuacucaacugaaaugcuuaaaauaaggauaaaacaucuuguuaguuuugugaaggcuaaguucaucuaaauuuauuuuuuauuacuaguacuuucuuugcucuuuuuuauaaaaagauuuauuuauuuuauaugugugaguacacuguugcugucuucagacacaccaaaagagggcauugggucccauuacagaugguuaugagucaccaugugguugcugcgaauugaacuggugcucuuaacugcucagccaauucuccagcccucuuugcuuuuaaaauauguagauauaguugagaucaugaguucauuuagcuugaaggauaagauuuugaagucaagugacuaaguaguaaaauuuuuaaguuuucagauuuauuauucaagcuuuauucucuugauaacugauacauucaugauuaguaaaauuaagauaaaaugaguauaacaugccaaucuguugagcauuuauuuugggauguuauuaccaauuuggcuuuuucauuuuuauuucuucaccuggaagauauugacaguuuguuccuuauuuacaguggucuggcugcuggagaagauaacggucagagggguuauuugcugacuuaugucauugcauauauucguguaaguuguaucucuucacugacugauguaauuacuuuccuauugcuguggcaaagcaccaugaccaagggaggcaucuuagaacaggaaacguuuaaucuagggcuuacagcugcagaccauuagaguccaugaccaucauggcaggaaacauggcagcaggcaggcaggcauggcacuggagcaguagcugggagcucaccucauuauccacaaggaggagacagagagggcugacugggaacagcaugggcuuuugaaaccugaaaggccaucccaguguugcaucuucuccaacaaggccacaccuccuaauucuucccaaauaguucuaugaacuggaaccaagucaaauauaugagccuguggggcccauucucauucaaaccaccacauugacuuagguuuuaagaaguaggcuuuuuuuuuuuuuuuuuuuuuuuuuuggcguuuacugauuguuaguuuguugcuuagaaugguuaaaauugccuuguuuccauaagucuuaagcuacuguaauuuagugugucauuuuacuugaacccuggguuuacugcaacuuuucagaagcccauuuaagacuuuuuguaugugcuuuugaaaaauguaggaaauuuaaugucuuucugccuuuuaaaaaauggaggcagccucuggcugaaagcugagugugcccauuuaacauuacuuggguuggaguggagguacccuguguagcaacagucuucacuugauuuauaaucuaucuuaaagauuuauggguuuuuaucuuuucuuuaaaaacuguuacuugcuuccaggugguuccagguucaccaguagugaugacuacagaagucagggucugugugcucuaacaugcagacuuuuaauguguacucuguuuacaagaggccucauugcucacacuuauuucaugucuguugcaguuacugcuauaaaaccagccuucugagaaucuaguuuuucauauguuuauuuauuuuauuuuuuucuguuuuggcucuaacagacucaaguuuucugacugaaguuuuuuuuuuauuaauuuuuuuaaaguuuaacuuuuaguaauuuuaaugaucuuaccuaaaaagauauguuggaugccauacugaaaauuugacuuuccuaagagauagauuuucuaauuuucuaguuagaaauuguuuugaggaaaacauuuauaaaaagauauguaauuuuuuuauuguucucaaaaacacaaaaugcuuucaguucagaauaguucaguccucauuaagaucugcuuuccuauuauaaugaauagucaguuucccagcccagguucuuccacgauugcaccuucccuguguucgaaacccugacuagcacaggugcugauuaugaagugguaaaugacuagggucaucuguguagacucucucuauccuaggauuuuccuagaggaaauacuugacaaucuauaaaaugaaguguuuuuucugaauauauugagggauauauguugauagguguauuucccacaauacugaauucagaauucuagaaaauuaaugcagcuauaaauaagcacagcaugauguauuuggaauaaauauccuauuuuuaagguucuuguuaauuuugaggcuaagccaaaaguaaguuuaugggucuuuuuccccaaauuuauuuuauuuuuacauucucccccuagcauuuauuuauuuuguguuugaguauauacauguguauagauacgcguaucacaacaugugcaugggggagaguguucaggagucagcucuuaucucccaccuuguggguuguggguaucacucugagguccucaggcuuggugacagaugcccgccuccccugcugagcugcuuccacaguccuacuuaccuuaaucuuuaaagccgcuucuagcgcacacuccuacugccacagguugugauucccaggcaaauggguguguaccaccgaacacacguuuuccaucaguagacuuggaggcguaucuuccuggcacuuagcgugguuaaagugcuugcuuuacuauagccucccucccucccucuuucucucuuccuuccuuccuaguuagcuagcuagcuaguuaguuaguuaguuuugguuuuuagauuuccgagagacaggauuucucuguguaguccuggcuguuuggcagcucauucuggggaccaggcuggccaagaacucagcucugccuaugucugcaguugaacggcuggaaguaaagaugugcagcaccacaccugcugccuuuucuaaauaaaagucagugugaggaaacuccuaccucuuguuacuuuaaccuugaugcucaauuuuuguauuggcuauuuuaauacuuuggccacuacaaaucuauucugaaaucuuuucuacauauguauaagcuuuuccacaauagagacucuauucacuaaagacauauuugaguuucuuuucuguaucagauacuucauuugcugcugagucuauggagagcaacagacaagguuccugucuucagagaggucauaucacacuugggaacuuuccaguguucuuaugagacaaagaauaguuuagaauagaucagagaugcacuaccaauaacuuccagagauucuagugguuuuacuaauuacugcaucauuuguaguuucaugauuugugugucuuuacaggauuuggguuuggaauacuauguaauaggagaaucuuuugagacuucugcuccuugggacagguaaaaccuaauaaaggauuuauucugauauacuuuauaauugaugcauguauguggauaugcaguuuaucuguuugugaauaaggaagguuuaaauuguuuuauaagaaacacugaaagaaggaagguacuuuuguuuaaauuaguuaucugaauaccauugcuuugaaccuucgccccacccuucuucuagauuagguaaauuugcuuggaacccaacaaacaaacauauugaaguuaacaguuugaacuaaacacaaaaugcugcugugucauuuggcuucacauaggugauucauugugcuuaaauguucuuuagaaggucuuccucccccaccucaaauuauuaaccuucuuagccuucuuuuguaauguacuauuuagcuuugauguaugugucuagauuuaacaagaucuucacguguguuuaagugauuucugaaaaaaauuuacuuuaaaauauuaagcauaauuuccauuuucaaauuuaaacaaaauuuugguacuaaaacacauuguagaaaauguccuugauaggaugcaugggaaguagugucugaguuuucucuccuggaaacacacaucuacacucacuacacccacacacucacaguggagggaggcaggaacaaaagcugggaaguacuuuuauaaacauggacuuuugaauuaaccuucaauagguucuugagaaaauucucaguauauuuuauuuucuuugaacaugccuacauuucacuuuguuuuauaagauguaugaguucuuuucagguguuggugaguacguaggcuguagcagauccuuuugaacucacucuuuagauauuaaauauuuaacaucuuguucuccuuauaccucguuucccauuuggaaagcuuccgucuuuucugcacuaucuuacuccacuguggucuuugacuuuuagaguacuggucaucagauuccaagaauugucuucagacugaccaguuucuaggaucacugucacucuccccccaaaaguacagacuuuuuaaaacaaaacaaaacaaagaaaaucagacagucuauaugauucugucuguccuuaaaccugccaugcagcccgaacagagaauuugugaucuuuuugcuucagcuucugguauuaggauuacaugcauguaccaccacaccccuguguuuuuguuuuugcuucuuaacaaauuuguaaagguacuuuuuucacaaggggacuacaucuuaaaaaaauaaaaagaauuguuagcuggucacuauugagcccucaggagcaauaguuuggcuggcagggcuaucguugaugacuucagucugccaugucuuuccuugucuuaguauggauugcuagguagacugccauaaacuagcaggcuuacauauuuuaaaccaagaucuuuuuucucccucaccuuggcgugugauaucagggcgcuuuggguaucuggguugcuguugguuuauggaaagucaccuugugguguguccucauguggcugaaagcaagcuucucaugcaucuuccuugccaccucuguccccucccacaucacuuucucucuuaugaucugauuaccuucugaggcccaagccccugacucccaauacuccgaaccaucccguggugugaaggggaggauuucagucugugcauuuugagguggacucagaccuucagccuugucagugaggaaauagauuaguacaguguuaccuuuuuagucuuacaauuuuuuuuacuugccaauauauucucuuaucuuuuuauccuucuagauguagaggccagucagcuaaacaaauauguaaauacaugaacugaugagggaaaaauaaaaaugguauaaggaaacuucauguuguauucaacuaucuuuucuaggguuauagaucuguguagaaauguaaaggagaggauaagaagggaaugcaaagaaaggggaguucaguucgcaccucuuucuacgugcaggugaguuuccacacuuauugacacucauucuggaaaguacugcuuacagacuugacuguuguguggguggauauguguauaugagcugugcaccacagugcgcaugugcaagucgcuucuccuuccacucuggggucuggguauugagcucaagcagacagguuugcauagcaagcacuuuuaccuguggagccaucccagugcccuuaaaguaauguuuuuaaacaguugcaaaaucuaguuuucuagcuaaggcgcagcuuuggcuuguuucauuuggcauacuuccucaacaucuucuacauuguuagaacugugucucaauccugagccaccaaggcaaggagccuuggucccugacggaguuuucuguccucugagaacccuggacaaaggaaucccuuuuugcucccugaugugcuguaagcuacaguagaggcauagaacuguaaacucuacaugcaguguuuuuguguacaugggcaagaaggggggggggugagggagagagagaguugggagggaugcuuaaaccuuuaugaaaggagugaaagauucaagugauaaauaacuccuuacuucccaauagauguuucuuugauaauacaaauauucuguauuuuugccguuaaguuugguagccacaagccauacugguuagugagugacugaaauguugcuugccugaaaauuaaaaaaaaaucauuuuaaguuuuaaaaauuacuugugauccguaucuuccauguuggauaaugacugguuaacugauuuuuaaaaauuauuauuauuaaauaguagccccaaaggaagaugguuuuguuuugauuuuuuuuuuccugagaagggaccuuuuacauuuaguuauaguguuaauuuuauauguaaacaccauguuauaugugucaagacacgagaugaacauuugacucuguagaaagguauuaaaguauuuuaagaugccuggcagugguggugcacgccuuuaaucccagcacucgggaggcaggggcagguggauuucugaguucaaggccagccuggucuauagagugaguuccaggacagccagggcuauacagagaaacccugucucgaaaaaaaaaaaaguauuuuaagauggaaaauaaguggcaaucagaacagaucaugaagagcgacccuuacagaaggauaccaccagcugccauuacccacugugcagccucacauugguacuguggaugugcaucugugccuguugaggggaacaccuuaagaacacaccuucaguauuaggaauacaaacuacuuagaauguacaggaauacagugacuguaacuuggaggcagugugugucucuguuaaauguaggugacauuggacgucaggaacagauguacuucagcaucaggcauuuccugugugcgucugucucuggcuuacaaugcuuuuagacuugaugguauugacacacaucagcucagccagucuucugucucucucaguauagccuuaaguaacuauacaugcucaguacuguuggguacugcagcugugccaagcauaauugaggucucuuaagcuacaauauuugguagcuacauauacccaguguacaacauuuuaccuuacaaugaaauuuuuuacauaccucuuucaggauugucugcauuucuguuugugaugcuuguuucucugauuuaucuuaaugucagccugggaaguaucccugaaguuuuguuccaucccaggaaucagggugauauuuuagauggcuuuugaagauuugguauaagagaauguauuagaagagcggaggcacuguucugcucauuagcaagaauuaaaucucgucacacucuuuuuuuuuuuuuuuuuaaugacaguuuuucauuauuuaaacuuugaguuaggccaaguuuggcuagaucuguuagguccaucauacuuacuauagacuuaguggugguuuuuauauacaaaaauguguaauauguugauccuaaauuuguugaaaguuggcuaucuuagaguuuccacugcucuaaugaaacaaaagaagcuugggggaggaaaggguuucuuucagcuuacagcucuaggauggcacuuuaucccugagggaagucaggguggaaacugaggcaggaguguugcucagcccugcuugaccugcuuucucauagcacccaggaccaccaccaguccacaccaaucaguagucaagaauagguaucacaggccaaucuugggccauuuggagguuuguucccaaauuacuagaguuacauugacauaaaacuagcuagcacagugacaauguucuauuagaauugguuacauuuucuauguauugaugucaaugauccucuuaugaguggugcacucuuaacuccuguaagcacacuuuacuuccuguaagcacacuuuacuuccuguaagcacacuuuacuuacccccccuuuuuuuuuuuuaaaacuugguucuuccugaucacagcaccucguaguuaaaauaguucuccaauuuucuuaaacuuguaaaucuggaacuuaaaauguaaauguucaagggaucuuuuuuaggagugugaauuaacacuacaagaaaagcacagcuggcaaauugacauagcauuguuaaacaguucauuuauucuguucugaggcaccuaacauuuggccaaaagaccauuacuguuuuagauuagauucuguuuguauuguguaguaaaagaacuugcuccuucuguuagacugaguccuuugugguuucuccauggcuugcauuuggagauuuaauugugauuguccaaacucccuuuucauguguccuaauugcauuuugaaagcccacauauuuaucauauauaugauuuaagaauccaacauccuugauaucuucugcauguacacacacaacaugcacauugagucacagacaguguuuuuuguuguuguuguuguuuuuuguuuuguuuuuuuguuuuuuuuucgagacaggguuucucucugcagcccuggcuguccuggaacucacucuguagaccaggcuggccucgaacucagaaauccgccugccucugccucccgagugcugggauuaaaggcgugcgccaccacacccagcuaagaaagaagauuuuaauuuuagcucacaguucaguccuucauggugagcaagucaaggcagcagggccuccagcagggaacaggaugaauaccugcugcugcucagcuccagcucuccacuuagugcagcauccucugcccagggcaugguccugucugaaggaagagggauuuuucuguaucguuaacauagucacagaaaucccacaggcaugcccagaggcacaccuccuagaugccucuaguuucugucaaguuggcaauuagcaguaaccaucacauuuucauauaccaccucacucauuuuuccuuacgugguuacaugguaugauuauaaaaguguaaaaccaguauuuucuacuguuagugugguuuuaaguugcauaaagcuguugauacucuuugucuucauauuccuccaaugucucugucuaguguaacacagauaguacaauuacacuauucauguugucaagcucugugcccuuuuaagagccauuaaacugagcguagaguugucaguauuccucccuuguauucuacaaggugucauguauucacuagagagagcuuaggaauuucuucuagcacauuuacacuauuuucuccccccgcccccacucaacuucaaugauuuacuuuuugcugucuccauuuucuugauccacaagaauccaaucacaugacagcacaugguauugcuaugagaauauuuauguaucuugcagaggugauagcuuguuuuuguuuuauuaucaauguagauuuuuuuuaaaguaaugaaaauuaaguucuugguauuugcuugucucuguguaguucauauuucuguuccagacaguaacgaaccaaugaaagaacaaauucuuuguuucugauguugccuuaucgguaguagauguuuugcaguaugucuuaugauaauaugaaauguauccauguauauagacuugaacaauacuaguaagguauuuaaaauacauaaguugaauguaacaggaaaaaguuaguuaguuauauagucgggauaagggcccuuuaagucaggguuuaguuacaaguuauuuuggcugugcauguuaaaagcagacuauauuuuuauauguauacuugacuaucuuuucaauguuuucagauacacugcuugaaauaagguucugucacuuguagauaacuucaguaagcucacugagaaugaauuuuuuuguaaaauacuaaauuuuagaaaauguucccuguaauugugguuacauaaaacagaauaaaugaguugagccauguacuugcaguauugauuaaucucacguuuaaauggaagaaagcaaacaccuucgucucccgcuagguucuuagcguccugcucuggcagucugcagaggagcagaccgcccuucucccagggcgugggagacugaggaggagaugggguuauggccuggguggauucccaucugaucuggucuuugacauuucuagauguuaaaucuguuuuuacugaacuuaaagcccuuuuggggauuuuuaucuguuugucuuuuagggugacacagacuuaugaugcaggugcauguaucuacuucuauuuugccuuuaacuacaggggaauuagugacccacugaccguguuugaacacacugagguaauuuugcauguaguuuuuauguuguucuuguacugaaauaaauuuuaguucugacuuagggauuuuaguuugcgucaccguugucacacauggcuugccuggcuacuagcccauugaaggaaaguaugcugaguccacugacuuaccuaccagauugucagucugcaauuaauguccuguauuucugaagcccaugucucuuugguuguuacuuccagugcauuauagccaauuaaauaacaacaggagccuuuaugacuaggggucuuugaugucccuucagcaauccauccaugugauacaauuguauauagauccuugggauuuauugcuaacauuucuuaaguggccuuaauuaagcugcugguuuuuauagacccauguggugaugacuauacuuuuuguuagaagcagcauagaauccuccacuaaacuggaggcagccauagcaggcaugucacuuagacacacagguugcccuaguguuuuaaguugauuaugugccugccaaugauaucuuauccucaaaaauuuaaguauauucuuuauugaugugugugccugugcaugugugcacaugcauacagucccacacaagugggggucagaggauaguuugugaagagugucuguuucucucuaccacaugggucccagggagaaaacucagguuugguagcaaguggcuuugugcacugcggggucucgucugcccacagauuugagaauauuuguauuuccuuggccugacuaugaaaaucccuugcuuagcuaggcaugauggugcauaccuguauuuccaagcacuggggagguagaggcaggggaacugcagcaagcuugagauucagccugguuacauagcaucaucucaaaaaacacaaauaaacgaagcuucuuucuugaaauugaaauuuuguucucccaguucuguuacucacucaauucuucaucucaaggagcuguuuuauuugaggagauuuauuagaaauaaaaaguucuugagcagaggcuagcauacucacgaucauauggagaaccucaacuccuaaguccugaaggcucccacaaaguacuuugcuauguuguauuguucgcaugcuccaccuggguggccuucuacaucagccacuguuaauugguuuauagacaugaauacaucugagaagcucaagguacaggagauacuuauuuuguggcuauuaaauauuaaaucauuaagaauagaaaauguagccagcugguaauuggcacaugccuuuaaucuuuaccuggaggcagaggcagguagauuucugugaguuggaggccagccuugucuacagagaguuccagaauauccagggcuacauggagaaacccugucucaaaaaacaagaacaagacaaacaaacaaaaagaauagaaaauguaguaaaauguaugugugacgguucauaaugaaauccaucacuuuguacacuaaccuaaaauuuuuucaguugaaaguuaaaagagaaccaggacuuaaguagggaagaagggaaacagaaaggcucaggccagcccauugcccuucgcugucuguauucuguuuaucuuuugacccaugggcccucagaaggauggucaggaccuagcauguuaggagguuaagcaaggggacaaaauaguaguguggguucuuuuuuuuccuucccuucucuucuuuuauuccucuuagauauguauauagaacuaaaaaauaauuuaucccauguguuugaaguaagagaugcucucccuaagaguuuuuauggucacauaguggaaauaaauggaagaguucaagcagauugcuuggcaccuuugugggcguguggggagaagucaguaaauguuagucacucuaaaguaaaauccaaguagcgguaacauuuguguuguuugcauuuacaggcagcugcuagagaggaaauccuugccaauggagggagccugucacaucaccauggagguauuuuuaaaggggagugguauagaauuucuaaugcuccugcuuuuuuaaauauuugguucaauaaaaaccuggggaauaucauuccaugaguaauuugagagcacuugagauuuagaaacauuuucaugucuuagaauaacugauuaaaguagguagguuauguuauagccaacagaaugccuggguugauagucagucuaucuugguauggaaugagucggcuuuccuaauucucaggacccucauguuaauagagagcagauuaccuuaccugggagguguuugaccauuacagccaaagcuuuaaagaaaggaaagaaaaaaccuuuuuagucuuuuuccagccacuguuggaguauacaugaacgucaguuguacauauaguaaaagauauuuguucuuucuacaucucagcacauuaaucaacaaauaauugaucccauaugaucaaaauaagagauguuuucuccaagacuaccauuauuaaaauuguaauuuugagauuauccccagauucuuuguaacaaaaacuuguuauaguauaguucucccuguaauuuuauacgcuuaggaaaaguacaaauguagagauuaaaaacaaacuuagguuggugcgugaggacaaauagucaccuacacauuaaacuuuugaccugucccuaguaccucuuguucuuuuugguuccccucuguuuaagucauuugcauuugcuugcuuugaaguaggggucccggaaggcaaugauucucuucuguauguugcuuuauacuaaaaucaaggacuguucuaguacucagccuccacauguguguggagagauaauggaagaguuuggguggaaagggguaaacuguagagugccugucuacacaaacauucuuauaggcggggcuggagaagauugaugauauagaugagugagaugcaagauaauucuggcacugcuacaucagucucuuccuuaacaccaucuucuuuucuuaaccuucacaaauaaguuaaguagguuuucuaaugaacauuuggaguggauaaauuaauucuuugccuccuuccuggguauacucuuuccuuuagaaguucuuuuauucguuuguauuugugugcacucgcgcaugugugugcaugugugcaugugugugcauaugugugugcaugugugcaugugugugcccaugaacuuggaggucugaggcugggugggggucuuccuugcuagcucuucuccacucacagaggcaggcuuucucagagguccuggugaauguuaggaugacaaaugaagaacgggcaccagacacgucuuaugugcaauuaaaagcuagguaugcuucuagaccuuauaccuucuuuaaaaaucauuaaauaugacaaagggaacagagagugaggauggcacguuguagagaagggggugauagaagcuuaaauugucauuuagggaauugauuaguaaaugacuguuuccuugauuguggaauagguccuagaauaggucacucauauuuugugagaaguuucgcaaagauugaaggagaccaagugaucugaagcagugcagaggagaguccuggucgccuucuguggucaagagcucugcuucuuuuucucccaucugagaggagauagaggguucccaggagcagcuguguuggagguucucaaggagagacacgugcugcaguugcuucucagaugcauagagcugcugucucagaggagccuacuuguccacgcacagcucuaaagcacuugcugcagaaaaauagacuguggugaagagagacucgaaguuuggauuuuacuugugaaaguuauaaaagaucauuguauuacacaguaccacaagugagucaauaagcaauaguuggaaaaaguauaaauuuuaaccuauuauauauugauuuugauuuaucaaccuuuggucucaagaauuauggaaauacucccuguggcuuuguuuaugauagacacugauccucaggccuuauagcugagcuaucuaucuagcccuuagugauuuuuuuuuuuuuugauacaagguauauacuuaaugcuuuuuaaucuuguauaauguguuuuccauauauaaauauuacuggccaccuaggcuagagaauuugaaagauuuuucuucuucucaaggguguuacacacucaguccaagagaauaaguauuacaacauaucagaaacuacugaugcgauugugcccugcucacugcuuuauauuaguuuccucuucacuucggacagcacugccaaggcagucacagcauauuaaaugucugacugucagaagggaaaagaagaugaaggaaauaguaaugcuuauaaacuauaaauguuuucugggaucuguguaauuuaauaucuuuuaauccucuucaacaugcagccgaguaacuuauuacaaauggaauucaaaauauaagcuguuauugcugguguaagauuuugaguguuauucagugcucuuguccugauaccaagaagccuaaacuaugugaaaucauuuuaaaccuuuuuaagauugaaauugacugccuuugaaaagaauauguauuaguuuuccuuuaaggugguaacucuuucuuuucuuucauuugcacauuauguaagauaauuacuuuuuaaacaaguaccacagaagggaaccaaaagcuuuaauuuuuuuuauuauagauaauuuuucuuaguucuugcccauaaauccuuuuacuuucuuguugguuuuauacuuccugauuauaggcaucuaacauuuucaaauucaggcacuaaaacaguucaggacaguuuauguuauagugucuuaguuauuucuucuauucuuguagauaauaccaugaccaaggcaacauacucugggacucacaguuucagaggguuagagaccaugaccacuacagcagggagcauggcagcagguaggcaggcauagcaguagcuaagcguuuacaucuugaaacacaaccaggagacagauguuaggaauagcauaggccuuugaagccccaccagugacaugccuccuccaacaugaccguacuucuuaauucuucuucccaaacaguuucaccaaccagagaccaaguacucucaccaaguauaugugagccuauguaggccauucuuauucagaccauacauacaguaaaaccacuaauacaauuuguauauauuuucaaguucuagguuuagacuuuauuuguuagacuucauacauugagaaaauucuguuuauuggcuugaaguagaauguggcaaaguuugauuccauauuaaauuuagaagcugcugcauuaagagauuuaaaaaauucuaucccauuuuuaguauguauuuucugugugaucagaaacaaugacugaauggaaacaaauuccaaacuacaugauuucuuguagugcuuagaaaaagacccuaggccugcagaggugcgcagaccacucacauaauaguaucaagagaggauauggucuuauaaaugccccagcagggagcucauccugucccgccccgucacccacuuccuuagugacagucucugccccacaaugcagaaccauccugaagacuccagaaaucaaaagaugucaccacuucuggcaccaccuuaguucagaucuguuuccugugggcacagagcaguaaguacccucuuaacucauaggacccuuccucccuucccuugcugccugggaaucuuucuuuuucuauuuaaauucuuuaacucaaauuuucucuucacauucagaagaaaacccagaccccucacuaggcuuucagugaugcagugguccaugucucugauacucuuuuauuuuuuuuuucuuccugcuguuucucaaauggaaccucuuuccccucaaggcccaugcuauucccucauuuucugcuguucuccuccuagauguuuccguggcucccuuuaccuggucauuuaggucuccaguaaagaugucacuuuccuagaaauguucccuugcucguguguguaguuugaauccuguucaguggcagaauuaugacuucggucacauucuguucuccaguucccagaacacugagugucugcucuacauaguucuuccuagggaagaggauuauaggagagcauugucaggcccaucugcuuuaaaacaaaguauauaaggaacacuuaauaauaugcagagaaaugaauguuauuguaaucugcugauuaagugacucugcuaacacacuuucacagaaauacuguaaacggaccuuuucauuaauaugauucuauauucaaggaagaucauaagcuuaagucauucuugggcugcugagguaguucgagucuuucuuagcaauuuauauugagguccugucucaagaugaggauuaaaaugaugaauggaguauaguuggaaggugaguacuugccucacaugcagaagguccuagguucauuucuaagcaccacauguguaggggcacacauauggaugugcacacgcacacacacacacacacacacacacacacacacacuguaaguaggaaaggauauagccugugacauaaaaccuguauuuguagcuccgaguuuacugaugagacugcaggaaagcagguucucugaccucaggugcccuuggcugcagaccaagagggauguuucccaccucagaggcuggcuaguggauguagcugcagugcauggagaacauggacagugccuugcauggaggcucugaagcauuguagcauguaucuuuaaacaguaggagaauaccagagagaacucugguuuauuuccuuaaucuuuugcaccaaccacugaagaguggcuugcaguuuauuuagaaaagaugugcacauuuaaggaggucugacacuaucaucuuuauuuauagcuuagaauucucuuuaaaaaucuucaugaaagaaaaauaaguuucacauuacuggcaaugaaauuggcuauaauaaaaugucuauuuucauacuagcuucucuauuugcaguuaaacuuucaaauguccauugcuaaucauaauuuaaauaacauguuuaauugugcuguuagacuuacuauuaauacuuuugagagauugcuaauuuuauauguauaaaagauuuuccucacuugcuccccgaacugacaaguucagcuggccucaguagcauguuucuuuacugaccgccaggcacugucacgacacccucaggacugggguugguuggcugguuuuguuguuguuucauuuuuguuucaucucgucucgucucgucucgucuccucuuucuuucuuucuuucuuucuuucuuucuuucucucucucucucucucucucucucucucucucucucucucucucucucucucucucucuuucuuuuguuuuuuuuuuguuuuugguuuguuuguuucagaguagcagaacugugaguuaggagaauauugaugcaauuucucuuggaggguuuggccuguaauugugauuaauaacagucgcuuucacuaucuggaaacagacaggcugguuugucugccuacaaucaugcugugauaaauggagcuauuuuaacucugaauuuguguaucagagaaaacagauguagucuggaacuugaggcugaaggaaacagagucuguuuaacucaaucuccauagcucuugucuuugcagcugauuugcuggucaguuuaaacaacaaaguuugugucagccacauauuuaacuugaacuuggacuuacaauuuuaggucauucauuucuaaaauuauucuucaaauccuuugucaauaaguaaaaugugcugauugcauuuacagucuugguuaaaauguugguauccgagcaaaucaaagcuguuacuagcguucuccccugauagucaguagaaacuaguaguagcaucagaaacaucugaaguaaaagaagcagagcagagccucuguuagaaaccuguagugugaaacagaagggaggaagggaggaagggagggagggagggagggagggagggagggagggaagaagcagacuucucggccacugcaugguucucugucuagaaaaucucugagaauguucaaaaacagagucagcaagaauauauacaaaaguuuaauuucauacaaaaauuaacaacaaauauacaaaugaaaaucuaaaauauaacagcauucacaguugcuaaaaaaaugaaguaaauggaaccuaaaaaagugcauagguuucaauucaagaaaauauacauaggcuuuguaaucuaaaaguuacagaauagcaauggcaggaaccaaggaaguccuuggaauaaauggaaggccuauuccuguaaaaugucaguucuguacaaacugaucuaucuuuaaaaacacauuuccuguuaaaacuuuagcagacuuuuucguauggaucugggaaagauuauucuaaaauuuaugugauaagacaaaggaauuaaauaacuaaaauaauuuugaaagagagacaaaaauaccuuucugauuuugagccuuauuauguauuguaguuuuguauaaaucaagacuacacuguuagaucuauggaauagauaugggaacacauaacuugguccacacaccuggacucaaggaacauuccaauggaaguggugcuggaguagcuauacaucuguaagcacacaugcauguaacugcacauacaaaagaacauugaacuaaaucugcauccauacagaaauuaacccaaaauggguuauuaucuuaaauguaacacauggagcucuaaaacuguuagaaaguaguauaggagaaaaucuucagcccuacagacuggcagagaucaauagcauaauccacaaaagggcagauuguuuaacuggacucaacuauaaaaagaugaagguggaacagccugugaagggcuaaacaaauccugcuacgcuguguucuggaauucuacucaguaacaaaagggaacgaacgacaaacuauaacuacuugggugcaucucugugggacugugccaguguaugaaaaccagucucaagaggcuucugcccuuaugauucugcagcaguuuugacaaaauaguugggaagagauuaguaguuuccaggagugagugagggcuaggaggcagcuggagacagguagcacacagcugcuuuggagauaaagcugcucugcaucuugacuguaccagggucaaagccaugcccucugauagugagcagcuggguagugugccaacaaugacuuuacaucacaucagauuagagagcaaaaugcuuguuugaccuuuuaaguaaauauuuucaguuucuucuuaauggcuggcuuuuucucucagaacauuuuuaauacauuauacuauuuuuuuuuacuaaaacaauguaaauagauccaacaguagauaaaaacaaauuuaauuuguaauauaucagaacauuacagcuuuuuauuccuaccguagguguagcaaacugggcucacaggggaaaucucuaucaaguacacacugcuugccgcccucccaccuaggcagcuacagagacucagccucaggcacagggcugugagacaccuguguuguuaggugcuaaacuuauguauccuccagccccacaggcauuauuagaaaugaauggcauccguuuucuugugcuguuaaagagaacauuuccuuccuggcaguuuuucauauagacccuuccuuauaaaguaagguguuagugugacgauguccauauuacguuaucauauuguuagagguacauaacuguuuauagucuguuucauauggcuaccaaaguuaauuuuaauaaauauuuucacauauaguaucuguuaaaagucuaauaucuguuagguaaauuuuauuucuguuguuauuuuguagcugcacuguacaauuuagaagccaugaugcugcauauagcuauuuaaauuucuguaauuaaaaauaaaaaauugcucuuauacuaagcacauuaaaugcucuguauccacauauaacuaguggccacugugaugagcaguuuagauuuacacuauuuucuugcagggcugugccaaaugcagcugcugacccaguaaguuauagcauugaaaguuuauggcaguuguuugggcuucuagguagugaacccuuggaagcauagagagccauggacuucucagucuugacauuagcuacauuuuuggccagauaaguuuuuguugauggagugcugcucaguguuuuggaauguuuagcaguagauaccuaucuuaguuaagguugcuaugauaagguaccaugaccaaaaagcaaguuggagagcaaaguguuuauuuuauauuuggcuugcucuuccaugugguaguccaucacugaaaagaagucaggaaaugaacucaaauagggcugggaccuggauacaggagcugauacaaggccauggagggagcuguuacucgcuugcuucccauggcuugcuuagccugcuuucuuagagaacccaggaccucaaccuagggaugauaucacccugggcccuccuccaucagucauuaauuaauaaaaugcucuacauauagaucuuauccaggcauuuucuuaauugugguuccuugcuuuugucaaguugacauaaaacuauccagcacaaugccaauaacaauugccccauuaggacagccagaaauuuccauaaacauugcuaagugcuagucacugcaguugagaauuauuaauaaacauugcuaagugcuagucacugcaguugagaauuauuaauaaacagugcuaagugcuagucacugcaguugagaauuauuaauaaacauugcuaagugcuagucacugcaguugagaauuauuaauaagagaauuauuaauaagguucagagaguucuugagauuuugaagcaaugaaaacgugcaguucugcgccgugccgucuguaccuacuacagaauagcucuagguauccucaagaaauaaugccaaaauacaggaaacacagggugaauacaauugagaaacuaagaaaacuacauugcuuuauuagauuuuugaaucccuaugcuauauuuuaaaugucuuaacaauaacugugguuccauucauuuuuacuucaucuaaauguagugauuaucuuucugugugguugauacuguauuaucuaacaugauuacaaagaacaauaagacauuguccuuagucuucaagaaagaacauucucuauucuuuucuuauuuuaucagucuuauucuauuuaaccuguucauuugcuuuggucucuguuguguguauaaacacucaauucuacucuaguuuaaauuuuaaguguaacaaacuaauugauggugguacugaagacagauugaauccaauucuuacuuuaauuacugaaacuucuuuucaguuuguagucucaaaagaacuauucaaauauucagagcuauuagauauacuguguagucaaauccuuagcauaagaaaacaacaacaaaaacugacauugccagcagguauugugaugguagacauuauauuguuauaacuccaguacucaggcaucuaaggcaggaugaugacaggaccgagacuuggucucagaagaccaagaaaacccacuaaacaacacagaaagaaaacaggcauuuuaaaugucggcaaugagagaaaacccauauaacacuguuguguucaugggcuugaacauucaguuucuuuuacgaggucaugaagagucauagucccaucuuagauucucuuacaggcuggaugcuaucacuuuucggguaucgaucaguugccuggcauuuaugaaguaugcaguuuugccagaagcaaccaauuacagugugcuuuacugcacaaguagauauaagucagagcacuuucuaaguugaaucucccuuuaagagacauuaucagucuacugaguaacucagucuaauuguccauuuuuuuuuuuuguuuuuuuuuucucauuaguaccuaacagauccuagaaugcccaagcuucaucugacgagauauuggguauccgucuaacaguuuuauacagcuaguaguaguuucaucguacuaaguaauggaaaaauaggaagcuauggggacuagagagagauggcucagugguugagaaugcuuucugcauagucaugaggaucagaguucagauaccagcacucauauaacacauuggguaucugguccacuucuguaagcccagcucugaguagggcagaggcagggggaucucuaggacuugcuggcugcuauuguagcugagaaaauaugaucacuagacucagugagagggccuuggaggaauagaggaagauacccagcauccucuuuuggccuccacauacacacauauaccauacacuggagggagggagggagggagggagggagggagggagggagggaaaguuuaaaaagucauuccuuaguguccuccuauaaaaccaagucuccaugauuuucuuucuaagauaugauuuacacauuaagggugaauugguacuugguguguugaguguaguguuuugcuuguuguugcucguuuugugaugauggggauuaagaucagcccugugcaugcuggacauguccuguauacccugaguuuucaagguguagcuguugaaagaguagcuguuacuuuuggcuuuugcuaauucugcuuuuguucuucaguuuuagccaguucuuuucuacucuuucugguccacuucauucucuguguccuccucccuucuaccaaguaccuagacccuuguagcaugcuaggcaagcacuuucccacugcgcuguaugcugguccucucauuuuguucuucugaaaaaaaucuauaaaugucuuucugcccuuacaaucaaauugaguagcaaguuaaauauaucuagauaaagauacaucuguguucaacuggcucagauuuauuccuuuuaagauagaauuauuuaguaguuucugcuacgucuuaaaccacaaagaggaguuccagauguuugugggucaggcuagccaucauguccacguuuuuuaaacauauaauaccauuccaccguuaaccugugugugugcacgugcacaugcuauauauaugcacacauaugccaguguguacauguggaguccagagguucacauugaguaucauucuuauucacucuguaccuuaguuuuugagauggggacucuuacugaaccuagaauuugccuucuaugcuagacuaucgagccagcgagcccuagggccugccugucuuugcccaugcccagaacugugguuacagacaagugaacaaaacacaguauuccuugaaucuguccaaagagcuguguaaaguaagugauuucaaagaaacaucccugaaucuccuauuuucccuacucuauaagacagacacaguuggaagucagacuuucguuuaagcaagaaaagaugucccuggccacuagauucucaaguagccaucaacagcacauguagauaaucguguggaauggauaaguuuucaugccacaugccucuuuguagugccuacugcauaguaggcuuguagaaguugucauauuugcuguuuguagcauucagucauucuucccgugugauagggugugcucuaucuauaagggaacuguuucuuuucagaaaauaagcugugcaaauguuuaaggugcuacuauauaaguguguagcaucuaugucacauguguauggaugaguauggccucugauugaugaauaucaagcaagcuaagaauuuucugaaauacaugugguccagcuucguaaugaaggugugcuuggaagccacuuccuucugggcuuaggcccugugcugcuuuaauguauugauguaucaggcugccauacaguuuuccagaaucucaggacuguuccuaguuacucucuaauuagcaagucucaugggaugcuuuguuuaacuaugcuuccuccuagcacacuuacucuacagugcuaaguuaauuugcuaagcaaaaccaaagcuuucuaguuccuuuauuuggggaagucaagauuugcagcgucccgauuuugcuauuucugucaccaguaucagaacauuucacaaaccaguaccaccgauggguuaaauucuuucaucaaacauguuucugagggacugcagcuaugccuucuccccugcugcuuccuaguucacuaaucaaauguauguuagauugauuauuguaaaaguauaaaccauagaaaauuugacaagauagauguguaaauuauccuucugacagaacuaaugaugcacuccaagcaccuucuguuuuccagugcuuggugagugacuucauuaaguaugcaauggcuguuggguggcuucucagacaaugguucaguuccuuguggaauugcauuauuacuggagguguaaaaccaggcagacaagcuagcuguuggguguccugcugagcuucuaaugugcuccaucuuguuggagcaguuguuugccgucuuuucaggacaauuacauccauaaccacaggacacauucagugaagcuauauuacagcuaaccugcagacuggggcuggcuuucuucaucccucgcccuugagcugcggcagcauggcuagcaccuucccuaagucagaccgaucuaucuaucuaucuaucuaucuaucuaucuaucuaucuaucuaucuaucucaaagcaaauccagaaacacagacucucaacuuguguaggauguucuaauugaauaggucaguccauuugcagaugaaacagcucagguuguagccuagugcuaaggugagaucuucagguggaggcuaugcaaggaguucuuguguguguguguguguguguggagagggagggauggagagagggaggaagggagggagggagagagaucagaaacuuccauuuugaacuuccgauccccuccccuacccccacuaaacuuagcuuccccuauuauagcagcacagcgcuuugauguuuugaugccagccacagauagcuugcucucugaaguaucaugccauuugguuauuuagaugaugauuuagugguuucccaaaaaaccggaccugaaaucuucuuugagcugagcugacaugguauuuaagguuccaaaaggcaggugcugugauauauugcugcagccugacaaaugggaguacacuucagagugacaggcccaagacuuuaaugaaaggcuucgcauuucuguuggccaauuaagacucuguugaugacuuuggaucauuaaugaacauuuguguaaaguggccauuugaauuugguuauuuuauaguaacgcauauguucaagaagugcucacugaaaauagcccuaaaguaaacuaagacgcccguuuugucauguuaaagucaauaaacuauuuuugcuuuuagugccaaagcaaguugacagaauuuuuuuaucugccccucacaaaaguuuuggguagaaaagguuuuauuuuuucuuuacugccuuuaaaaaugauuaacgcugcuaauuauugugauacuucauugccucaaauguguaagcccuaaaacaagaaaaaaaaguaauacugacaguucacaaaaggagauuaaauuuaauacagaguaggcaccugcuuuuguguguaccaaaagcaaaagccaaaacguuuggaucugacagaagagcggcaagagugagccuguuacccaggguacacagauuaauuguaaagcacuuggaaaaaaauuuuauuugaaaagauucauaacuaggucuuuccccccagaaucuuuugagucaaaauuucuccguccuuuuaauuguauuucuuaaaguauuuuaaagaucugucauuuuuguuaagucuauccaaacagauucauuuuuucuaugauacuuuucuucaguaaacuucauguucuacagaauuugggcuuguuggguaguuaugacaaggguuaggcucuuuugauaagcacgauucuuuucaucuuguuauuuguauaggcuguaaucucaguccacacuuccuucagucuccauuucauaguuuccagagaaaggagacacuguggggcaaagacuuccccugggaaugcaucgggcuuaaugagcgugaucgucuggugggcucaauaaaucaaauaaagcaaagcauugcucguuuuggaaaaaaagcauuuaucacacaguguuugcucacucauggucacaagauugauugguuuccagcagucaagguguguacugaagccuuuuucauucucuuuuccagugggcaagauacgaaagcaguggcuaaaggagagcaucucugaugucggcuuuggaaugcuaaagucggucaaggaguauguggacccaaguaacaucuuuggaaacagaaaccuuuuauaacuccauuaauaucauuaugaaaaauguuaccuuuuaaaagucaucagcuaugguuauaccaguaauugaauauaucaugggacuguauuucagcuacauuuguuuguugguuuaaaaugaguugguuuuuguucugugcuuuguuucuacaucuauagauugacagauggcgcuccugggccucauuguagguguaccaguuuauagccaacuaacugguugucguuucagauuuuagucaggcagcacaaggcugcccauuaucugaggaauaugcugccagcuguuuuacaugcuccuccucucggugagcugaggcagagggugucauccguugcucggcuagccucucuucuguccuguccuuucuuaaacauuucucuaaagcagauaaucuagcaaagauucugcuggugagagauauuuguguauguuguuaaagcauacuuuccugugaguaggucauuggggaggacacucaagacagagcugguagucuguuacuagcaugccuucaucuguauaaggugcucagccuaagcuuugcuugaagugcauacauguuacaaacuuaaauugccaacauauaaauuacucugucagcagacacacuuuuguccuccgugucuguuccuaggagggugugagcuguauuuguaucacugaggugucaacuauagcuguguccuggaucguucauagcgugcuuuguaagaacagcugacuuaauucacgugaagggcagguuguaccaugaagugaaggccauuguccauccuccagccucagguuucuucugccccaugccugguaagcugcacacgcagugcagcaugagcaaaggaaagucuucugagccugcugucuccgcuguagagaauuauuuggcuaaagaaauagucauuaguugacucaaagucucaauaauuucaaugacaacgaucuuuuuuuuuaauuagccacaaauagccugauaaauuuucauggaaaaacauuuucaguuuaauucuuaauaaugguuuaaugcuuuuuugaauuacugguuuaaccuaaauuaaaagaaaauguauuacugcauaugccauaaucacaaguuugaaauauccuauuucuuaaauaaaaaggagaacguuaauuacauuuagcagacauuuuuacauucaaaacuggauauugaaauacguggaacaauugcuuuaaaucacugucuguugagguuccugauucauguuuugaaauggguucuuuucuuaaugcaauaccuaacuuuugauaauuuuuuaaaauuaauauuuaaucagauaauguaagucaaaaugcagacgauccuuuaaaaggacacacugucugucuauguagcaacagcuccagauacguuggggcaguuugauaccuuuuauaucuuaaguagccuuaaacagaacagcgaaaauuuaaaauugacaaaauauuuuuaagacuucaaaauaguaaauaauuuuuaacuauuauaauuggccucaaacuaacaaauuuaaaucuguaggaaaaucaauauuaaauauuagguuaacaacaaaaacucaauauuuauuuuuuggaagcugccuuuuuauugaugauuuauuuuuaauuauaaaauuuacaucagaucuuugauuaaagacuuugaugguuugaaauagccggacacucaaggaaauugcuucuagaauuauaagauucuuuauaaaaugcaucuucaugaaggugauucucuaauugguaauugaaauguagcauuuaguaagauuccaacaucucacugcaagugucuacauguuuccaaguaguuauuuuaauaauuucauuaguagguccaguuccuugcaugugauuguuaaaacguuuuucucaaggaguucagcuuuucacagccucagcgaucuguacuguaauuguaacaccugaguugcuggguugguucuuaugagcuuuauggcaguuggcaguuuaugucuuugcuucccuuuucuguguauggaggccucagcaaccucgauucuauaaugguuacuacauuuuguauuuuaaguaauuucuacagggaucauuuuggaacacaugaauguucauuaguaguaguucuuacugcaaaucaggaagccuucccagccacuucugggaggugcugcguuguagacugugucugcggaggaacaugaguucaugaauaugcacaaagcacuuaaaccuugucucuucuuucagaagugucugcacauggcuucaugaagcuaagcccaggaaaauacuguucucugaagcaucuuaacucaaagaguaguguuuuuccuguuggguaucagaggccuagaacacugacuuguccuucccaaguuagucauauguguaauaguuugcuuaaaucacaugcagguugggcuuucagugggaaugggaacuugcugcuagugagaaauggagucagauacuaaagacucaccaaacaggcuguauugaccuuggagaaacugcugcauccaugugugguggugcauaagugaauugagucuuaaugcuaugguccuugagcaucuccguuagcugaauuguggagaccacauguuucuuguguccaacauuuuauuacagaauaaaggauuaaccuauggucuuuuuagaaaugguagguuguuacucaaaaugcuuacguauaauaggauuauugaccugagguuauuuaugaaucuggaagcuuucugguaugcauauuuguguuguugguguauuuugggaaacaaaagcucaauaaaauauaagcuuccauugguguguauauuauaucagauauaaacacauguaggaacccuccuuucccccuccagaacacuguaacaguccuagaugacguauuugaaaaagccuuucugcauguuaaucccagagauauuuuuugucauacucuuucauaccaacagcuucuaaguguaacugaucagagaaacucugacaugcuaaccugaaguguguugcuccaaauggggccagcuuugguagcacugucagaacaaagagaugcagagggacugccucacaccaugcagucacaacacugaaggcggccucagaugcugucuguggaagguguaucuccagucugaggagcuugagucaacaguuuuaguaauuuugaggguuccccccccccccaucacuuaauccuuagugauuuuugauuuugacagaggcucagcuuuuaacaggagaaaaggagggagcacagccggugcagguuaggacugaagagcuccgaguucucugccuuuggcauugucaguucuggaggcuuggcuuggcuuggcucagggcucuaugcuccauuaugagccaucugccuacagauucauuuaauucuuaccaguuucucuuuacuaaaaaaagaaaauccugaaaguauaaaagguuuccuuaaacuguugaagugugugucugacaugaaggauguaaccaaccuuucuguuccuuaagccaaauaguguucaucuucagugugaaacuuaacuguacaaacugcuuguauaaugucaagagauuauagaaacauuauuaauaaaaugaacaugagccuaugauuuuuuaaaucaaaggaaguguggagcuguuuuuucuucuguaugcauauguuuucaacuuuacuuuuuuaaccuguauuuccagauuugaaaguagaaaguaauuuuuauaagucugcuaauguagcauugucuagauaacccaacuaugacuaaaucccuuuggcuuuacagcugaacauaucauaagcuaaguuguaucagucucugguuauuuuuaaaccaagacuaaacuccuaggugguguugagucugugauucucaagcauucucuuucaaaccuggagcaucccaguggacauucucauucuucuaaguacggucagcgccuuaggugaggggguaaagaucacagaugguacacgccugagccaaagaacccucacagaauuacgccuaguucugugaguaugaaaagacugccuccccuaaggaauauuguuuuauuuuuaaagauaaaauaauaauacauuauuugauuaaauguuuuuuuagauacuagggguuugcuuccugagagcaaggaaacaggagaaagaaaucuugagcauagauugcacgguuacacaugccauuuggaaaacagccaguguuugugcuguuucucagcaacacagugugugcccugugaaacaccuccauccccuugacuguacacagagguucuagauugccuguagcaggguaguuucaguaaguaaauagguauuuauugagugacaacuuaaacacuaugcccuaaaagcucacagugccuuguugggauuugucuguuuuuccaugaaacgguuuaaaaggagagaaggcacaucuguaaagacagcgaugguuuagcaguucaaggcucuuccucuucaggacacgguagaauuccgugacuguaugcacaaacucuguucagagucgguuuagguugucugucuccagucaguuacaugcugaagcuggacucaaacagcuaaugagucugugggauaagugucugcuucucaugccuacuguuccgacccaggggcccugagacgaggguuggcaagucccgagacacccacuguaugcuuuuggcuuugcucacacagcucccaaaggguaaagccugguggcaggcaggguuucuaguccucauaccaugugugcccgucuuuuuugugugugauggugccuucagaauaaugagcauuuguuccuggauagcaacaaauccagugagaaguagguguguucucuacagcuuuggucuuuuguuuguuuuuguggguuugcuuuuuuuuuuuuuuuaacuaggccugugaaauacuuugcucugauacaucuugacuugaauaauaccuuauccugagucuuccuccaugguaguacauguucugcugguauuguuguaauuuuuggagaauuacauguggauaaaauguguauguaagccauuacacugcuguaacuaaugcguagggaacaauucuccccuuaacacuuacagucuaaaaguggcuguggagugggaggugacaucccugagguucuagcauagccugucaugcuaacugagccgugccauuuguuucacaagggcucaaugcauagucuggauaccaggcuuuuagugucuguucagaaguucuuccuacugguuuucuuagucuuguucuaaaacaaaaaugcccauguguaauuuuuaaagaugugcugggaacaaauaaauccuuucuaaaaccaau

SEQ ID NO: 869 - RNA, 13795 nt, Mus musculus
cugcuuuccggcucucggcucuuccggaagcggagcugcuuaccggcguggggcgagacggggagcugccgggaagcggccgggaagcggccgagaaccugccgggugaacagggccugcaggggggcugcgccugggucccgcguggggcgccauggacgacgccggcggcuugggaggcagcggaggauuccgcccgggcguagacagccuggaugagccgcccaacagccgcauuuuucuagugaucagcaagcacacauccgaauuggugcugagggagcgcuucucgcccuucggagacauccaggacaucuggguggugcgcgacaagcacacuaaggaguccaagggcguggccuucgucaaguucgcgcgcagcucacaggccugccgggcaauggaggagaugcacggacagugccugggucccagcgacaccaagcccaucaaggugcggggcugaggugccugguuuagggugugugagguagagaugcccagguugggguguuugggauaugggugcccgggguugagggugcucgcgagggugacggcgguauggguuggggucucucccgccccuuugcugcgccggggaugcugugcaucugguaggagagggguuggauucugcacgcaccgugagugugccgaggauggcuuggaggagcggauccccggccucuggccaaaggagccucuuacccugggaacagauuggguagccacauccaaggauagcacaacuguggcugaccucguaagucagucaaccuccuguccccgucuuccugucuauugugaaaacuuuucugagcuuccucucucgaacacuguaauuaccuucgcgacuagaaaauuuaguuuuaggguuuuuuuuccucguguauuuuacuuuuacaaagcuugaaggaucucuuaaguaaaaaaaaaauuacagcaccaugccuauaaacagaaaauuaucaaaguaaaaguauuuugugacaagcuaugcuauacuggaaaggggcaaaccuagaaaacggugcaaggugugggggaauucugguuuggguuuuguaagaauaccauuuacgaguguucauggacugugggcuagagugucuccagccccucuucuaugcugcaccugggcauggggaggggaguuagaggguaguaggggcagagaaaggcagagggagaggaggagggggagggaaagaagaaggagcaggaggaagaagaagaagagagaaagaaaaggaagaagaaagaagaggccagccaugagcacguagagaaggggaaauaaaugggggcggggggagagcaagggaggaacgggguuaaaauuuuugagaacaaggugugugcuaggucauucaugugcgcuauauagauacagucauuaaucaggggacuuuauaagcucuuuaggcucgaaaauuuagaaauuugugaucugaugguauccccgcucuuauuuauccaagguuccccuuuuaucuacuauuuguguuuucuuucgaguuucucuuguauguuucuuuggcuauuucauuaccgguguguugauuaaauuaacuuagaguugcccauuucuucuaauaccguuggcagugcuugacauaugguggguauuacugaagaaauaacuaaaauagaccaccuagggauaugccucuaacucugucuuguaaguaggguccuuugccucuauagcaagcugucuccugagcaaagguaagcucuccuucuccuggacccaguguucucuuccacaaaaguacacagugucgugguuuuuauauucggugucuuuugaguuucugccuccugcaguguuccguuuuccaugguuuucucacacuucagugauacacacugcccuccuuaaaggaaacacacacacacacagagcaccccucauggguccuugugaauaagguguuccauauuaccugaaggccugccuggccuacagacagaguuaaacuguagccaggguuauaaaguaauaugcuuaaggaauacacagcguuauucugaaggcuuuauauguuucuuagguuuucauugcccagucccgaucaucaggaagucacagggauguugaagaugaagaacucacgagaaucuuuguuaugauaccaaaguccuauacagaagaagaccugcgggagaaguucaagguacuuuuguguuaucaucauagcuccgcccucaacauuguuauuaacagucacuaacagcuggacgauuguaaugagaguucaucauaagaucuagguugagaaaaugaagugcaaacgcugaguauuuucauuaagacuacacagcuauaggugauagcacuaaaauauaagcccucucugcccccagagccugcucucaaaauuccaaagcacugguugguucucauuuaucuugccccuccacagagugagucaccggccugagcacgugagcugugcuggcuaauucugaucauggccugugcuauguugauaucacacucacucacagcuagcuuuauccuaagauugagcuucucugugggucacaguuaagggaaaacguuacagcucugagcugcuaaucagagaaaaugacuuuggacaaauaauuuuaaaucuuuguaggcagcaacuauuuguagguuuuucucaacagaaacucaacacgguuuuaauuguuucgaggugguugcuuucuuaugguauucucuucugucuaaccucuuaacaccgugaguuggaggugggugacaagcaagaagaaagaagcuagcaggaaaaaauaguuuucauaugucuuuggcccuacuccaguugaccuucagaaauaacagauuccaaaaauuuguacuccauacuuccuccaauaguaagaaaauguuuaccuaacuuuuucucagagaauaauaaagcaccuuaaucuaaauauauaauaaacuuguuuacaagagaauuuuguaaaauacauacuaaaugacauagcaugaguuuauaagccuacgugucuuccaacauuaaacauuacuguguguuucucccaaacacuaauuuucugaguagacuauuauguucugcuuugaacugauccucaaaagagcauccagucagucauucacgaugcugcuggagacacguaaacauuuucaacagauacugcugcguauugagcgucuccuagacucuuaagcguuuaaucuggaucaguccauuuaaccuuucgcaguccagugaggucagaggugcugaagaugcugacagaggagaguaaacugccuggcuacugagugguugagcuagggcugaaucucagaaucccaguuccagagcacgcccaccugucuacugagugagacaguguggacaagccuuucucucccaguuuaguuucucuguggcuuaggcaagauuucuauaggcucagcuucauugucugucaaaucagcaguauagaaugugugugucaccuugaaggauugcauuguuugcacgcacgagacacaaauacguauaauuuucagucuuggacuaucuuauucaauugugagucuccuaaggucaucucuuuugacucuuguagguguauggagauaucgaguauugcagcauuauuaagaauaaagucacuggagaaaguaaaggcuugggcuacgugcgcuauuuaaaaccaucacaagcugcccaggcaauagaaaacugugauagaaguaagaaugggcuuuuaaaguuuuauuuuauguguuuggugguugugccuacauguacaucugugcgccacaugggugcagugccugccgaggccagaggaacaucagaucuggaacuggaguuacagaugagugugacccuccauguggguauugggaacagaacccagguccucuguaagagccacaaguguuuguaaccacugagccaucuuuucagccccagaauauacuuuuuuauauuuuguuuuuaacuuugcuaaaaggccuuuaaaaagaaauucucauuauuauaaauaacagccuuccaugcuaugccauguaaguaguguagcagguauuuauacagauccaaggcugaaaacauuuugcauugaugaaucagucaugcacugaugccauccugagaaacacgaucggcugaauccuccauaguaagugcaggacacuccuggcucauuguuugcauagguuuggggcuuuaaaaauuauuuuguaauuuaaaguauugaaaacugauuuacccuuuuagguuuuuaaaaguauuuuucuuuguuguuuuucuuaagacagagucuuguuguguagcccagacuagacuuuucacuugugauuccccugcccuggccuccuagcugucagcuuuacaggcgaaugccccugugcccagcagaucugauucuguuuguuccuacuugaccuaagcccuaagaaggauuuauuauacuaacaaacauacaaauuaaggauggcauugguaagaguugcuaucacggguaaauaauuugaagcuauagaggcaaauuguuggauguuuaauguuauauauaaaauugaauucagcaaauaagagguguacuaaacucugugcuuuagacuguuauaaaaaucuguauauacaggaaagaguugcgguugaucaguagaauucuuauuugccucuaaaguccacacugugauuuucuucuuagguccuucuguuucucagaagucagucuuaacuggcuuccugugguauguuccucaguaugcuaagaggaggguauaggugaaguaccugcuagcucugacauuuaaaacucuaugucuauguugauaagacugaaaacaaaaguacaucuuguuuucccugaccuccuaguccuuguagagucauaacuccucccugcagauagaaugagcucagaccagcuuuguuucgccguguuugcagcugcuggauaauaugaacacuaugaacccauauacugauguacacauaauauggauaagcauuuuguuuuagaggguuuguggggcuuucccaccuuguauagggaggcaugguaacaggcuaaagaugaggacagccaaugggguuuuggcgcuaagcaugcugggcuaaugggcgacaccaucuuuuggaagaauggcucagcaaugcugaccuugcuuguuuguauuaaccucuacuuggggcucuugauuuguuguuguuguuuucuuuguuuuguuuguuuucucguauacuuuuuguccuuuaacuaugaaacaagucagucugauggggauggccaccauguaaauucugccuuguaugguuauauuucuaaaacuaggucagauccacaaaaaucaaacauguuaaguuugcuaugaagcuugaaaauucacggguucucauuuucagguuucagagcacucuuggcugaaccuaaaaauaaagugucgggguccccagaacaagaugauuacagcagcgggaggcaggaggcuuugggacaggaacccagagcaaaucuguuucccuuuggugaguagacugccuguaccucuucauauuaauauguagcauauugguuaccugugagcugacuucaagccguucucugucagcaaccugaaaaugcuaccuagugaaugaaaaucugauauguugcuggguuuuuuccugagaaguugcucaguucuucuaacauccuuaauucauaaacuuuguuuaccuucuuuacaauauagauucuucugacuagcuacucauuaucuacauacuaacauguuaaccacuauauuuuuugugugugugaauucugcuuuuuugcgcaauucaccaaaaguaugaaaguuuuauacagguaucccuucacugugcugcuguaaagcuugguuuacagagaggagaggaccaaaggcagacgcugcgaagugggggagaguggguuagaguccacagaggcgcaggcaggacuuuucagauaagauucuugccauauuuuacaguuuuauauucuacacuccuuccugugguauugaacuuaggcucuccugaaggaguucuauauugaaguuaaggaagugggcgaagcugucuacuuuccugucacugcuucucuaugguuguagaauacuacaguacuacaaaagacagggguagauaugaucaaaacguacuguauacguguaugaacucucagaggauaaauuaaaauauauuuuuaaaagaauaauacaaaauauagugucucauguuuagacauuuuaaauaucauugugcaaaaugguuacauaauuuuuaauguauagaaauuuaauuauucauuuauauauguguauuauguauaaauauguauguguguguauucuauauauauaguuggagaacagcaaucugaauuuucaacuuuugacaagaacgauagcagaggccaagaagcugucuccaaacgccugucgguggugucgagaguccccuucacggaagagcagcucuucagcauuuuugacaucgucccaggccuggaguauugugagguuccgcgagauccuuauucaaauuacgguaaaaugauguuuugcuguuguuaaguuugcagugcucugugaaaucaguuuucauucacacaugauacuuucuuaugcuguuuaugcugcaggaaguuuauguuuucuuuuucuaggugguuuuuguuguuguuuguuuuaguucuuuuuguuaacauacagguuuauuauucagugaauuuuuuuucuuuuuucuuuucuuuuuuuuuuuuuuuuuuuuuuuuaaccaugugaagccagagucuacucuggcccaaagauuuauuuuuuauuauacagaaguacacuguagcugucuucagaagcaccagaagagguugucagaucucauauggauggucaugagccaccaugugguugcugggauuugaacucaggaccuuugggagagcagucagugcucuuauccacugagccaucucgccagccccacaaugacauuuuuguuagguauaucauguacuuuaaucucacuaccuucuucuggccccuccguuuuuccuauuuuauaguuuaaaauccaacaauaccuuaguaaauaaacccucaagaauguuaucuuuuuuuauauaaaaaucauucaccauaaaagauauuuuaacucucacaaaauaaagaauucucuauuucccauuguaaaacaacagugccucaggcuagggucugguuuggcucuuugaguugaugcauauaaaguguuuaaagcguccuccucguugcauuuccaggucucucuaccucucuggcauccuaaguguucugcaccucucccuacauucucugauucgugguaguuacagucagggcccuuccucacagcacgccagcggggggucugguccaggcgggucuccagcugaggcuccuccuuccgggcagcccuagguuacgucagacugacaguaaaaccuacucaguccaguaaaaccuacucaguccgugugauuuacagaggccagcacuguguuucucacgacagagaagucaugaaagcuucuugguugugucacaagccccugggcuccgggauaaaccucucccugcccccgcaccgcccgcucaauugacacccagccccagagcugaagucucuucaaaggaaugugaaacgggcaacguuucugauuuucauacagaccacccuccuccacgguugcaacuagcugacuauauccguggacaaguucucauuguuuccuguucaguauaacaagaaaaacucuuagcuucaaagaauuaagauuuugguuuuuauguauauggcuauuauauaagaaaacguaagcugggccuggugcuaagcgccuguaaucccaggacucgaugggagaccgaaacagugggauuacaaguuuaaggccaauggccuggucuagcaaguuccugcuaagagaagaauaaauauauauuuuaaauucaacucauuagauagaauauauacugauacuacaauuucuuaaaaauguuuguauuuuacaaagaucuaacuuacauuucauugccuacaaauaauguuacaugcauguuuagcagaacuuuguucucuguuaucuuugauuuguacuuacugguugugugagaaaaauggaaguccuguauuuuuccaccuuugaaauacauuguaacuggggcuggagaggaggcuccuugguuaagagcacuggcugcucuuucaauucucagcacccaccuggcagcucacaccugucuguaacuccagugucagagcuucugacaccucacacagacauacaugcaggcaaaaugccaaugcauguaaaauuuaaaaacuaaaaaagagaaagaaaggaauacauuguaacuuaggccuuaaggaugcugccuuuugcaugucuguauauucucuauuuuaggucauggugugguucaguauuuuaacguagcaucagcuauuuaugcaaaauacaaacugcauggguuccaguacccuccugggaaucggauagucgucucuuuccuggaugacgggaguaauaugacagaguaaguaccauuccaggguggcccaagucaaaccgcgggccaugugacucuggcuugacggauaaaaauaaacaguucaccucaggugaggaagccacagcaaacaaauuauuguuaagaugcugaguauuucuaguuucccauaaaccgucgguuguuguuuccagacucaucaggaaaauggcgacacagaugguggcggcccagcucgcgucgaugguguggaguaccacgagucagcagcaguuucugguaaguggguaagaauguguugcgucuguaccgagaacacuuucagagcuguaguaaaagaccacgugggugccggaacacacccuuagcucuuguccccaaagcgcugaagggcugccuucuuuucucucccuuugugccggacucuucugcagcaauauggaggaaaugcugccucacaggcgccucaaauccagacagauguuguacuuccgucgugcaaaaagaaagcgccgccugaaacuccagugaaagaaaggcuguuuguuguguuuaauccccauccuuugccacuagacguguuggaggauauauucugguaagguucucaaagcuacccguugguaguuguaagcaaguacacucauuuaaaccaguaaccacuauucucacacucccgcugcugcgccgugaccugcucugaguucuaaagacuuaacugaucuuuucuuuaugcucauuuucuuuucuccgucagacacacauccugaccuacacacggaauuucccugauuucuuuuuuaagacuuaagauauacaggaagguagagaauggaaaaagucacuugucucuugagagaagauucauuugcauagaccuguuguuuugacguuauguuuucuccauguuauaauucaguguuuacuaaacaucuuacauuuuacccacacuugguuggauccugaggguuaugacauggagggcaaaucacuuaauuauaggggauaauauguaguaagaauaaaggcaagaggagggucuuaccuauuuuuguaucuuaauauaacuuuauaucuaccauagcuauuuuuuagacauuugccuuuuccccucccucuaagauuguauauuaguuaaacaaauagguagcauguaaaagcgccacacacaaugucagucauguacagaugugucgaccuuauguaacugauucauuuagguuugggucuggugguuuuguucuugaaccacugcgucccucugugcugggcaugcacugggcuggcaugcgaaguguguuguaaacaaagcauucuaccucaugaacaggacauuuguuacacagagcagcaguggaaggucccacagaaauucugagauuucucuuugaagcaggauggguccugagaccugaaggauaaaccuaguuuugccagaguaggagguugggggguauggcuuggguuuggguuuuuguuuuucuggcuggaaggauaugaaaagagaucauuugaauguggacaaugagagacuguagaggauucaaagcuggggacaccagugaagcuaaguucauuuuuaccuaggaggcaagguagaaccguugagaugcuucaggaaaaagacagagugaaggauaaauuggaaagggacagccauggcguagggagagucaugaaaaaaaugucagagcgagggagaggcaaagaugcuguuggugaggaaggaggccccccgggagccaagagaaguuugcugaagaaggcgcuguuugcugcgcggcgccagcagaaguuacaugcugacguagacaggcaucgggaaagaguggagacuuguauuuagaacuuacagguagauggucuucuacuuuguuucagccguuuugggaaccugaucgaggucuaccuugugucgggaaaaaaugugggcuaugucaaguaugccgauagaaagagcgccaaugaggccaucacaacucugcacgggaagauucugaauggggucagacuuaagguuaugcuggcagauuccccaagagaagaauccaaaaagaggcagagaacuuacugagccuuaagguaagugcuucucacccacuagcgaaggagccuaagaaaaggaccgucuguaaguauuucacuuguaagcuuuccuucuggggacuucagaagccagauaaaaccauguuggcuuaaaacuauuaauaaagccaaguucuucuuucaauauauuuuguuaauuuaaaauuguuuaaauucagggcuggaaagauggauuaacaguuaaaggugcuugcagcucuuucacaggacccacaucaggcugcuucuauaaccacuuguauagaccuuacagucuagagcaguguuucucaaccuguggugugcagcgaccugagaccaucacaagacaaaucuauacauuauuauucauaacaguagcaaaauugccauuaugaaguaacaaugaaucuaauuuaggagucaccacaguaugaggaacuauacuaaagggucacagcauuaggaagguugagaaccacugcccuagggcacucagugcucuccucugaacucugugaacauacucagucauguauacauauucacagacagacagacagacguguacacgugcacacacacauaucuauauauaucucuaucuaucuauauauauacauggauaugucuuuuaaaaaguaaucuugugaugucuuacuaucuucauacugaaaaacaguaugaaauaauguauauuuuuguaccuaaauauuagugucuuuccagacucaaacuuuugaguuugcacauugaaaguauaugcucagaaaguacuuucaugugcaucuguguauuuuuagagaacucugaccauuugcuaaccuccauuucuaugaauacugauauaacacagguauucuuuuuccuacggguuaguuuucaaagcucaaucuucuuucucugugcugaguuauaucucugacuuaaaggagacgucaucuuugcuuuccucuagugaauucugaguuucagagacuguuuccuguucccucacucaucauccucucagcccugcuccacguaaggagcguccaggucuggccaaaguugugaacuaggagcuuggaauuagucacugcaggccucuccggugaagacccuuguuuuguagagcaaagcaagucauuaguuccuucuucaugaaaagcauuuggcagggaaaaaugcccacugggcccacuagaaauaauccagcuuuaaaagugcuuuuaaauaucuuauuuaaugaugaaauucacacucauuacacuaaacagcuuggcauuuuagcucuaaaaauauucugguaccagugaagaguuagcaagcaaauuuucuuguuugcuaauaagauguuaauaauuuaauucuguauaaauaaauaguccuuuaaaguauaaugcagaaauuacacuuacccuuguguuuaaauauuuuaguauguaggagauaauugcugcuuuuguucagggaguuuuugcccuuuaaaaaggcaagauauugacuucauaguaugggaagauauacaaaguggucucaagguugagccuuucuaaugauaauuuacauuuuaaagggaauuauuggcuuguaaucucagcacccaggagacuagagcagaaauguugaguguggggcuggugugggugugcagggagagcuuuagagagagggagugaaugagaagggagcagagaugugcacuagguccaccucgaacagaacaaggaaagcuguguaguucucuucagauuugagagaacucagguuuuggcuagguuccuuguuagagacugggacagccaaauuccugauuaaaggaaagaaaagcuuuguaaaugugaacuaaaaagccuuauauuuauggcuuuaguggaaccuuucagacgucaucuuauacaaaugaugagaaaggaaaagcuuaagggugaagggggaaaaagauggcgcagaagucccuccccaccagcugcuacugagagccaagcuuuaaaguagggcagcuuugccuucauagugaugcagguucaccuggcuucccaauuaaaggaacuacaugguuuucagcauggcuagccaucagcgcuuuuaccauuauugaauuuugauacauauucagggcagagaucaaaaagggucaaauuacuugaaaauggugcggugguuaggauagaaauagcuauaacuuggauguuuauaccaugacuuuuguuuuuguugcacauccucuauuaaccauggauugcauagugagauuuucuaccuuuggggugcauuaaauaauuuuauuagucaagaguggaacccugaaccuauaguuguaguucuucagagacugaggcaggagaaucauagaaacugcagagccuggaagacacagugagacccuguaucaauaugugaaugaucuuuuuuuaaagguucaacacgauaguaugauagacucccacauuuuacaugucaugacaggagggauuucuucggugugguuggugcacuguucauuuagcuuuuauaggacgcaccuccugccugcugggugcucuugucucugaggaauaagccuaggauucagugagccccacccgagagaucuaagagccaguguugaaaguaguugagcucccuuuuaaggugagucuuguuuuuauauuucucuuucuguuagcggaauauagacauuuuacuauuucagagcaucugguuuuaaguuaauuuacagacuuuucucucucacaaugcagucaguaucugccagcaucagcucucuaaguaagucuggucuuguuuacuuggaggcauuuaugcugaaccaggucagacuggccacgccacggaagguuacagagcucccgacagugagggaugcuaacuacaucggcugcacgugaugauuuucauccuuguguuguguucuuucuacagaacaaagacuaacuagugacauaauccucagcugacugacugaaaaccugacuggacgaaccccuguggacaguugacagcuuuuuuuuuuuuuuuuuuuuuuuuuuuuuucuauuuucuuacauauccgauagucuucacaccauugcuuaucugggaucgcugacauguauuuuugucugaccuuaauggaaaaauuaauauaguaguuguuuccuagaacaaaauguuguuguguauagcagaaauaaagcuuccuuagagaaauauguugucauguauggcagaaauaaaguucgcuuugcauaacuaaau

SEQ ID NO: 870 - RNA, 1003 nt, Mus musculus
cauccacuucuguguuugccagacacuggcauagccucacgggagacauacaugauuuuaauaacgagggagaaagauaaauucaucaucuguuaacgaauuccauuguaguauccggaagccuaauaaguggauuguaucauuuccucuuuuagagacaguaacucaagaacacauggaccuugggaacuaaagguaugguaugucuagugggucagacagcaagcucaggaaaacguaacacuacagccugcucggugcagcgcaugugcuuugagccaagcagaugugaucgauggcugcauuugcuccugaggaugguauagaccaugcucggagaaaaugcacacccaccagucccugcaaaguccaucugagagacugccccggaaaagggaguucugaggcuacucuuuaggaauugaaguguccgugucaagguccacguggccuagcaaagacgcagguugacagaggccacagccacuguagcgcucauaaaaaccaccggccugaccauaucacuacagacucgggagaaagaagacuucagggggcuauuuuaagaaaaugauugcauuugauaugugaaacucugugacaagguaaguacuguuuccaacaaaaacuagagaaauauuaagcacagucagauaauggaaguggcuauucccagaugcccuucagagccugcauccugugaacacugccauuugucugcagcuaacugaguuucuuauuuagacuggaauguuauguuccaaccacuaacguauaggucauaguaucaaguagcuaggucagguuguuagggguauuuguucuauuguuuuguuuguuuuuuaaaauucuguaaagagaauuaaaguugucuacuccagugucgcuuaccaauuuauguaaagaugugauauaucaaaauauaugcuuugauuuauuuuuuuuuaaccuuuuuuaaaaaaaucaauaaauuccguugguuuugguuuuggcccuaggaaac

SEQ ID NO: 871 - RNA, 10092 nt, Mus musculus
ugugacguaggacaaugccugccacgcgucccaauucagucugaucagccugcugacacucuguggggcuuacacugggccugggagugcugcuuugggaaacaugaaucuccuauucagacuagcaguuuuccuuagccugugguguuguuccgaugcucagggacaaacaaaagaagaaagcacugaggaagugaaaauagaaguuuugcaccguccagaaaacugcuccaaaacaagcaggaaaggagacuugcuaaaugcccauuacgauggcuacuuggcuaaagacggcuccaaauucuacugcagguaggagaugcuccguccaguucaaguucaguugauagaccacaucuugcccacuaccaccagcagcagcagccagagccuaacugguuguuuuguuuuaagguuuuuugguuuuguuuuuuaacaguaaauuaagccuucaugccgauuuagauuagaagacauucccuaaacaaaacugaauguuuuuaguuauuugaaauguaagcgcaguaaacugacugcagacucacuacgucaggcagagcacugaccaccaccacuguccuuggaacccggaaaacuaaaucuagaggcuucuugaaaagauauucacacuuucuccuuacccagagcugaagucugauuccaaacagaguguauaagaaagcuaccgcguuuccuucuggacuuugugggucauuuucuaaaacucugguuaucacauccauucucucuguucccuaguccggucugacugaaugcagucuguuuagcuguacuguuuccccucaaagacaggccaaucuuuccagucuagcaauucuuuccaauuuagaggaaaacuuauucuuccaacguagaagagaaauuugacaggaugcuauuuuucagucguucuuaaaaugaaauuuagggcucagccugccccuuugguuugggaaacaaacccagagaagguaaaugagucauuuuguucaagccauccagcuaguuagaggcaggagacccauuuuuaaaagugaaccauugaguaguuuuuguaaggacggcaaaaaucagaaaucagaauguuuuccaaugauaugcucugccaauuuauggggaaguuugauccaaacaauucgcaaaggacagaguucugaagggugcaauguggggaaagagauuccagucuuaaguaacaagugccugagcuguauuuaaguuuccuuuaugagauggucuuacuuacacacuaaguaugguuucucauagccggacacaagaugaaggccaccccaaaugguuuguucuuggugucggacaugucauaaaggggcuggacauugcuaugauggacaugugcccuggggaaaagagaaaggugauuauaccgccuucguuugcauauggaaaagaaggcuacgguaaguuguggguuuuuuuuuuugcuguaucuuuuaguagcuuuaaaaaagauaagucguuuauaaaaaaaaucaaaacaaaucuguauauucuuuaaaaauggaaguaagucucaaagagauauuugcauaucuauguucucaguaacagcacaguccacaagaagcaagauguggaagaaacccaagaguccagagaugggagagcaaauaaaacaauggguauagggcacacagugaaauauuacauaggcuuucaaaagagugaaauucugacucaugcuacaguguagaugaaccuuaaagacuaauccgcuaagugaaagacgccagacacaaaaaaauaucaauacuguaggauugcaauuauaugaaguaucuauaauagucaagccagcagacacaaaagcagagggugguuaccugggacuaaaggagagauguugaauagcauaguguuucagugaucaagauaagaguucuagauguagauugcacuguaacacaauuguacuuuauacuuauuuaaaaauagucaaggaaguaaauuuugcugggcagugguggcgcacgccuuuaaucccagcccuugggaggcagaggcaggcagauuucugaguucgaggccagccuggucuacaaagugaguuccaggacagccagggcuauacagaaaaacccugucucgaaaaacaaacaaaaaaaaaaacaacaaaaaaguaaauuuuaaauuagguguguuuugucaauuuuaaaaaguuacagaagaaaucaucacagaaacuuguuuaacaaauucuuguuauauuuaauucauccuauaccuuucguuucaugucuaaagaaaacaagacagcauuggaguaccaaccuccagccagacucucauccucugcauagacacaguguuuaggaugacuguauauuccauaagcucccuuggacauuuuugguuuuaguauuacauaugugcuuccaguaaagaucauuaguaagcagccagguuaaguuguuaaaacuugggagucaggaacaauuucaggauagaaggaugguaccucugagcggugagucguucuucccccaacucaggagaauccuucagaugcagaaaaaauaaguuucagaguugugccuacuuuuaaauagauccuagagcaagaagauaugugaaccugcagaaaguuggggaaauaugauuaacugguggguaggugaucuagcccuagaaguaagcuaaguucauaaacuaauaaaacacaaauugucuuugauucuaauggaacgcuuaauuauauccauaauuggagcaaaauuagaacacaaacaagguaucauuuuuugcuuaucccacuagcgaggacgagaauacugacagagacauggggaaaugggccauuucuuauaugaucgauggggaaggaagucauuugaccaagaguuuuaucagaaguaauuguacccuuaucuucugacuuaauaauuuugaauuuuaggaccauacaccaaagcguaaaagaagauuuauugcuguguuaguuaggguucucaagagaaagagaaccaguagaauauauugauagauagauagauagauagauagauagauagauagauagauagauagauagauagagaaggggagguuauugauuggcuuauaugaagugaucuggguagcccaacaauggcuaccuucucaauggagagaaccuggaagcugcuuggucuucaaagcuagaugccucagcugugccacacuaacccucaagaucuggaggauuuuuuuagagcuccuggacuccaguccauguuggaaguuagacugucagacucugucagcaaagaauggugacagcagcaaggguaaaugaagccagcacaacaugaaggcaagcaggcaaaaagcaaacacuuuucuuuuucagaguuccuuuucuccaggcugcugccaaaagguacugucgacaugcagaccagguguucucucuucaauuaaguuuauuuaaacacaaaaucccuuauggauaugcacaguggcuucucuguucauuccaaauccagucaaguugacaacagagauugacuaccauaauugccaacuucuuuugggcaucaaaauacuugagacuaccuagugaguaucaguaggaaaauuaaacuacgggauauccauacagagaauuaguauguaaccggugaaaagaaugaagugaaaucacaaaaauuaauaaagcugugugcucuauuccugugcugaguauuuccugagcacccaugcaggcuuucagacagauguuaauaugaagggagaagcaaacacuauucguggucugcaaaguguuuucauggugaagggggagcuucccagacaccuauuucuacacagacuaguguagggagguguguaguuaucuggugacauugucaggaaaggaagccggagggguacuaauaagauggcuuuucucugaaauguugaauuguuucacucuuuguugcuguuguuugccacuugcauguauacuaaucuucacaaaagcaaaccugaaaacacacaacacacacacacacauacacacacauacacacacacacacacacacacacacacacacacacacacggacauuuuaugggagcaaguaggcgcccuugcagggaugagcagcacccuccugguuucacugagaccuucuuugcugcagcaugaagaaccuuugccugcucaccuuguguaaagcucuugccgacuccaccuaacugaaauagcuaauauguaaauagcaaucagguucuuaaggcaugcuuuuggcaacauccccauuauccuguagagguaaaccauccuugaagcuguuggcugaguguuuaagaggugaucccccuugccacugcuagaugccuagaugugacaugauaaaagagauggcuucagauaucuacagcuucccguucaaugauucugccaaucauuugcucucaucagagcagcucauagcacugggaggaaaccagcacaggcaaaggccugacucuaaucagcacugcacuaucaaggggacagaaaagccuggcaucaucauuuguucauuaugugugugugugugugugugugugugugugugugugugugugugugugugucccugauauccugugugucugugugugcaugaguguguguauguuuaggacccugauguccguauguguguguguuugaguguguguguguguuugaguguguguguguguuugaguguguguguguguguguguguguguguguguguguauaggacccugauacccuguguguguauauguguguguguguauuuauauuuguguauguauauauguaugugcauacacauacauauguauauacauauauauauauacauauauaugacgcugauauccucucucucucucucuuugugugugugugugugugugugugugugucuacccagcuacuuaaacugucaacacaaacuccaccguuaacagggagauagacaguucuuaaugacuuugaggagucuucaauaaacaucaaaacaauucaucucacuagcaccuuuauuuuacuuguaugaagacugaggccuaaaguauguacauagaauuguaguuacuuaccuguuggcuuuaccauuauuacagcagcuuagaguccaugauuuuacaaguuguaguauaugcaccauaguuauuuagcaaaaucuugguugugcaagcuuuuuaaaaaauauauuauuauuauuauuuauuauuauuaauugagaguuucauauauacacacacacaauguauauugaucagauccacacucacuccuccccacuaauuccucucagauucacucuccaccuuucuaccgcuccuaacuuugugucacacacacacacacacacaucacacucaaacacacacauauacacguauuacacacacacauacacauaucacacacacauacauaucacacacacacaucaccuaccaagucaauuuguguugugcauauccucauggguguggagcuauccacuggaauguggucagccuaccagggaccaaaagcccguuuuaaaacugacucucccuccuaccggcugccaaaugcuccucaguuagggguaagggcagggauucuagcauguugacuggcuuguucuuuacaggucucuaugagcuaauuuaagguguuauuaaagcguaacaguuauaacuucauuuuaggugaugcuugaagaagcuuuuccucuggcgaaauguccuuggcucaugucccagaacacccccgcaugucuuaaagugcauguggcuuucuagugcuuugauuaaccaucucugugguauguauauacucuuuacaguaacuccaucucuccaaucuaccucuauacaugcagauaauuccacugcaaugcacaucuuucucucaaucuuuuuuuguagaaaaaacuaauuagcaacauuuucuguguguguaauagaauuguuuggaacuuccugugcaucuguggucuucuuucuugggaagguugaguuugggcuucaggguagcucagugguguagaagcucacgugucugccagacccugcuuccaacaccagcaccagaacaacaaaaggaauuuguguuuuuagucugucuucauuauggucaaauuuccucuguccuucaaagccagguaaauuuguaggacauuagaucaggacuuugacgacagguacaugaggauggguagauuuuucuguguucugauuuuggaaauuacagugcacugcuuggggcuguaauuucuacccuuuccuuuauggguuagguaaguauuauuagcaaguucuguguaaguacuauuuagcaagaaucaucuacuugacuauuaaggaaauuguuucuuuugauggacaaauuuagcuacuuucaaaaaauguuagucguuuggcagaucuucuucuucuucuucuucuucuucuucuucuucuucuucuucuucuucuucuucuucuucuucuccuucuucuucuucuucuccuucuccuccuccuucuuuuuagauuuauuuauuuaaauuauuuauaugaguacauuguagccaucuucagagacacuagaagagggcauugcaucccauuacagaggguugugagccacuaugaccucuugaagagcagucagugcucuuaacugcugagccaucucuccaguccucucuuuuucuucuuaauuacacuuauuuauuuauguggggugaagcauauaccuuagaaaguaugugaaagucaggggacaauuugugggagucaguucuccugccguguagugaacucaggucaucagucuuggcagcaagugccacugaguucuuaccagcccaaccuuggaauguuuucugcucauacauuucuucucuauaccauaaaucugcuacaugaugaucaagauauacuuauaagugaucuugguuuauuuuaacuuauuaggaaacuuacucugguucagaagagccuuugaacugacuugguuuaaaauauacuggggaaaaaaguuccaaaauguuuuuauaaaauguggggggaaaggguauaaauugaacuucccugucuuuuuucuuucuuuuucuuuuucucuuucucucuuccucuuuuucuuuuuccuucauuuuuucuucucucucucucucucucucucucucucucucucucucucucucucucucucucucucuuucuuuuuggauguuaaaaaguuuaacauuuugaaagcaguucuaaggucuauaacccugauacuaaugcggccauggaguauguaccugaaagcuacuuucauauaacucaaacuguuaaaauuuaaacccuuagcagaaggcaagauuccacccaaugcaacucugauguuugagauugaacuuuaugcugugaccaaaggaccaaggagcauugaaacauuuaagcaaauagacacggauaaugaccggcaacucuccaaagcugagguaauucaaacuugcugugugcaguuugauuuuuucaauuaaaacucagauugcguugaagacguucuuacuucucacuagcaccagcguuuguguugacaugauuuuuagauuuucuccaauauuggcucugauggcuuuagucgaucgaguuguuugcuggaaacucaaaaaucugagaaaaaaaaagaauauccuuuuccauuuuucuguauguaggaaggucauuaaagucauaauguuaacuuuaugaggcaggccuauagcuucgguuacucccaaacuugacauaaggaauaacaccuugagggacagccugggcuacagagagugcuugccugacuauccgugagcucugggcucaauuaccaguacugccaggucaaugagucaaucacucaaucggauaagaauaaucccaagcuacccauggcucuuccagcaugaacacuaggggacagaccucuuuccaacaguacuguauaaacaugucacuucuggacugggacauaaaugagauuaggagcuagcaaggauugaaccggaugggcuaagaagucgguaagcaugagcuacaaguuccucgccauccccuauagauggacaaucugcgaugaugauacccauucuucacacuuucuuagucccggguaccauuuuaagcacguacaucccugaaucuaucuccaggacaguucacaugacagacucuccucuaucaucgcuaucauggagagaaagcuacucaggagccguguaacugccguuacaauaccagcaucgcgcuccaggcggucugcucuggcccugagccuuggccacucugagccuuucugagaauuaccauccugaguguuucugggaagccgaaugccucagccgcugccuccuuuguuuagaggugguuaaaaguguauaacuacugccuacauaggcuagaagaggcagguaguggccugauuuuaaauaugucaguccucuuucugacugugggguugagauaaggccucacucuagccccaagcugcccuggaacuuacgauguuguauagguuggucuugaacuugugaaaauccuccugcugcccccaaguacuggaauuacaggaagaagccaccagcccuaacuaauaagccuuugccuuuucucuguauuauuuuaccuggggacuggaccuagaacuucaugcaugcuacacaugcacugggccccuaagcuguaucuccagucgcuuacuucaucuucauuucccucuccagccuucuuuccacucaacuccaucuccuccuguaggagcuuagugggucauagagcauccuugcagcuccccagucagcccacacgaagagagacauguuugccaggugucuuacuuugcuuucuacugcugcaauaaagaccacaaccaaaaacaacuuggggauaagggccuuaccuggcuuacauagccugggucacaguccauugagggaacccagggcaggaaacacaagguaggaacugaagcagagacuaugguggaaauuaaguguggcuaauaccaccaaucuauagccccaaggacagcuaauuugaauaacuauuucucuucaaaaauuaaaagcaaaacaacaacaaaaucccaagccagacauguuggcacaugccuuuaauaccaguauuugggaggcagaagcaagcagaucucugugaguuugaggccagccuggucuacauaaugaguuccaggacagccagggcuacauagugaguuccaggacagccaagccuuuguagagagacccuguuuuuaaaguauuuccaaaccuugaaauaucuuuauaaaauaguuacgggcuggcaagauuucuuuuuucuuuuuuuaagguguauuuauuuauuuuuugugaguacaucgcugucuuuagacacaccagaagagggcaucagaucuuauuacaaaugguugugagcuaccauaugguugcugggaauugaacucagggccucuggaagagcaaucagugcucuuaaccgcugagccgucucuccagcucaauuucuuagugaauauagcucuugcuccaagccugauugaugaucugaguucagucccugguacccccacaugguagaaagagagaaccaguccccacaaguuguccucugaucucccucugugaaccaugguccuugaguguccuugccccauaaacaauuagaucaauuaucuaaaauguuuguaucauuuaccaugcuuauucauuacuguaaucauuucuuagaguuauuggauaucauuugugguguguuuuuauuaacgauguuguguucuggccucuagauagagcuuuacuuacagaaggacuuugaaaaagaugcaaacccccgugacaagucauaucagaaggcaguuuuggaagauaucuuuaagaaaaaugaccacaauggagacggcuucauuucuccuaaggaauacaaugugcaccaacaugaugagcuauaaauauaauuacuucucuauuuguuaguaacucacauacuuugcuuuaaaaaaaauaccaccguucucuauguugugguuauaccuguuuucccuugugagaagauauuuguuccuucaauaaacauaauuuugguguauuaauguaaaccuguuuugcaaaucuga

SEQ ID NO: 872 - RNA, 54541 nt, Mus musculus
uggcuucucuauccagaaguggucucucucucucucucucucucucucucucucucucucucucucucucucucucucucucucucucucucucucucgcaaagcagagcccgccgccagacacaucggguuauugccccuaaacuuccucacuccacuuuuuacaucuugagcgggacauuuaaaacacaguuugggauuuuguaaguuuccaaagcguccagagggcaguccccuuuuggcagcgccauugcaggacgggagccagagauuagccgagguagguccccuggucucaaaauccuauucaccucgcucagaagcccaggacucuaccuugcuacuuccuucagcucagaggggccagaagcagcuuuccuuugccugcgugccuggccuccucaauaacaccauucaucgccugccucucggggcaccggggaagccccagucacgcgccaggguucucgcucagguacgggauucccgggguaaccgccggccccuaaccucaggggcggguaguccacugggcagcgucggcccggaggcgggcucaggccggaagccacccgcggccccgcgagaccgcgcccccgcccccgccuccucguccuccucuuccaguacgagcucggcggccaagggcgcaggggccagcccgccgguccccgccgcgcucuuugucccggccgcgcgcgggcggacgcgugcgcaucugcccccccgccccccagcuccccaaccuccgccaccccccgcccgccaccccccacccggcggaaaaaaaaaaaaaaagaaggcgcagcgggagcgcgcucgcgcgggggcgcgcgggagccgcucgcgcccccuccgccaggcaagcagcgagcacgcgcgccgccgcgcccgccccucccccgcccgcccgcucgcucggaacuugcugacugcgcgaccgggaggagccgagccgagccgagccgagcgcagcggcgggaggcugagcgcgcggggggcucccgcgucccugcgccuucgccuucggccggcagagcgcccaccccaccguggcucccggagcgcggggcggcgccacccuccggccgcagcgcggcacugcacggccgccugcgacuuucgauguuccacacucccgggccggagccucggcggcggcuucuuuucccgcccccccggugccccccccaggcugccuccauuuccucaaggaagguuccucggcgcucucccucccccacagcguagcggcgcacgagcgggccgggcgggcggccgagguaaggcggcggggccggggcccgcguggggggcggcgggggcgggggcggcagcuuuguucgcgccgggcgccgcgcuccucaguccgccgcgcuagucagucagcggcgcggggcggcgggucccgcaucccccggcgggcgggcgcaguggcgcgguccccugcgcggcccuccccacaaaggaccgcggagcugcguggcccagugcucgccccggggcgggccgcgccaauuuguugcacuucuggggguggggggugggggagggcuuuuguuuguuuguuuguuuugcccucgggguuuuggccgcuuugcggauuuuuuuuuuuuuuuuuaaaauaacaaaaugucggucggugagggaggaauugagcggggaacgucgauggcaccgggagcuuugcagaaggugcaguuuggagccugcccuuccccggguggcagcucgggcucggcccggugaauccucgccgccggccguggggacggcuguggggcggcugccaguugauuuuuuuuuuuuuuuuaaauucgagugcuguguucaaaggcuuucggugcgcacgggaggaccccgucaccguaaauaagcauaugggcgacuaacgggguauguuuuuccucugggaaggaggauuugaucgcucagaccggugucagccuguaaauauuuagacgguauuagugacuucugaacauucucggcgagaucuguuauuuacaguugucauauguuauuaaugcccguugcccaaguucccuggcaaaucuguuucaugccuucugagaaaguagacaauugauagauuguccaagggaugggaaaaaaaugugaguggguuuuccaacuugcauuuugguaaaucccucaacgccugcauuauaaauuaugauacguaucagauucccuguaacgugcugcacccuaaguacagggacuuucgaauccuuuucaauaaaauacucucaaaggugcuuauugagaagugcaugcugcuauuuuuuuuuaaagaucuaauguuucuccaugggucucuucucuccuuagaaguuuucccagagauaaguucaccaagauguccagugacaggcaaaggucggaugaugagagcccuagcaccagcaguggcaguucagaugcagaucagcgagacccugccgcuccagagcccgaggaacaggaagaaagaaaaccuucugccacccagcagaagaaaaacaccaaacucucuagcaaaacgacugcuaaguuauccacuagugcuaaaagguaaugucuacaaggggaggacucacacggucagguccccuucccauugguggcuuuugcuggcuuaacuucaguggcaauaguucagaaauaguucuccaucaaacguaugugaacuugagugggcugucauucugugugugguauagccacgcaguuucccugcaacuaucgacucuaaagccagcagacuuuguucugugcuguggugacucgaggauggccucaagaagagcugggcacucauucugacagaugaagggcuuggcaagggaaaucuggugagucccagugaaauggcuuguaggagagguuuccuucugugagucaugugugagugaaguugacaguucuagagaucagcagagcuucucuccagaaaacggaauugucagaaauaacaauauuuaccagaaaauugguaaacuccaggcuuggcucuagugggaagcaguucuuaaugugugcuuuaaauuggcuuacaaucuguaagaagaggacuuuaaaucauguggcacaggugugacugagugaguuacugcuaucccaccuccucgugagggcagauacaacucggaaguagcuguuacaguuuaggugucacccagugacugaaaacacccucggccuuccucugcguagcuccagcauuguggaugagcuuggcagguuaacaacagggggaacauuucugaguccaagugagagaucaguucuucucuguugacuucuauuuucuguggugacugaacagauccugucaauggggcuccaagugguagcaguguugggauaccuagagaaacuagugauuaaggugaaaugugccugccuuacccaggacagguguuucauugguuuuuauuggacauaaauggaggaagaaaaauguaaagacugaucauauguuacauuuuuauugugauucaaacuuuuugucuggaucuaaaccaucgcugaagugcuagcagcuuuagaguauuuuauuaaccaggaacagccuuugaaauaaucugaaguguccaguuuguugcacucuccuggaggaacguauuaagcacgcucucaguuuugaaaaaugcccugaauuugaagaaaaccagccaguugacuuuugcuuauacuucagccuacauauuuaucugucuucccuacugcagguuuauugacccuuaaagguguaucuaaaaucagagaagacacucauagcucauaugacuucuguugacuuccaguuugaaauuuucauuggcagagauauuuauacauuuuaaacuuuucuggcagcuaaaauauugccagaaccauuaaugugcucuuguagcagucuauuaauuuuuagcucaguaaaaagugacuugaagucauugucaaauucucugcuguuuucccuccuccccuuuugucucauuugcauauaagcuugaaaagagaauuucuuugguaaaaaauguuuuuaaauagauugucuauccuucacugagcagucagaaggggcuauuucccaaaucaggugugaauggcacacuuacuuacacuugugcgugagaaaaagagcugcaaaguuugugcuaagggauuuggguuaugccucugagaacaaagaggaagcagccauguuagcauuacugaaggcaaagccagccuugcauuuaacugcauggugguagagggcagugugauuccccgcuuauucuguagacuaccucagauccuuuuuguuuguucucauuucacuaacagaauucagaaggagcuagcagagauaacccuugauccuccuccuaacugcagguaagaaacaaauuuuguuguucggauugugaguugugggaaaauaaugauuugagaugaaugaucuugccugaauauaugugcagcccaaagagcuggcuucauguguuucuuccuuuuaucuucugaagugcacagacuaaaagugcacuaacuaaauaaaaaggggagaaacgacacgcuagcauguccacaucgugagcgucugaguacaggauugugugcuucugagaccagugcgauggggcugguuuugccugugugucuguagggcaguuugguuugcaacacagauuucagugauuucuaaaauuuucauccuuaaagaacuguugugugcaaucugaacugaccuuccaaaucuagaaauugcuaaaugcaguguuagaaaauguaacugcaguaaacaagaguaucgucgguucuuuuugauuuauucaguaacuugccugaaggguaaauuuuaugugcuaaacgauugguuucaguuguuuucuggaggaugcauuguuggaauuauuuauguuuuaagcaguuguccuaauuacuugaaaauucuuaguaaguacugaguaaguuauaauuguagaaagaauuucacuggaacccaaguagcuaguuagugcaauuuuuuguuuguuuuaucauauauguuacuuuuuaaauuuuugauuauauggcuuaugaaaugaguaagauuuagagauaaauucaaauaauuugcaaacuaugaguugcugguacaguugaagugaugcuaccuuuugguggggaaauuccucaguguuuaauccauuucugcuacaaguucuguaguuuucuguguugauuagacagaucuuugaagucauuuauaaacacaaaugugauccauugaccucuuacuguguauguuaaucagaucuguugauaaggugaugugauuuugcauuuuucaaugaauuaauaguuugcuuauuaaaagucgauaugucuaaccuuaaaguaauaacuucugagcuaugcuauccaauacagcagccacuagccacauguagucauugauggcuuuacuuguggcuaguucaaaaugacaugcuaaaagugugauauaugcaccggauuuuaaaagcuuagcagagcauaaaagucugcuuuuauauguugaagugauuauauuguggcuauguuuaauagaauaaaaauaaaauuaaaauugcuuucacuuuuuuuaguuaggaaauuuacaacuaauuaugaaugacuaauguuauaucuuuguugcuuuuaaaauaaguaaguugagguauuucuguucacccuccuaaauggucuguggaaucuguguucauuuaagaaggucaaguuguuugcucucugaaagaauaacuuaauucacaacauauauacuuauuucucccacuaagagagauguaaagaucagagaaaaaaauucugcaauuuaaaaauuguguguaagaucaaacauuuacaaaaguaguugauuucucugcaaauagcaaaauccaggggacagaaaugaaucuacagagugugguagauguguugaaugcccucagagcagagcuguagugguguugaaagcagcuuguguauuaaacccaggguguuuccucaaggucaccaaggauuauuuuagaaccuuucuauggugcagaguuagauuuguccugaauuuuucuuuuguguaucaguccaugagauaguguuuggcauuuggcaguuagacuggugggaaagugaggcuuggcucgugcuuguagccagccuugugucuguuuucccucauugggcuugauagcugucaguaacugcaggccaugccggucaguucucugcauaagacauuagaaaauagugggcuuuauaaauuguuuccucgcacuuugaaguuaggcuuucuucucuuauaugccuuacuuguaaaaagaccagauacuuugguaugucugauuuuguguggaaggucuguuccuuacuggguaggaaauuugcagauuguuuuaauccaggcaauguugaauuuugacagagaagucuaaauuuauauuauauauauauauauauauauauauauauauacauuuuuugccuucaugucagaucugggaaagagcagcacuauauucucaauauuccaagguguuuaaauauuuauugugagguuuaauggagauuguaugcuuuaaauuuacuuuuuacuuaggcuaccaucuaucuguguaucucaggaaaaaaaaguugaaugaaaugcagaaaaauuuggggggaaagccaaauaacuccaacuaugaagauuuuucuuaaauuucccccuuuauuuagcauucuuuaguuaggccuaaucaccaagagugaucgaguauugauuuaauuguugaguuguauacccuuaaguaagcuugaugcuagguugguggauugcuucuuuuucuugguaguacauggauaaagguguuaucuccggcgauaagauuguguuuccacuuuggaauuaugagaugcugcugcucccaggcaggguaggacuggacucccuccucauuucucuugggaaacacccucacagacauggccagagguaugucuccugggugacuucaaaccaagcagguugcccaugaagauuauuagcccacugaugcacuauuuucuuacuggcuuacauuuauaguuuugccuucuaggcuuuagauuagacuauaauuauaugcuaaggauguuggaaagaaaauugugugugcauugcucugcuuuuagagaaaccgguugauaaugaccguggagugaugcauaaaagggucaccugacuaccuuccuggcacagcuuguagacacaccgaguuuaggaagguccuaugcuuuuaacuuagccccuaguuuuucucucuauauaaacaaguacaaauguauguuucuuaaauguucuuuagcauguuuagauagaaucuauuaguaugcaaacauuuaggguauugguauaguuuuuggaugugggaaaugccuaauugggguugaaguuuguaauauuuuucugguaaaaucuaaaagcagguguuuacaauuuuugacaauuuaccccugaagaaaaguaaaacuggaaaccucaguucugaaugagaagcugguaacuccucacguguucugacucagucugggauuuucuucugccaucuucuggagguuguuaccugcuuuucuagguagaucagugagcugcagagcagaccugagcaucacauagacuugugagaaguacugaguacuguccccaccccacuucgcccucucccagaagugaggaaccauaaccuugaguugagugagauuugaggacuuguguguuaagguuugcagaguccugguacagcagucagucugucugggugcagguccugcucugcugcucaguagcauguugcacuaacaagucaugcuuuauucuuauucuuccauuuucucaggucuaaacagcaugaaguuccaggaaaauaauuauuuuggauugaaagaaaacauuaaggaguacauauguuugucuuuauuucaguagugguguuuaagaugauuauucuaauauaauucuaagcuuucacuuuuauuuaauuauaagaagaaauugaaauucacaguaaucuuaauuuuugcaugugaaccaguacagaaagacuuggauugcuguaagaauaaagccauuucugcccccagaggaggaagugaaagaguaccuuugcaaaggccauagcuuuauuaguaucugcuaaugcucuguucagauaaugccaggaaguagaugggaacaauaagcacuuuugaaaaguuacaugcuguaaauuauauucuccaugcaaaacuuuuugguacucuauaccauauucucaucuugaaugugacucuguaacagcagauguauuguguuugguuaucagaaaaaucagauuugcuuggguguucaaguuuagaaaguagaacaugaccuuuuuaaauuuauuauuauuauuauuguuauuauuauuauaaccaggcacagguuuagagaauagacauaggauuuucuuccuucccaugucuuucaacaggaaaaaugcauccgggcauuuuuuuuuuuuuuuuuagaggcuuagauucuaggggauaagcuguauuaaauuucuaauaauuuucuuuugcaucuuaaucagugguuuuauauuguggcagugccuuagggcucccacaccugucuagggaacaguuaccaaugccuagagauagcauuauucuugagaauugaggaagaaggccacuggauuuuugcccugcaaagcacaagacagcccccccccccccccaggaaugaucagaacaaaagcaucaguaacacugggaggggcggggcguuguaguuaccuauucuuucacucugcggacaguuugcuauuuucucauaugauucuuuccuaacugauaaccuccaucucuugucagucccguauuagcuugugucuuauauuacaauuauuucaauguaugaugaagccacagcuuuggaacucaaaaauguuuucaacaguguuucuuuuaggucuuauaacuguugauaauaccauuggcauggcuuuaggcugauuguaucuaugguguucaaagaaauacuaaggaaacauaagggagaaguaugugagggccagacauagugaucacugguagagcgcuugcuuagcauggaugagguccuaaguuuaacuccaaguaccacaaaacaaaccaaaacaggaaaaaaaaaaugccauugaagaauuaccaaaguucaguuuuaaaauaacugaguuguucacaagcaagaaagccaugcucuuuauuugcuuuuuuuuucauuauuaaaauauuagccugccugacuggcauauugccacaguuucauacuacuuauguuucacggugcaugaauugucagguuugcaaagguagugugaucugauaacuguguuuuauauguucucgaggcagcacuccauaaucacaauguggauauuucuacacuaaagacuugugcauauucuuacuaagugggauaaguagaaaagauaagcaauuuaaggccagcucuuaguuuggcuuugcuaccaaguuauuuugugcaaaccuuacuaaaaucuuugggucuucagugcacuugaaagacagccuguggauaaggagaugcuggacagggcagguucagcucuuaacaguggucaucacagccacagugccuacuaguggauuccaguuucucaguuguuaguuuuggcuuauuaggugguuguuguuguuuuauaucuuauaugcuuacuagaaaaaaaauagauuuaguguucuuuacucuuaauguguaauuauuuauuaguguauuucuuuuaaaguucucuuuaaguuggauuuuuuuucccuuggcuuucaaaauacugucuuaauuuuucuguucauucuagauauagaaaauuacauagagaauauauccuuuaacacauacaagaugguucauuuucaaauauguguuauuuugaagcaucuuagugcaauuaggcuguaaagagaaacagcagauucugauaguuguggugccauuacagagaagcuuaggugaguugcuggcucagcauagaaaggugcauuucuuacucagaagacaccugguaugggccagagacacuucuguguugcucuucuggugcaaacugagguccaugcuuccacccuguggcucugccacuugaaauaugugucuaaucaagagaauugaaggagucacgugccagguuuaaggacuuugguuuggaaauaagacaaaaaaauugguuucacagcugugccuaacaaaacuguaaggugacugagaaaugugagagaguucaugggcauuccaugagaaaccaauuuuucugacacaaaacaugaaugccaaggauagaugacuggcauucucucuaagaguaaugauuaaguaguugaguagcagccuggcgcugaaggauggcgccuagcaguucaguaacuucuuacuuaauacaguguuuuguuuaaaucauaauuggauaacauuucuuuugguuuaaaauuaaaaaguaaaucuaagaguuguugagaaaucuaaaagacguaauauuauguacaugaaaaagucaggcauacaucuuagcuaacuucagauuugaaaguaagcuuuuucucuuucaaacaauacuguuugaaaaucugaugaaaaguauucagaguuugagagucuuuggauguguguuuauuguaaguguauuccuuugcucacagaggaacaaacucugugaagguacugcaugguuuuagaaucugucccaaagugagcuucaagugguuaaguuggggggaaaagccucuuucucuagcuuaguggugagggccucucuuuagggggugagguaucauucccaagguugccagcucuuuguucuucuccccuuguaaggacagaguaaaggguugaauguguucauaauggaaaaaauaaacuuuuguuuuuugcuuauggcuuuccugugcacaaaugauagaucugcauuuuucuuuggguuacuguaggagcaguccauuuuuauggguuuugaauuugaugagaggcuuuguguuguuaagaauuucugugcuucacuggggaaagcuaucaggaccaauuuuaagggaagccuaaagcagauagcgugugcauguaugguagucuaccugugccagauccaaguuguugcagauguuagcuuuauauuagauuccucauaauuuuguuuucaguaguaccacagucuauuuaaaaaauauuucuucuaaacauaauuuuauauaaaaauagcucauaaauuauuacaguuuuuuucacuaagagcuucucuggcucucucucucucucucucucucucucucucucucucucuuucuuucuuaucgauauaauguucucagagcgagaggccaggucuauagaaccuaucacucaaauuuguaccauacauguauuuagaugcugacucugagggcucaucucuuaauguuguagcagcuaauagggaucuauaagcaaaugguuuaggcucauuuaugacaccugugaugcucaguugugauaaaaguagcaucgcucacuaauaaugguucaacuuuauggguuggugguuaaaguuuguaaaguuuaaagaucucguccucuguuuggcuuuuacugugaacaguuguuuuacguuuacggcuuuuuguaacaaaccuuuggaaaaaauuggaaggaaucccaguagcagucucacugucguagguuacagccuggucggagggauuugaccaguuguaugucauucauaaaagguuuuucuuuccguuuuucuuuuuugcuccuucagugucccagagcaaauauacuuugucaucuguuuaacauccaguuugucuagggaaaaauagagacguagcuagccugaaauugcuuuugggaguguaagugcauaucuuuugggcugaaugaaaggccuagggaaacaugaauuuugcuaccucauuuuauuuuccuuuacucacaaaucaucacggugauucccucuucacauccaugcccuaguguuuauaaacaucauuauuucccuucuccagcucaugauuucuagauaguuuugcuauauaaaauuauauagguuucuuacaaauauaucuuuuuuccccacauuaaauuuuaagucgagaauccagaguccccaagagagugaguuuuuguaaguguguggcugccuauuuauauggcuuuugaugcuuuccauaguuuucuaaacuuaaaaaguaguggcagcaaaauguagaggacguaggaaggcaucggcuuaaugacuuuagucuuguuucauaugagagcauuugcuauugguuggauuugugguauauacauauaugugugugcauauauauauauauauauauaugcuuauagaugcaugcuguuauuacagugagguaaaaucuaccacuuggacugcaaacacaauuugaggcaaguauaugacuuaauggaauaggcuuucuucauuuuguuuaugucuuugaaaaaauuuaaagguuuuuguuaaauuugcuuaugcuugcuauuagcauuucuguuaaagggcuuuguuuaaauuguauucauuuuguuuuuucuuucuuuuaacccugaaauauguugcaaaugaacuguuccuugcuaaagcauuugaauuuuuuaaaaaaauaccuuuuuauggaaaaugucaaacauguagaagaaaacagcaguauaauaaacuuuuuauguagcuuucaucaaguugcaguagucaccgaucaguggcuuucuguuuccucuacacaguccauucuuuuaacucuccuuaucacuuagcagauauuagcauuguuucaucuuuccccuuucagaauagauauugcaguacucuuuuucaaaacauauagacuacuuuuaacuuaacuacagggcuauaguuccuuagucauuauucagaauuacaaaugggcuaugaauaacuuuucuuuucccagaguuaacuugggccacaaucagcagguaaaucaggauugguugagagcaaucagcuuccucucccugggagcucuuucacagagguuccuuuuuagauauccuggguauaagauuuuuacauuacaauccauaacaguuauguaguagcagcuaaauaguuuuauaguuggggucaccacagcaugagaaacgaaggggcuacaguguuaagguugagaaccacagcuauaaugucuuuugaccucaagauuucuucauuucauuuugcaucuuacuuauuagagaaacugagcugaauuugcuguaguauguauuuugcuuauuagucuccuacuaaguaauuuaggaucuuuuauuuccuuggugcaucauuaaauuugggaguuaggucaagaggcuugaucagagacaaacugaauucauacuuuacccuauucuuuccuuuugucccauugugcuggcuagucaaccugacaaaagcuagagcuaucugaaaggagggaaccuaaauugagaaaaugccuccauaaguucuagcuguagggacauuuucuauauuggugauugaugggggaaagccccaucaaucuauaaagaaaacaggaugagcaagccuugugaaacaagacuguaaacagcacuccuccauggccuccgcagcagcuccugcucuaggcuccugccuugugugagcucuguccugacuuccuucagugaugaacagugacacagaaguguaagccaaauacacccuuuccuccccaucuuguguuuuuguucaugguguuuuggcaauggcaauagaaacccgaagacacccauugaccauugacucccacuucuuuucuuucuuucuuuuuucuuuguuuguuuguuugcuuguuuuuuguuuguuuaaagcaaaacugcuaggcagaaugccuuuggcaauagaaacccgaagacacucauugaccauugacucccacuucuuucuuucuuucuuucuuucuuucuuucuuucuuucuuucuuucuuccuuccuuccuuguuuguuuguuuguuugcuuguuugcuuguuuuuuguuuguuuaaagcaaaacugcuagacagaaugccuuucagaagacauucagcugugacagccuuuuuugauguuucgugacugaacagcccuuccuaggcuuggugagacuauuuggggagguuauguaacuuagaggagguggggccuggcugacagauguuuucccuaaggggccagucuuugagcauagguaguccagccuugcuucugcuucuggcuuuuuacucugcuuucuaagcagagaccuguguugugugcucucaccauuggugcagugaugccucccccaguuaguuuuugcucucauggacugaaacuuucuaaaacagugagccuaagcccauuuccccuuaaguugcuuaugucaaggguuuuguaacagcugugaaagucaucacacagcagugguguaagguaguccugguuagcaguguguuucuucuuucucuucaggaaagucaguuuucugcuguucuuuguggagucaguaauuccuaguuguugucuuucagucaauuguacugcuuuagaaugucacuauuauccuuuuagaacuuauuaaauuaauugauuuuuuuguguauguguauauucauauguguauauaugugcaugggugugcuuccaugugugugcaugugaaggucauauguuaacagauaucuuuuuuugcuguuuuuuaauguuuaaauuauagucucaaaaauaaaagauaauuuaaaaaauguuauuuguauguacaguaauuuguguguauguacauauauauccguguguuguuaccugcaaaggccaggagaaggugucugguccucugaaacuggaguuacaggcaguuguaaacugcccugugagggugcuggaagcaaauucagggccucuauaagagcagcaaauguuuuuacuugcugagucaccucucuauuuacuuaauuauuuuuaugacauuuaaaaaaucuuuauacaauauauuuuggucauauugcccucuguuccuccugcucaacauaguuguuaggucuuuuugcugaagauaccacuuaaaaccauugaaaauguagaaauccagcuaucguccagcuagaagcuucacaaacccuucugacuugcauuuguguauugggaggugauguacugggaaggaaagauaaucagccucgcccagcuaggaaccuugugaucuacagcagugaccuacuuuauuuuuugagacaggauccaucauugaaccuggaacuuguuugaguagaacagguagccauugagcuaccaggagccuaaugccuaaccacuguuuguucucuccuuucaccucugggguuaguucaccauuccugucuugugugaguacuggggauuugagcucugucucugugcuucagcaggaagcacuuuaccuggugaaccaucuccuaagcccuguuacuuuuaaauaagcacacuucagacgaaauacaucacugugccuuaggaaaaauuagaaguaaauguauucagagaaguuaacagaaguuauuucuuuaaacaagauguccuggcccuuguuauuguggagaaauuaagucuuagcaguagaacaauagaagcaucuucauaucuuugcugagaauggguucucugguuuaaaaguuggguuguuuuucuucuuaauuuuuauauucuagguaugggugcuuugcuggcuugugugugcaccauguuuguaccugguacuuguggagguugauauuguuccuuuauuacucuacugagacagugucucuagcugaaccugacacuuccuagcaugucuagccaaccucgucuacuuauccuugggaucuuuguaucuuuacagagcgcuaggacuaugauaggcugcugaagcuacuuggcuuucuuuauuuggguccacggaucgaaacucuuauugucaugccugagugcuguguucuuugagccaucucuucaggcccaauuuuauugucuuaagugucuguaugaaaaauaauuucuucccucaacauuucgcuucuuagaccucuuucauuaugaaaucuuguaguuaauuugagggcuguaggguuauuaggugcugcuguuuacgugcaugaguccacggguguacacacacagacagacacagacgcugcugcugcugcuaguacuccuacuaccacuaccaacaaugccacugaaucucuuuguuuuuuuuuuuuuuuuguuuuuuuuuuuuuuguauguuuguuuuuguuuuucuuacuagugaguuuuauuuacaggcagaccuguguuaauaggauuuuuaucuguuacuugaaaaugugccuuucuaaucucuuuuauuagcuucuuuaguauucuaagaaaaccuguuuuuaaugccuguuagucucuugcucuucauacuuuuaacaccugaggaccaaguauucaaauauaugaacuuauagggccauucucuuugaaaucacuacacagauuggcauugugaaugugugcauggcauguuuaugugagguugggaguggggcauggagggugauucauuaguuuaacacaauaccaggaguauguuuuacaguguaguagauauuuuaaaguuugugcacucaugaugugacuguauguggaugugagugugugugugggugguggggguacaugggccccagcuccagcauauuuguggaaucaguuguuugcuuccaccuucgcguggguucuggggauugaacuuuaccugguaagccuuuucacuagcccuuucaaaugauuuuaaauaaaaucaaaguuagugucugugaguagaaacauucuagcaguugaugagacaaaauuggcaauauguuuuugugugaguugcuuuuaaaaauagcaugucuauaucaagucaguguuggagauacaggaacccaaaacaaauuggcucacaggauuaaaaagcucagggucuguuuggccaucaguaucucauuacuuucaaacuguacugacgacuucucaguuaaccccaguuuaaacaccccuuuuuauuuucauaaaacaacugauaauacuuccagcuuucuccuucagauugagcuaccuuuucacauaaugugacuuuccacccuaggcuuuuuuucacaaauguuuucucauugcauaauuaguguugaucuauuuaauauuauuuauuaaauaauaaauugauuuauuguuguugaugauuauuuauuuguugauuaccuuuguuagcuaaauuguaucaccguaauguguacauggaaaagcacaguguguauagggcuuggugcagccaauuacucauuagcagucuuuaaauauuuuuauuuuaggaaauguuuuuguauucaucuggcucugugcuguggccugucuucucuuucuuuacacugaguacauccaugggucaccugccaugugcucuuucuccaguccagcuccucccuagagaagucauguuauuauuuuaguuuauguguguaggugaaacaccuacguauaugucuguguaccaugugugugccuagugucuuuggaggacagaagagggcaucagauccccugguacuggaauuacagaugguugugagcugccauguagguucugggaauugaacccaggucuucuggaagagaagcagguucacuuaacugcugagccaucucuucagcaucuguuuuaauuuuucaaaagcauacuuuacacagagcaaugcaguuuauguauuaaguaaugcuauaacagaaugacuugauacguuuugaacagaagaaaaagauuucagaugacaguaccuauuccaccaaaacaguuuuuuucagucauuuuuuucuaagagggucagugugacagauguguuccaugauagguuauguuuaauuccuuuuuucuuaauagucagagaagguaaaaaagcagccaagcauucaucaucaccaccucaaagggauaacaugcuggauucauuugaaauuuaaacaaaaaaaaaaaaagguuuuuuugcuacuugagaaaguauguauuuugcauauacaaaaaaagaacuuuuggaaugaaaaauaaaacaaaaguuguacauccucuuucaagaggaugcucuugccuauggccaucuuuccucaguaucuucccuuggucuuuuuuccaacuuuuagauuauauucacacuuaugccugcuuucauauuucauauaugcauguaugcauuauagacuagggcuacauguauaagagagaagauagaugcacauguauuuucauucuuagcuuggauccauucucuuaaguauacuuuccaacacuguucuuuuuccugaaaauuuuaugauuuccuuuucuuuuccagaugaguuauauuuuauuuugagucuguaccacguuuucauuaucuuguuauuugcuaauggacauucaggcugguccauucuuuacuguuguaacuagggcagggacagcauggugugcagaugccuuggugauagggauggagccuugcaggcacuugucuaagagcggaauggcuguuuuguacaaugguuucauuucugaguuuuaaggaaccuuccagcugauugccauagugacuaugcuaauuauacucccauaaguagugagcuaaggguugcuuuucccuuacaugcucccaacauuuguugucagauuucuugaugaugggcauucuuuuuggggugagguguugucucaaaaguaguuuuaaaauauguuugacugaugacucaaaugcugaauauuuuuaacacuaguuacuuuuuuuuuuaaagaauuguuuauuguugauuuucuguuuuguuuucuuggugauuuuaauuuuggaguuacuuuuaaauuuuggguaaucucuguuugaaauauagcugauaaaagauuuucuccacucuggccugcuagggugcauccaaccugguaacucuuugccuuccuguuuagaaguuuaauuuuauggaguccuguucgaugucucuuugcucauuccugugcccuuguacuucugcuuggaaaguucuugcuugacuccaaaaaucccuguguuuuucgcugguaguuucaggguuuuaauucaggucugagauauaauucuccuucauuuuuguauaaggugaaagauauggaucucuuuuauuccccugaaccuggauauccaguuuugucggaaacaguuauugaauaggcuggguuuuuuugcaauguaguuuuuguuacuuuagucaaagauuaagugaccauagcuuugucuguuuauugccaaacccucuuauuuugcucccaacaaucuguuugauuuuaugccaauaccaggauaucuuuauuaccauagcuuauuguaguauaauuugaggucaaauaucauguuacuuccagcuggauuccuacuccucaggaucgcuguggaugaugguggcuguguuguuuuguuuaccuugugguuccauauacauucuugaauugaguuuucuagacccaucaaguaugacuucagaauuuagguuguaucacucagucuauagauuacauuuuguaguaaagcuaauuucacaauauuaauucugcuaguucaggagaaugaaacguuuuuugucaucuagugucaucuuugauuuuucuuuuucagugucuugagguuuucauuguagagggcucuugcuuuggcuagguauauuuucagguucucuugcuuuggcuagguauauuuucagguucucuugcuuuggcuagguauauuuucagguucuuuucuuuuugaguuaaugugcaugaaacacuuuuuauucugaggggucauugcuaucuuuaauguuuguaucuuuuaacuacuuuaaaaaaaauuuuuuuaguagauccuauaaagucuuucuuuaauagauucugcagucuuuuaaggauaagaucacaucugcaugugagaauaguuugacuuuccuauuuuuaaaaccuuuugucuuuccagcucagauguagagcacaguauacugaauaagagaggacaaagaagcagucuucucaguuugcuuguuuagugugauguuggcugucgguuugcuguauauagucuuuaucauugugauuuaugucuuaucaguuccuagugucaccaguacuuguguuaugaaacaguguguucuuaaacuuuguucagugcuguuucaacauugagaaugauuaugucguuucucuuaaguugguuuauguaguguauaaccuuuauguguuuuguuaauauauucaaccuaucaggcauucguuugcugugggaugagagcagcgaagcugacauaugaaugugguuugugcugcagcuguugcuugucccugaggucaagguggcuguuagaaagggacaugcauuugcaauggcuuguguaaguuuaaugaaagaaauagcauagcagaaucagcaucugugacuuugagagucacaaacaugcauuucaucucagcuuucccucuuauauugucuuaauuaauuuauauuguguuucucauaccauaaagacauuuagguaugaaucucugacuuauagcuauugucagaacuguggaugaauucuuuauggcuauggaauuauacaucuuuauuccauuuaaugcaaagaucuacuuuuauacuuuuaauaauuuggguaucaggucucaauaucuuaauauguuuuugugaauuugaaguuauuuguuuuaguuaaugaaguaauaaaaaugcuuauaacaguuugaguuaauugguuuuauuuuucaaaugacaacaccaaaacagauuuacuccuagaauuaguuaacuucagguggaagucauaaauagcuguagaccaggaugagguuaagauuuuacacacacacacacacacacacacacacacacacacacacgcgaguauaugauuacaaauaaaccaagaguccugaccuaaacaccaguggguggcuuaggacuguuguuggaggcugcuacagcagucacagagacaauaaaagcuagaauuaaacauucuuguaugaaaaguuuuucuaagacucucuuauucaauucaauggcauaaaguugacuuauauuaacauggcuacacuuuuacaucuaggauacagucucuucuuagggauuuggccugauuuugucuuucuuaaauuucaugaaggcuacuucugaguccaagguggcaagauaaaugagauucuaauuaaaauuaaauucagaucaacaguguauuauuucagacacagacacacaugaaaggagagggagggagggagggagggagggcaagcaagggagcucgagacagagcauguguguguguguguguguguguguguguguguuugugugugagcaagccagccugugugcgcccagguauauaugaaggcauaggacauaauuauauacaaauuaaaccaaauuaaauauuccuggguauuuaggguuuggacugguuuuccauaucuuuaugcuucaaauuuguuuauuacauaugauauguguuuuaugguuacauacauuucuugugucagcauuuaauuguuaauaguagccuauaaguuaucuucccauuucugugguguuuuuugcaguauaucauauuuccucuuugauuuuauuuggguuuucucuuuucuugcuuagucuugucaaaauauuuuuccaauuguauuuauuuuuugaaaagacacuuuuuguuucaucuuuuuuuaguguucuauuucauuuacuuuaucuuugaacuuguuaucucuccuugaauuaauuuuggauuuaguuuguucuugcuuuuguugccugaauuguaucuucagguugcuccuuacuguuccccacuccuuucucuuaucaugcauauauauugcugcaaauaucacugcuugcuauguuuguguguguuauuuuuauuuucaucuuguuaccacgauuuuuuuuuaaaaaaauuccccagggucccauucauuaaauaccauguuuaguucucuguacaacuuuuaaagauuuguuuauuucugugauggcaaaagcgugugcaccguggcuucaguaaaccugaauacuugccccguuuacuagacuagaccugaaaauauaaacaguauugguacuaguuacuugucuuguuguugugacaccaugagaagaagcaacuuaggggaggaaagaaagguuuagguucauuucuggcucacaguuugaggauauaguccauuaugauggggaagccaugacagcaggaucucgaggcuccuagucacauugcaucaacagucaggaaacggaaugaugaauucucaugcucagcucacugucuccuuaaucaguccagguccccagucuggagaaugugucacaugacaugugcuggguauacuuaaauugguguugcuaccucagugacucuaaucuagauaauucuuuccagucaugcccagaagauugccuucuggguaaucccagauccugucaaguuuacaaccaauaucaucacaagcauuuauaauuaucaaaacacacauucauuuuuacuguuuguguuuguguguaugugugaguugaugcauaugugcacaugcauguaugugcauaugggggauagagacagucuugguaacuauccuaaggaacaccuuccaauuuauuaugagauggaucccauuggccugggauuuaacaacugguuggccaaggagucucacagcuccaucuguuccccguccuuuggguuauaagagugugggccauuauaucccaguuuuuacuagugauugaguccguaggcuuggagauaagugcuuuauauucucagcuaucuccuagccccuacagauccauucaagaguaaucaaugaugagugaaaauauguguuaauuacacugaaagcaugugguuuauucuguagaauguucuguaagcuaagagaauguauuuuguagaacuuggauaaaggacuguuggauucacuuuaauaucguuuaacuguuucuuugcuaauuuucuuuugguaugggggggggucuguguauuuugucagggaugaaucuaggguauugagguucucaguuaaaguauuuucuucuuuuacauugauccuuuaugauggauacugugcaugucccucugcuuggaguaaaggccuugcuucauagccccagugagcuuugaguuagugauccucuuuuucugcccacccuucuaaggacugcaguuacaguuguguacaacugcagcccacuuuuagcuuuuugacaucugguuuagaauuucuacauuuuauauauaucaaguaguaccucaugcauuuggcuuuuuguauauucuauguuuucuucauucuuuuucaguuuguuugugucuuuauuagugcuaagugaauuuucuuguagauggcauacuuuuuauuuuuuuagcuauugggcuuauuuuccuaugccuucugacugauaaauuuuaucuguuuauauucagguauguuaacugguggaaaaagccacacuuguaucauucuguuaauuguuuuuaagcuuuguauauauuuucuuuguuccccucuuguuucuuaucuuccugguuuggggcauucugcaacaguaaguuugaauuuuccuuuuuugccuguauuugcuguacuguugaguguugcgcaccaguuuugugauauuuucuauuaguccuuuguucuaguguaagucucccuuaagcauaucuuggagggucucacucuugugauaauuuuauaucaucuuuuuaccugucaugaaacuuuuucuuuguuuaugaaaaauggcuuuguuggguaugguauucuuagacuagaauguguaauauuuaagugaaauaacaaucucagaacaaaaaaaaccacuuucucccucauguggauccuaaucuguaugugugauuuguaaauucuuuauaauaagguuaaagauuuuugaggacaguucagcuuuagcuugggauacaauagguaagaucuuuacaggcuaacuuaauucaagcuucucagucaaaagaaauaauauauaugcauauauaugugugcauuugcuuguguauauauaaacaaauguaaaucuggguccuauguaacauaggaaggagaauaaggaaggcuaguuauuaggugauaaggacugaauagggguaaaguguaggagucaccacagaugaguuuauaaagcucauuuucuaguuuucacuuuuacagcuuuuguuuuuauggucauggacaagugcauacaaauauauuugauagugaaaauguaaaaucuaaugagaaguuccacagacuaagaauagcuuuucaaacuacaaaaguucauuguaauauagagauuuguuucugauuaauuuugauaauauauuuuuauuuguaaauucuuuauuguaaaguuaaaacuuuuugaugacuugucagcuuuaacuuagcauauaauagauaaaaucuuuauaggcuaauuuaauucaggcuuuucaguaaaauuaagcagagauucccugaguuggguacacaaauagguacuuuaauaaaaucuggaaaaaaguguagauuucuggaguuuuauuagacaaaauauauuucauggaauagguuguguuuuccauugucagaauuaaauugucauuuuauguagaagggaaacucuacuugauugaacuccaaaguggaagaguuaguuacuagucuccugggaaaacaaauauugucuugcagaggaagcugcagugauuugguuugguuuauggcacuugggaucaaauccagggcuguguucauacuggacaagcuuguugcuacugcuaguuccgcacuuugcaccugcaggggcucccaguuuugaagaguauaccuuucuuccugucuugcagcaacacaaacuagauugguaacucuaacuugguuagauugaaugauuuggcucaacaguuaagaucacuuguugcuagucaggaagacccauguucaguccccagcguccacaugguggcucacaaauaacuccaguuucaggggcucugauguccuagccucugcagguacuaaggaugcauaugcaccugcauguguguauggaaguaaaacaccuuuauauauaaggggacccuaggaaccguuacauguacuauguacuguguauuuuacaaauaacuuaaauauuauguauuguauuggaagcacugauuugguuguuucagugacauaaauaguggauacuguaauuuuuaauauacuucaaauacauauguucaguuaucaagguacuugucugccucauuugcugcuuuaguuacaccuuguuauuuucauuauuuccuccuuaacuuuuuuauguaguuuggugugugugagaggugucuguggacaagagucacuuaucuucacuauauggguuccaggcauaaaacuuaugucauugggcugaguguaggcccuaguucuaguguuuuaaaguaaacuacaauuuuaagaaucaaaaugugucugggguugguaugcacaugcaaguacuuuuauaaagucaagaguaugugugcaauccuaaguaauuuaauugacauucacacagaggugaauuaaacauguuauaaucccagcucucacauuguuacaccuaaagcagauuuugaaaguucguuaccugacucuauucuaugugcacugaguuugagauauacuaccaauuuuguuugucuauagauguaugauuuuugaaauuuaaaauaugcaguuugaauugagguauugaggcccuuaauggcauaguauauucaaguuucacgauuaucugacauuuuuauaaugaauuuuaaguuuuuccuuccguguuuauaaagccucuucuuuuguagugagaauacuauuaugaacaacuccagcuuuaucuaagccuauauaagacugauugaaagaaauggguaguguuggugucacucaaaggaaagguagcucugcuaggcaguucguucugcaaaaauaguuccacaacgcccaaacuagucuagcaagaacacuuggcuaagauguguucuggauagacguaucuuuuucgucuuuucaaguccuauaucuuaccacuacaauguugaauuuaaguggaaauagcaauaaacaucccugaggguacaucauuuaaagcauggacgguuuaggggugggaauagacagaguuggcagaguacuagacaaagguccuggauuggaucccauaguaccacauaaaaccaggcauaguauuguacaucugugauuagcacuuaggcaguggggacuggaggaucagagggucaaaguuaucuuuagcuguguauuaaauucaaacgggggccuagcuauaugagacccugucugaaaagugugggggaguauaaacaaaagcaaaauauuaaagguuugaaucauaguuuaaauccugaagacaggaauucaacuuaagacuucauuuuccuaaacaguagaaucaguaagacacucgcucccuccuucccucccucucucuuucuuuuaccuaaugaaaauuauucagagauaacaaaacuauaacuuagaucgaggaaaaaaaucugcguaacagaaugacuauggcuccauugaaauauguugaagguguaguuuauaguaaaugccuagcaaucggacagaagcuaagaugguuugucuggauugccagugugguuauacuaagugcaguaaagcuuagcucugcuucugcaguggcauucccagagauggugccauccugaauuccugaccuaauggaugguuuaauucacugaugucucuugccgccuccccccaauaaagaugagaauaguuuggagguaguagauguaggcaaaguaugggcuguuuggaggaaacaggucccugaaucuuauuugagugacuuguguugcacaggcucugcuuucuggcugcauuguggaguagugugcccacaccccugcucugcugcaccacagcaugucagcaguuuuucuuuuaaaccuaugagauuuucacuuuaaugauuaucuacucuuguuauaugaagauaugacucuggguaguuauuaauagcuaauacuauaauuugaauccagaauaacuauaauacucucucuucucacuucuaugacagaguucaguaauacagaaugguggucaccaaaaugcugaaacaagucaugacauuuaacaauuguaauuaaauauuucaaacagcaguuagaaaagggaacagccccaagugguuuaugucccaaggaaucaugaguauuugaguuuggagcgggcacucacauaaaagccaggcaccagucaugcaguacaugccuguauuucuagugcugacagauuggagacugguggaucccuguggcuuacuggcuagucagucugucuuaauuggugaacuccaaguuuggugacacucccugugucaguaaguaaaguagagagccaggugaaggaaaacacaugaaguggaccuguaguuacucuuauguaugugcaucaugcagacacacaaagcgacauaccuauuuuuuucuucaacagugacauuguuaaaaguagaaguagauuuuuuugucugcucuaagguguucuggaggugaaguacccaugccugucugaaaacagugacuggguuuacuccuuuagcauaaugccuuuuuagacaugucuauauuauuaucucaacaucuuuaauuuauaugauaaacuaaggauaauguuuugaauaacauauuaaugggaaaauaacagugccuuacagucaugcauucauuaacuucaguuucuaagucagugguucucaacuuuccuaaugcugggacauuuuaauacaguuccucauguuguggugaccccaaucauaaaauuauuguuguugcuacuucauaacuguaauuuugcuacuguuaagguaaauaugucuuccaguaguuuuaggugacccuuugaaagaaaaggucauucaaaccagcaaagaagucacaacccacggguugagaaccacugugccaaguaauaaugacauagccaccuucacauuccaguguuccacuuguuauacuguauuacguuuagccauuuuuauaucuguguuuuaaucaauuggcauuuuuuuuaucucuaucacucauugugguuuuucuuuucuuuuuaaaaauuuuauuagauauuuucuuuauuuacauuucaaauguuaucccccuuccuggucucccuccgaagucccccuccccuugaccucccccccccgcccccccgacccacccauucccgcuuccuggcccuggcauuuuuaucauguuuguuauucaaucaacaggcauuuauuuaguaacauguuaaauagcaaauguuuuauaagguguuuguggauguguaagauguuguagcauacacacauuuaaguuagaguaaaaugcaguucuuauuuaauauaagguauaauauaaaggacguggguggguggucacuagaacuuucaggagucucauagguuaaaauacuguaaagucucauuacaaagucacugauaauuaaaacaaccaucauuuaaaaugucacauaacaaaacgacuugagauuuuaaaaaauaaaauguuuucuuuuccaucauauugcuaguggagauaauacaauuaguacacugacuccugagaggaacaggagacuugguuuucauaaaguaugccuugaaagcuucccucuggugcucuagcacacucucucaucucuaaaggcaugugguggagaguaaugcuucucgaauucauaguggucuucuucugaaauagauuuuagguuuuauauggaguauuaacaccugagccaaaacccuuugacucuccucacagagaaugggcaguaacaaaaguuucaauuuuaacauuuuuacagauggucacuguacuucuacuaauuguuaaaauaggcggaaagauucuaaaacuucugugucacacaaggauaguacagauuguagaauuacauugaugaccugugcuuucauuugauggauugaaugacagcuaagaccccuuguaacaguaugauucgaaagugcauuggaauaugaaaaugacuuaugcccaucaugaggugaagggugaucugagaaaaccuuacauuugcaggucuacagaguguaaaagcuuauaguuacuuguccaagacauuuaggaagccagugcuugaugaaauaguagaaauguuauuucugcucuuagacuugucaguagcaaguuaauguugguaaauuauagcuaaagucuggggcauauucagauuuuucuaagguuuuugguuguuuuuauuaugagauucauuaaccaucuucugucuuauucauuaguguagcccaucaauuuucagucauucuaagguuauuugaaauugauauauuugccuguuacaaagcaaagauauaacaaauauuggguugcugagucuucucuuagccuugaagcugcugugauauuucacacuuuucauguuuucuagcuugagggcacacuguugucuuuagguuuuccaucuaacuaaaaaguccgauggugguauauguauagauaaauucagaacaaggaugaagucagucuuggcacucuucaggaccuuccauuucucccuugaauucaauaaagaccauuaaaagaggcaggaaugaucgaggaauuaggaaaacaaaaacaaaaaaacuuguggcaaagaccuaagaaaucccaaaaaugcugauaaaguaauacuguacuugguuauaaaagaaugguacaauucagauucugcuauaguucucuggcuugagcaagucauuugcuucagucucuccacuuauauaaaauaaguggugugcacugugaccugcaaucagucaccuuuuagguuuacacauucuuaaauagaacuuuuuauaucauaugggcuauucuguguuuguagaugaugucauauugcugaaguacuuaaaugauuuuaucuugaccaauauguuaaauguuuauuaccugcucaguuucuaauacuacucuaugcuucagcucuguuauguuccauuuaaaguacuuauaauauagcaguuaauguauuaccugcuagcauuuauugguuauuguuuuacaauuaauugugcaugauuaagcuuuccuucauuuccccacugugugaauuagaauuuaaagucagguguuaaagguccuaacuuaaauauaucaucuaguaguuagaccuaguauuuaagcuuuuaaguauguuuuagauuucuaaguagaggaaaacaauguaugaaaccagaaaaagcaaggaccccaaaauguucuagcaguguacuuuaaaggcuaauguugacacucauguaucucuuuaaagagaaaguucaaagcuauuucucaccauagcuuuuugagguuauaacaggaaaguuuuccagaacaucaggcaugcuucuggcugagauuuaacaauauuaccuugauaacuuuaccaccauucacagauauaaugaguuuuggcaaaaaaaguuaccauagcauaucacauuuaucugcacaguggcaguaaccauuacaaagcuuggguagauauuuuuuucugaggaaugaaauacuuugauuuaguuaauuuuccauucauuaugcauaucagaucuccuuucuuuaauguugaaucauauaguuucacuuuauaucaccuauugagaucucucuauaaacucaaauccuucaaucaaaauugcuggagcuggggcggcagggacugagacugauaaaucuuuuuuuuuuauuuugcauuuuuuucauuuuuuauuagguauuuucuuuuacauuuccaaugcuaucccaaaagucccccauacccuccccccaccccacuccccuacccacccacucccacuucuuggcccuggcauuccccuguacuggggcauauaaaguuugcaagaccaaggggccucucuucccaaugauggccaacuaggccaucuuuugcuacauaugcaacuagagacaugagcggggggggggggguguucuggguaguucauauuguuguuccaccuauaggguugcagaucccuuuagcuccuuggguacuuucucuagcuucuccacuggggucccugugauccauccaauagcugacugugaaaauccacuucuguguuugcuaggccccggcauagccucacaagagacagcuauaucaggguccuuucagcaaaaucuuguuggcauaugcaauggugucagcguuuggaggcugauuaugggauggauuccuggguauggcagucucuagaugguccauccuuucgucucagcuccaaacuuugucucuguaacuccuuccuuggguguuuuguucccaauucuaagaaggggcaaaguguccacacuuuggucuucguucuucuugaguuucauauguuuugcaaauuguauuuuauaucuugggaauucuaaguuucugggcuaauauccacuuaucacugaauacauaucaugugaguucuuuugugauuggguuaccucacucaggaugaugcccuccagguccauccauuugccuaggaauuucauaaauucauuguuuuuaauagcugaauaguacuccaguguguaaauguaccacauuuucuguauccauucuucuguugagggacaucuggguucuuuccagcuucuggcuauuauaaauaaggcugcuaugaauauaguggagcauguguccuucuuacagguuggaacaucuucuggauauaugcccaggagagguauugcgggauccucugguaguacuauguccaauuuucugaggaaccgccagacugauuuccagagugguuguacaagcuugcaauaaucuuaacauucccuacuuuauuccaccagguagucagcguuggggccacucacuggggccucgaaucucgaggguuagguucaucuccaacugaggccagaccaggcaguucucugcuguauuuguguugggggccucggaucagcugguguaugcuacuugguugguugcucaguaucugagagaucucagggguccaaguuaguugagacugcugguuuucuuuugggguugcucucuuccucagcuucuuccagccuuucccuaauucaauacaggacuucggacuucaaggacuaaggguuuuuaaguaugccauauagcuuacucuauuugauuauuuuuauggcuuagucuuuucuucugcaguacuucuuuaucuaaccauaugagacaaugcaggguagauugacaagaaaaaguggguuucccuuuucauuguggaauaccugguccuuuguaaagacaccuuguaugaguuggaugauccuuuccucuugaccucugucuggaagauugcacuggagcacuucucuuucuucacucagcucucuccuuauaucuagaacacccuuuuccaaccucauguaauugaaauucccuuugauuugcucucaucuuuuuaggaugugugguggcaguagucccucuaguauauaucuguuauaggccuggugugucuccucuuauuucucugugguguuucccaaggcagucucauuccaccuuuaggacucuuaguuaaucauguaccaggucugaaacauuuugauauaugcuguaguccaggcuacagagauauauauuaccuacuuauaugcguuugacauaugaauuccuuggauauuuuaaaggcuuuuuagcauauuauaucaaaacuaacuuuuauauugcagugaauggcaucuaucaucuuuacugaauaauuaugaauuguauaaguagucuuauaaguuacaaauuauuucuaauacucuuuuucugucacuguucacaucugacaaaaguucaauuauugauugguguuaugugcagauaacaugcuccugggagcauacaaguagagcuuaaggagacugcugugucuuucucuaaacuaaggcucuucgcuuuauuaccuuugacaccacuccacauugaacuugaagcuuucagcuuugaguuaggcugacucuggugaauuuuuugggauaaaauugccugucuccacccugacucacagcacacucaaaucuggggcuauaggcacacagggccauaacuggcauuuuuuauguagguauacgaucauuugaaugccagucuucaugcuuuaauagccaucuucccaaaccuguuaaaaccuuaaauccuuucgauuuuguuguuuucuccgcauuuccuucaucauaguucauccuacugucaucuuucacuuagauuauugcaguaauccauagcaaguagaugguacuuagcaaugaggcuaaagagagagagagagcaaugggguggucccugggugacacuacuggaaaauggagcuguaugccacugagaaugugccuuguaagaaaguugugaagucauuaucuuuucuuuaucucgugccuguuccugacggcuuaggugagccacacauuaugccaucuguguaugguacgucauucuauggcacccaccuagacuaaagcaauugagucuccaaaucuuggacugaagucuucaaaaaugauccaauauuaauuaucucuugguaaguuaauaccucagauauaucuugauaugaugugaagcuuaccaguacucuugucuucaggauaaagaugcagguccauuuggaacauugguuacuuccucauaagcucaacucuuacuguguugucaugcuuucaugauucugcacauuguccugauuuccaguugccccagugcauuugcaaaugcugcucagucuuuuggagauuuuacuucuuaccgacugauacauguaggucucaguuaucuuccccaggcacugcuuccuucuggucauuacuuuuguuguuucuaacauguucauacuccccuggcacucaucaaggcaagcaucuccuuuguaaugcauaucacauuucugcuuugucuguuguggguuugcuuaauuaaggucuuuauccucagguaggcuauagucuugacauuaggagccuuuguaucauucuugguaaagguacccauaauaaaauaguaggagucaguaaaucucuagugaauugccaaugaaucuaauuacuaaguacaauauugugaaauuauaaagauuaaauucauugugcauucauuuuaacaaaccacaauauugggggaauacgugguacucuggccugguuuguuguaguagaacugguaacucacuaaaauuuagaaguccauuuuuuaaaugcauguuguguaggaggagagcaggaauaaaaagcaauuagaaacaaccuccucauuuggaggcugauuaugggauggauccccagguauggcagccucuagaugguccauucuuucuucucagcuccugcugaaaggacccugauauagcugucucuugugaggcugugccggggccuagcaaacacagaaguggaugcucacagucagcuauuggaugggucacacggcccccaauggaggagcuagagaaaguaaccaagcagcaaaagggaucugcaacccuauagguggaacaacaauaugaacuacccaguaccccccccccccuccagcugcuggugucucuagcugcauaugugucagaagauggccuagucggccaucaguggaaagagaggcccauuggucuugcaaacuuuauaugccucaguacagggaacaccagggccaagaagugggaguagggggggaggguuuaggggacuuuugggguagcauuagaaauguaaaugaagaaaauaccuaauuaaaaaaaaaaaaagaaacaacuuacucuuuaggaggcugauuuuuuuuuuucccugucaucccaccaucuccucugcuauugucuucucuuauccuuaauaaaucaugaagauuugauucauugucaaucuagagaaagacagguuuuccuacaguccccuauaauagcaacuguuuacuuaaaauacaaaguuugggacgagaaauaacgacgcaugguuuuuccuuaggaacauuuaggaggaaguuuuccuagguuucccguagcggucacucaaaagcauuugauguaguuaauguaaucuguuuuacauguuaggaauacuccaaaccccagcuauuagccaucauugauaacuaaaguuacuuucuuucucuguuccuguguuuugguaaaguuagaaauuuauaggccccagcuuagaaauagggggauaaugggcaaggggagauguaauuuagggaggggauuuugcuaucuccauuagugagaaaaacuaaggauaucuuaaauagguuuuuuugcaaauaaguauuucaauuaaauuuacuauuacauacuacagugagcaugaagacuuaagaguguacugacagcugcugauaauuugacuuuacucucuuuagaaucuguccuucuagcaucaucucuuagacacugaaauauuauagauaacuggaguuggucuuauguaaaacuaguguauuguguagugaguugugacuggcauucuuaacuaucuucuaaaauguuucuuacuacuauuuaugacuauauuuggaugaugaaugucaacauagacaaagcaugaccaaaggcucuauaguaauacuggcuggagaagaaagguuugaauauuuggaacaucuuuagacagguuccauauauccuuuuuugaacccuucagucuuuuuuauguguauaccugucagaaauauuaauuuuuucauaagcauaauccugccaauggaaugugugugucuguuuaaaacaaguugaaucuaacuccuuuaagaaaaagcuaugaaaauaaauacuacuuuuucucuuguaaaacauuguacaacauugucagggcugagaaaaaagaggaaagcaguguaugugccucauucccaguaugagacaaagagauuaagucccccaaaaaaacauaacuacuuuucaugugucacaauaauuuacaaaaaagguuggagauuacacagcacuuuguaguaauuuguguaaaacauuuugcugguacggggugguucauaauucuagaaggccugugcuuuugugguaacauauaacaggguuuagauggugccuaagauagaucuuacugaagaguccacucuauagggcaguauauuaaguugcaguuuguggaauuguaaaacauguuucagcagaguguuacauacagaguagggaguguacagccuuacaguguagaugaguuacauuguuuuugaaaggugaugcucuuugaacuuuuucaguuugccgaauagugcaugacuuuuaggaaacaccaucagcccaugccacauaacuccuuuugagagagagaggggugggggagauugggauuuuaaaacaaguuugcaaacuguuuuuucuggcuuuuucaaauauucccaguguugcuuauuucuccuuccuucuucucucccuguacuccccuuccuaccccucuucaguuugaaaucuucccuacauuuuguccauugcccuuuugugucuucuguccucuauccucauuucuagagcuccuucugcacuaaguaccccucaccguggaccguuucuucuguucuggugucuucggauaugucagguuauauauauacuccaguuuaaggauuuggagauggacccacaagugagaauauuuggcauuuguuuucugggucuggguuaccucaccaguguuuaauuuucagccccccucaacuuaacuugaaaacuucauuuuuuuuucuucuaaauagcugaauagaauuccaugaugcauacauauuauauuucuauuccucucgguuggaagagauucugguuauuuauauuuccugacuguugugaauagacagcagcaaaugugccugagcaagugucucugaaugauaaugaguccuuagggcauaugccaaggagagguauagcugggucaugguggauuuguuuuuagccuuuugagauuuuucuacacugauuuccaguuuuucauccuaccaacagugaguguagguccccuuuucccugcauccucaccaggauucauugucuuuucuuuaucucauccauucugagugaaguaagaugaaaucuuacaauaguuucaguuugcauuucuuuaauugcuaagacgcugaacacuauugaacaacuacacagaugccaggcauggagacccucccccaagucauuauuuggggggacacaaaucuccccaaacaguauggacuuuuucuauugccuauuguuauucuccagagcuugaaggcuaacacuuuauugcugaagacucuauacucuucagacacaggacuaggagguauuaagcuggaauugaucuggaaacugccuucuugagggcugguucucaugauguugguggguaguguguggccugccaagguaaaggagcaacugacaauucuacccaggugaaaaaccuacaagacacaacgaccacauugacaagauagucacaaugguccaguagcagauuuaucuugagaauaaugaaaaucugucuaauuggauuuacagccuacucagaaggaagggguucaugccugguacuauagaccagcggacuacccauaagcagagagguuauagaccugagaggagaaccuaccauuuuccuaaaucaauauaauauguaacugcauucuaaagacuuaucauuauaccuauaaguaaguguagcucucacccauucaucaaagaagcaucuuuuugcaucagauagagacuauaacagggauccacacauuguuaaaaaugugaaggauaagugauuuuaggguguccaaccccuguacguaaagcucaggaaaaucacagaagagggucagagggguuguaagucaauaaucccagggcuccugcuaggagaguguguucccuagacgugacauggaaauugcauacaugaaaucuuacuaguaugcuccuccccuagaugaugagcuauaggcagucaguggcugcugagagggagaaaguguccuucagggaugggcucaugaaguuccagugguuaccuuggauauguguacauaugaacggcuguaagaggaugcagccugcuaaacauuuacgucuaagugugagcauauggacauuaguaggaacuaaagaggaagucaugaauuugggaaggagauuuggggcacaggaauuguugaguguaggcaggcagagugccagcuauaauuacaguugguaacaacaugacuagcaaaugcauuucuuuuugauaugcaaguuuauucugcuguagaugccaguguuuguaccuuuaauauucuuuaagugcauaaacauguguuuauuaaacuuuaccuuaaucacugaauuguaugcagccgacuggaagguuuuuggugaacuuuuuguuuuacucuuaauugucccuaaaauuuuuuuaaucuaacuuaaggguuccuuucucugcucucuuucuuuccuuuuguaauucaugcuaagugguguuugucuccugugggaacaugugccaguauuagaagucacugcuuaucuuagggauauuaauagaaaucuguucauguccaggauuauucauuuuuaaaugaaaugaaccaauuaugaaguguccuuuaaggauagauacauauuaguucugauacagagaacuuuuuugaaguauuuauuuacaaugaacagaugagcuaauuauagaacuuagaagcaaaaguagggguuugcuuugaguuugaggcauugacuaaacugcuaggauacuugcuaacuucuagaaacuuaaaaaaaaucuggaaauggucugagugcuuuuagaaauagacauccgugagaauauguuuuauuccacacauuuuauuaacacuaacaguaacuggcuuacucuuuuuuacuagaaggcuaauagcuauagauguuuccuuccuguuuaaaagccagauguugguuuccagucuucccaggacuuguccucaucuugugugcgguggacguguccuuccuucaucuguuccuucuuuauugucuuuguccugauuccuuugucucuucugucacaaaagaaacuccuccauuuuacccuugcugugacacgcuugcugcucaguguccuaacuuccugucucaccuuuccuuggauucuuuccugucuuaggcugauaagauaggcuguccacuuuccucccuguucauagcccacauaucugucacucugacaguacuauccucugucuuuuauuuucuaaucauuaaauaagaaggaucuuuaaccuuccauucucuuuuuaaaaaauuuuuauuggauauuuucuuuauuuacauuucaaaugucaucccuuuucccgguuuccucccacccccucugaaacucccuguccccuccuccuuccucccccugcuucuaugagggugcucccccacccacuccugccucccugcucucgcauucccuuacauuggggcauugagccuuuacaggaccaagggccucuuuucccacugaugcacaguaaggccagccucugcuacauaugcagcuggagcccuggguccccguguguacuccuugguugguggcuuagucccugggagcuuugggguguuugguugguuggaauuguuuucuucauguggggcugcacagaccuuucucuaacuccaaugggacaccaugcucagugcaaucauuagguggcugagagcacccaccucuguauuugucaggcucuggcagagccucuaaguaaacagcuauaucaggcuccuuuuagcaagcacuucuuggcauucacaauagugucugacuuuggugacuguauaugggauggauccccagguagggcagucucuggauggccuuuccacagucugugcuccacacuuugucucuguauuugauccugugaauauuuuguuccuucuuuuaagacggacagagguacccacaccuuggucuuccuuauugugcuuuauguggucugugagcuguaucuuggguauuucgagcuuuugcgcuaauauauacuuacuuaucagugaguguauuccgugaguguucuuuugugauuggguuaccucacucaggauauuuucuaguuccauccauuugccuaagaauuucaugaagucauuguuuuuaauagcugaauaguacuccauuguguaaauguaccacaucuguauccauuccucuguugaaagacaucuggguuguuuccaguuucuggccauuauauauaaaacugcugugaacauaguggagccuguguccuuguuauauguuggagaaucuuuugggaauauguaauguacuauguccaauuuucugaggacccaccagacugauuuccagagugguuguaccagcuuacaaucccaccaacaauggaggaauguuccucuuucuccacuucgccacaucuuugccaacagaugcugucaccugaguuuuuaaucuggccuuccauucuuugugacuagaaucuuacucuuugucucuguuuuccuggggugucaaguuguuuuuguaaggauaggaaagaggccagagugaauacuugccaacuacaugaacuugaagccaugcugguuaaacugagguaguaugguuaauguagcuuuaaaugcuuaaccuggaagcacgguaagcauugaaccuuuuuuaaaaaguauugguuacuuaaaaaaauaugaaguuauucauuuauuguuauggagaaaguuguucccauucauauugaugggcuggcauggaagguuagaaugcuuccauaguucaggacaccuaguuucaagaugaaacuuuagaguauaacuuuuuguaauucagaagccaagacuugaauaauauuuacuaucuauaguuuuucuuuuuaauaaauauauuuuaguuuauucuuacaggaaauuuucacagcaaaauguaauagaaacugcagcauuaccauaugccccuuugucuccuaccucccucaugcgaccuucacuggcauucacaccagcagcgugggugcuguguauuacuugcuuugagcauauuuugccacacaaagucccuaaagucccuagcacaugacaguuuaauuuuggugcugcacauuaugaauuuagguagauauauagugauacauuuauguagcuucacaucagcaucuacucucuaguauccuccugacauuuuuauuuucuccauaguuuugccuguuucaggaugugguauguuuagaaucuuguaguauauagcaguauauagguuuucagauuaucuucuuugaccaaguaauaaggauuuaagguacauguguguauuuuuguggcuugaccuaucuuuugcacugaguaauaguucaucaccuagauguagcagcuucuaguucaaugguugcuguggugguuugaauuugcuuggcccaggaaaugacacuauuagguguggccuuguuggaggaaguguguacugugggcaugggauuuaagacccuugucuuggcugccuucagaagaagauguagaacucucagcuccuucucugccaugccuuccuggaagaugccaugcugcugccuugauaauaaugggcugaaacugaaccuguaagccagccccaauuaaauauccuuuauaagaguuguuuuggacaugguaucuguucacagcaguaaaacuauaauaaugcuuuccaguuaugacaguuuacgaauauuccugcuaugcacagguuuuuguguugaauuuucuguuuucugguuaaauaacaacaaauguuacugcuggaucauauaguaagauauacuuagucucuaagaaacuguuaaaguaucuuccaaagugaauuauccacaggcaaacucagagggaaauguagacauuuuguauugccucugucauuuugcuuuacuaguucuguacccucugcugaaaugcugcugccuuugcucuguuguuacuugugcacuuagaaagauugggugacucucuugguucuccauuuuguucucuuggucgucuuuuuuaucuguacacaccgauguccuuucuguggcuaugcaguuguauugcaagucuucaauuugggcaauacuugucuuuuuuguuccauccuuccugaccaauauucuacauacacuuuagaaucauguuuguugggaucuacagaauaauuugcugugggauuuuuuggggguuagcauugauauacguagaugaaguuaaauugacauuuugacaagccaaaauguugaaauugacauuucaacauuuugaaauugaauugacaagucucccuacaaacuugauauucagaguauccaauuuuaucuucauaacauuuauuuauuucuaucuuaugggcaaguguuuuuccuguauauauguauguguacuaugugcaugcagugcccacugaggccagaaggagggcauugacccuugugaaacuggaguuacagaugaugauaugccaugaguuggguucugagaagagaaccuggguccucuacaaaguaaccgguacucucaacugcugagucaucacucaagccacuuaauuuuauuaauaauuuauuuuuauuuuuuaaauuugcaacagcuuuuccauaugagauuuuuauacauacuucauuuuguugacuacccccccucuucugguuucuugaguuuucuuuucuuuucaguugauuuacuacuuuaaaauuuaguuaguugaugcaugagaaauuaccauugggcccaucagugaugucauugcugaccuuagguaaaaaguuguuuccauagaaaaaugaggaaaaaaauccagcuugaaacuauuuuaaaaacaggaggagagaaauuagagaugucaccuaacaggaauacuuuaaaggaguuuuucuguuaaagggacaauaauuugagauaaaagcuggaagggauagagaaacguuugucuuuuagacaaguuuggaaaaugccauugcugaauucuuguggcuauuguucacuugagaaagaaaaguugauuguguauggaaggaagguuauagaguucugcccuauggaaggagagaaguagaaaguacggagguuugaggaaagauacagggaauggcuggucaguuucacccaugucuuuuccagucagcucaguggcaggucugcugcuaggcuaugaaaugcuuugaguuaauggacucaguccugaagcucuccuuucccaugucucuuggugggucugucccagccucuccauauucuaagugaugcuguaaaggaagugaaauuagacuccuuaggcuagaugcuucucuuguauugaaagcccugauguaauagaguuaaaugaacccuuuucgugcagcauaagaggggaaaaacaaacuuuagaaucaagaauuugguuucacagugggaaucccggcuuuaccauguaacaggauuuaagauggauucgucacccucuccaucuuuguuucuuccaggggcugguagauuuguccaaagcaucaucuuuuuaaucuaagauucuaaaguccauuaaaauacauugaccucaauuuaucuucuguucaaucaucugaauuugguuauuuggaaguugguucucuuuggguacuuacacaaguauuuauagucugcugggaaagagagauaaccacagugagauuagaguagcaaauagaaauauuugaggacuauaagaauagccuuuguugaggcuuaucauuugaacuucacuaguuuuacaaugucagucuugcagaauuaauaacauguaguuaagcugaugcccuauuauuacacaugguugcaguacuguuuugcacuaacuacuuuaagaggucuuccagaucauuucuaaauugaugggcaguuuaaaagaacaaaagcauguaccugcuuacagaaagccaagaaauuuucaguguaaaagccuagaguuaaauagguaggacugaugucucagcuguuuagggguacaugacuuugcagaggacuugaguuugauucccagcaccuauaucaagugccccaguaucuucacucauaugcacauguucuccuacccacucccaccuguauaugcacaugauuaaugugaaaaugcauucuaaacagaggaaaaugguaauuuguaagguauguuugaacaauguuuacauugaguugcauuaccagccagaaauugugaguuuagauuauauugaacuguuaaauuuuuauuguauaaauaauacugauguuuagcacauugcauuaaaguguuucagugauucaguagaauucaagucucgauuucuuaacauucuccaacaaggacccaggauucuugaagcugauuccagggcugggaggaggaagcauguuagaaguguguuggagcugcuuuguaggcucucccucugggcaacagucuaugaugauucaagcagcaaaauaguuaaaagcaauaaugaauuauaaaguauuagaaagaaauaguacuuuacaaguucauaucaauaacauaauacuuauguaagcacacaaagcaagagggagcugaagagugcuguuaaguguggaggaauagcuggaguugaaaugucaugauuugccaguuguuauaggaauguucagaggauuccaguugaguguuaaaucuagaggagaauuuugaauaaagagaaagguauuuacaugguaguaaucuaaccaaagaguacauauuggaugcagaacagauaguaacuaagcaguaggaaauuuggaaagcaucuucaguaggugaagcuuaauaucaccagugagggacaggacacgaaaucaugugcuucaaaaugucaugacuccaaaaugacauauaauuuauuuaguguuuugguuagggguguacuugagucucaugagagaaucacaggcaaacucaaguguugcuguguauuuauuuuuuuaaaggacuauauucugucaaauaaaagucagaaaaaauaaguucugauagagcccauauuaaagguggcugugcugagugcacacgcugaauuguguacucagaugggaaggcaagaugauugcaaguucuaggccagccggaguuacucaguaaauccugucuuggacuagauuaaccuauaagauuuucuugcgcccccccccccccccagacuggaucuuuuaucugggaggaagaauguauuacagaguuaguugacaauuuuaucaugcaaauuauagauuagugugguugacauuuaguaacuauugauuuguaaauuauuuuuagaagaauacauguaaguauuuacuguggaaaggaucagugucagcaaauuauacuaguacguguucaugugugugugggggguacguguucauguguuugugggggguagcaagaggggaggggaaugggggcaaauaguaaaaugcuaacagagguauccaauaaacauaguuuuuauguuuucauuauaauuuuucuguucauuuggaauauuucaaaauuuauacaugugugcagaaacauguuggucuuaaugcuuuuuuagauugcuuauuuaacuucuaauuuugcauucaucuuaggauguuaaccuauauuauuuauagauguaaauauugauuuuuaauuucuuuuaaauagugcugggccuaaaggagauaacauuuaugaauggaggucaacuauacuugguccaccagguucuguauaugaaggugguguuuuuuuucuggauaucacauuuucuucagauuauccauuuaagccaccaaagguaagagcuuauguguccauugguuaauauuuauccuccuucaaaacccaguuaguuacucuagaauuuauauguguauuacuguaauaauuuguauuuaauuguuguucaugaauuaauaggaaacucagaaccaaauuuuaaaaccaaaaagucacugacuucugccuuuaaaucaucuuauauucaauauaguuuguuacuaguaaauaaaucuaugcacugaagaaaacauaaaugugaacauauguaaaacucccucugaaauaaagucauugguagcuuucagaaauagauuaauaauaaggauuugucuuuauuccucgauaagugaaaacuaggaaacuaacaaagggaaacccaguacuuugacacuaauuuugugccuucuugugagugugauacaaaacugacgaguggcaggcucacuuguacuuucuucuuaauucauuuaaacagauuguuuaccuggguaacaaacggaaagcuauggcuaugcaaagccuaaacaggauacuuauuugaagaacuucugacuucucuuuauaaaguagucaaggaaacccuagagcuuagucuguauaucugaguuuuccuaaggagaaauccagcucccaacucguaacaugcuuuccuuuuuaauuagauaaacuuuuaaugcaguauauucugaucaugguguacucuccuccaauaccucccagaucuacccuacuuucccuccuuaggauacaaacagccaucuaaaaauaaaaauaaaauuagccggucguggugccgcacgccuuuaaucccagcacuugggaggcagaggcaggcggauuucugaguucaaggccagccuggucuacagaaugaguuccaggacagccagggcuauacagagaaacccuguuucgaaaaaccaaaaaagaaaaauaaauaaauacaauaaaaugaaauuaaauuaaauacaguaaaaacaaaccaaaauaggacaaaacaagagagucaaagauauuuucugauuuuaugggguuccuugugugaaaaaugcuucccauuucaaauccugaaaauauuuaaauauauuugugauucauuguauguauuuaucuauuuauuuaucuuaucuauccaauuccaugugucugucugucucugucucucucugucucucucucucugacucuguguguguguguguguguguguguguguguaaagucuauaaaggcuuacuucaugacuuuuagaaaggaccuuuuucuggacaguauucucuaacacaguguaacaaugguuccaccuagugguguguaccucaaauuacagacaagaugguuucugucuguuucugcccccccccccccgcccucauuucuccccucccugaauccacuccuccccuucuguuuccucaucagaaaagaauagggcaccaagagaacaaaauacaacaagacuaagcgaaaaaccucauugaggcuggaaagaacccaguuggagaaaaagggucuccaaaacaggcugggcaaaacacugaucuaugaguauagcagaacaucauuggaaaucauaucacugcuuuuuguuuguguuuugucaaauguguuugguucugccguaggucucuaggcuauccagucucugguuccugaccauccugguguagggcaugggcucccucaguggaucucaaguuaaauuggcuggucaucccacauacucuuugcugccauuguuccaacacaucuggaaggcugagcagaguguagguuaaggcuuuuguggcgggguuaguguccagguuuguuuuucuguagucuguagagaauugucaugugccaaagaaacuagaauguagggcugaaggcuccaugcaggcaccaguuucaccucucugcauucgugaauugaauguugccucagcuauuguuucccccaugcagagagcaccccuucaguccuugugucagccugggauguuuaggaucucuaugggcccccuuugaccaacagcuaaaccgaaugcuacccaauucccccacuuaccuagcuacacaagauguccaguucagacucgauagccuacauuacuaagaauccucacgagggccaccuucauagcuuccagaagauuuucucugaacuguuuccacccucacccagugcuccugaguucaagcugucucucucucccuucaucccucccugccugacuggauucuuuuacucuugucucuaacucucccuagaccaccugcaaaaucuauucuauuucaccuucccauggaggugagaauauuugucuucccuggagcucucuuuacauaaccucuuuggucuauugguugcaucuugaugaucauuuacuuaacagcuaauauccacuuauaaguugagcucauaccauauuugucuugcugggucuggguugccucguucaggaagguauuuuucuaguugcauccauuugccuacagauuucaugaugucauuuuuuuuucuuuugaucagcuagguaauacuucacugugugcuacauuuucugacaagaugguccuuuaacaacccgggcaaacuuacuucaaauuaagauuguuuaaguguuauacagugugacccauuagaaucuaagauccuaaaaguuaucuuagaagcucuuaaagucuccauguuccccuugcuaagucagauagucagagccuucauuccauaaauuagauccucauggagaaugguacauauauaaugucagcuuauuaccagcugcucaauuuucauucuuuugcuguuuucuguauaauaaauguuuaguaaacuguaugccuauuuuuauaaauagugaaacuuccacaugcauaguuuuucauauugaaaauugguuuuaacacuuuagaaaauagggggaaaguuaacaggauauaguuaugauacuauuucuguaugugaggaagaaauaauguaaccuaaaagauucuuacauuuuucuuagcacuguucauggaaauagaaauugucuagcagaagggcuuggaacuauaguccuguauauggcuugucauuuuuauuaauauauggcuauuuauagauuuaguauacuaugaaguuccaauguguuaaauuuauaacuuuguaauguuucucucauuguuaagacagauuuuuccauucuuaaacccuauuccuaaaugaaacaaauaaaauuugugguaucuugguaauaagucuuauuucuuucucucccucucacucugucucuccccucccucuuucaaauauauacuuuuuuuguuuuuguuuuuugaagcaggguuucucuguguaacuuuggcuguccuggaaaagaccaggcuggccucaaacucacagaaaucuaugugugccacuaacaccuggcuuuucuauaguauuuaugaaguucaguuaagguauugaacuuccuaaagaguaauaaacauuuuguuaauuguaaauaauuucuaugucuuuuaaguaauaagcucagucuuuuggacaagcaaguauuccauuuucuugaaaaacauugucuauuagaggcauagacaaaguaaaaugcauguauaguuuuaguuuccauagccacauuaaauaaauaagaggaacuaauugugaauuaauuuuaaagguauauuuaacccuauauauugagaauauuacuauuucaacaugcuauaaguaacauccauaagaauauuauuaauguguuuuuugguacuaagucuuugaaacaugguauucaaaguuagaugccuaguuagaauucagaucucuguauucacagaguaucaugauaucaucuauagccccuauuaagccaucauuagguaguauguuuauuguuccuccacucugccuuuuuuuuuuuuugugcccccacccccugaaaaagcacuuuuggguauucuuccuguccccugaugcuccuuugaagcucacaguacacugcuaauuauaaaauagaaaguucuuuuuucuacaaguccaagugaugaguuuacucucucaacugcuuuuuguauuugcuuagaaacauacaaguauuuauuccugaaaaagagaugucaguuucuuuggugcaguaacugaaaaccuugcuuuuuuuaugucagugucuauaggagagugacuaagaaaggacaguaacacagaugauggccgcagccuuccucccaguccuucacuuuauucugacauaggaagacguuuggcugagcuggugauacucaccacuuucacuagaagcugaccuaaccuuucaagaaucauuuaucuucguacuuugaugucaaaacuuuucuccauuuuccauguucauguguguccacaaagauauaugauauaugacuauacauauacacgcuuauauaaugccauucauguagauuuaauugaucaguuguucaccuguucacuuuguucuuaaaccaggguaauuccugguauuguauguagugcaugcugauagucccaguacucaagaaacagaggcaggaggauugcuguaaguuugaaaccagugcaaugugcacagcagguucaugucaccagacuuacacaccucuuuuuuuuuuuuuuuuuuuuuuuuuuuuuuuuuuugacaccuugugucaaaaagaaacaacaaaaacaaaugagccaaauaauaguucuuucuauguuaagucaaaauaaagccaaaaaucaauacuuuuaacuaaaaaacaacuacguaacuuuuaaaauaguuuugaauaaaacuacuuaacuguuauuacauccaauguaagaacaguacugguuaauuauuuacggucagcaucgucuguaauguguuacuguugagaugaauugggaauaagccguguuugcuuccuguuugcugugauuguguauagguuacuuuccguaccagaaucuaucacugcaacaucaacagucagggagucaucugccuggauauucugaaagacaacuggaguccugcuuugacuauuucaaagguuuugcucucuauuuguucccuuuugacagauugcaacccugguaagcaaaucuuuaugaaucuacaaguaaaauguguuuuuuuaauguuggucaagacauaaauguuacuauuaggaagagcugcaucagaaauagaguaucuaguaagagacuagguguuaaugagacaacucugaacucacagggagacggucuuuaauaguaugucguaauacagggaccuugagagauauauacacaccguaguaauguuaaauuguaggugcaagacauauauagaauaucuggaaaaaaaguuguaugccaaggauugaguucugagucucgggcauccagaagggaagcguuuuauugugucuguauuggcuuuguuugguguacuuucuauacacaaagcaugugugcaugcuuugcuuauaaaaguuuuaaccucagauucaacuuuuacuucaaaauucuauuuaaaauaagaugacagguaaguuuuuagacugcuuauguuuacaauuauagauguuacuucaugacugucagggaucguuucauucugaauaacauuguaagauggaggcuuuaugugaagcuuagguaacgaugcuuaacaagaaaugcagccucagacuuucauaguugaauaaagugucaagaauaacaugacagggaacuugcauccuugacaucucaacagaauaucuuggggcaccuaagcaagacccacacaaugucaucagcaauuucagaagucccuaccccagcugcuaggggagcaagaagaugucauuucuagugaugagccccugauagguuacaucuuuauuccuaaacggucagcccuaaagacauagacugaagagagagggagaaaagaaggaaggcacauuaaagaaaggaguccuggcuuuggauagagcuagaaguaaacguaauguaaauauagucguguaggauucucaaaaaacagaaaguuaagucuaaaauauuuguuaaaacacauaucuuuuccaaauauuaaacuguauagcuguuucuugacuauuuuuuaugaaaaaguaaaaacauucugaauuaaaaugcugccaaacuguagcuguuuuuauauaaugccuuguuagaacuauauguuuaaaacauacauguuuuaauguccuuuucacuuuuccagcggauccucuggucggaagcauagccacucaguauuugaccaacagagcagaacaugacaggauagccagacaguggaccaagagauacgcaacauaauucacaucauuuguaugcagugugaaggagcagaaggccucuucccacugugcugcggaucuuuauagccuuuacaauacggacuucuguguauauguuauacugauucuacucuugucuuuauccuuuggagacugggagacucccccaaaagguaaaagcuaccaagaguagaacuuuguagcuguagauuaguuauguuuaaaaugccuacuugcaagucuugcuucuuugggauaucaaaauguauuuugugauguacuaaggauacugguccugaagucuaccaaauauuauagugcauuuuagccuaauucauuaucuguaugaaguuauaaaaguagcuguagaugacuaggaauuaugucauuuguauuaagcccagaucuauuucugaguaugugguucaugcuguugugaaauguuuuaccuuugucaguuuguaaugagaggauuuccuucuacccuuuguagcucagagagcacugauguaucaucucaaacacaauaaacaugcuccugaaggcauaguuucuugucauaauguugaaagucuugucagaaggugugucugagaugauuguugaugaaauaaagacguggcuaugaagauugauuauuaaggacuaguacaaaugaauuauuaaauugaaaacauuuaaaaauccuguguguagaguuuuuuccuuuaaggagagaauacagugggcuuaaauaugaagcuggauuuuaaccauuggucuuaaaaaacaauaacacacaaauucuacauugacaguguagcauuugaauugaaaaugaaguccugcguuauuuaggacucucuccgugucuuaacagaacauuuugucuccaaauuggugauuucuguucaacgcugggcaauauugucagauaauugcuaugcugugauugcuuuucuauggugcuuuucccuuuauuccugaucuugaauuuuuauggugcauuauugcuacugugauacauagccggcaaguguagccagaggcucaacaguccuguuugcccugaagguagaauguguguuagugugcaggcgugacacucucaguugaagacaaacaaguuguaagaguuuagagguuaaauuccuucuaaguguaacuaauagguauacuuuuaagcuuguaauuauuaagcuugcuuaagagaauuguaauauaauuguacuauuuuuuuccccugugccuggaauaaauuaucuguggucaaugucuuuuccgguccuaaguaugguaauacagcaccauaauaaaauuuauggaggugaauuauuaggauaaaagcaaacauggcuuugggcuggagaauguuaacucagugguagaagcuaguucggcaucuccagcaccauguacgcagagauaaagauuucuucaggaaagugaaucuuauaguuagguagacuacuaccauagggggcuucuguucaaguauuuggugauagaaaucuaaauuauaggaaggcuuaaauuuagcaguugucuauuuuuccugcaaguucuauacacacacaaacacacacacacacacacacacacacacuacccuuuuauaagggaacagcuaacauauuuagaagauuuaagcuguaucuuugaaaacugagucuuauuuuauggagaaauuaaaaauccacaguucaagucaaugugaugaggguggagguuuuauaugaaagugaaccauggugaguuguagaaaggacugcuugccaucacugaaaugagccauucuauacccuaaaguugaguuucucuuggugcuggaagguucuuauucugaauacugggcuguugcauugccaauccagcuguagcuuguaaguaugaaaguggcugagccucugcauaucccaccagaccugugguaugcuaaugaccgugccacaaaccuucugaggaacugggcaguguacaaaaugauggugacuauacauguugccuguaacuauuaccuguaaaagaauuauucauggauuaauugcaacuccuccaauuagauaaagaauauuuuaguagaucuuuaagaaucuauuuuaguuucagauuuauuucugaugaauauuggguaguuuauuaauauuugucacaggaacacuuagcauagucccccuuguuuaaacacuugaaaugagacaaaugauacuaaaaacaaaaacaucuuauauauaaacacaugaaauguuuguauuaauaagcuauauugauuauguuacuuuaaaguaaaaaaucuuaauuaauuaugggcaccagaauuaguaauuuugacccauauuaccuuuuuucagacgaguucuuccucucugauauguaaagaacuggagucaauccaugguauucagugguguacaaggacuaguaguguauaagugugaggcaguuuccguuaucaucacauuaauguacacauuggcacacggaucauuuaaacaucaauuuuuuuuugucaaaccacuuuaagaaacuaauuuugcaauuauuacaucaugguuauauuucaguuacuguuucuuacucagagaaaguaaauaaauguauaagucucuuuauucuauaucuagucacauuagguuuugcaaguaaua

SEQ ID NO: 873 - RNA, 3286 nt, Mus musculus
ugaagcuuuuauauauauaaaaucuccagugguaacaguuacuauauaguauauaugaaaacguuuuuuaauggcacauuuuaaaaugcauauuacacuuuauuuguguguaucaucuacauuaaugagacuuuuagaaauaaauuaauuuuacucagucaauacauuguuauuuguguacuucagaaaauaaguauugcucuggauucuuagaaguaucagaaaaccccuauccuuaguaccccauccuuaaacacggaguucuaaugagaaagaaaguauuuguuaaguagaaagugguaugcagaaaacagaagcaggaaaaggaauuagggaguggguguggggaggaagaaggaagucacucuucacuuaggaaugaguaguguauaaaucaggguuccaaggcuucaaagacaugaaaaggaauuuucagagccuuguacaacuuaguuguuuaagauuguguguuaucuuuacuuccccaauaaaacugcuucuuuagaaaccaagucucaguugagaguagccaggaaagacuugggcagaaaagugaugugagagauaagcuggguaagagugucccaggggggauggcaggugaaaagaaaggcuacggcaugagagcacucaagaauucaagaagagagugugugugugugugugugugugugugugugugugugugugugugugugagacaggaguagugagcucuggggaagaguagguggcacuagguuaaggggagcuagaugaacagauuuucaggucuugcaugagcuuuggcucucauaaauggaaagcucuuggaggguguuuuuccacccaaagaugcaagauaugauuuagguuuguuaggcugagugggagagugaagcuguaagaggagaggacacacguaccaaaauuugagagcaguuaggagacuggauacgugcuaucaguggccuugaccugggugacaguguucuucauaagaaaucccugggucuggauugaagguagagcuaacaguauuugauaaaguuggacugugugauguagaaaaggaaccaaugugugggacuugagcagaccagaagaauauaguucugagggaaccgagggaacaggguugggaagaggcuaagagcuuuauuuuugacagucugguuuugaagugccugacuuaagugcaguggguguguugggacaguggaccuauauagaucugcuggguugcaauccuaucugguuuaggcuugugcauucaggacucuaaugugaagauggagugucugcacuaugaaaauacccgagccugucugcuaaggcugucugcaggaugggugcugcuagggcaggaaaggagcacucaacucugcgucagaaagaagcugaagugaggaacccaggaguguggaaggaccuggaguuuuagggauguuggaauggcuuccuugcaucagauggcauucaggagccaagucaggacucaaauggccacuuucguuagcuaccuagggcaguuuugcauagcugacuuuaacaaguguggcuuuguucaagucuaugauuagguccaagcuugccuggagaugacaccaaaggagaaaaagaaagcuacuauuugcuguaaucguucauuuuuaagcucauguaaauguucugucugaacuuaaauaggugaugccuauuuuccucuuaaauuaauuguauuauucuuuagcauauuuccuacagaggcaacuugauaauugcccuauuuuccauauuuccaaagaauuuugagucuuuuuuuuucuuuuuccuuucuagcccuauuuaaauccagugcuugguuaucccuuaccuucaagaaccuuguugaaagaauaccuucuugucuauacagacuccaauccauccuucacacuucucccccauacaagcuccaucuggcaguucuuaauucaugacuucagggguugccugguuuugaacaggugaagucuacacucugcaaaagccuugcuuucugucacuguaccauucuguaaugaagcagcauccaugagcucaguagccccagauguuuguuuugcagugaaauucaagggucacuuuugcuaccggcaacauugcaaauacuugcucaaaaaacuaaugacagugauacauugugaauacuugcuaaucuccagacucuucuucaaggcuuacugcuguuaauaacacugcaguccuuggauucucugacaucucuguacuucccuuggaguaguuaaacauugauguguguaacccugugaacccuagcauguguaacuuucuguuaaacaccuuugcuaggcacauucauaguuuaaaugugcacuuggugcuuugaaacagauggugagguggcacauugcugucuguaccuaagagcauuuggcagugcuaaaauugagcuuucuguuuaguucaaaauaauucagugaugagugggcuacuuuguacuuuucuucccucagauucugaguauuuggaagucuuagcuuccaaugacucaaacuacauaaaaccguauuuaacuauguauaagcaccuuccuaaaaugagacuuugugaguagacaaguaccuagucgguggcuaaguccuguguaucagucggcauguaucacuuguucugucauaaugguguuucuagugagacuagcaagugcuugcuucuauuuaauugugcacacaaaaccuaggcuuaaagggaaccguucauuaaacucacgguaaacugaaauguucauauauuacugaugugauuuaaaggaacaaagugcccccaccccuguuucaguuuauucccccuagugccucucggauacuuuacuuagacugcacucuccauauaugccugggcuggaggaucucagcuaacagaaucucucaagucuguguuuauagaagggcaugucacagauccauuagcguuucugaaguccaguaacuugguaacuaaaauuggcaaucccuuuguauuuugacuuguagauuguuauauccucucaguguauuuuuuuccucguguauuuucaaaguaggauuaacauaaccuauuuaucauucagaaauacuagcuauaaauuaucaugggauuccaaaagcccacaggaagauacagagcuccagcaggacuccugcagagaaaguacaaacacauucccguuggcacugggguguggguguugccuguggugaugguggaucaggagguaugauuuagggaggcaccacacuugggaaaccagccaacccauuuaaauucuggugagaaaaaaaag

SEQ ID NO: 874 - RNA, 15306 nt, Mus musculus
uugcaguccgagguguuccugaauaaaccugcuugaagaaggacaacgugauguugcaucuuuccugcugguagggguggauucgacacucuacuauguuauaggauucuguaaacgcaguucuuagauaagacaaauaagaaugcuuuaccuguuuuacacugugugaucuguagugugaccaggagagaguuauacagcgguagguucacucccauuccaaacaguugauauuguucucagaagcgacuucagugcagguggugcuguggcagccaauagaaacacguacuugagccuuucccaugugggugaggcuucuuuacaguaugguggcugcaggcagaucucuaauuuaguggcucagugcuccaacagguaguuguaccacacagaaucugcauauccugucauaaucuagcccuuauaucccugcacggcuuuccuccugcagggcuuuccuuuacuuucuauuaauuacaagcaaauuauuaguuccagccagauauaaagggaagaacagauacccuguaccuccgugagagaauaacaguggaccugugguuguuggcagcaaaucgccauggguuuccuuauguuguuacugcuuaccauguuuguggccugacucuuaggcuucacauuguucuaagcugaaaggguugccaauaacagcaaauaaguacacagaguaccccccuguacuaugaauuucagaugaacaggauauacuaaaaaauauuauauaugcugucuaucuaagauuccauuucaacuggaugccccauagguuauuauauaauccuguuuaacacaucuucuaguguuaguggaaucagagagguucaauuaugccuauuauugauccaaauaugcuacuugauugguucauugaaaagcuauauauaccuaaucaggacuuuguccccuguacuggugaaauuacauguuuuacacauagaucuuugguaugacugagacguccuuuggaaccuaaggguacaacccuauucauucccacuauuaaaacauaauacuaacuaauauuccucagcuuuuacaguuaguaugaauugggguuacauuugaaaacucugaagaaaaauucugucaggcuuacaaaauaaaauugaaaaaaugucucuaaaacacuauucuuuuuuaaguugcacuguuucugguguucacaguuccuuuuccccaucaacacaucucucuccugucugagcaccagucucuccugaagugcucguugucauaaaggacuuucuccgcugugccaaaaaucuuucagcagcagagaaccuacagaaaucuuuaaaugguuuuaggugguuaacaaaucccaauccuuaucuguacacuaugaauauaaagauauuguuauauggauacucaucuuuuguauuuugucugguuuguucuccuaagaaaggaccuugcucugugucccuggcucaucugauucuaacuguagaguugucaccacacuugagacaggcuuccuaccucagccuccccauuggugggagcacauggaauaugccugaucugagagucacauuuaauuuuuauacuuguguagguagaagggaaauauugaguggucuacagauuuuuuucuuggaauaaacuauuuuauucauuuuauucauaaguaauuucauccuagguuuguuuacaaaaauauuagguuauugaggguagacuuugauagcauagagaaauauuuuuaaagcaucaaaacacuuuucagaaaguggaaaagcaaaaucagagguugggcaagauugaguagaaggaaagaaucuaaugaaauaagccuaacaauauaguuagauaagauaaaaagugugccagauaagaagagaggaccaauuuaacaaauaaguagauaugcacuaagagugacugauuauggcaggguguccaaccacgguggauauaucuacaacacaaugccugcauuuaaggcuugggaaauaucacagaacagcaggcaagaagaagggaggagccagaagacaaggcuaugagacaguaucuuccauauaucccagggaagcugcaucagugacaucuuaaaaagaugguuaccuaaauaagaccugcacagugucacaaugucaacaccaguuggcaugccuucaagaacagggaauaucacaagaccccauucacagaugaggagcuaugauugcccauugagaacgggagacaccccauauuauguuauuuuuguuucauauucaucaaaaaauguuaaagcgucauuccauguaacuugaaaacauaauaaaguugaugauaguuacaauuuagagauauaauaaucagauaaaaugcaugagggaaaaaauggacauagguuaaaaaaaaaguggcccgacauacaaaggaugaaacaucaaaaacuugagcaacacaggaacucgcuuuguugaaauugaauguaucaaagguuacuagaauuuagucaauuacauacacagaaucaauagacucagagagugauugaguagcugagcucagcuugucucaaucugaauacauauaucauaaauacaagugggaggcagguaugcaguccaucugucuagcuuuuuaaaaacuaaguguaucuuuagcuaauaggaaaaagcauaaaaaucaucacaucuauagcaaaguggauuucaaugaaguuauucuucaggugcuaucuaaaucacauuaaagauagcuaccucuucauugaauaauuauuucuuuagggagaaagaucuuuaaaaaucuuuccucuggcuuguuuuaaaaaaaacagcacacagcuguucgugaccuaauucccaaauacccaaucuagguaaaaagucaugagaaauuuguucuaagaaauuuguuccgagacaguuugggaaauucaguuguuguuguuguuguuguuguuguuguuguuguuguguuguuguuguuguugaugaugaugaugaugaugaugauaaugauguuaaauuguuugguuuccuuuuuggcuuuugagacuguaacuuaauaacauuucucccuucccuuuacucccuucaaacccuuccauauaccucucccgacucuccuucaaauucauggccucuuuucucaccaauuguuauugcuugcgugugugcgugcgugcgugcgugcgugcgcacguaugagugauguguauaaaauuugucuauucucagagcugacuauuuggaauuggacagugaguugguguguucuuucuggagaagaccaucucuccuccucaguuuuccucaguuuccuggaguucuuuguguagguucagaccccagggggcuuuuccuguccacuuuagcauguccacugcuaucauuuuaguuccucauacauuugaauaaucauuuugaugagauuuauggguguagcuuuucauaucauuauuagaaaucaucucacagcaagagccucuacaaacuuuccaccucuucuucugcaauguucccugggccuuagauacauggguguauuauaaacguauccauugagacugagcuccgcaguucugcauuuugauuaguugugaacuaucuguugcaaagagaaguuugcucuaugaggagugaagacuauccuuaccugugggcaugagagcgguuauuguuaggguuuaguuugcugguuuaguaaauuaguaguugagauucuuguccaacgagugugacuucacuagcacaggggagguagcuggguuuccaauaccagacaugguaucucccuuguuaagugggcguucaguacaguuagacagcggaugggcacccuacugcaccuucagcguuauugugccaguugguuguugauaugacccacaggcaucauaacuuguaggaccacgguugcuugcuucacuccuuccuuuggaaguuugcagggugucuugugguaccaugaaaccuagucauuagguaggggauauuccaguaguuccaguucaggggucgcugggcccugauacugaagugcacagugucuucagcaaugggaacuuaccuuccaucucugagagguaaccaggggcaacagaauuuagcuguauauuuuaggagucuauugaaccauccugacuaacaacacaaaaguggguaucucaugucugguauuggguuuuugauagguggucuuugguucuuggagggagcacugucaguccaaaaugaagaaaguucauuaacuauuaauauaaaaauguguauagagaaucauauguauuauuuuuagguaaauagucaauaugauuccuugugucuuuuucgggcauucauauguuuaccuacuucccccaucccguguauuuaccuccuucucauuuccucuaucaagucacuuguauccugucauuccccuccucgcacggugguuucuuuuuuuuuuuuuuaauuagguacuuucuucauucacaucuccagugcuaucccaaaagucccgcacacccucccccacgcacucccccacccacccacucccauuucccugcccugguguuucccugcacugaggcauauaaagucugcacgaccaaugggccucucuuuccacagaugaccgacuaggccauccucugauacauaugcagcuaaagacacgagcucuggggggcacugauuaguucauauuguuguuccacccauaggguugcaguuccccucagcuccuuggguacucucucuaacuccuccauugggggcccugugauccauccaauagcugacugugagcauccacuucuguguuugccaggccccagcauagucucacaagagagagcuauauuuggguccauucagcaaauuccgcuaguguaugcuauggugucagcauuuggaggcugauuacgggauggauccccggauauggcagucucuagacagucuaccccuugaucucagcuccaaacaucaucucugaaacucccuccauggguguuccacucccaguucuaagaaagggcaaaguguccacacccuggucuucguuccuccugaaucucaugugcuucgcaaauuguauccuauaucuuggguauucuaaguuucuggguuaauauccacuuaccaguaaguacauaucaugugaguucuuuagugauuggguuaccucacucaguaugaugcccuccagguccauccauuugccuaggaauuucauaaauucauucuuuuuaauagcugaguaguacuccauuguguaaauguaccacauuuucuguaucuguuccucuguugaggggcaucuggguucuuuccaacuucuggcuauuaaaaauauggcugcuaugaacauaguggagcauauguccuucuuaccaguuggaauaucuucuggauauauguccaggagagguauugcgggauccuccaguaguacuauguccaauuuucugaggaacaaccagacugauuuccagaguggucguacaagcuugcaaucccaccaacaauggaggaguguuccucuuucuccacauucucgucagcaucugcugucaccugaguuuuugaucuuagccauucugacucaugugagguagaaucucaggguuguuuugauuugcauuucccugaugauuaaggaugcugaacauuuuuucaggugcuucucagccauuugguauuccucaggugagaaugcuuuguuuagcucugagccccauuuuuaaugggguuauuugauuuucuggaguccaccuucuugaguucuuuauauauauaggauauuaguccccuaucugauuuaggauagguaaagauccuuucccaaucuguugguggccuuuuugucuuauugacagugucuuuugccuuacagaagcuuugcaauuuuaugaggucccauuugucgauucucgaucuuacagcacaagccauugcuguucuauucaggaauuuuuccccugugcccauaucuucgaggcuuuuccccacuuacuccucuguaaguuucagugccucugguuuuauguggaguuccuuguuccacuuagauuugaccuuaguacaaggagauaggaauagaucaauucacauucuucuacauguuaaccgccaguugugccagcaccauuuguugaaaaugcugucuuuuuuccacuggaugguuuuugcucccuugucaaagaucaagugaccauagguguguggguucauuucugggucuucaauucuauuccauuggucuacuugucugucgcuauaccaguaccaugccguuuuuaucacaauugcuauguaguacagcuuuaggucaggcauggugauucuaccagagguucuuuuauccuugagaagaguuuuugcuauccuagguuuuuuguuauuccagaugaauuugcagauugcccuuuccaauuuguugaagaauugaguuggaauuuugauggggauugcauugcaucuguagaucuuuuggcaagauagccauuuuuacuauauugauccugccaauccaugagcaugggagaucuuuccaucuucugagagcuucuuuaauuucuuucuucagagacaugaaguucuuaucauacaaaucuuucacuuccuuaguuagagucacgacaagguauuuuauauuauuuguggcuauugagaaggguguuguuucccuaauuucuuucucagccugucuauucuuuguguagagaaaggccauugacuuguuugaguuaauuuuauauccagcuacuucacugaagcuguuuaucagguuuaggaguucucugguagaauuuuuagggucacuuauauauacuaucauaucaucugcaaaaagugauauuuugacuucuuccuuuccaauuuguauccccuuggucuccuuuuguugucaaauugcucuggcuaggacuucaaguacaauguugaauaaguagggagaaagugggcagccuugucuagucccugauuuuagugggaaugcuuccaguuucuuaccauuuacuuugauguuggcuacugguuugcugggugguuucucuuuuuauccucauuaaagaaucaucaaguuguccccauccauacccccuccucacucccucucccacccuauuccuccuccauccaccuccaaugucuaucuuauuucccccuuuaagagagagggcuggggaagaaaacagaaaucaguggggguaucucugggacuagcccaagaccugggauggagaggcuucugggaguauauugggaugacccuagcugaaauuccuaggaguggagaauauggggacugaaguggccaccuccuguaaccaaacaggacuuccaguagaggggaggggacaucaaccacucacagagcuuugagccaaaauguguccugccuauaagauaugcagagauaaggauagagcacagauugagaaaacagccaacuaaugacuggcccagcuggagacucaugucauggaagagagucagccccugacacuauuuaugauacucugcuaugcuugcagacaggagccuagcaaaacugucuccugagaggcuucauccagcagcuagaaacagaugcagggauccacagccaaacauuaggcagagcuccaggagucauguggaaaaguaggggauaggauugagugagccagagaggucaaggacaccgcacaaagaccuacaaagucaaauaaccugggccuaugagggcuuacagagacugaaccaucaaccaaagagcauucagcauacauauuuguagcaaauguacagauuggucuucauguauguucccuaacaauuggaguaggggcugucucugacucuguugccugccacuggacccccuucuuguagcugaacuacaacuauggccucaguuggagaggauaugcuuaguccagcugugacuugauuuacaaggucagggugguacccaaaggggcuuccuuuucucugaggaggagaggggguauuugggaaagggacuugugagagugggacugggaggagaggagaggagggaggaauggcuguggcuggaauguaaagugaauaaauacauacauacauacauacauacauacauacauacauacauguaagaaaaaaugccagaugaucauuaaagcauuugugaaauaaaaugagaaaaucuucauauaaauaaaaauguucuccaaguguuuacuagaggucaggcauucucagaugggcuucuugccccucacuguaccaauaauuguagccacuaaaaaaacuccaacucuuacacaaccuugacaaauacuauaccagcuacagaaagccaucaguucaauacccagagcaaagggaacauuuucuauuuuaacauuuuuaauuggauauuuuauuuauuuacauuucaaauguuauccccuuucccaguuuccucucuggaaacccucuaucccauccccgcuuacccuucuucuaugagggugcuccccuacccaccuaccaacuccugccucacugcccuagcauuccucuacacuggggcauccagccuucacaggaccaagggcuucccuucucauugaugccaguuaaggucccuuagcuccuucaguccuucccugaacuccuucauuggggucccucugcucaauccaaugguuggcugugagcauucacaucuguauuggucaggaucuggcagagucucucaggacacagcucuaucaggcuccuuucagcaaguacuaaucuuggcauccacaauaguguguggguuuggugccugcaugugggauggaugcccagauggggcagucucuggauggccucuccuucaaucucugcuccacucuuugucccuguauauccuuuagacaugagcaauucuguguuaaaauuuuggagauggguggguggucccauuccucagccagagggccuugucuaaccucuggauaugcucucaacagguucuugaaagagagcauuuucaaacuccucguuauuccguacucaacuccaugucagcaucacugccaaauugugugcuugagcaguucauaaagucacagacacucuccaaggacagaggaaggaauaguguugaauaaauguuagguucauucuucuuguuaugugaauuacuuuagaaucaaaauacugauuaaauacauauacucauauaaacaugucugcauacacacacacacaccaaaauaggaaaaaaaauucuaugaccuccaagugggcacaacuuauaucuccauaucucauauccuuucaauguuuccaaagcuuaccucacucccaaaguauguacuggcuuucuucacaggcugacgacucaagugaggcaggguguccucaguucucaggacuucucugucacuuaauggcacuugacuuuauucaaauaacuagaagauaggccugaaacauggcuugcucaguaauauugcacaaauucuccuagaaauuaaagcuuuaaauuagucuauugccagucuaucacccauucaaagauugugaaccaggagcuuaguugguuaaggcacuugcugcaagcauaagcaucugagcucagaucccaagaacauucauaaaauuuagugggccaugcugaccccaaugaggacacaagacagauauauacauugaccaacuaauuuaaaugggucaauaagauucucauucugugagaggccaugcuucacaagacauaauagacagugacugagaaagacauaccaacauugaccucuccacaugcauguucaugcacacacacacacacacacacacacacacacacacaaaugugagccauugcacauuuuggaugauacuuuaauuuuuguagcauguuuuguuuagaaacuuguggggcaugaagcauucucuuuggauuccuaccacagcucuccaauagaaguauaauuuucuauuucccccuuauggauauaggcacuugcucagaaaggaaaacuuacugccccaaccauuuauaaaaucaaaggucaaaaccaguuuuccauuucuucagcaaauauuuauaaguacugcagagacugcuaccaacaaaauaaauuaaaguccugcccauugggaguuaugauauaaaaugagaagacagaaaauaaacuaaauaagcuuauuauauaacguagaggaggaccguguaaaucaccaagcaagaacuuuaugucuguguuuccgaaauggaggucucuugaaauuuuaagcacagaagggaaauauuccuaagaaaaugguuuugaaagaauugggugagugugucaugucaagagcaggggagaaaacagcaagcuguccaagaaggaaauuagggucaaagacagugaagcaagaguugccuggcuuguuugaggagcaauauaucaaguaccuucuaacuugguaaacuuuacuauauguaaauauguguauauacaauuacaguugaggcuuuaauaauuaaauguuaguaucccagauggaguguagauaauacaagaacugauauugcgaaagcuccugugggucccaaaggaagaaaguuagcuacagcagacagaaaagucaaacuggaugaagguaaaagauaggcugugcuuacuccccagcuguggaaagagccauuuagggugguccugcaccucccaaacauggcuaaccuccaugucugccaguuuucaucaucugagcuguuauggaaaggcaguaaucuugggcagacacuaucgauagccauggcaaccucuaaaucaccuuguaggcaaaacucuaccagcaggccccugacaggagagccuguaugagagcaggagagcuguccccgacccuuaccugcugcagcaccaagcccugcuccuuaccuggacaacacaguauugcugacccugaugguggaggguagaggugagcuggccccaagaaugugagcaugggagagcuugcucugccucuugucugcugggcaguugugaggaugagaaagagacacucucccucauuccuugccaucuauggcaagcaagagaacugggcucaaggucaucagaguaggagaacucucccugucuuucaccugcuacagcacucaggagagugggcccugcaucucacuuggccaguguagacuuggcccugguagugggaguuucuggugagcaguccccaaagacaugagaacaagaaggacaaugggcugaucagcucagauaccucccaggcccagauacagaguuuugaauuggcccaccccaacaucuaucccaucaauaaacugcuuuagugcauaaaggggccaguucuacagauccaaaaauuacgggaacucaaugacacagaacaacagcaggauauuugagaggacucuuagugagauuccaguacugauagaguaguagaagcuagagaccuuguaccagaccagcaaaucauugcaaugaacauuugcaagcgaagaaguauggacaaaaggguauacugugagacaaacuguagcacacuauagcuuuacaaugagauuucuuuuuucucuggugcaggggagguugcuaggguggaaggcagguaugaggaaaagaggagaugaauggaauugagcugccucaauaauaauaauaaucugaaauaagaacccauaaaaaguuuuuaaaagaacaaaaacagcaauaaaugucuacuagcaauagcagcccagcaccugaagacauacaucuaugggcccaagcuuaugaaggaguaugaaugguguuuuaacuaagacaaucaaaaacaaauaaacaugacagucugacauuaaaggcuugagaggaauuuuuaaaacccuaagaagguuugaaaugucacacaaagccaacagcucaaaguuuaagaguguugguugaacuacuuauagcaaugucaaaaaaaugucauuuguuuaagaaaagagacaagacaaaaauaagauuuaaaagguugucuuaauuuggguuuuauuacugugaaaagacaccacaaccaaggcaagucuuauaaagucaaacauuucauuggaacgagcuuacaguuucagagguucaguccacaaucaucaugguaggaagcauugcagcaugcaggcagacauugugcuggaggagcugagaauucaccaaggcagccaggaggcagcucucuucugcaccuucagaguuugagcaauagaaguccucaaagccugcccccaugguggcacacuaccuccaacagggucacaccuauuccaacaaggcugugccuccuaauagugacacugcccaugggccaagcauauucaaaccaccacaaagaguaaaauaaucuuaaauacaagaaaaacugaaagcaacaacagauucaaauaauuaagaauacagauaauacuuuuauaaacacuaggagaauaaaauaaacuauguaacuggcuagaaaauaucucuaauacaaaacaccaggaaagccaagugcaagcugaaugcuagauagugagucucuacauuugauuauucaugucugaaaaucagaaccucuuugcaaagaccaccaagucuucauguaggaaguccaagcagucagagcgcugauuaugaucaaugucaccugaauucucuaggcucugugcucaaccucaucuagacccaucugacauucaccaauaaaugugggggucagguauacuuacguggccaguuucccaaguguagcccuggaccucuguuuucucccagucuccaaaccugcugaauacuguugacugaucugacugccauuuucacauggugccauuacaagacgcgucuaucagagaugcucagcaucuuaaguacucgaaccccaagcaauauucaccacaaagagaguuauagaagcuaaggaaaaugguuucagaguagcaacagggaaaaagguuauuuugaaagaaaaaaagaggaauacaacacacacacacacacacacacacacacacacacaagugucuugaccguguaugguggacuacauauaaacaaaacacacagcaccguuugagucagccacaugaugucaucagucucuucucauuagcagucaggaaauuuaaaucacaauggcuugguauuuuuggccauaucagcauuugacauaucugauuucaaaacacuaugguuauuagacuccaaagauuaagcuauuuuaucccucugccauagcuacagucuaaaacaacccaaaaagaaagcuguucuguuguuagggguuuccaaagacuggcuuuacagcuccccuccaugaucaugucaacauuuauuguuuauauugccagaaaauauuuauugaggaaagaauaaagaaaaaugaaagaaagcaaaccuugucuguaaagauagggaagaaaaaagaaggagagagagagagagagagagagagagagagagagagagagagagacagagagagagacagagagagagagagagagagagagagaaaaaaagaagggagggagggagggagggagggagggagggagggagggagggagggaggauuauaguugaaucuaauauuuuccucuaaauaacaaaauaccugcucuaaugacagcuguaaaacccauggcagccacugugcacacacugcagaccagguccaagccucagccauuaaauuccuucuucuccagcugauccucauaagaugacagggagucaacucaaauaaaccuugcaucacaaagaacuccggcccgauacuaaauuuaugcaaaacauauuuguacaauauuuuagaaugccaaacaagcuacagauuagccuguugaaauagucucaguuaugaauucuguauaccuuacaugguaaauauuuaaguuucauuuuuauguauuaaaggcuaaucggauugcuugaacaacaguaacacuuucauaggcaccugagauggggguugggggaugucuaagaggaaaaauaauugaacagaaauaacuuuuaguagacuguguuguaggaacagauuugagucaaaaauuauuagguucuaauaccaaacuuucaugaauccaacauauauaucccuccaaucugaaugaauaucccuccaaucuguaggugccaucacacagacgccucuguggaaacacaaggcuuaaguuucaagagcuaugagacggcagccuugugguuccuuggucaagucauacacaacuguggaagcagaauauuauuuauuuauuuauuuauuuauuuauuuauuuauuuauuuauuuauuaugcucgccaaaguuucuccucccucuucuccucucagcuaguccaaucccccaucuacucucuuucagaaaagggaggccuuucacagauaucaaccagccuugccauauaaagcugcaguaagacuaggcaccuccucuuccauuaaggcccgacaagacaauccaguaggaggaaaggguccggaaggaaggcaacagagucagagagagccccugcucccacuguuaggaguauuacaagaagaccaagcuacccaacuuuaacauguacaaagugucuaggucaggccuaccuaguugagaguucagacucugugaccccuuauggacucgaguuaguugauucuguguuuuuuuccuucuaguguggaaagaaggcauuuuuaagaggaagaccuguguacuuccacucagucugcauguguaaguccuuacaugcaauaauacaaccugcuuuugcuaaaugcuacuucucuuuacuacuuuugaaagaaccaaagagcagccauggauacagcuccuauauuuucaaaaugcuucccagacauggaagcucccaccuguaaccacagcacuccacagccaacgcaggaggauuucaacgaguuugaggccagccagccuggacuacauggaaagacugccucaggcaaacaagcaaaaaauaugaacagauucaaacaaagaccagcuugaacauuuauaguaaaguuaaguuggugugaacuacuauaauuuauaaacuuuuguuuggagauggaucaugugaccuaaucaagaggggauagugacaaaggccauuucuggaaucagucacucuuuaugcuaacacuauuuuaauuuugguaacugucauauguuuaugugaguuuugugauaauagauuguaaggauucaaaaaguauaacuuugugguuacaagauuuucacaugaggauuaaagauucaaaauaugugauaaauugcacaauacccauuuaaaugaaauauaaaauauuuaaauguucagaucacuccauuuauuauuuaucucuaauuguacuauuuuuuauauuuucauguguucuuaaaauuaugcacuuu

SEQ ID NO: 875 - RNA, 80766 nt, Mus musculus
gcgccggucccggcugcgggaagccgacucguucucagccgccgccgccgccgccacaccuagcggaggagccgggaaaggcggcccgggagugggggguguacuggggcggagagcgccgcggguggaggcggaagggcggcgggcggaagcgagcgccgcggcugcugugucacggcgcgggugggcgcacggcaugggcgcgccgcgcugaggcggaggucgcgggcgggcaggcgggcgggccugagggaggcggcgagccggggaguagcgcgcccggcggcgguggcggcggcggcggccgcaccaugucgcgcuccgugcugcagcccagucagcagaagcuggcggagaagcucaccauccucaacgaccggggcgucggcaugcucacgcgccucuacaacaucaagaaggugcgcacgggccggcgaggccgggcggggugcggcgggggaaaaggccgcgggcgccagcucggccugcucgcgcggggccuccgggaugcgccgcggccuagagugagccgcggggcgggcaggcgggagccauuucccggcucccggcggcgggaaccggccgggccgcgcauggccgccgcggcgcucugguuugcggggaggaaaggagggcgcgcggccuucccgggcugcggcgaacgggcccgggguucuuggcuugcgagugugggaaugcggcgaucgacccucugguccccacuuggccacuugauuuuucguucccugaaucaagccccucacccccacgacagcguguugacguuugggauaauuucauuuugaagauggaccggagggggaagugaggguggaaccgguuuucgucugaaauacuuguaggcugugagucacuagaacaggaauaaccaccuuuacucccuacuccuccucauuuuaguuuucccaacccuaucugauuagcaccaaagcaccauuccuuaaaguacaauggcuguauaaaauaaagaccgagugugcucccguugcuaucuccuucgcaacauaguacgaggauuugagcaacuagacaguggacccauugaaaaucugagugucuucagauuagggaguggaaggcuguaucgaagugaagaaaaguagaucuaaagguggaaaaggauugccauuaauuuaccuuagagggaaacaaccucaaauccauuuauuuuaagccucacugaauuugguaaagagaaaaaguuuccuuuugguacacuuuauaccaguccauccuugcgggguucuguguaucugugucuuuucuuuaauaaucuuguuuauaaaauuauauauguguguguguguguguguguaucuaucuaucuaucuauauaucgugaaauauacuuuugaccauaucaaaaggauauagguugcuugugaguauccugaagauucuuuuuaaaauuuagaaucaaagcauuccaguauaaacuuguuuuauucaguuuauacaguuagcuuuugacacugcaauucugaagcacacucucuaaaugaauaauaguaaacguugggaaugggauagcuguguuguucugguuacucacuuggcuuuaaugauugucucuacacccagcacaguuuggagcuaggaagaacccauugcguuugugccaugaccaugacauccaccccuugaucguaacuucauggggguuggaagaauuaagcuuguauacguugcagugaugagagccuuugaauuucacugcuuaagaaauuuggaaauuaaguucuauaugcgaaaccccagcaagucaaauguuccuaaaagcuaccagaccugugguuuugugguuagaggaaaugguuaugaugguuucuagaagaggaagugagaguaaccuuaaaagugauuugaguauuugaguaaaauacugucuuuaauuuggccaagucacuaaacauuuuuauaguauaaguauaaacaaacuuugauacuuuaauuccauggguaauaguaaguggaauucuaagcauuuaaacuucggauuccagaucgcugccuuuucucaguguuucucacuuccuguuuugagaaacuucauucaggcucuuguguugacuagaauggaaaaugcgugaaugugauugaccuaauugccaagcauuugaguuacagaaaugcuguauauuucagcacguacauauuuuuuauagcuuuuugaaauauuuuuugccuccuuggcuucuggguuccuuaugggaagaguaauauugagggcauuaucuagcucacaaggcuuugaucagagcuggcugaaauugacaguguucauguuaaaugcaucugauguuuauuuugugagaggaagagagagcagauguguguggagguuagaggagagcuugugagaacauucuuauuccaccucagaggguuccugggaccaucaggcuuagcugcaagugccuuucugcucugagccauuuugcuggccuuuuagguugacuuugaauccuuuagccuguggaauugccagccuaccucuucccagcuggcuacagagugaagcauuuguucagauaucuugccaaagaagcaagaucuguuccccaugugcguauaagguucauguuaucuacguuauuaugacaguauaaaucacauaaucuuucauuuacuuuuauuuuuucuuuuagauuuuaaagcuuuauaagcaugaguguuuggaaugcauguaucucugcagcaugugugugugccugaugugcaccaaggcuaggagaagguauuagauccccuagaauggaauucaaaugguggugagcuucuaaagcuggaauaaaugaucuuacacauagucccaucuuuccuagucuaacaucucccacugucucaagucuuucacaauccuacuuaaacacugcauuuuguuagcuagcuucacaucucucccauugagaugagaaugucucaacacuggaauaauacaccugguacuccaaugcuagcgaaaacauucaguagauggauuaauagggaggaagcugucucaacauugacauuaccuaaaagauuagcuuauaaggccauucuuuuaagaguuauuugaaauuaucauauauacagauauauuuacacauuaacaauuuaagauuuaugaaguuugauauuauuaaaauacuacaguuuuauacuuuaacuauguaaguaauauauacauguaaucauauguacagaucuauuuacacauuaacaauuuaaauauuaaaauauuacaguauuguacuuuaacaaagaauaguucaucauugucuaauuauuugacaaauuaagucuaauuaaguauacuaaaaaauauacaaguauaccaaaaccuacaauauuguuaaauucuuagaaucaacucuuuuuuuuuuuuuuuuuuuuuuuuuuuugguuuuucgagacaggguuucucuguguagcccuggcuguccuagaacucacucuguagaccaggcuggccuugaacuuagaaauccgccugccucugccccccaaguacugggaucaaaggugugcgcuaccacugccggaccaguaucaacucuuaaaaucuuaagagcuuacuauauucacuaacaaaugcaauauugaaaacagugggugaaaauuuuaggugugugguuacuauuaauugaacuauuacuuuacuauuaaugaaacaaacuuagguuaguugugauuccugacugcauuucuugugcugcagguuacauagucuuucauuguacagguuaaucuuugaucuugugaugucauaccccagauagugcugggaaccaagucccagagccugggcaugcuagaaauggacuacugccaagcuaaguucccagccucacuguuuguccuucaaaaugaaaauuacagaagaaaauuuuuaucucauugguucucuucauucuaauuuuauguuuuaaguauacuccccauuuuaagcaaaaugcccuauuuauuucgguuaguuuuacuuaugcucuuuuaucuuguacacguuaaaaugcaccagggacuaaaccuuaaccuuaaccauagagggagcugaggagaccacggcggggcuggcuacacgggccugagaacugaguuuauacccagugcugaccuaagaugccaggguuuugaucccagccccagggagagagagacagguggauuccuggagcuugguagccaccagccagccuaaccuaauaggccagccugaaccuccccagguuccugugagagaccaugucuccaaaaaaaaaguaacuccugaggaaugacaccaagggugaccucuggccgauaugugugccugcaugugcacauaccuucaauuaacccacuaaaauuccacaggaaaaauaacuguaaucugcaauguuguuacaaaauauaucuuacuaaagaaauuugaguuaaaauuuuaaauucuuucuccuuuaauacaucacaagugcaaacagaaaucuccauucauaauuacagaaaacaugaugaaaaugaucuuuccauccagguccauagauuucaucacaaguaguccacaauaaaaagggaaauuauuccugugcuaguacauuucuguaagauuaccacauauuaguuuuaguuacauauuccuuucagauguaaaaagugaauuggaucuauucauagccagguuucuaaagaagcuacuaugcauauuuuagaagcagugaguuggcucagugagcagaggcaucaugacuucaaccaggcauggugaccugagaauaauccuuaauauauguauguauauacacauacauacauauauguacauauaacacacauauauauauaauagcugggaagugguggugaacacucaggagaugaaggcaggcagaucucugaguuugaggccagccugguccaugcaaguuccaagauagccagggcugcacagaaaucacugucuacaaacaaggaggaagaaaagaggugcacagcugucuucugaccucuacguguacuccauggcacaugugagcuucgucccccacccccuuacauacacaaaauaaaucaauuagaagguuuuugaaguggagagauggcucagcaguuauacgcaccagcuacucguccguccggagcgucacgguuuguuaccagcacccacuugguaacggacaacuguucuuaacgucaguuccugaggaucugacacucucucuggccucuagcggucccaggcauguccguagugcacaggcaggaauggaaaaugaucaguagaccgaucaaaaaaagauacgaaauauguaauaaaauaccuuagcuaauaccgugaguguguguguguguguguugaaggucagggacaucuugggggguggggggagguucuuuucauccaucaugugggugcuaggaauugaacucuauacaucaggucugguggcaagagucuaccaccugagccaucucucuaaccuuagaauuuuuuuuuaugugcauauaaauuauacuucccuguacuuagauuuuuccuuuucuaagucuuaugacauguuuguggguugagaaugacauucuaggucagguuuuaguacuaauuuguuuuaaccuugaacaaauuuggccuuguaggcuaucauuuauaaagagagauuaguaguucuuacccacaaucgaguuaucuuuuuuuuuuucaguacacacuagaauucucuuggagaaaauguuuggaucuuggcuugacucuaaugaguuagaaguaguucugaugcuaagagccacggauauaagcaaaucguggugcugucaauaccuaugggguuuuucuuuuuuuguuuuuuguuuuuuuccuugauggcuguccauuuucaagguucaguguuguuggugaggcuauaacuaagauuuuggaagucguacaguggcuucaugguaugcacguggcuuuggugacuaucuuacccuuuuuuuuuugcuuuuggcuuuuugagauagggauaggguuucucuguguguagcccuggccaucuugguacuugcauuguagaccaggcuggccaugacgucagagguucucuuuccucugccucccacaugcugagugcugggaauaaaggugugugacaucacugccuggccaucuuuuggcuuuuuaaagccuuacuaguggugcugaucuaaacuagccgucuacuacugugcaguaucuccagucauuagcauuacugauguucauuuuuggaaucuuaauuagauauuccaguucuuccacauugugcaauauguuaauaacuucauauuuugagaauuaagguuuauuuaugugaaguguuuguacagugccugaaaaaaggauaaaugggcuuggagagauggcucacugaguaagggcucuuacugcucuuccaguggaugugagauugguuccuagcaccacccauaucuggcucacaacuaccuguaguuccaacuucaggggcagcauacgucuucuggccucugcagguaccuauagucucagucucucucucucucucucccucccccccccccucucucuauaugugugugugugugugugugugugugugugugucuuauauccacaugacuaacaucaaaguaagcuuuaaaaacaaagaauaaacaugauaaauguuggcugcuguuucugggucuuggaacagagcagacauuucauaaaugcuuagaccauuuaauaaauaaauauagugugauuccaccuuuaggaaacaugucucaaguacccuuuuuucuacguaacaguauagguggacaacuacuuauuguucagaguaauugcagaaguguguucuacaggaguuaaagaucuguuuagcauuaguaugucaguguauaaaacuuaaaaaaucuguuuuauaaacugagguagucuauauaucagaacucagaaauauaagaaauguaguaacuaucuucuugugaauugaauaauuguuagaaacuuuaauuugagucauuaaaauuuuuauuaaaaaauuuaaauuuauguguaugaauguuuugcauguaaguauguauguauaccauguaugugccuugugcugagcaagucagaagagggcuuugaauccccuggaacuggagaugguugugaaccaaggugugggugcugggaaggaccgggguccucugcaagagcagcaagcgcucuugacugcugagcugucucuccaguccagaaucauggaaaauuuuaggaaaggauuuugaaggauguaaugguuuagauuacucuuagaucaugauuuccccaagauuuaugauuuauauucaccuauagcauaaaaauauccuuaauuaaaccagaugggcuaugggacacuugggucaaaagacaggucaucuucccuucuuuucccuuagguccccucuccucccccuuccucccucccuuccuguagugugcauucaaauuggagaaggguugggggcgguguggugcgaugcuuaguaugcuggacaaguuacauagccaagauggcauucaggcuaauauggcuagcuacccagucucucugaucugccugucucuauccgcccccagugcuggggauacuggcagacugcuuuuauuccauugcuaggaucugaacucagguccucaugcuugcccuugaccugcugagcuguuucucagcuccuuuuguuauuguguuuagauucagguguagccaaguagugugauguuuuuuaguuuuuaaaaaauuuguacuuccugaaugacgucucaaaaaguaaaggauuacuaauaauuuugauagcaugagaugcuuucaaauauauugacaguuuccauucuaaaacaauauaaauaauuuucuuccaaguuuucugucucccaaaugacuuguauuuaugaauuaaucuuuauagcuagauuucuggugaguuagaacuguccuacugugguaguauuguguaaaauccauagcugaguugcagucacagcuccuuacuggcauggaucuucccagguaacuuaaucaggucacaguuuacuuuuccuuguccuuuguuccugagaauuccucacauaagcaucuuucuuuuuauuaaguaaauaugccacguaagcugcuuuuagagaacguguaauggaacaucuguguauuccuuauuuuguauuuuuuaaaagcauuuauuguauucaaaacauaccuguaaguuccccacaaauaccacaccccuguagugaauauagaacuuuuuagggcagguuguaacuauuaucuccaguuuaguagauaaagaugucaagauaugaaagauaaagucaucugcucuugguuauacagcuauucuguggcguagucaggacauaggcaggcugcuuuaaaacucaugcucuugggcuuuagggaugcgaugguagaauuuguuccuaacauacuuaaguuucugaguucaauccucagcaccuaaaccccaaaauaaaacauaaagcuauauucuuucuguaaguaaagcaauuauaguauguuagaccuagggugagugauugaggaggggaaucacaguuguuaaggaaguuacacuaaaugugcugguuguagauacugugacagagacugaugauagucuccgugguagacuucuggguaauuaucauaaccuuuauuauagccauuccuaauaacagcauauauuuuugagcacuuacgucucagucacuuuguuagaugcuuuacauggguuaccuaagcucuugaaccccucauaaugacauggugagguaaguauucucccuuccgcaucuacagaaaaagaaacugagacuaagaaauuauauauaucuaucuaauuuguauauauacacauacauacauacauacauacauacauucguguauacauauccauccccagagcuagugagugagagguuagaggccuagcugcuuuuagcagaaucugucauuaacucagggaugcucuuuacauauggcccacugagcagcaugcaaagagguaaucuaauucuaaaagaaguuauauauaauuuuauuuuuccauugaaaugggauuauuuuuuuauuuugucaauauaagaaggcauauuucuuuugugaucuugggaaaugguuauuguuuuuaaugauaguuaaacugauaauacuguuaaaguggauacccagauuuuuaaauaaguagaauauaaaagauauauaucaugaaaagacaauguauugaaucacuauaggauucuguacugucucaugcuugguuuauauaaggacaugaugaucucuaccuauuuuuuaugggcaguaucuuaguuauaugacucuugguugcuaguuuauguuauauaugauaucuugaaauuagacaaauuagaaaacuagucuauaagaaacuauuuuaaaaaauauagccugagggaaagucagaauaugcuaauauuauguauaaaugaauuugcauaguagccuugucagacccauuaaagguuaaguucuaaauuuaaaaaaaauguucgauuuaauuauaccgagaauugguacuguguuccuauuuucauuuauaaaaauaggaauguuuuuauuggcuuagaagcuaggugauauuugaaaaauaguuucaauuugagcuaaaguacaaaguucauccuguaacaauuaauuauuuuuauucuuggcuaccguuucuuuuuaagguauguaaaauuucacugaugguuuugcgccuauuuuuuauagcugcauguagucuuuauuuuuccuucuuucuaguauuauuuuaaguugguuuagcaagaccaccaagauacugacaugguuauacacuuacacaguaguauuuaaaucuauaugcauaguauaaacuauauaaaucuauugucuaauaggacuugcuacuuaaguaccuuaugaauuguagcaccauacaguuuucaucuuguauuguuacucauagucugcagugcauaaguuuucuacugaaaaaguaugucauaguuugacaaucauuguuuacacguaaucuucucucuuuuuauuacaaugcuuccccagcaaggacaaguuuggaagguuugcaaagcuuuucaccuucccucugcccgcuugcccgcuuucagaucagucucauguuucauaauuucucuuucuguaauccacaacauagccauaguaaacuagaaggucagguuacaguacuguaucuccucucacaccgcagacagacaucauuguaaaagcauuuacuuaaaaaauggaauaaaauuuuaaauaggaaugauaugauuuucaauauuucccuaagaaaaagcaucccacuugcaccagcaguugucccuuaacugagcuguuaauaguuccucuuaaagcuuccagugacauuuguagagugucugccuucucacugcagaggaggcugcuguugugggcagugccgugcuugugagcuaaggacagccagccagccauaggugccuugcuugaggugcugcuggcuugaggagcagugcuagagcucuugcuuggaggacgggcagcacaccugcagggcagagcaccuucagcuucagcggcucccaguucuuuugaacuagggcucuuguauuaaaacugaauguugaaagcgaaugaggaaaacauuuuggaaaagacauucaaacauaagccuucauuuuauaacacuuagaaacauuuuaggacucuacuuaauauuuaauuuuguaauacuuuaucagcuucagaugaauacaauccuaccucaaaccaaaaagguuuucauuuucuuuuccuuuuuuuagguuugagcuuuuuccuucacugcuguucugcgcuaacugcuuuaaaacuuuccaugcguuuuuuucaguagaagagcaucucuguacugucucccaucgcaucucucagcugugacaaccccugcacuuugccuguucauuuaucaccugcucaccaaaaccaagaaaccuuucuaauuccugauuucagauuugcucuucuuccuugauuuuuaggaagauacauuuuacuuuuuuucauuacuguuguuuuuuuaggcauguggcgaccccaaggcuaaacccuccuaccuuauugacaaaaaccuggaaucugcugugaaauucauagucagaaaauuuccugcuguagaaacgcgcaacaacaauguaaguugucccaacuuucuacuugacauuucucaucuaagaacagcaaugcucagugcaaauguuuuaucuccuguuaaucuaauguccuguacaacuuuuagaccuugcuuaaaugcuuuuaaagauaacauucguuucuuugaaacuggaaaaauuuuagcuacauuuuauguggaaaauguugaguguuaauuucuugcacuauuuucuuggaugaauagguaauggauagauaaaccgcaccccaaaugugugugacuguucgggguaccuuuuuauccuuauaucuuuaaccuaguuuucuuuuggaguuggcaauggcuucauggagcuugauugcuuuaguaaucagcuuuuaaaauguguuugcuuaccugccauuuuccuaguucccgagagcacuucuagaagugagcagguuauggucuuuaugcuauacuaguuccugggggaagcuuucucuuacaaaguuuggucauauuuagucuuccugguacguuuauuuuugggcaguuucuguuuaguaauuuuaugaaugagcaauuuuagaaagaguuguuuuacuguaacauauuuuuaaaauuuuuauagaaaucuucacaggccauuauuugucccauauuucaacuccugcugucuuuuugcauuauguaaaaauuaaauuuaacaauuuccccuuaugagcucuccaaucuugagaaucuuuuuaaaaaauaaauugucgccaggcaugguggcacacgccuuuaagcccagcacucgggaggcagaggcaggcagauaucugaguucgaggccagccuggucuacaaagugaguuccaggacagccagggcuauacagagaaacccugucuggaaaaauaaauaaauaaauaaauaaaugaauugucauguuuuuguccugaaaugauauaugaucauugaagaguuauauuucccuuguugaaaauaauuauuuaaaaauuuuuaauuuagauaggaauguuagauagaauuauuaaaaauaagacagguguuuuuuuuuuaagucuugguuuggguuucuuaaguuuuuaaaaauguuauuuuaaggcuuuuuuuugauguuuggauugguaaaaaucuugguuuuauaaaagguuauauuaguacuuuauaagugauuauauacaagaaucaccaagagguccuacuaggaaaaaauugauuggaagcauacacuuuuaaaaagacagauauuucauugaauaauuuccauacaaccaaaaauuaaaauauuaaagugaauaggaaacauguauucuuuaacaaaagaaaaaaagaaagaaagaagaaaacagguggggguggugcacuccuuuaaucccagcacuugggaggcagaggcaaagagcucucuguaaguuugaggccagccuggucuacagaguggucuccagggcagccagagcuagaaaaacccugucucaaaaaccaauaauaacaacaacaaacgaacagguauuaauuuguaguuuguaguaagauauuuacauauccuuuuagauguggugaaucauucuuuugggcagaugcaggcugcucuuggugacagaccagucugcauugggaguuucagguccccaggguugcacaauuagacugucuaacaaaaaugaaaaacacauccuauagaaaggacaaaugagcuggugaugaucaguaaucugcugucucuucagagagauuacacacucaccugaaaugaguuuucauaaaagcugucucuuaguucuguauauacuuguucuuaauaaaguaucugacaugaaaaucuuuuuuuuuuuuuuaagauuuauuuauuauuauauguaaguacacuguagcuguuuucagacacaccagaagagggagucagaucucauuacggauggcugugagccaccaugugguugcugggauuugaacucuggaccuucggaaaagcagucgggugcucuuacccacugagccaucucaccagccccugacaugaaaaucuuacauuuaguuuauguuaauuuuuguauggcucauuuacuggauguaagaauuuagacaguuguuaggagcugauagguacauauuaacuguuuauuaauaguaaacauuuuaaagggccaguuaauagauuaauaguuuuuacuguucuuaauaugcuugacaaacugcuuguaauaacagugcccugcuaauacuuguucuuuuauaguuuuacuucccuuuucaaaauuuaaagcacaaaauuggaaguuuugauacuuuguugagauaugauucacuugccauacaguuuaucucuuugaaguguauggcuuagggcuuuuaacuccacagaauuauucuguaccacacuguugaccuacaugaaguuaaaauguugguugguuuuuaguguauucacagcucugucaauuucagaguaguuaauuacccagaagaaauucugcuuccugcacagucagagucccuguaucccugccagccucccagugcuaggcaagugcuaaguacuaaguacuaagcauugaccuacucucugggccucgucuggaggcuagccucgcgcuguuaugaaaauauaacugugaccuguaauacuugugacuggcuucugccauuuaacacaaugcuuuccagguuuauccaaaugcuggcagauuucacacgucauuucuuuuuuuagugacaauuaucccacuaugaauauaaaauacuuuauguauucaaucguugaguugauagauguuuguguuguuuuuacuuugcucagucaugaguuauaguuccgugaacauauauaguuuuuaauauauacauugugguauguguuuuuuuucuguguugaauuuauacaaucgauaacauguuaacuguuauaacuauguggaauuuacucuagagucuguuuguuguaugauuuuacaauucugcagauuauauucugugguacucuuuuugguugguuggcugaguuuucacgacagggcuucucuguauaacagcccuggcuauccuggaacucacuuuguauaucaggcugaucucgaacucacaggguuccuaccgcugccucccuucgagugcagggauuaacggcaugugccacaacuguguuuguuuuuuaaauacaugucauuguacuauguauugacuauuugagaagucuuaucucagccuuugucugagucuguuaaaauguugaugagagacuagcuacuuuagauuaggaaauaaaaaaaauugugccuuauaguuacuuuuuaauuccauaaaauuacuuaaugaaggccaggugugguggugcacaccuuuuaugucaguacacaagaggcagaggcagguggauaucugaguuugaggucagccaggucuagcaagugauuuuucaggccagcuagggcuauauaugaaacccuguuucaagcgaaaacaacaaaaauuaguucauggaaaguuuaaagguuugagugacaaacaaugucuggacuugcuaggaaauggcagauuuccuucuuugccagagaccaugcuuaugcuuuccccaggacuggcacuaguuccaguuugcuucaugccuuacaaauaguacuuguccuucauuuaagaaaaggaacucaagaacagagauuguuuuaaugaaaaucaacaauuuuuuuugaaguuucuaaaguagauuguucuaagaaaauuuuacucuaucaacauuguagcuaaaaauguuucugguuuuaauucugucuuuagcaacuagccucaucuuaucuccaagcauuuuaauucugcuggaagccaugagcaccugaguuggagugugucaaagaaaguguuguuguuggaagcaggcuugguguguagugcauccccaguguccucaggguuacuccuguucaggccccuuugugggcaugaauuguauauuucguucuggauuuagggaaaaaacuguacaucucaccucccauuaagauguugagucaaaugccuuauaugcuucaaaguaugcucuugaaaugcaguuuuguuauaaugcuaacauacuaguuuuauaacgauaggugccacuuauuuugucucuguaugugcugggcugugcauuuugguagauugcauuuaauuucagacuagccaaauuacugaauuguccagauguguacuuuaaaacuauuacuauuuuuucaaguaauuuuaacuuaaaauuuuuuucuguuuuuuuucuuuuaauuaacaucuaaaacccaguuugucauuaaaaaaaaaaaaagaaaagaaaaagaaaaccauuacuuguaauuccuguaccuaggaggggaggcagggggaucagcaguucaaguucauccucgguuguagcgagguccaagccaaaacacagacaagcgagugcaggaccaaucuguccuuagagaaucuuccuguuguguguuuaaguguaaugucuugauuuuaauuucccaagaaauuggaaauauuagucacugccauauguacuaucuuagggucucuaagcacaaguauauuguugguguauggagagugacaaggaugauagaggaguucuguaccagagcacaggcuguugucacaagucuuggaagaccauguacuauucaaccaaaaauauuugaaguuauggauauuacuuguccuuagggagcacaauauuacaagaggcuaugcaacaauuguuuucuguguaaguaguuuacagccacucaaggagagauaaaaccugcaauaaaguggauucaguuguauaacaucacugauuuuaaaccccauuuuuguuccuggugccugauaacagagaauaucaaauauccaaugaaagaacaaagcuuuucgguacauguuaacugacuuucacuuguauuaaauguuuccuuagacuuauaucaggauccaaaaucuuuuuuuguuuguuuguuuuguuuuuucgagacaggguuucucuguguagcccuggcuguccuggaacucacucuguagaccaggcuggccucaaacucagaaauccaccugcuucugccucccaagugcugggauuaaaggcaugugccaccacugccuggcccaaaaucuuuuaaagcuaaaauaucccagugcuuuuuagaaguaaagcuagugcaauucucauuaaggaugcuguauggguccugaauaaccuuguaaaagaauaagauucccagguuuagaaacaugugucuagggucuggagagauggauuggugguuuggagcacaggccuggacucaauuccuagcaaacacauggcagcucacaacugucuauaacuccaauuccagaggaucugaaacccucacacagacauacaugcaggcacaugaaaugcaaauaaguaaaaaguaaaaagaaaaguuaaaaaccaugugucaggugagcugguagcaguauugggauagauguaggagugcccuugauaugccugcugugggaaggaauuagaaggaaaauggaaggacauauaaauuccuuuuuagccagucuuuaaggggcuuuccuaguucugccauggcuucuguuaugagagcaguauauagugguuagagggugcacuucagagucagaauuugaggucaguacuaguuaugagauuuuaggcaaaucauuuggagucugaaagcaacauuuuucuuaugucuaaagugaaaauaaucccugucugaaggagcaguucaauuugccuuaaagcauuuaacacagucuggcaauggcuuuaaaugggguagccauugcuuauguuccaccuaacucccugcuguaugcaguacacuucuaaaugcccccugcaacugucuguuauuugaauuucugcuagcuuuugaacagcuccaagcugaacacaaacuaacauugagcacucuucuuuuauuuuuuucuguuguguucccugcccugagccacuaucuuguaaguugguugcuuaaacuagaauuuuauagucuucuguggcuuuuaaaaauauugugccuggcaaauauagaaguggaugcucacaaucauccauuagauggagcacuggguccccaaugaaggagcuagagaaaggacccaaggagcugaagggguuugcagccccauaggaggaacaucaauaugaacuaaccaguacccccagaguuucuuagaacuaaaccaccaaucagagaaaacaugguggaauuuguggcucuagcuguauguguagcagaggauggccuagucggucauuaaugggaggagaggcccuugguccugugaaggcucuaugccccaguauaggggaaugccaguacuaggaaugggaguggguggguuggggagcagggcgaagggggaggggauaggggauuuuuggaggggaaacuaggaagagggauaacauuugaaauguaaauaaagaaaauaucuaauaaaaaauuuuaaaaaauuauaaacaucaaacugguuauuuugggcauguuuucaacacuacacaauuucauaaacuuuccauucagguauauguuaucuguugagacaaguucuaucuaucuuaaaccaaacauugauuuuuauuuuuauguuuccuaguuuucucuacuugcuacuucuuccauucucuaaaauggguaguaaaccaaaccaauauuugugauaccucgcauaucugucucuauggaccaaaccauuuacuuguuguugaaucucugaugucuaggagauaagggccaacaauaaaacuuugauuuaaaaggaaugagugugauauacauauugugauguuguacuucagcaugaguguauguauucccugaugggaacuugauggaauguuguuuuuaacuaaauugaacuugaauucuaagaaacacgaauuuuaguacagugaaaaaugacucaggcaacaguauuauuuuuaaaugacagaaagaauacaugaugguuuuaaacacucaauguuuacuggguaaggaagcaaaagaaguacgggcucaguggagguugcauaggacagcucaggguguuaggcuugaggugcccauuagaaaugcacugagcgguaaguguaguacucaggcuacaaaucuagagcucaggcuaggggcaagcugaggaccaaagaaagaugcuuguuggggauuuuaagaggcuuagagauugcaccagucacugaggaaagcagagagcggcuuggcaguagaaccugaggucaugcccuaacucaguuacuguugacgcgcaugagcugagauuauggccaagucggcauaugcguauuuucuuacuauaggcuucaucaggcaguuauaauagagaaagagaagggccaaaauaaugagcuaggauggauaagaaaggaauuaggaucugacgagugacaguggaagacaaaggcugauagugaagggcucugagugagcugugguggagguguggcuauucucccuguaaugccaucuaaugcuuucccagagaaauagaugucuaaaacaacuaggagaagccaagaugacuuaagagauaacuuucauauuuuugucuuuugucuugccaaugaaggaaacuaucauucccuccugugaguauaaaccccagauaauccaugggugaccucacuucuaugcuuaucuuuuacuugguccaccaggcucacuguccucaggacucucugcagauguggccuuuuuuacuguggccuuucuuauacuauaacacaagaucuuacccauuugcuaucuuuaugaguuggugagucauuguggcuucaagcagauguggagcuguaguuuuggcagcaucuuugacuuuaccugggaagaguuguggaacugacuuuuaaacuguauuauucaccuucagcagcaagcauaaagaugucuuauguaugugaauguacauuccucaguauauucuaugccucauuuaaagucuuuucucauacauuuuuguucagcuucucccaugaugucugauacuuuauuugcaguauuuuuucacaaauaauggaugauacauuauuuacugaucauauuucacucacuugacugucuuaaucacuguugaaaacucaaaaagcaguucugauuuuaaaaaaaaauccucucaaacaaaauaaaaaauaaaaaugucuuugugaagacauauuuguagccacauugauuauuccuaaauccaaacuagaaagaguucagcugcucaucaauuaaccgaggaaucgauaaacaaaagggauuaguacccgccucccaaacugaguaucugggagcucaaaggaaaacacuacugauacaucauauuuaugcugcaacugaacauuaaguguuaagugaaagagucagauaaaccaagcucugcauacucuuugauucuaugcuauagcaagugccuagaaaaggagagguuuauugagacaggaagcagauuauuauuugcacagggcugagagugaaaccuggguuaaugccaggaagcacaguguacuuugcacuuuggaugcugaagcucugagacgugagaugaauccuugguucuuguagaauuuaauucagaugggcaauguaggugacaacggaugcacuuucuucuugagacuaaguagaagaacgaaaauaggaaucaagauaagggauuagagaauacuaggggagaagguuacuuuagcaaaguuuuccucagugguauagccaucacuaaagagaagugagcaaggaagcucacagacgugacuaaggcuaugcaagaacucagauuggugacaugcagcaaggccaggugauagcucuugauagugaugagauuugagaaagaaaauuagaggugcuugaggagaaggggaagggguuggggaaggauugugggagggagugacugggacggggaggggacagugagugggauguaaagugaauaaaaaaauuaaguaaaaaaaaucaaucaaauguaaccuuuaaaaacguaaaaaaagauuuuauuuuaaucaugccagcagauuacuagaguuucaaaucuuauuuugaaauaacauuauacuuauauaaaauuuucaacauaaacuucucaauacgguucuucccacuguguuaacauauugcaucaucuuuauucgaacugcuuuuuucaagauaaauguugaguaccuucaggagcacacuccacuaauacucugaagacccuugaggagcacgcguccuaagaccagcuagaagccacucuaguaguccagucgagugagagcuuugacagcugaaaauguaucucaguacuuuuuaaaugugucugagguggacucuuacugagaugcugagcagaguuuuccuggagcuagacuucucuugguuuucucucucucuuuuuuuuuuuggugugggggggggcuguuuugagacugguugauaagcccagguaaggcugcuagaauuauagaugugugccaccauaaaauaauaagaagguaauaacuauacuuuagcauuuauuuaauuguaauaagaaauugguauaucugcaguucaaaagugcugaacaccguaguaugcaguuacacaguugaugcuaucuuuucuuuuuuccugccucucugugucauucucccucccacccauuucuucucucucuccuuccuacuugacgacccuucuuccuucagucuuucuggcguucauucuuguauuggcuguugagcucagugacaugcacgugcuaggcaauuauucuaccaacaaguuauaucuauauccauaaagcugccugugaaacauguacuuugacauuacguguuuaaauuguucuaauucucuggcucaucagaauaggaaacugaauuaaaugauaguauacaagaaaaaaguauaggcauggacagggacuuucugaaagagacucaguaauuauaggaaauaaccugaaaaucccaaauuugauuucacaaaauuaaagagcagagugaagagacaagcugcaaaauggcagauaaucuuuggcagauauauuucauauggggauuaauauguaaagaauuucauuaagaagccauaaaaaaucuucugaucauuauuggguuaauuguuggcuuggauuuuuuaaaaucuacuuuaauaaggguucuuaaaugcuucaaccucccuucuagcccaccacccagagguggguggaaaagaaagguuaguaggaagugaaccuguuuagaaauaguucuuugggacgauuccaaucuuuguugucaggaguccaguccucuagcaaaacuccaacaccaaucagcaauggcaguccaguccaccacucacaaaucagcaaagcacuuugauccagaagaaacaacgaggcucugucagucggccugaguuugagaagcugcaagaagccaccagaauaucccaagaaauucucuacgaagucacaaaaaagaucagcaacguggugcaaggggaacagugccagagucuccucccacugucugaggaaucauagucuuucuacacaucacccauccuaucacgugucugcuucagcaaaucauucugucaccugugucugcuucagcaaaaccucaugugacauaacugagguuccaaagaagccagaaauuuccacuucacuuagugaacuaaacaguucucaaaaggaccacaaauaauuaguuuuuuaaguguucaacauuuuuagccauuagagaaauguaaacuaaaacuacuuugagaugccauuucaucuuagaagagcuacuggcaucaaaaaaacgauuugagaugcgaccuuaaccaugucaggauggcugucauuaagaaagcaaauuaauuaaguuugugagugcaauggcuguggacugcuccggacacugugccucagaacuucuccccacucucaugcuccugugaauacacggugugugugcaaagaaaaggcugaaagggcaggaaggaaagaaagggaaauaauggauuucuaaaaaggaaaccaaacccugagaagaagugcaggcaaggaugagagaaagcaaacccuguaacuuauuguugaugggagcgugagcugucuccgccacuguggaauacaguguggaaguuccucagaaugcuaauguagaauugccagaggcccagcucuacuccucgggcagauacacaguggucaccauguccuucuacagagaugcagcgcaccagucuucacucuugcaucauuuacaguagcagaaccaacaguaguggaaccaaccuagaugcccauucauaauugaaugaauguaaaaaauaauucauagaugcccauucauaauugaaugaaugaagguacaugcacacaguggaauuuuuaaguaacauuaaggaacaacaaaaucguguuagaaauuauagaacgcuucccgaguuugcauaucauucuuguucaggggccaugcuaaucucuguaucguuccauuuuagcauaugugcugccgaagugagcacgauaacuauacugaaagcuguagccauguuucuuauguuaaagauuagugaguuaguccugcuaaguguugguuccuucagucauuugccuuucuuagaacaaaacaaaaaguaggaaauacuaaauuucaauuccauuuaauuuugucuuucuaaaaaaaaugcuuguuaauugaaccaagcaagauuaaucaacaaaauauuucaguuuaaagaugcacaauuuccaugacuuaagguaugccuuauuuauuucaguuuuugcauaucuuauuuuaauguuaagaauaaaggcucuaagccagaaaauguaaacaguuauacaaauguuuugcuaaaauauuuucauauauuacaggaucaugcuuuaaaauuguugaguacaugguuuucagauaguaccucucuaauguucugcuguauagcaauagcaguaauuauuaccuaugcauauuuuaaauaaccucugaccuugaaccugucauuaaugguuuuuagguguaucauaaacuuugaaaaauacaguauaguucguuccuuguuuucuuuguaauuaaagccugagaauugugauauuugacaucucucaugcauaguuuuaugaagcuuagcuucacuaaaauguggaacauaagucuuacuguuagguagaaacugugugauccuuaugagauguuagaaauaaugccaaacacagugcauacuccucaaauauuugcuuacugcaaguacuaucagugguguuaggauuacuuagaaaauaauuugguuuugcuuauuugaagaaguggucuguagccuccauuauuagucuccugacauggaaugcauaguuucuagguguuggccacucucaguguuguccugugccaguuuauccaguugccuuggguaauuguauaaaugugucccaugugaugaugggcacauuagacuuacagacguuaagcuacucacccuuuuuguaugcacaguuggagagggacuuucuuuuuuuuuuuuuuuuuuuaauuuauuauauguaaguacacuguagcugucuucagaagacacaccagaagagggagucagaucuuauuacagaugguugugagccaccaugugguugcugggauuugaacucuggaccuucggaagagcagucgggugcucuuacccacugagccaucucaccagcccuggagagggacuuucuaaagacauuuuuuuucccaaauauguccucuggcagucugcguuaugauccuuuauuuaacacauuuggauuggauacuuaacuuguacuucagaauuguaaguacuggagagucuaacaccuugagucuucuacacuacacugucuguaguguaggagaugacagugacaagcuagacucgaaaacaguggcugccaucaggagcgaguuagucaaggaugguuccugaaaaugggguuaguauuuaagcugagugguuuaggauacugggauuuggauguaaguggugagauuuuccuaccccuguaggaaaccagagaaaucaugagcugugcauacaagauggcaguugguuugcucuguaggcuacggaugaauguaggggagauugagucuggaaaaguaaaggguccagauuguagagagcauuaaaaccucacucacucacugagaacuucuccuguagucacuguagcugauacagcaccuaggaauacuguuuugggaaaguuaagggggagauugagacuaaggggguauuauuauugacaagaggauagcaggcaagaauagaacacauuugagaagaaacugagaucucugaucuuggcugguacuaaguauuuaacuuugcaacauuuguuuuggauuuuguagguagugcauccuuuuauaaacauuacauucuugauauaugaaaugaagguuuguaaaagaucauuaguguuuacaaggguaugaugcaaacuaggauacugcggugggaaggaaagcaguguuaaugauuaccuuagugcuguugacauuaauuaggauuaagaagucacauagcaaccauaucauucucuccauauucuuuuguuuguuuguguuuugagaaucuauguagauuucacugucuuggaacuuuauauguagaccuggcuggccuugaacucacagagaucccucugccucuuugugcugagauuaaaggcagaugccaucauacuuuuucugucuuuuggggaggggaggaaaggaaggaagggaacaggguuuuucuguauaauagccuuggcugucuuggaacuugcuuuguagaacaggcuggucacaaaacucaugaucugccugucucugccugccgagugcuggauuaaaggggugcacauucacaccuggcacauaccuuaguuuuugagccuacuuuuuccucuuguauguuggaacucaaauuuauggaauuaaauaccagaaaagaaucaugaucagucagaaguguuuaauaaaguuauuaaacaagguuaagguauaauccgaggacaaggaaucaaguuauucaccugauaauucuggaauaguugugauuaaaaaugcagagaaacauggaauuuuuucaaacugcuauauuguacaaaauaguuaauuauucugagaggaagcugcacacugaaguugcccaucgcugcugcccauaccuuaacuccuacauuuauggggagaggugagacugcaguucucagcuuuccagacagauuccuucuucaaguguccuuacucagaggcacuuugggugcuaugccagauugcuugcuguuuucaguuugcuuuuccugaagaaucuucuccugcuguuaggcucacguuuguaaguguucugacuuaacagcucauuauagucacguauaggcaggcaucucuuucccaaugcucacauguaaguauauaugaccugaugacgaccucaaaauuguguggacucuggcagcauguuggggauuuuuaaaugcuuucuuguauuuucuaguguucucacauccagagugcuucucagacauuucaugaguauuuagaucaccugggcucuguuguuuaagacagagucuuauucagcaggccugaaguggcccagagaguccaccuuucuacugagguccuaacugauguucauuagaaaacaugaaggcuacuaggaucugggugguucccugggauccugggcacccuguuaaauaggcagcagaaaagacuagucuucagaaaugaugguaaucguugauuugauaagaaaaggcagugcuugucaggucaauaauuuuacugaacggaauaccuuuuuuucucacguuuccuucacucaugucuaaacucuagucucgcuuuguuucauuucuuuuuuguucuugugauuuucucuuuuguuugauaacuuauuguguucugugggucugaucaggaaccguuacuguauuuuauguuuguaucuacauuuuauuuugcaugcguaacguggcuuugccuggauguucuuuuugguaaguuccgaaucucucuagcauauuguuuuuuguaguguaagcuguuuuucaccuucuuuucucccacuucuagugaacauagucaugauuuguuuuuaaguuuuuugaaagaguucauuugauguauuuucuccucuaacauuuuucaguuuucugcuguagugcaguuugguacuaauccuccucggucuguuuauggccucccacucucagcugcugaucacauuaguagucgcuuucucaagugauuggguuugaaaaaaaccuuaaucauuuagaagucuaaaacuugugcuuucauauagcaaccauaugaaagauaguguacagugaaaccugauacugcucuucugucggaaaauaaacucuaauuuuauuuauuuauuuauuuauuacagcaacagcuggcacagcuacagaaagaaaaaucagagauucugaaaaaucuggcguuguauuacuuuacauuuguagauguuauggaauuuaagguaugcguuuaaauauguaaacuuuaagguuacaaguggaaagagaggcccauugguuaugcaaacuuuauaugccucaguacuggggaauggccagggccaagaagugggaguggaugggggagcgugugggggacuuuugggauagcauugagaauguaaaugaaauaaauaccuaauaaaaaaauaaauaaaaauaaauaaaaauugaaauauaauuugcuaauugcauaaauugcucuguggguuaugugguaaaagaauuucagaaccaaagucuaaaguauacuuuauccauuuguguuuucugaauuuaaaguucuuuauucaaugccgaagguguggcucggugauagacagaaugcuugcuuaagcaugcagaaacccuguuguaauuaaaccucagccuucucccgcuuaccuaagcuucucuuugcaggaccaugucugugacuugcugaauacuauugacguuugccaagucuucuuugauauugugaguaucauuuuugggaaaauuuccuaauucucuguuuacaaagaacucagggaaccaauuguuuuucuuagaguaagguuuaugaguagcaguauaaaguuuuagcauuguuuauuuggcuugcuggauaacuuuuuuuaaaguaaagcuauuggcauauaguuuuguguguuguaaaauagcuguuaauuucaguuuuuuaucuuaauauaccuaacuaaccacuggacaauauuuuccuguaaagucaacuugacagaguuuccuuuguaugacauuuuauagaugcaaaaggucaaugugaggaguguacccauuuacuuucaaugcuccgguuugcuuuggugagaugggugccagugcuuuuuuugguuuuguuccuuucagcucuuacagcuuaaauacaguagccaaagucccuuuccuuuuuucuguaauuccccccccccuuuguuuuuuguguuguuguuguuuuucaagacaggguuucucuguguggcucuggcuguccuggaacucacuuuguagaccaggcuggccucgaacucagaaaucugccugucucuaugucucccgagugcugggauuaaaggugugcgccacuaccgccuggcuguaauucccaaauuuuacagguuuagaaaaagaaauuagaaauccagaauuggggauaagcaaaauauguagacuuucaucuguuucagaguuuggcaggaaggaaauaaacuugauuuuuuuuuuuuuuuaagacugugaacuuugauuuaacaaagaacuacuuagacuugacuguaaccuauacaacauuaaugauacugcugucccggauugaagaacggaaggcaaucauuggacuauacaauuaugcacaugaaaugacccauggagcaagguaggcagacaucacacagaaugcuugugacguucucagagccuuacaacucauuugaauuugauguguguauuuuaagugaccgagaauauccacgccuuggucagaugauuguggacuaugaaaacccuuuaaaaaagaugauggaagaauuuguaccccauagcaagguaagaguuguuuuauuguuuguuguuugguuuuuuguuuucuucuggguuuucagagacaggguuucuuuguauagcccuggccguucuggaacuagcucuguaaaccagccuugagcccacagagauccaucugcacuugccuccugagugcugggauuaaaguccugcgccacugcugcccagcaggagcuguuuuuuagaugugcaacaguacacauaaggaauuguuuacccauagggaguuaaagagauaacuuaguuuuaggauaaaaauuauaauguguuaugaaaaacuguuuaucuguugaguuagcuguuucagguucacagucauacagagacucaggaauguauugauuuuaguuauuaaguugaauuauaguuauucaguugaguguaguauucagcgguaauaaaggguauagugcaguauucucagguuuaccaauguacucugaaauauuguauaauuuacuuaaacagcuuaauugucucucacuuuucuuuugggcuaaaaauagucuuaaaguagcaauuaucccaugugguuguuauaaaaauugaagcagucacuucaucaaaagaauuuagauacauaauauugcauuaagaauuuagauacaaaccagucagaggugguacacguagccuuuaauccuagcacuugggaggcagaggcaggagcucagcaguuaagugcacuaacuacuuauucugaggacccagguuugauucccagcacccacguggcagcucauaaccaccucuaacuccaguugcaagagauauagugaccuuuucuggcauucucagguacugcacacaugugauauacagauauacauugcaaaacccauauacaugcaauacauuucaaaaacuuuuuuuuuuguuuuuguuuuuuucgagauggggcuucucuguauaguccuggcugucuuggaacucacucuguagaccggcuggccucgaacucagaaauccgccugccucugccucccaagugcucaaaaauuuuuuuaaaaguuuauauacauaguauuucauccuaagacuuuagagucauaguguugaaucaguuuuagauguauuguaucuuacucucuugaugagaaaaagaugacaggaauuuuuuagaaguuauaugaaauguccuuuuaaaaagacacauugaaagauauuucuuaauaaauuugaugggaagaaaucauugugguaacuguccugcagcaagaccugucauagaucuuauccaacaucaucacaauaaauaaagagugaggaagaugacaaaguggugagucccuuggcaaaaguagugccaaaaccagagcaaaggaccagaguguuugagucuuggucgcuguucucuuuguuaacugaaccuucaaacaauaccauguuuauauuaugcuauaauuuuucuugguguucaagaauuuucccaauguuuucucucaugaaaaucugaagauacuuuuucaguuugguuucuuugcauacuguaugaaguagcuugaacauuucauaucugaaaaccaugggcuuaaaauauccaaagucuaaagcacuucccuuuugagcacuguccugacagcacauguggaaaauuccccugccucaugcucaggucgcugugagaacacagcuccccaaaacuguuauacaaaguuguggggagcguuugccgcuucucuggggcagugaggggagucugcuuggcaggcagagucaaggccugucagggccuguuggcagauuucucaccuugcugaggcauggaacgauaagaggagagaugcacuugaggcucaaggcaaggagcugaagaugcuguugacuuugguggaaggaacagggaauuuuuuugugagaaaaaaugucuuuguguguauuuuucuguuagcuguggcuuugcuucccacaguacugcaguauaagaaggcuaugagaaaugcacugguggcuggugugguacuggccugccgcccucccauacugucucuugcaucuuuuuucugccuuuccuauaaucauccacacucccaccucagaggacuguccgacucuguacuggcccggcuuggggugcaguucauaaagugccuccguagugagcauaaacuuacguguguaccuguuuugcuagucuucaggaaggagagucaagaucagaaguuugucaucuucagcuacauagugaggugaggccagcuugguauaugugagacccugcauacagcaucgaacuacaaggaaacccugucucuuaggagguggaagaguaggacuagccucccagauuauccucugacuucuguggcauuugucuguauucacacagaugaauuucuguacauauaaagcugccagaaaaaggaaggaaggaaggaaggaaaacagacagacaggcuaaggcaugugaucagaguccuuuuagcaagaaucauuagacauuuaagaguucagcacucuuucagaaauaaauaauaaacgaagauuccugaaguugcuacacauuuuaaccuuucaagaaauaacgaagccaggcgugauugcgcaccccuuaaaucccagcacucaggaggcagaggcaugcggauuucugaguucgaggccagccuggucuacagagugaguuuaaaaaaaaaaacaaaaaacaaacaaacaaaaaaaaaaaaaacgagcaccugcucagugcgggccgcugugcgagagguggcgaaggccguggagccgccauggugucggccacacugggcagcuugucgagcucugcgucccuggccauggccgagcuaugccagaacacccuggagaccuuucuggaggccuucaagcugcugcucaccuacaccgacaacauccugagaaagcccagugaugaaaaauacagauccauccauauugggaacacagccuuuucuacuagacuccugccugucagaggagcuguugaguauuuauuugaaaugggcuuugaagacggagaaacgcaucuuauuuuuccuaaaaaagcuucagugggacagcuacagaaauccgugaucagauugccauagagagaagcagcagguuggauggauccaguaagaagguggaauucauucucucagcacccugcggcugccaagcuuccucuggagcagccugagacccugcuggguuaaugcagccucaggagaccacacagggcggcugccaggccuacccucugcuccgcuccagugguugguggagauucagccaccuuagaaguccuucaguccaacauucagcaugugcagcucugaaaacccuguccuccaggagagagcagugacuuacaucccagucagugaacuaaagagaaaaucucaagaaaaguuaguuauucagagcuagaaagguagauaauugauuuagugcuaaguuugcuucauugcuagauaguagugccuuuagcuaugugugcacacuauaaauacauaacuuagaccuauauggguuuuuaagaagcauaacaauaauggacauauauuugcuuuuuuuaaaaaguauuuugugguaacaguaauauagaaaucuuucuauccuagccuuuuaaguauacaguucauucuauugaguacuuuucugcugcuacaugacccuuaugaccauccuuccuuuuguuauauaaaauggaaaaccuacucaaugaaugguuaugcccugcccuucgauaacuccaaaaggaaaaaaaaaaacaugucagguuggagagauggcucagugguuaggaacaucgccugcucuuccagaggacccagguuuaauccccggcaccgugccuguagcagcuaagaccuguaaguccaguccuaggugaucucacacccagcuuguagaucuucucaacucuauaagcaucaggcacacacauacauguauaugcagucaaaacacccauacgguaaauauauaguuuugcuuuuuuacaggcaguaacaugauuuccugaguguagcucuuguccaguaauaucagcuguaacuuuuauagaauuuaaaaccaaaggaacaguuguagaggagacuugugacccauuauagggaguaggguugaaaucagacaugcacagaccuuaaagcggaagucucagcaaaacagaagcacucuauucaacuuccuuucugcuuucuuagucucuuucagaugcgcuaauuucucuucagaugguguauccuagacggaaccuuucagcagaccaguggaggaaugcccaguugcugagucucaucagugcacccagcacaaugcuuaauccugcgcagucggacacuguauggcuccguuuuacuuuuauagucacuuaucacuuaaacaguguuaguccaguuuucuaguuaacauuagccuuucagguuuauuauaaaaugugcauaaaaauaaugcaggguuuaaauuuuuuucuuagcucucagaaauuggagguuaauauaagcaaccauuucuuugggggcugcugagguggcucaguagguagaggcacuugccaccaaaccugacagccagaguuugauuuccaagacccaggcaugauaaaaagaaagaggcacauauuguggcaugcaugucuauagaaauaaauguaauuuguaagaaacuguaaaaaaauugcuucuaucaugguacagaaauuugaaaauacaauuauaaagaaaaaaagcagaacuaugucaagucuuaccaguuagagaaagucauuguuacagucuguuagauuucucuuucaagugucuacauaauaauguaguuauuaugauuacagaaaaugcacacagaccauugguucacuugggcgggauacagagcaucuaggcacaggauucuguuuucacaugauuaaaauaaauuugaaaaaacuuaaacuccuuuuaugagcuugagaaauuuuugucauuugccagaagacaguuuggcugugguguuguucaaagaugguugaggguaugcaaaugugaaauacuacaacagcucauuguccucugcuggcuacaguuuaaguaauuauuaaauuuuuacccagugucucaaauuuccugugguauuugaacaagaauagaagaguaagaauucuuuggagcuucaaagaggcaaagugacuaaggaggaaauuaguaaagaguuuauguuaagcgcagauugucuucucuuuuuaagaugccuugugaauaucucuccuuggaugcaauggagaaauggaucaucuguaaguaaccgagcuagcuagggcugucucuuguguuuaagcuuuaaugagggaaugccuguuucugccuuagcucugcccuucacccugcaaugacaccugugugcuuuaccucagauauuccucauacagacccaucugacacaggcagagaaaugaggacucuaaaguuaggucacauagcucauuagugacagagagaccaaggaagagcuaaggccaaaacucaggagcacuuucaacacuaaauuucuccuuuuagucauauguuuuuaaugucacagguauuucguuaaguuuuaacuuaaacgugauaaaugacuuauuuuuuugguaguuugauagaugcaugagggaugaaauuacuguugugugcuuuaagcagcucacaaacuggaacaauauaugacguaauaaagaaugagaguugacguauaauauguagucagauuccuucuucccacugcgcacuaccagagagaagaauuuugaauaauuugugcuuuuuuucuugauguauugccuuuguaaacuuuuuauuauagcauggggguucucucaagcuuccuaauacugcaacccuuuaguauaguuccucguguugguguuggggugaauccuaacuauaaaauuauuugguugcuacuucauaucuguaauuuugcaacgguuauaaauaguaauguagggcuggugagauggcucaguggguaagaacacugacugcucuuccaaagguccugaguucaaaucccagcaaccacgugguggcucaaaaccauccguaaagagaucugacgcccucuucuggagugucugaagacagcuacaguguacuuacauauaauaaauaaauaaauaaaucuuuaaaaaaauaaauaguaauguaaauuucuaauaugcaggguaucuguuaugcuacccugugaaaggguuguuccacucccaugagaaccacuguuacaguguuucuccaacuauagcgaagaacuauuuuuuuaauaccugugauaugauacauuggugaaauagugaaugaaauuucuuaccagcaaaacaaguauuagacauaaaagcccagaauuuuguuauauauggcuuaaucuaaaaauuagauauuauuaaguuuguacuuaaaaugacuacagauuuugaauacuauaaacuuauauacaauaucucauuauagacugaaacugcaauaacacuaacaaauguggaaggaauuuaguaguacauucuaccuguacuuaggcauuuuagcuaauuuuguuacuucuuagauuugcaauaguaauauuuuuuucuaggaagauaguuuauauuucuaugcuuuugaaguauugauuuuugcuugauuauauaaugauuccuaguuuuuacuuucuguucauaucugugauugaagaauugaguugaauaguaagcauuguuagcugaguggacagcuguuuguuuuaguuaggauuucuauugcugucauaaaacaccacaacuaaaagcaacuugaggaaaagggauuauuucagcuuacauguccugauuaaagagggaagucuuggcaggaacugacucagagccggaugggugccuauggcuuguucagcuuguuuucuuauagcucccaggaccaccugcccagggguggcuccacccacagugggcuguaccaucccacuucaaucacuaagauaaccuacaggcuaacucacagcucugucuuauggagauauuuccucacuugagguucccaccuguacacgggcuguguaaaacugacauacaacuagccaguacuuuacaguccaguuuauuuuuuaaauggaaaugauuauuuugugaagcaggaaaaucucaacaaaaguugaaacuuaguguguauguugcaacuacuacugaguaaauguugagugaaugaacaaugagguucucugucuugguguagaaggcuggagaaggcauuuacaagcauagugguauuauacauuuggauaggguuuccaaauagggaaacaaauguauauagggagcuaaauacauugcaagaauauugaauuucaauauuuggaugcuuccuuucuuucuuuuuuuuuuuuuuuuuuuugaaacagucuccuggccuagccuuggcuaaccugggacucaugcagaccaggcuggauuugaacucacugccugccugccugccuuuguuacucuaguaguacugagcuuucacucccucaccuguaaaagaaugacacucucuugucuacugugcagguuaaucaugugagguaauaugugugcaaagauuaauaagggagaagcagcugagacaagcaaagcuguuaccuuagcauuucuccuggcgacgagaaaaguugauugcuuuuauuuuucaguuacuuuaacagcaguaaugauuacuguauuggguguuaauuuuugaucuuuugcuuaaacuaauguuuuuaaugcuucauuaaaaaaauaucauuuguaacuccaccccucaaaaagguauuuuuguuccuuuaguguggcuucaaagaacuuacuuugcagaauauagaaaaucauaauaaaaguuuaaaguauuguuugcacacacacauacacgugccuguauguauguauguauuacauuaugaaucacuagcgaaugaaccuccagugauggagguuguugcccauuguagaaagcuacaguguaaccaaaggaacuugucugugcaguacuuguaacuuguccuuguuucucuuuguuugaaguuggcuuuauucugugccaugggaugcuaaauacggaggcuaccgcacugaaccuuuggaagcuagcucuucagaguagcucuugccucucucucuuucgggaugaaguuuuccacauucacaaagcugcagaagacuuauuuguaaacauucggggguaugguguuuucagauuuguucauuuuggggggaggagguggugaaugaaaugucuuuaguagcauagguuuugggguuagagaguugaucacauuguacaggaaaguuuggccuagacugucuuacuuuggucccagcaauuugcuuuuaacaauauccugauaauaguagaaauaauauucuuuuuuuguuuguuuguuuguuuugguuuugguuuuuucgagacaggguuucucuguguagcccuggcuguccuagaacucacuuuguagaccaggcuggccuccaacucagaaauccgccugccucugccucccgagugcugggacuaaagguaugcgcccagcuagaaauaauauucuuauagauaacuuuacuaauuacaaauauuuacaguuucucaccuuuuugaaauugguauucuagagaaauacgucuucuuuuuauucagacuuaauuuuauucauaaauauugcuaaaaguaaaauauagaguguauuacccagcaugguggcuuauaccuuuaaucccaacacucaguggacagaggcagguacgucucugaccuugaggcuaguuuggucuacagaguggguuccaagucaggcaggguuucacagaaaaccuugucuugccccauuccugccgcaaaaaaagagaacagaguggauuuauaaaagcauuugaaacaaucccagaugucauugaaucgugccuaacagucacagaagccugaucauagcccugagggaucaugguucucgagagcagauuacacccaaaggacguagagucacucagucucugcaaagcgaauacuuuucucauuuguggcuaucuuucuuuaauaaugacauuucucuugaggcccuguagccucuaugugaaaagccacauugaguucacauguaagagcagucauacgaucuuuugaacugaagagcagauaaaauacccuguagcuacaugugcuggauauaguaauuuuaaaaaaagagaaauuuguauauauuucauguccaauuuaguauugcaugaaguugagacaaaaaugaagcauuuauugguugcuaaaaaauaacaaugugguugaguaguggccuuuuuuaguucuaguacucaggaggcagaagcaggcgaguuucugugaguucaaggccagccuggccaacagaggaaguuucaagacaacuaggggacauagagaaucccugucuccaaacaaauaaacagaaaaagccaaacaaacaaagggggaaagaaaaguguguguaacacugacaguuugaggcagcauguauuucaguggucauugaauuacccugaaaugcaaacugaacacagguucucuggcaucacuguuuaaaguagaaaaaaauaguaguuuguucuguguacccugagcgcuuuguuguuuacauuuccaaacauaaaaauaaggucuuagggguaugguucagugaccuugucugugaaucuccugaguggucaucaccuaggucaggguaggaugucugucuucacagaugagccucggaggccuugggcaccacugcucguucuauuguuaccccugagcagccacuguucucacuucugucaccauauacucaucaggaaaacaguugccuuucugcuuuuauuguguugagauuguaaacgauaacauuuguauuacaucuuaauauguuaaccacuacuuuuuacaaucucuuaaauauauggauauuuuaaacuagugcauuagugaggguuuucauugcugugaacagacacuaugaccaaggcaacucuuacaaagcacaacaauuauguggggcuggcucacaguguaagagguucaguccccuaccaucacggugggagcauggcagccugcaggcugacacagugcuggaggagcaucuugauguaaaggcgucagaaggagaccgucuggacuuucacacuggguagagcuugagcacaggaagacucaaagcccaccuacauagugacucacuuuuuccaagaaggccacaccuacuccaauaaggccauacuuccuaaugccgccacucccuauaaaucuuauuuaaaccaccauaaccaguuaguguguuuauauucagugaacuuauguaugauguaagucuagugauaccacaaaacgaguuaucuuuauucuguuuaaaaauaacaguugcauuuuauuuuuauuuuaugugaaugaauguucugcaugcaugucucucugcacugugugcaugcuugugcucaagcaaaccagaagaagguacugcacucucuagaacuagaguuaaggagaguugcuuaguuguuagcugccauguggguguuggaaaccaaacccaguucucuucaagaauagcaacuacucugaauugcugaaacauuucuccauccugguccuaaguguuguuuggccccacccucuccucagccugcuugguuccuuccuuucuuuuuccuuuuugaguuaucagucacauuaaaaaaggucacaucauagucaaguuaggaguaugagaguguauuaauugcaagggccuauauuacauguucuagacagucucucaaauuaaaaaguguuuauacauagaaauugggauucauuuugguguaaauggcucagcuaaguugucaaggauauguuuuucccccuguuacaaauauugaguucuuaucauuaguuuucaugaaauuauauguuauuucuuuauuuauugacauguuuguuuuagugguacaucugaacuaguuaacauuggaguucuguuucuuuuacuuuuuauuagaaggugcuuuuguauauauguauguguguguauauauacguacauauauauauauauacacacaaauauauauauauacauauauacacacacauggauagaugaaagauauauauguagagauguuugucauacauauacacauauauaguaccuaguauguaagaauaaaccacaguucucucucuaaccugagugcuuuccugccuuagcuuucuguguuauggaagcccugcacucagucgcacugcugguuucucaugcacacccuuguagaguuugccuguguuacgagugaccuggcuaguaucagaagcaaucauucuugaauacuuuggugcuuggaaaugacuuaauugcaucaaaggaaauuuuaaaaauaucuagagcuuaagaaaauaauaaagucuaauuaaaguuugcauuaugaaguuucauuuuauuuuuggauuuacuguaacugauauuguucuaggaagauuugcauugaguaucggaaguacuagaaaauacauuugagauagacaucacccaucauuuccucuguaaaccauuguuauugaugaaaauaaggauuucaagugacuuuuauuauuucgcuuauucuuuuugucuuuccuuucaaauuaaguuuaacaagcuuuauuuauuuuuuuuuuuuugcgcacagcuacaauaaacguauuaacgacauaagagaaugcaaggaggcggcuguaucccacgcgugaguacuuguauuugugaggaacuucuucaaacuuuacuuuguuaaugacguagaaguguacgagaugagaacuuugaauugaaagaaaaguaaguguaauaaaaucaagaaguguaauaaaaucaagaaguuccacugaaagggcucuaguuauuaucuguguaaagaacguugugcgugugcuugguuagagugggcauggaugugugccgugcuugcagcacaguacauagguuguguucagaggaggaaaucugggggaagcugauucuggccguccaccgcauggguucuggggaucacacucagguggucuguaugaaugcaggcacuaugauuagcugucucugugggcccuagcuggccacuccuccugccugccacuguguuccccauagcagugcuuucugcacguugugcugacugcuguauaaccucauggacauuguuacauucuuacccugaugccgacaaugugagaauauaacauucuuucaaaagcauguuagcuccaugucuuucuccaauuucauauucuuaaaugagugaauauauuagaaauuagugguuuugagaccuauacccaauuuaccaacuuucucaugaaauaauuaaauauaucaauuuagugguuauauggaugauuauuuauccucccaugaacuuauauaagaggaaauggugauacugccuaacccaucaguguuucuucaaggcagagaagauagguaccauuuccauagacagcaaaucgcaaguuggaaaugcucauucuugguccguuaccacucccugcaccuacacugucuacccaagugaagcacaggugacacgcugauaucuuucccuacagcggcucaaugcacagagaaagacgcaaguuuuuacggucugcacuaaaagaacuggccacuguccucucugaccagccuggccugcuuggucccaagguaacugagugauaguuguacccuauccgcccuguaaagcauguuuucuguaugaaauuugcccaaagugguagccaagaaugcauuugcuggcuugaggcucgcaucacacuucugucuuuccuuaguucuuacguguguguucaucuuuaugugaacugcugugugcugucuugaucugaguggcucuuuuacauuugguguuaauucuuugucagggacuuuucacauagagcaaguuuucaguuguugaguaaugaguuuuguugauuuguuuucaauaggcacuuuuuguuuucauggcguuaucuuuugcccgugaugaaauuaucuggcugcuccgucacgcggacaacaugccaaagaagagugcagaugacuuuauagauaaguaagugucacauuggagcaccguccauuuccugcuuauuuugguugaugggucaugagucugagaacauguauuaaagcaaagguguuuuaaaaacucuuugggguucuuuauauuuauaauggaauacaucugggcaauauagccuuaaugauguaauuagagugcaaaaucucuaggacuuaauauuucuaauaucauagugauaagaaaguuguucuuuggcucugcccaauaauauuuucuaugcauuugguccucaaaauuauuucuacaugaaacauuaaguaaaaaucauuaauggucucauugucaucaguguaucauuugaaauaucuucucuuagucaaugguuucuuauucagaguuagauaguuaaaaauagaaauaagcacaaacugaaaauauuauuucuuguuauuauucucugaccaauuuuuaaaaaaauauauauauaugagaaguaaaaaucauacuuucauuugaauauucuacaacuauuucuaugauuuuauugcuauaaaagaauuuuaaaaggaaguaauugacauuaaaaauuaauggccuugggcuggagaaaugacucagcaguuaagagcacugacuguucuuccaaagguccugaguuccaauucccagcaaccacauaguggcucacagcaaucuguaaugggcucugaugcccucuucuggugugucugaagacagcuacaguauauucauauaaauaaaauaaauaaaccuuuuuuuaaaaaaaaaaguaagaaaagagacaaaaguagguugccugggugugguauucuacacauauacucccaguuuguguaauucucagcacuuaagaggacugucuggaguuugaggccagccuggacuacauggugaaggcuacacagcaaagacaauucuccccccuaagcccccccccaaaaaaauuaauggccuuucuuaggggaaaaguuuuagaaauaauaccaaaaacuaguauuuucugugauaacaguguguagcugucuuugacuacuuuauggauucuuuguucuuccacucuucucuauauuuuuucccaccuuuucaacacccuaacacuagauaggagagaaaaagaauagaaaggaaagggggcgacauuauuguuagaguacuuccugcugauuaugguguugaguugcuugggacaaauuugauuuucucugucaggauaucuaauucuaauuauuucuucuucuucuucuccuucuccuucuccuucuccuucuccuucuccuucuccuucuccuucuccuucuccuuccuccuccuccucuucuaccucuucuuccuccuccuccuucucuuccucuucuuucuuaguuucuugugaggguuuuccucccauuuuuuuaauuguuuuauuuauuuacauuucaaauguucccccuucucaguacccccccccauauuucuucacaaccacacccucuccccaccccgcccaggcaucugaugucccuagaacaucaauugucuacaggauuagacacauucuucucccaauuugugugacaacguaaugaauuaugaccaacagcaaacaaccaacagccccacccuucuugguaugcuagcauuuagauauccucugaaaauuccccagaauuccagacaucacauaguuguagaagguaucugcaguuggcacugucagacccuuacuagagcacaaggcaaaucauagucaccugcuguggacaaucugaagcagccuuaaaucccauaccuaggauuaaaaugaaaacauauucuuaaaguauuucucucucucuuuuuuuuaaagaaaccaaaauucucacuacagcaaugaacuuauuaucugaaacguuucuuuugacuuuucacaaaggcacauugcugagcuaauauuuuacauggaagagcuuagagcacaugucaggaaguaugggccugucaugcagagguacuacgugcaauaccucucuggcuuugaugcuguuguccucaaugaacuugugcagguaagaagucuccuaaucuucuuuauucuucgcuuacugcuuguugaguaauugauuuauaaacuacaaucauguaccaaaugauguaaauagaaaucagcuguggucccagcucccaaagagaucucugucuacaagugaagacacaggcacuuacguaguugguauuucauaugaguuuguacaacuugagaauagacgugauaaagacuucaguuccucauuuccagggugaauaggugugcugaccagauucuagagggccuugcaaaagagccuaguuauaagucaggacuuggaaaagucuugguggccuaguauggaugaaccauugguacaggccaaggagaagcagagcagaaagaagaauugcugcaguaugcuagguggauacugaugaaagccugagcuugcacaguggcuggguagcaguggcugaguugacaggcagucuagugggugauuauuagacugaauaacaacaaggacgagauggccagcagaugaacaaucccaucugaaccuuaacucaaguguccuaguuuugucuuuuucacuguaacacaaauuuucuuuaguuuuauugcagguaaacuguaauuaaaaauaguuuuuuauuuugucuuacucuauaaacucacaggugccuaaaaguacuauaaacuaaugaacaguacagauaaaggagugauaaaauucucuuuaaaaaaagcucugguuuuccuggacuuauuauuuauuuuauccacuagauggcgcuuagacaccuuuuuaaaaaccauuauuauuauuaaagagugguuauuaaaaaugaccagaacauccuaaauuucauuuacagcuguucacuagaugcacuuuagccuaucguuacuaugucuuauguauuuauauagcguauaauuuuaaaacaaacucagacuugcugguuucauguaaguuuugaaacuauguuguagcucuuuggauauuuacuaagaaacuuuaaaugauuuuugauguauuacuagaauguucaagccacuaaaauauuggagugcuuuauauaaaauagaguguacuaauacugggaaaguucauaguauuucuucugggacuauaguaagauuaguagcaauagcaagaauaauguuaaaguugauguccccaaugauaauauaucuuaauaaguugauauaguucugaggguagauaaaguaaucauuguugaagaaaagcacuuaauagaaauugauugguaucucauaaggaacagagccaguguucagacuucagucuuagcaggaaagacagcguuuuacuuccuuccucuuucuggaucuaguuacggugcuuuuaacugguugcuagggugugaauauaaaaguaaguuuacaaaccucuuaaugaaguuucugguuauaaauguaacuuuuguguuguauuaauguuuaaagaacaaaauuaaacauuuuggaugcuuuuuagugcauuacuuaaagauaaguacauauguguugcuguguaagucuugguguuuucaaacuauauuuuauauacauuguuuauaagcuaagcaucuaccuuuauuuacuuuuuuuaacuuuuaaaaauuuuuucuauacuguguguguaaggaugccuugguuacguguuugucaguguacuguguacagacuucaguguccacagccgcuaagagagggcauuggauugcccugcaccugaguuacagucgagcaucaccaugugggugcuaggguucccaucccagaagagcagccagugcuguugaccaccgagcuagcuccagccccauaugugccuuuuuguuuuuaauguccacuuuagcuucagauuuuuuaaacucaauuuuugauuuugccuuugaagugcuauggauugaaguaagggccugucaccugcagaccgagagcucugcugcuaaaugccaccccaaguucuccugguuucauuucuuaaccagauaaagaguuugggaauuuuacuguuuuauuguggcccuacuacauugaacaugcuuagucccaucugaaagcuuggcuugggucuuuuucucuuugguuuuuuuuuuuuuuuuuuuuuuuuguauuuuauuuugcuguagguugggguuuuuugggggguggggguccuguuuuugaggcaauuuuuuacauauauacauaaaauaaucuguguuccccaguuuugaugcagugcauauucauguaccacagcacauuugacacagaacauuuccagcaucuuucugugcaucuucaugguagguuucucauagcuguccuuaacagugaugucuugucacugcaguucuagcugcccagaacuucuuuucaugaauauggaaucauacuuugucaucuuuuaguuuuauuuuuucuuuuacauagugcugcugagauuuauuuugguacagagcaacauuuaauuccuuuuucuuccugaaaaauaauugugcaguguugaugcaugagucuaugugcccgugugccgacagagcugcgagcugucucacugggugacuuucacguuacuuuguucucagaaccugucuguuugcccugaggaugaaucgaucaucauguccucuuuugugaacaccaugaccucccuaagugugaagcaagguaagcagccuggugucugucaacaguuagcuuuuauaaaaguggucuuucaguuuugguuauauuuuuaucuguuaccuuugucuuaauuuaguucugucagaggaaaguuuuccaaauuggauuucagaugguguucauaaaaauguguaaggugagcaggaguccuaagcauuguguguggcuguggcccacaugggacagcagugugcuguuaggaauagcauguugaucugaagccacagguggugggaaccuucagugccagcacuggggaggcugaagccggccagcuugcucuacauaguguguuccagugaagcccugagcacaaagccaagggauagcacuaauuuaaagucuguacccgucaccuuauauauacuguccuguuuaauccacaacauucagaaaacagcuacugcuuuuguuugucagauuugggaacuauagauuucccuaagggguuugacaguuaacauuucaaucauuuguaacuaagaacaguuauuucaaguuagauaugccaauucaaaaaucagugcugugccugcaccagcuggcccugccuugaaccuucucuuccaauagcuugauacauuuuaguuuuuauucucuauaaaaauauaucaaaaauccugaaaagaugagguugaucaguauauauuuuaguucugucaagcuuacugcuuaguauauaggaaggugacugcuacagcauuguguaguaaugcuugguuuguguggcauugugcgacucuagcauucuaacagucuacacugcucuccuacguugucacuguaaacacaugaagacuaggagcucuucaaaggaaguugcugucucuuggcccagcugccuacuuuccaggauuugagaaguguugcaggcuuagcgcucacauuaaauuuuguugcuuuuauuuuuuuuauguagaaaauucacucagcauaagccauccuaacuaauuuuuaauguguuagguauauucaguaucgaagcaccagucgucagagauuguuuugauuagaaaauugaagcuuuggugcuuaggcuccacucuccacuucugcagccuaugacaacaccacucuacauagugguuuuguaaauuugcuccaaaaccuuuauuagugaggguaguuguaucuuugugacugacuggcugcuuuuuuuuucuuuugaggggggguugguaucuucuuuguccuccaacucuuuacauaauccuucuaccucagcccccccccccccaauuagauaggaauuaggcauaagccacugugccuggcucugacucauuggauacaaugccacaguguccagcaauauguagaauuuccuuccuauuuaaggcuaauuuucuuuuguaauuauugugacauuuauuaaagggcuuauuuuucaucaaacauguaagucccuuucuuuugggguauuuugaaccacucugguaugacaagggguguguaaauagcacuuuuucuuuucaguuguaugcccagaaauugaacggucucaucuguuuuuacuguguuuauuuugguuucguuauuuucgauauggcccuuacuagguagucuggcuguccuagaacuuacuguguagaccaggcuggccucgaacucaaagauucugccuguaucuaccucccacuugcugggauuaaaguccugcaccagcugucuuagcucuuaaaguagaaaauauaauuaaugaauuauaaaaucauuaauuuguuuugucccccuuuuuuucuguuauugcaguugaagauggagaaguguuugauuucagagggaugagauuagauugguuuagguuacagguaagaauaacuugauuuguguuguucuuuuuuuuauacauuauaguuuuguaacuuuaugaauuaacccacugaaaagauaucuugugugcuaaaccacaaacaugaagcguuuuguaaacuauuaaaccuauauaaauauauuucuagcaagccaauagguuuuuaauaaaauagguuaugauuuuauaauaucuauauauuuauaucccuaguucucuugauuauccugauucauauauguaaauuuaauuugaaagcauaaaaguuuuauuuuuuuaauaaagcauauuuguaauauagcugugaacuaaaaaaaaaaagccauuugguaaaaacuugaguuuguaugcuaugcagugcuugguauaaaucauacuuccauuauaauaccagagcaacuguagacaauauguaaacaguugugauauauuucaaugaaacuuuauuuauaaaaauacgcaacuagggucugaagauggcucagcaguuaagagcacuggcugcucuuccagagggccuagguuuaauucccagcacccauauggcagcucacaacuguuguaacuccugucccaagggauccuacacccucacacaaauauacaugcaaucaaaaccaccaauaaauaaauuaaaauaaauaaauuacuaaaaauauacuaagcaauugaucuguacuuucuggcaccugacccauuaacccaaacuuauuucuaaacuauagaacuauauaguuuuagacuucaguaaugucauuucauauguauuuuuugauuauuaaaaagaaaaucaaaccuggacugaagacaugucucagcaguuaaaagcacugacugcucuuccagagguccugaguucaauucccagcaaccacauaguggcucacaaccaucuguaaugggcucugaugcccucuucuggugugucugcagacagcuacaguguacucauauacauaaaauaaauuuuuaaaaauccuaauuaucuuuguguauacuauaaauggucuuuauuguuaagcaaagagaagagggaguuacccuguuggagaguuuuaucaucuaacuauggagacaaggcccagcgaaccugaguucgagucccagcauccacacgacggcucacagcugucuguaacacugguucuagauuuguugcccuccucugccucugggcacugugcauacaaaugaugcauagacagauagguagggaauaccuguacauaauuaauagauaaaagauaaaugaggguuuuuuuguugcuuuuuaaaaaggauugaauuaagagaugccacagaucugacuguuaguuaaugauaccauugaaagugaaaagcucacguagaacuuguagaacuagaugguuuacaaaguuugaaagaugugugggauuugcauacaacgguagcuuguuuggguaaugaacaaaacugaguucaguuuucuuguaagaaggaaauaagauggcaggacuccaucacucacagcugacuccggccgaggguucuacccaaagcacguguugcagcggagcaaaggcaucaggauuagcuuuuggagaauuuuaaguugugugcuuuguccucacuuggguuugagucuaggauuuuuguuuguuuauuuuuaauuuuuuuuuucguuuuccuguuuacuuugggacuucuuuaugucugcauuauuagucauuguccuuuuccaaaggaucacauucccuuaucacuuuagacacuuaggcaucuucagucuuuuccaaauguggcccucucggcuuucuucuuaucuguuuggauugauccuuuccuaagcgcgguuugggagcacacuaaugcuugcauugugucaguaauaucgggagcuuguuuucagccagugcaguugcugcuacuccugagucuguuuccacaaugcuacuuagauucugagaaucaguuaaugaaaaugcuuguuaaaggcauggccucaauggguuccucuuuacaauagauaaauaaaagcagauaauacaguuagauuuguuuuguuuuucugauguauuuuucaucacuuucugacuuguuccuauagggacugguaaugccaucuaccugaaggcuucuugccacuguaagauuagagguuuaguuuuuaaucuugcuuauaaaacauaaguuaguuucuugucauuccaugggugacagggcauggagaguuccaagagaccagugacuugcacguccgcgacuccugcaagagcaugcugaggccuggcagacgacggaugccgugugugccgugggcaugcucugcagcugagagagcuugggcuucaggaacuugcuagucucucaacagcacacgcgcuucucaguguuuuauguaaauuucccuuacuucuccagugugacugcucuccaugcaaccccaauaaguagccaugggauugaguagucuggguugugcaucuuuuucauaucuaaaauguuggaguuacugagacccacaaaaagugccuccuaaugggcagaacugucauagcagcuggaauucuguugcccaucacaucuggucaugucccacaguuaaucauuugaguaaucaucacuguagaccaagccaucauaagcugucugacauguugccagcauggcugucugauaggcuucugccacuuuuugcuuucugguuauguccaccuuuccuauuccucccacguucagccaacuuucuucaauaugaacuggccguuacacaaagcccucggugguucaccacuucucuuccuuuguuugcacucaaauccuggucacugugaucaaguguuuaucuguaagcacuguguucucuccuucuuaaguguccauuguucauguccaggguucugguuuugauuugauaauccuacuuauggaguuucuuucuucacagccugcuugagaguuuuaguuaagucuuaacuuucuuuguaugacccauuuuaauuuacuucuugcauguguuuguagaaguuaucaaauuaguauagucuguuauuuuauccaguuauguguauguguguagauguuucuggacagggcacacauauggagggcaggaaaaaucucuugggagucaguuuuuucuuccaccauguggguugaagggaucgauugaacuaggucauuuggucaacuagaaacaagcccaccugcuaaggcaguguaccagcuccuacugugaacaauuguagaaaaugaugcuuugauacagcaguaaagcuuaaauguuuuucaguaauggacauuuuuccucuguacaaagacaagcguugagucauuagcaguuccuaacugcuguuauuuguuguugaacugcuacaggcguacacuagcgucuccaaagcuucacuuagccuugcagaucacagagaacuuggaaagaugaugaacacaaucauauuccauacaaaaaugguagauuccuugguugaaauguugguggaaacauccgaucucuccauauuuugguauguugaaauuuuccuuaagucuaaacuggaaauguuuuauuaugaagcugcuugauuguuuuuuguuaguagcuaucucaagauagcucaguaucagguucuuaaccauaaguggaacaauagacuuuuauaaaauuuguaacaagcugggugcacuuuuaauccuaguacuugggaggcagagacaggugaacaucugaguuccaggccagccuggucuacugaguucuaggacagccggggcugcacagagaaacuguaagaaaaagaagcuugcagaauugagauuuuuaugucaaggagagcaaauauggaaauugauagcugguaaccaugccuccaguguuagacacuugugucacagugaugugcuggcugcuccuugcacuguuguaagcacagccgcuccacacuucgcacuaccauucacuuuucucccguuacccucuccagaaaacuuacuucuuaaagaaagguuauguugucauuuccuuuuugucuaccauacuaaauauuuaauguuagaacgaaugacggaucgaggacagacccauaaacaaagccgcaccacaguucagacuggagugcuuucacucuguagcugugugguaguaauuugguucccugcuucuuggccuuguagagggguaaacugacuccguaugucuuggcacuucuaaagugcugagauagcucugacuggauagugguaacggugucuagggauccauagagaagaucuuagcgcucugucaggaaagcguuuauuacuugugcuggagacaaaaucaccaggagcgaaggccugcuucucagagaaauacagcaguccagucacuuuuugggugagauuuugacuguguguugaauguguaagaguuugaagauuauuuggaccccuuuguuacugucucaaagccuguccuagaaagagggugaacacuauuuguuugcauucuuuuuuagcucuaaaaggguucuuauuguaaaagaauacaacuauaaacuucuuucugguuccuuagagauaaaagcauuuuguauaauguuuaaauugucauauuugcuuaacuuauucauauuuuaaaaaucgaugacaugauuauuuaguugguaauauuuuucucagugauacuuaaauaauagguaguccuuauaauugauaauuccuuaacccaugauaaaauuugaagauaagaguuuugaaugucauguauucauauucuguacauaucacauauuaccuguuuaaguuuuuauuuaaagugucuugauauuauacaaagaguauuauucugaaugaauuauugacaugugaaaggucauuuugagggggaaaugacuguucuuaagggaauaagugugaucaguggauaaccuuuauucacuuggguuaagagaauuaaccggccaucgggugcuguaucacuuguuugcgugugagcuaggaguguggcgguuagacuguuuucugucuuuccugacaguuuuuacagccgugcuuuugagaagauguuucagcagugcuuggagcugcccucucagucaagauacuccauugccuuuccucugcucugcacucacuucaugagcugcacacaugaacuguguccugaagagguaacugcacccgccaugggccucauguggugaagcucgaccagauggguagcuagccaaauguuuaugacgacauaguuacuuaguuuuucuccuuaccuaaaccaucuuuguauagaaucagagaaauucuuaaauaaauacaugauaaaacaaugaucgguaagauguaugauagaggcaaguaggaauauaugugagugcauagauaugaacauguaacagucauuugucuuuuaaaauaacugauaugcuugguauuacuauuuauagauuuauucauauagauuuguagauuuauucauauauauauuaauuaaauuucuauacuuuucauuguaagacugaaaggacuugcaaauugaauuauggagaacugaccuguaauaucauggauauguuaggcagagcccagguuuucugacguuuguggaacagauauaaaccuauaguugcugaggacaacuaaucaguaguuuggagaucuuaaguaucuauaaaaaauguacuguguaucaaaagggauaaaguucuagcuuggaaaaguaaguuucaaugaucuguuacacugcaugcugacacaguuacuaauaaagagcugggcauagugguguucccagcacucaggaggcuguggcaggaagauggcaaguucaaggccagccugagcuacucaagagaccaucucagaaaauaguaauaauaaugaauauuuuaaguagcuaagaugaauagauuuuuaauguuuuuacuacagaaaucaaguugguaagugauuagaucuuucuguaguaugcacacagaucauaauguccacaguguggcagagugcuugcuggguguacaggcccugggcuuauccccagaauaaaaggaaacuauagggggcuggagagauggcucagcgguuaagagcacugacucuuuuuccagagguccugaguucaauucucagcaaccacaugguggcucacaaccaucuguaauaggaucugaugcccucugcugguguguccaaggagaaccacaguguacucaaauacauaaaauaaauaaaucuuuaaguuaaaaaaaggaaucuaugaaaacaugaagcaucaaauuguauccccaauagauguaguuaucauuugacaaccagugaggaaauaaaauggaaagaugugucucuggucuugaaaaaauuauuuuauaaguauggcaagacuauacauuaaaaauugaguacuguauuuuuuuguaacuuaguguuuacucucuuuucucaaaacugcagaauauguugaaaagaaaccugagguagcauaucucuagcuugugagucuucuuugagaagaggacuuugagagagaugaggucagaggaagccuuaggaagcugaaaggaagacuugugugacaugucaagacacaguugagccuggugacccucgccuguuauccuuucuacuucagaggcggaggcaagaggauugauuacaugguuaaaggccaggcuagacaacauacugagagcugucuccaaauuuaaaaaaaggcagaagaagguuggcgauugccguuuauuguagaaugcuugcacaguuaaaugugcauggcucuggguucaguccacugugcaugcucccuccuacccaauccucugaguugccuccccacauacacauaagauugaccaauauuucaguaugucuagcuacaguguuuggauuccuauuacaauuuacaugucauuugaaauuaaauucaagguuuacagauucaggaaagauugccuugugggucagauaugucuuuguucuauaccuuuauuucaacaacauagagacuuucuguaugguacacggaugaaagacagagaaggaaauuguuucuucuuuucauguauuguggagaauuuauggcuucauauacagaauauucuaguuauuuuugacaaaaauccaccaccagacagcuacaaaccaccaaaauuaaacaccaacucauguggaaauaaauagguuguauauuacauauauauauauguauauauauauacauacaggaauauuaauaauauccugaaaugaggcacaccauccccacucuugccaaacucaaagaaugcauguucaguuuugccuuuucccaucccuaggaagcuguaagauaauuucagaaauuuuaaauaucuucuuuauuuuuccaacuugauuucuaauacuuuuuuauuuauguauuugaguucuuauguguuuacuacagaacuauguauuagauguaaauauuaaagugauuuaggauuagaaaacucuaacauaaauuugcacguguacaucauguaccuuauuuuuaaauguugaaaaacuagauuuagaacauggugaauuugagccgggcagugguggcacaugccuuuaaucccagcacuugggaggcagaggcaggcgaauuucuuuguuugaggccaaaaccaaaaaaaaaaaaagaacauggugaauugaaugaugaaauauauaguuuauuaucuuccuuuuuguaauagcaucugagucuugugauucuucugccuuaguuuccccagugcugggauuacaaaugagugcuaccauaccuggcugaauacaguuuuaugcuuuauaaauagagauuuuagaagauuguucuuaaaucauaauuuucuuacauuguuaccaaguauauauuuuauaugaacacauauaguuuaauuugaguuguagagaaagcaacacacaucuacuuccccagcccuuauagcagaauaggacuuucccugaauuuucauguuuguguaaaguguuuuguugagaucauguccuugugaccuguguuacuucugucuucugcccaccagcgccaucauauaggagaucguagccuuucccugugcaauauguuccuggaugagauggccaaacaagcucgaaaucucaucaccgauauuugcacagaacaguguacucuuagugaccagguaauauuuuaaguuuuucaauuauuucuucugucaguguuaaaauuaaccuuagaaaaacaucuauagcucugccaggcggugguggugcacacaccuuuaaucccgacacuugggaggcaggggcaggcagaucucugugaguuugaagacaguuuagucuacacagagaaauccuaucuuggaaaaaagaaaagaaaaaaagaaagaaaacaucugugucuccaucuguaaaaccugcccguuucccagauugcuugcaauauaaaacuuucacucuggcuucacucucagaacccccuuaacagcaaaaacuacuguguuuuuuuuuuuuuuuuuuuaagauuaauuaauuuauuuuauguguaugaguacacuguagcugucuucagacucaccagaagagggcaucagaucccauuacagaugguugugagccaccaugugguugcugggaauugaacucaggaccucuggaagagcagucagugcucuuaaccucugagccaucucuccagccccaaacuauucacugucuacucuaugcucuauuuuacagugugcccacuagauacugaacagaucugguuucuucuuuguaggccauuuacauaguuauagugccuguuauaucucacuccauaauugccugguauguuuuauuugucuuuugaauaauaacuugaauaagccuuaauacuugaguaaguuuccaccucugccuugcuguauagggccugugaucuagauagguaaaaugcucccugcauuucagcccuccugguugcuccugguagcaacccagccaagguagccugcggcaguuuauacauuccgagaagucggugcagcaguauaacagccuuuuuacccaauuucaguuauugccgaagcauugugccaaaaccaucagucaagcagugaauaagaagucaaaaaaacagacgggcaagaaaggggaaccugaaagggaaaaaccggguguggagagcaugaggaaaaacaggcugguagugaccaaguaagccuuccucuucuccuggggacucuguggggacucuuuccucggcgcuguuagaacugagacggggagaggaagugaggagguuuuauugucuaacccuuacgaaacaaacaaagcagaacagaaauccuuguacguuuaucuguuaguacuauguucuacaaugcagacucacugugucacugcugugacacaguacccagccaguguaaucuaagacguuuauuuggcucacaguuugaggguacaguccuggcaggggagacagggaggcuggggcccuggacuuuguaccugcagccaggaagcuuccuucugaccguauucccugggcuccagcuugcugagugacacugcuuacaguuaccucuguuagcccucacagacacacacacccaugggaguuaacuaggugacuccaucugucaaguugacagucaguacuaaccgucacauagguaacaggugguauugucuugauguacagaauacugaaggccaagagucucucaaauucucugaggcgcauuuuuaacaacuucgugauccauaagaauaugucugauaccauuauuugaaaaaauaaaugugcuagcuuguacucacagacauuaguuagcauuuugauuggugguuaggaaagcagagguggacaguaauugggugaauguuguuuguuaaauguucuaccuguuccuaagacgaaaaagccauugccccuuuauaaacagugccucugcuccauagcagauuaacaccaccaggaggaaguuauugcugcugacggcugaauaagcgccucuucuuguggugcucaguacauuuauuauuagccgaauguagagggauacaaacgauccugcuuaauauuugcuugaguuagauagaaaccuuuugaacuaucaguuuaagaauaaaaaaauaaaauucugcaguguucucuguaagucuugcuauuuuuaugaaauugauuuggaaguaccuguuaugaacuaucauguaauuguuauuuauuacuguuuuuuagccuugauaaguugcacacugcacuuucggaguuaugcuucuccauaaauuauguuccaaacauggcggugugggagcacaccuucacgccgagggaguauuugacuucucaucuggaaauccgguucacuaaguaagagagcacacagacuguugccacugcuucauuuaacaagcuuguguucgccaccugaugccuauccaguaccaacuguuacuagcauuucugaggugaacuggugcacugcauaucgcagugggccgagaaccauguggaauagugaagugagacuuacugggcagcagguuccugccccacacuuacugcuaguuaccaacacugaccaugucagcaacuuccuccuaagauuaguuguccuacacaaacagggcuuauuagcguaguuugucuucaggcuuauggagguuaagugaguaaggccaggagcucacuaggaugcggucaguaaagagagcacagcaagugaguaagaaaagaugcaagcaucgagcaucaucaagugcguauuaggcuuugccugagcacgccaagccaucaguucugaguaagguuuacagacauuugugugauacugcaguaaggaauaaaaaauucaguucuaugaaugauacuuuagauuucugaaaguuaacuauuaagaaaguguuuauuacuuaaauuuuaaucuuggaaauuaauaauuuaauaauaauuuaaucucaguaucugaaaaauuugccaaaggauuuucaaaguguuuaugaucaugaaugaguaauguuuccauuguuguacgugaaacauuguggcaaggaaauagaauaaagcuggagacucuagcugguaugacaagaacacugcaacaagagaacaaaguaggacuauauaaaacaacaguaaauggaguauugaacuaguaauugucagugaagcagccagcgcugaacaauaucuuuuguucccauucuuaagucagauacacugacaguaaacuucgguauugagacccaaggcacacucugccuucugguccuuaacacuguuagcugggggugggggggacggggacugcuggccagggucugagguucaguuuuuggcuccuguguuuuccuuuuguaaauaguuugguuauaauuuaugggcacgccagugcccuuuucuucccaaaccucuuuuagugguuggguuaagucagggagcaacuugcuuuguuuggguuuccuuuguuuuuuuuuuuuuuuuuuuuuuuuuuuuaagauuuauuuauuuauuauauguaaguacacuauguaguugucuucagacacuccagaagagggagucagaucucgugaucggaugguugugagccaccaugugguugcugggauuugaacuccugaccuucggaagagcagucgggugcucuuacccacugagccaucucaccagcccccuccuuuguuuuuauuguucaguuuuagucuuauuccuuggggccuaaauacaagaguaguaauuuucaucuugaguuggccuaucuggauguaguccuagcugugggcuuugucugcuguguuaaagacgcaucuuuagaaauacaagucgaaugcuuaugggagugucuuaaaucgauaaggacuggcagcuaggcucuguagguaaaggugcuugcugcgaagcaggcagacacuugguaggaggagagaacugacuuuacaauguuguccuuuaacuuacacacacacacacauaauuuaucaguguaauuuaaaaauauuuacuuguaaauaaauguaauuuaaguaaaaauuuuuaagggaauaggagggacugaugcggagaaagaucacuuagagaaguauuuucaagccuguguuuccuguuagcuuuauauauacauggcgaguaaacgugcuuuaaugugcuguucagugucaucuuuuuuuuuuaagauauauuuauuauuauauauaaguacacuguagcugacuucagauggaccaaaagagggcaucagaucucauuacggaugguugugagccaacaugugguugcugggauuuugaacucacuucagaaaaacagucagugcucuuacccucugagccaucucgccagcccuguucagugccaucuuauuuuaacugucaaguaguuuguugaagaccagcauuaagucaaacaaacauuuauagaugcucauuuauuuugucaacuuuagaucaggguguaugacuuuauaaaugguuaauuaaacuauuaugucuaguuacauauuuacauucucucuagguguuugaaaacugcucauucuaaacagacugccuccaaacacugauucuuuuuauaguuuccuuaugguuugaaccuuaguuuauuuaugaaguguuagugaugauaacugcauagcuauuuuaguacauacugggauucaguucacucacauaaaauucaaaaagcuucaagcagcagugccaaauaaauuuaagcuuuaggauaaauaucucauuguccuuguuacauuaauggaguuuuuaaaaguccauuuuaugucugaucauuguuaguaacuuaccuucuuugaaugauuuuuaauuguauucuucaucauuuuuagguuaugagaugacaguaauuucauggcuuuauuuaagaauuaauuuuaucauuacugcaaagagaggcccauuggacuugcaaacuuuauaugccccaguacaggggaacgccagggccaaaaaggggcaguggguggguaggggauugggggggguggguaugggggaccuuugggauagcauugaaaauauaaacaaggaaaauaccuaauuaaaaaaaaagaauuaauuuuauugcuuauuugauauuagauguuagguugaguagauuguuugcacaagugagaaaaucuuaugucuguuauuaccuccagaucaauuguuggaaugacuauguauaaucaagcuacacaggaaauugcaaagccaucagagcuucuaacaagcguaagagcauauaugacuguacuccaguccauagagaacuaugugcagauugauaucaccagaguauuuaauaauguccuucuucagcaaacacaacacuuagacagccauggagaaccaaccaucacgagucuguauacaaacugguaaggagcacauuuacaagcuuugaaggauggaaaguuuuguuuuguaauaaacuccuuaggaaaaccauuuuaugguuaaguuuuuauauaugaaucuuuugucugcauguauguauguguaccguauguguuacugguucccucaaaggccagaagagggcaucagauccccugaaaccagagucacaguuaugaaccagcaugcauauucuagaaagcaggccuucaguguucuuccccgagccgcccucccuucagcauuauguaccauuuauuuuaucaguuaacuuaaaaguuauauguagggauguagacuauaguaaauacuugaacaagccauuucuccuaguuauaaauuuagguuuauaaaccuuucuuuuuaaaaccuuuucuuuuuagguacuuggaaacuuuauuaagacaagucagcaauggccauauagcuuauuuuccugcaaugaaagcauuugugaauuuacccacagaaaaugaauuaacauucaaugcagaggaauauucugauauaucaggugaauauuauaugcuagaucuagaaaaugaagaaagccugauuguuuuacaugguaacuuaauuuggcuugguuguuuuggguauuaauaauuaguuuguaagcugggauaguccaguauaucaguguaucuuaauauauuugcucugucaagaaacugaaguuaauucauuuccuuucagaaaugagaucauuaucagagcuccuaggcccauaugggaugaaguuccugagugagagccuuauguggcacauuucaucacaaguagcugaacuuaagguacagucuucaccacccacccugcuguccugguuugcaguguugggguuuggaccucuggccucucacaugguaggcaggugcucuaccacuagcuucaucucuagccuuuuucucauuuuuuauuaugaaacaggaucuuguuaauuucccaggcuggccucaaaacuucugcaccagccucucaaauagcuagcauuuugaauauaggcugcucuacauggcuuuaauuuacccuuuaaacauucauucuuguaaaacauuucaggaaugugaaaauaccuagaauuuaaauuagccugacaagaaaguacuagcacauaagugaaguuaaagcaauacagggccucucaaugacauuugguuuaguugcagguaagacaacaaagaggccagaguggugaauuaauuuguacaacugauggguguucagaugcucaguguccuuaagccuuuaucuguugcauaaugaugcuuguauuugcuuauguccaaauucucgcccaagcuguuuguucccauuuauuauuugaauauauugcuuuccacauuaccacagauuguaacaugagcauucuuaguuuauugggcaguauuagagauugagugcagggccucucaugugauaggcaagugcucuaccacaagccacauaccugguuucuuaguuaggguugcuauugcuaugaagaaacaccauaagcaaaggcaaguugcagaggaaagaguuuauuuggcauaugcuuucacaucauaaucuaucaccgaaggaaggcaagacaagagcucaagcagggcaggaaccugggaacaggagcugaugcagaguccauggaggucugcuguucacuggcuugcucagccuguuuucuuagaaaaucaucagcccacguauggcuucacccaucacucacuaaugaagaaaauguccuagagccagaucuuuuggaagcacuuucugaaugagguucucucauuuaagaugacucuagcgugugucaaguugacauaaaacuagccagcaaaccuaguauguuucaucuuaaacccuuuaagcugguugaaaauaucuuuggacugcuucaugauuaaguaaauauaauaauggcagcaacauuuuaaauuaccauuuuuaucauuuuaggaauaugucagugcuaagauaaauuauauugaauaagaacacacacacacauuuguauguauuuauaaaacgacuguacauuuugagagaauuuuaauuugggucacaaaaccucuuggaacuugacagacuagaagagucauguuuaaauacuguagugugucugaguauguggugguccuuacucuugcuucuuacucugcugaaguuuccugaccucuucgugaauuggaaaccgaaaggaaaauauuagucuuacauaagucauuuugagauucuuuuauuaaaacaauuguauagcaugauccucuggacuuaaugaauuuuuuuuuuuugucuuucaaaugguaacuugcaagcaacuacaugagucauuagaacaaagauccgugccugaccugggcuccugucuuuuuuuuuuuuuagaaacuugugguggagaauguugauguucuaacacaaaugaggaccagcuuugacaaaccagaccagauggcugcacucuuuaaaagauuaucauguagguuacccauaguacuuuuuauaaacauucaaaagaucuaacaugcaauauguaauuucuacccaaaauuuguaacauaaaugcaagugacaaacuaugaaaagugcucuuuagcauaugaagagauauagcaaaaaauacuagucacagggucuuuccaguguacaucuacuccauucacucacucauucauucauucauucauucuccagguggcagggucucgacccagucaggccuuaaacucacaacugucugccugccucugcuuuuugaguugcuaggauuagaaauguguaccacuacaccaacuuuacuucagauaugcuugacuacaguuuuuuuuuuuuaauacaugacaguuacuagcaaauauuaccuguaaugaguucuucagccuacuaacuauauuaagucuacauuaauuccauuaagagauaauuaacuuccgagucuguaacuuucuaaaacucauuucccgacguggccagacaccgaggaaaggcuacaguauauguugacaggauuuagaucuguaaccguggccccagucagcagcucuguccucucaggaacgccucccucuguugucuucucccuacucuuaaacucacacacguuccugccaccacagagcaggcucgggauugcuucugucacuuagcaugcuucucagauucuucgguuugugguggccacuggauuaauaauuuguucccucuuuuuuucuuuucuauuuuuuuucuuuuuuacuaauuaguauucuacugcaugaaaaccuaagccugucacguacaucuuuaacuuuuauuuaaaugucuucuugaaaaugaugcugcaguuauacuugacucauaaugguaaaggucuuucuagcacuaaaaacuuaagaaauccaaaauaaucuguauuggagaaaggcagagugugcuaauuacucuacucaaacccuggggguggggcagucugacaggggcucucucagucagugugugugcacuugacaugugcaaggccauggccacuucuccuacguagugaaucugaaagucucagucauuggacacauagcguggauuuaauauacuuuaccaccugauacuuucuuuucaaaugcuuagagaaucacuuuauuguuuuucuucuauuuuuaaaaccucauuuaauaaaaauuaccauaaaauuagugcuacaaaacaccaaagauggucuuguaaaccacaguaguugccaggacuuaagaaggaagcaguauggaguuugggguaugaugcagcuguuuaccauggaggcaguauugguaucagauauauauguuauaauuucauacaacuauagaccaagauggggagugggaagcugaguuuauugugugguuguuuuaaaaagaaagaucaacuuuacaguuacaggagaaaagcauuuucaucuuuaauuuuuauuauuuugcuauuucgguguuuucuuucuucuucguuguuuuguuucuuccauuuucuggagucagcugaccaugaccuacuacuagccuuggcuguacuggacuuuccuauaauacgcaggguuuugcuuggaccuugucauuugaaggaauuacuacacugaaagguuuaauagcccagucuuuaauucacugucccuuaacaagguuauguaugauuacacuuuguauauaauaagacuuugggauuuguuaaaacuaaaauuuaaaguguugaaucauugugacccauauuuauaaaauuagccuuaaaauaaaauauauuaagccuauuuuguuucauuaggaaaagaaaagaugugcuugauugagagaggccucuucagggcagaaggcuauucugugaggugaagcgcucugaccaccuccucucaugcucucuucaccccauagccagaaagccagauguuggauuuagaaucagcaagucaugcuuucaggagacaaggcauuaugucuuauuaaaaguggcucugaauuuggggucaguauggaauugguuuucacuugaaggcuucuguaucacucaaaucucauaguguaccccaguccuuacuuccuguccucagacgaucucucuuggagccagaccgucaccugacuccagaccacuaucuucuagcuuucugccaugaugcuuuguucauucacuuucguccuccuggcaccaugucugagccugcauacugcagcagagcaugaguuaggacgguggucucacugcuuuggagcucuguguccugacuguaccuagccugugacacagugcgccuuuccauugcuggucuccugucgcucacggaaaccugaucacucuucuguuuauccuuuuagaaauuuuggcuaguaaggcuuuuuccuuuuuguuuucauuuucauuuuuguuuuuguuuuucaagacaggguuuuucuguguagcccuggcuguccuggaacucacucuguagaccaggcugaccucgaacucagauccaccugccccugccuccuaagugcugagauuaaaggugugcgccaacacugccuggcuccuuuucuuuuuuuaaaguuguguuuuuaauuacauuuagaguguguaugucugugugcaugcauguaugcuugugcgugcgugucucucuccccguauguuuaaggucgugugcagaggacagaagucgcuucucugucauccacgugggcccuggagguugggcucaggcugguaggcuugguagcaggccacuugacuggcucugguuuagcuuggcuuggaaugucuuuuccuccuggucuuccuuuaugccaacugggaugacacguucucagagaaaucuuuuuguucauuuuuuauuuuucuauucacuuuuuuccucugguagaaacauuucccuagucucuuguuacaccacugcuuauuaaucugccaaucagcuguucaucaggcaccaacaugcuguagacagauaaagaccaauaaauugauuuuuguuuaugugaaacuuaccaugcauuuguagguuuuuuuuuuuaagcauguuuuauauuugucacauuuagugcauauuuuuauuuauguugcuuacuaaaacauuuauacuugagaguuuaaauucuuagaaaguccaaacaaaacaccccaauuccugcucuucauuugacaucugugcuuaaguuuucuauagagcucuuucuagaaauuugauugaauuuuucucauuuaaauagcaguuauauuuuaggggugugugagugugugugugugugugugugugugugugugugugugugguaucuuagcauauauguguauaguagacacacaugcccuguggcgugucuuccuuagcuguuacuccacuuauguuuugagucacugggucccagaaccuaaagcucaucagucacgcaggauggcuguccgguacacuguaugcaucuucuuguuuccaccccauggcauuagaauuacacgagcuugcuccccgcccagcuuuuacuugggggugcucaagauccaaaccacaccuguacagcaagcacuuuacccacugagccaucuucccagccuuguaaccuucuucccugcuuacaugacuuggaucaaagcccaggcuguuucucuauauuauauuguaguauacaaugucauguaguucaucgccuuguauugggguauuuaauacaugauaccuuugaaucccucucuuauuuuguuagcacaguuaagggacuaagggcauagcaauuauuuucaaaauaguuuucucugagcagcauccaagugcucaagccggcaccgcgggcuccaggaacuuagcucugcccagcuacuuauaaucucccagccagcacugaccaggacggccugggcagcuccugagaucaagccauaggccugcuuaugaucuuaauaaacaucuuuuuuccuuuuuuggccacaacuuaagaauuuucuuaagggggcuagagagagagcuuggcaguuaggaguauucacuguuuuugcagaggacuggagucuggauuccagcaccuucaucaccccccacaguucccaauuccagggcaucuacaccuucuucuggccuccuuggcauccacacgcuagcaucacacagaaccuuacagaaaugcacauuaauuuuuuuuuuaauuaagaacaggagagacuggggauagagagauggcucagugauuaagagcacugacugcucuuccagagguucugaguucaaaucccagcaaccacaugguggcucauaaccaccucuaauaggaucuaaugcccucuucuggugugucugaagacagcuacaguguauucacauacacaagauaaauaaaccaaucuuuauaaaaagaaaaugaacugaacuagagaaaugcuuuugugguuaagagcacugcucuuccauagaaccuagguucuacugccagcacguacauagcagcuuuugugugugugugugugugugugugugugugugugugugugugugugugagagagagagagagagagagagagagagagagagagagagagagagaacugauaaauauuggguaucaguauuguuaagcauuuguugacucagauugccauuagucaugcuauuccagaaauuuugauuuugaguguucucuccaaagcuaaaauaaaaugucacuuucugacuuuuuucuucucuucuccccuuccuugcaauuuagcuguugacagugucuugaaaaggaugacgauaauugguguuauuuuauccuuccggucauuggcacaagaagcauugagagauguaagaaaccauuuccgcaucaucucuucauuuuccaaaaacuaaaauucacaguuagcaauaauaagaguaaauuugcagcuuguguauuaaugguaaauaagguucguguuuugguuugguauugaauuugguuaaugcacuauuucagcucuguuacacauuaaagcaucccuuuagacuauacucaaccccuuuaauacugaaugcauaucauuuccauauauuuuggccuuuuagaaagacccaaugaaaauuacuacguucuuaugaaaaccuguuuuuaccggcggguaguauuucccgcugugcugucugccuuguagcacugacccugucguguaucgucugccuagguccuguccuaccacauuccuuuccucgugagcuccauugaagauuucaaggaucacauuccucgggaaacugauaugaagguagagucuguuagaguuuguuguuguagaaugagauguucacaguacaugaguaagaccugguaaaaccugaacauagcaugccuaccugggauggauacuaugucucugagcucucaguaccaagauauucccaaccauuuuggaaaccagccuucuuugaucaauuuuauggcuauagggacauuaaauuuguuaaaaaugggccuuuuaccccuucaauguuaucacauuuuucuuucacauuaagcagaaagaugaguuauuguaaacucaaguuguauucaguuuuuaaaauagguauuuaaaagucuuaaaagauggcuauggucuauucaaaguuagcuuuucucuagcauuuuauuuuuuccuuaaugacuaugacaggaaaucgauagcuuuuuuuuuuauuagauguuuucuuuauuuacauuucaaauguuauccccuuuccugguuuccccuccaaaaacccccuauccccucucccccucccccucucccccauuccccaucccccugcccaccaacccacccacuccugcuuccuagcucuggcauuccccuauacuggggcauagaaccuucacaggaccaagggccucuccucccuuugaugacugaacaggccauccucugcuacacaugcagcucgagccaugagucucaccauguuuacucuuugguuggugguuucgucccugggagcucuagggguacugauuaguucaaauuguuguuccuccucuggggcugcaaaccccuucagguccuuggguccuuucucuagcuccuucauuagggacccugugcucaguccagugguaggcuucgaggauccaccucuguauuugucagguacugguggagccucucuggagacagcuauaacaggcuucugucaguaagcacuuguuggcaaguugaucgcuuuuuaaggguuuauaguuaauuuguuuuaaaauuuaagauccaugugaucaaaaccacagauuuaauuccagcugugauuuuguaguaaauuuaaaucacaugauauacaaggagacacaguuauugcaaguguccauguuugagacaugauguguguaucugucuucucuccuuucugucuguccaucccagggaucaaaccaagguugucaggcuugguggcaaaagccucugucuaaugaaccauuuugacagacugccucgcauaucucgacucuugaacaguguucacguuucaaaaugaugucuuucaaacuguagggugggaugggguuugagugucuuccugugcagcucagacuggcuguccacucuaaauaauccuccugccucugccuuagccuuccaaaugcugggauuacagauuuaugccauugugcuugcuuuauucaaauggcuuaucuaccacucugcuuccauuaucugccucucuucauaugucucuucugaccuaacagucuaugagcauucucucaggcuccauuuaccucuuccuuaauucuacuugaaacucuucccuuuucugucucugccuuuggaaguccugccugucugugaggccagguucacuugccauuuucuaagaaccuagauuccucaaugauaaaaaaguuuuuucuuagugcuaguagacaauuuuuuuauuuuucuucugcccauauuuauacuagauaauaaacaacuuaaaggccuuguuucuuuucauuuuugguuuuccuauaaugcuauauagaaguuagcacuugagaguaaugauuguucuauaauuuuaugacugaaacuaugaauagagcagaaaaugaguuuuucuaaguagaaauaaaauacaagguuaaauaguucuuaugagcacacugauguuugggugcugagaauucuaauauagugcccgaauugaauuaauuauccaauucuuauuacuuaguauaauuuuuaaauugaguuuuuagcaaacuuucaauaaaaaaaaaaugacuugauuugaagaucccaaacauaauuuuuagcagcuuuauucuugugucauaaaagaugcucaucuaaaguguacaguuccaugguuuugaauauagucacagagucauggccaucacaggucacaauuaguuuuagaauaguuuugucauccccaagugcaucaguacccagggcaggagcuccccacuuucagcucacuccccaucuuagaugauagcuacgucucugaagucaucccucuuugaguacuguguguaaaucauuuaacggagaguuuuuugauuucgaugucuuuaacuuagcauguuuucauggcccaccauguuucagcauguguuagcacaguacuuuauuuuuuaguguuuuauuggaugaauguacuaguuuguuuauucaguuaucaauuacagauguggguugucuuuacuuucuagauguuguaaauaaugcuaccuuuuuauccauguugauguuuuuggucucuuauauaacaaauggauucuguagaaacuguuuagcuuugaggaaccaccaaacagaugggcuguggcgagacugguuuauauugcuaacaaggagggugccaggguuuucucuauccaguccuugucuucauguugagagccauuuuaguaggugugcagagguaucacgcugguuugguuugcaucuccuucauucucgaggcugccacacgucugugaugugucuguauggcuucuuuagagagagguuugucuggauccuuugcccauuuuuagaccgugugucgccuguguuugcagaguuggaucucuccuuucacucuugccuggccuggggguugaacuccaucgccggguuuaugccaggggaaaauccuuuucccauugagcugucacuggccugcaucauuuuauuuuugaacuaucaagcaguaauacaucuucaguagaaucaugguucugaguucucuuuucaguuucuugcuaguauccaagaaucacagaacucuuucauuucagcguacuuugacuuaucuguuuuuucuuuuguuuacaguuuugcugucaaacaaacaaauauugucuugacaaaggucaucagaauuuaugccuguauuuucuucuaaauuuuugaaauuuuagcuuuuacauuuauaucuuugaugcacuuugaaauucaguugguguauugugagcagugugcgucucugcaacuuaguucaugguuguuucuauuugagcuuuauuaucuguuaauaucaaugauagccaacuauguauacagguuuuaauuagaauaccacucagcauaucuugaaugauuaaaaucuaugcaugauagaaaauuauuagauugcuuuaucagauucuuagguuuuuaauuuuuuuccuguaauuaauuugcuauguuuauggcucugauuaagcauugaaucccugaaguuuuucacuaaguaacuguggauguaagcauagguucagucauaauaacuggcuuucgguguugacucuagccaggcugagcuggugcuccuucuguagccaggcuggccuugaacucucaagugcagauauauaggugugagccaccacaacuggcuuucuuucucucuuuugacuugauauuuuacuuccaucuuugcaagacaaaaaguaucuuuaggaugauucuguggagcuugccacagagaggcugcaagccuuguuugcacagugggaaguuacaaagagcaggguuggagcguugucugguguggguuaccugcacugucagcccugcuucagccaaggugcugaaaucuucuaguagguucgugggcagacugauggacaccauagacauuuucuuacuaaaguaaacuuucucagacguuuguuaaaauauuuaucucuuuguaauugcuguauuuugucagguugcaaugaauguguaugagcuguccucggcugcuggguuaccaugugagauugauccugccuuagucguagcucuuuccucacaaaaaucagguaaaaugcauucaaauauggagcuuucuuauuaaaauuauagggcagucuagguauacacguaguauuuguuuuuuaaaaugucuuauguuaagcuuuauucacccauuuauucauuuauaauuggaauacaucaggauucaaaagacaaaaugcuuugcuuuggaguuuuugcuauagcuuagucauuacauccuguccaagccauacuaccagaugaagcuguuaaagucauuugguguagauagauagggcggugcaaagaaacagugcccuuucagcuguagugaguucagggagaagaggaagaaaugcauaauacagacuaagauggaaggaccaauguaaucagagaaaaaacaagcacuugggaaaaagcuccuaagacagugaaagcgaaucgcgaacugugcacuguuagagagcuguggugcugagaucggugucucugaagucagugagugugagagaagggacuggacacacuugauauggaacagcucugcugggaugaagacauagugcuuguguugggaagcauggguaggcccuacacacuacacuguagcuauauauaccccagcuuguggaaaggacuuugugaguuggagauagaagaagagaacauuuguaugcugguggaaggcagcccuuaugguagccagagagcugggacuagaaaaugguguccuguuuuaauuagaauagauguucaccauaaaaaguugcuacauuauauaauacugaccauuuagaaauuuuaaaaccaguucuuugaaacauaguaucaacuauguuccaaaucuugguuucucuacagugugaauaagguggggugguuuuuuuuguuauuguugaugauguuuuuuguuugauugguuugguuuugguauugaaaugccuucuccacccuuuugauuuuaauuucuuuuuaaauuuuucacuuacuuaauguauaugaauaauuugccugcacuuaugugcacugugugcaugccugguacccaaggagugaagacgagggcaucagccucagagcgggaauuacagaccauugggagccaucaugugggugcugagaacugaacucggguccucugcaagagcagcaagugcucuuagccacuaagccccuuuucuacucuuuuaagccaacuugcagucauugaguuuauuaguuuucuuuuuaauuacacuguuuuuccuaauucaaauaauauauaaauuauugcuuauagguauuuuuaugaucaaccaaaguuuuaaaaauauacuguguuuuuguuuucuugugaucaauccauaguuucauauaauugccaacugcuggguaacuagaaguucucagaugucagauaagaagccaagugcuagacagagcuauuuaaauacgcuagguauuuuauuaaagguuauuguucuuauagcuacugaguauguuagauacuuucauucauaacugcuuccuucugucuucuagaauggagaaauaaguaacgcaguccccuuuucaauacugguaaccuuuaagcaguguauuuauauauucuuagcuagccuagggaaagaaaggaauuguuuuucuuuuagugaauuuucagauaauaagauaagaaauuuauaaauaguaauauguaugguauucucauaauuauucaucaguuuucaauuaggaaauuuaaguaguuuauuaccuuuauuuuuuagguuagauuauuaacuuucaaauaaucuggaggaaagcuugauuuucacuccuugauuucuucugcagagaacauuaguccagaggaagaauacaagaucgcuugucuccugauggucuuuguagcaguuuccuugccuacacuggccagcaauguaaugucacaguacagcccugcaauagaagguacuugguuuacaauuguaacaaugaaagaacauuggcuuuaguguuacauguauuuuucucucuggguaauguucuuuucugauaaaauagugcucaaauucugccaaacaguagcuuuggagugggcauccuaauuuucugaacugugaaauguuguguaguucagcugagaggugcagcagaggguaguguguguguucagacagugggguauuuuagggccugagaaggcgugccuuaaaauaacuuagcccuuaucauuuacaguuccaagggguaggacgaagcaucaugucuuucuagaguguuugccuacuaaugaaguacugacguggucauuaguugcauccuugcugggauauuuaaaaacaugcaugcucauaaaauaaaaagaguaagucacuguggacccuaauucuuagucagucaugcugccauucgcguggucugaggagucacuaaagcaugcugucuguguguuacaauaauauuuuguggucaugcagacuacacagcccuguuuguucucucccaggacacugcaacaauauacauuguuuggccaaagccaucaaccagauugcugcagcuuuguuuacaauucacaaaggaaguauugaagaccgacuuaaggaauuccuggcgguaugucuaaucaaauagcuugacauuuuacaaagaaaacaaaaaguuaugccuauguuauacaacaguaaauucccaucauuuuuacaucuuauuuaguguucuccaaagacauuuuuguucucaguuuauuaaguauuaaaucuuguuucuuuuuuaauguuuugguuuuagaaagauagauugcaucaagguuaucauuguuuucccucuagcuuggggucuuuccuuccagagcucugcuauguggccuguuugcugaaaauaauguuugagaggugcagcagaggguaguguguguguucagacagugggguauuuuagggucugagaaggcgugccuuaaaauaacuuagcccuuaucauuuacaguuccaagggguaggacgauuguagagauugucuucacauucaaaagauguuuuuuucuucaaagaaaguggaagccuagagagcuaauguguucuuuaaaagaugcaauuucgaaaaaacaaaacaaaacaaaaggccaggcagugauggcacacgccuuuaaucccagcuuuugggaggcagagaggcaggcaaauuucuuaguucaaggccagccuggucuacagaaugaguuccaggacaaccaggucuacacagagaaacccuaucucgaaaaaccaaaauaaauaaauaaaauaaaauaaaauaaaauaaaauaaaauaaaauaaaauaaaaaaggauuauuugccucucaguucccagaccuacaauguacagcucauaaccacuuguaacuccugucccaggaacuggccagcauggguacuacacacacacacacacacacauacacacaccacacacauuuauucagguacucacacgaaaaauaaaaauaaauaucuaaaacaguagcagaagguauguuuccuuauuccuacuuauuugaagaaauacuauuaauagguacaaagucagcaauaaaaguaugacucacagggcuauggcaguuacggauacuuacugcucuuccaaagguucagcuccuagcacccacauuagacaucucacuaccucacuacaguucacuacaguucuugggauuugaugcccacuuguacacagucaugaaggcauauacauaugcacauaaacaaacaaacaaaccauaaaauuacauguggcuugcuaccaaaagagaguaauguuaaaucugucaccagacaugguuuagugcaguauuuuucuuuaccaaugcuucuuuuucauaauugcuuaaagaacagauaauuuaagcaaaaugaacccuagaauauuuaguuuuuuucuuuguugaaaaucuuguugguuuuuauauauauacacacacacacacacacauauauauguacacauauauaaauacauauaugcaaauacaacaguuauuuaagaaggaacucaaguuugaaaacauuauuauaauucuguuguuuuccuuuuauuuacuuuacuuggggaguuaauguccuuaaaauuacuaugaauacaaacccagauugaaauugccuuauuuaggaucuaaaaaguacacaguguguucaccucucauguauagauuaugcuuucugaguuccccacgccaagaggguacuugaagccaggaauaguacugaacuguaugcauccaugcacacacaggaaaguauuagaguacaauacauuauuaauggaaauaauagaaagguuucaccaguuugcaugccauaauaacaguuaggagagugaagucccucgaaaugcuuuguugucuuauguccacccuucuugugacccugagaugacacuggugugugugagguaaauggaggugacgauguagacauugguggacguuggaggugggcuuuagacagugcuucaaggggaggauccucugcuuugggugauaaugaucauuaccgggagaauaucuugacuugcugccaagagagaguaguguuaagugugcccaucagacauggcugcgaggaguucuuggacauuaguagcaaauaacggcgauggcugggaauucucaacagccuuuaaaagagaccuuggaaggauauuguaauuaguucuuacugaauaugaaagcaguggugcagagguuauaaucuuucagggaccauguggcugaccucagugcuguuuuccacacagagaccuuacuccuuuaaucuccaccuuuagaaccuaugcagcguagaacacuuuggcauacuucaguaacaugugcuuggugcuucugcucucacuuccucuacuuuguauugucuucuacagcccuugugagcuuuguguacugcagcauggucuucaccaaguaguucagcagguccugucccaccaacuugucuuguuguuuuuaagcgguuuuccuaauuuuccugucuauccccagaaagccuucaaaacaacucauccaucacuguauccaugaguuccucauaucaguccugguuuuacuaauccauugccgcuuuaaugaauguuauugugcccacaauagcagauaguuuucaguacugcauuauauccugggguuuccuuugauugcuaguugauuauaguuaaauaccagggagguggauauggccuuaauaaacuaaauaauacucuggucagauuaaaacauucaguaucacauuuuccccucccucccucccucccucccucccucccucccucccucccucccucccucccuucuuucaucaucauuuuugggauuuuugagacagggccucuauuguaguccuagcuguccuggaacucauguagaccagacuggccucgaacucaggcgugcuaagauuacagacgugguccagcauuacauuuuuuuuuccagcauuacauuuuuauugucucuuuuugcagaaguucagaguggucagauguugucuguuaguuacaaggcuuuuaauucaaaccgucuuccaacaauauggcugucauucacauuauaguuuuuauuucugaggaccuuguguccaucacucuauacaguggcauacacuuuggcuauaaccuucaguuugacaugugguggcagcauuagaauaaauuaccuucugcagauagauuagcuuuuccuagagauuucaggaucuugauagaaacuugucugcugggcuagagauggacugaggcugccacaaggggaccacaugggggcggggaaacccaguugcuagaacauagcuggcgcuagagugggugucauuuauauauuucaugaaacauuacauucucaugugaaggaaagaccuucuccccccuccucccccccuacccccccuccuccuccuccucggcuguacauuugcaagcagccaugcugaggugugggcacuugaacagaaacacugcauuaccaugucauucagcagguaacuaacaugcagguauauacauagugugggugugcaggacagagggacagcccuguuccugaggaagauggagcagagucacacauagaauggcauggaauucaaaguuagaaacugauuauuggaaauuaggaaauucuggaauuuucuauuuugcuuuccaaccauauuuggccauuaaaagcaaaacuauuuguaaaagggggguggcugcuguagaguauuauggaucuugggaagagaaaacaauaugaaucauuuuaagaaacaaacuugagcaaaaaguuaguuuugacgaauauuugauuauauguauaccuuaauuguugauugauaagaggucucuagcucaucguacuuuacacauugaauaacggaagcuuguugaagguugaguuguacugagaauggacgugaacagcauuucuuugccaaccucauugauuacauguguguucuuuuaagcuugcaucauccagucuacugaaaauuggccaagagacagauaaaacuacaacaagaaauagagaaucuguuuauuugcuacuggauaugguaugucucauuucaauuuaauuaacuuuuacugauaacaaaauguuccaguccuuagcacuccucuucuuggcaagugaaaguuuuauugguguuuuguucuguuucuuuugugauuuuuuuuuucuccauuucuuguggucacuucacucaaaccauacacuuucuaaaaauuucugcaaagacuugcauugcuccuuuuuugccauaggucaguaauaggaagucguaagaccaaaggugaguguuaacuguaagguuguguucaggccuuuuauauuccugcuaagccgaguuuaauucucuagcuugccauggcagugucugagacucuuucuucuuaguuuccuuugccuguagagaucugugucuaucugaagacucagcagaacucaugacuccauuucuucccuagaugaucuuucccaaucacacaggccuacauuagacuuucuuuccucuugaacucuagaauuuacugcuuucuauuuaaucauagcuggucuuauuuuuuacuuuacuuucuagcuugauuuugagcuucuuaaaauguaccauuacauuuguauuacguuuguauucacuuuuauguuuagaguauugcuuaagaugugucuucuauguguuacuauugauuaauugauaaacuugaaaauaucauuuaaaaguauauugauaggcuucacuguaacacauuuucauuuuagauucugaaguaaaaugguuuguguguguuucaaaugagaagaacauagaguuguuuucuacccccauugaguaacuugaauuuugauauuuuuuuaacuuuuucagauuguacaagaaucaccauuccugacaauggaucucuuggaaucuuguuuuccuuauguguugcugagaaaugcauaccaugcugucuacaaacaaaguguuacaucuucugcauagaguacuuacucaagacaagcacgaguuucuguugccuuguuuuaucuguaaacuguggaacuauuuuaccuuaaagccugaaaacaguuuuguggaugaaauuuucuucaugcuguuguauuuucugaucauuggcuuccuaauaugguuguacuacaguacauuugauugauuuaguuauacauucucaaaacucagugaauucuaugauuuuagaguaucauuuguuugaaauaccauuaacacuauguuuuugauaacugauaaugaaaaaacuugcuuguuuauuucugaaaaagaacuguauuuagugauuauuuuagauagugauaugcuagcccccaucuguguguaaauuauuuccuauagggagaguucugaucuguaccuacgguuccuucugagauggagacuggaugugcacaucggugaugcuuacgacuacauuucuacuuuauguugaacauuugccaaacuaaauaccuaacgcgguuuaaccuuccacauggcagacaacuugagcaucggaagcagguuccgagguucucagacagcagcacaugcugccgccgccuguagaaagccuacuguagaaacaucucaucccgugcugcccggcuggcaucugcacugccuuuacccugcuguauaauaaacaaccagacacuuggcaacuguugauacagaugguagucccgaaucacuuuuuauauguuuuaacauuugaaauucaaguguaccugccauaacauaaauaaacacuagacuguaucacaccuugaau

SEQ ID NO: 876 - RNA, 1822 nt, Mus musculus
uuuuggacuucugcggcuuuuauuuuugcauguaaaccacuggggggagggggaucuugauggugggcacccuagagauuacacuggaguuccgagggcuccagacacuagcugggaagucaggugacagaaacaaugauucagaccaaucacaugauugcaaaacugggucuccagcagggauucugguggucagguguggaugccuaaggaagcagugacaugggaggggcacgcacugggcuggccuugagcugcugggaugacaucagggacagaggaccuagcagcugguggcuccagggaucuccgguccaugcuuuauuuggccaggggguuccugaaggaccugccagcaaacuuggcuuugcugcccagcucuuccucaauucuaaggaucugguuguacuuggccaggcgcucggaucggcaaggggcaccagucuugaucugcccagugcagagccccaccaccaggucugcgaugaaaguguccucaguuuccccagaucggugggacaccaugacgccccagccauuggauugggccagcuuacacgccugcagggacucggucacagagccgaucugguucacuuugagcaagaggcaguugcaggacuucucgcucgcagccuuggcaauccgcuuaggguuggucacugugaggucaucgcccaccaccuggaugcccgcacuagccgugaacuucugccaggcgccccagucguccuggucaaagggaucuucgauggacaccacuggguaguucuggacgaaggacuuguacagaucagccagcuggucgggcgugauguaccugcuggggucauccggagacuugaaguccaggucauacuugccagaccuguagaacucggaggcagccacauccaugccgaugacaaccuggucaguguagccggccuuugcgauugcagucuugagcagcuccagugcuucuuuguucuccaggauguuaggugcgaauccacccucaucacccacauugguggcguccuucccguacuucuccuugaucacguucuucagguugugguaaaccucugcuccaaugcgcauggcuucccggaagcuggaugcccccacaggcaggaucaugaacucuugcauggccagcuuguugccagcaugagaaccaccguugaucacauugaaagccgggacaggcaggaugacuucaggguugccggccaagucagcaauguggcgguaaaggggcacccccuuuuccacggcaccagcuuugcagacagccagggacacucccaggauggcauuugcaccaaauuuagauuuauucucugugccguccaucucgaucaucagcuugucaaucuucucuugcuccacaacauucacuuucuugcuaaccagagcaggcgcaauaguuuuauugaugugcucaacagccugugagacacccuuccccaugaagcgggucuuaucauugucucggaguucuagggccucguagaugccaguggacgcaccgcugggcaccgcagcucggaagagaccuuuugcgguguacagaucgaccucaacagugggauucccacgggagucaaagaucucucuggcguggauccugagaauagacauggcgaauuucuggcaguaggaucgcugcaaagcaaggaaagagggucuagaaaauauuuuuaucagcugguaggauugcuugacugcuuuuuagguuuguguacuuauguaauuauacuccuguaaaagcuaaaauagaaccucucuaaauuaaauuuuucucugcuacauuaaauuuuucaaaaacauucuuuca

SEQ ID NO: 877 - RNA, 1832 nt, Mus musculus
auauuuuuuuuuuuggacuucugcggcuuuuauuuuugcauguaaaccacuggggggagggggaucuugauggugggcacccuagagauuacacuggaguuccgagggcuccagacacuagcugggaagucaggugacagaaacaaugauucagaccaaucacaugauugcaaaacugggucuccagcagggauucugguggucagguguggaugccuaaggaagcagugacaugggaggggcacgcacugggcuggccuugagcugcugggaugacaucagggacagaggaccuagcagcugguggcuccagggaucuccgguccaugcuuuauuuggccaggggguuccugaaggaccugccagcaaacuuggcuuugcugcccagcucuuccucaauucuaaggaucugguuguacuuggccaggcgcucggaucggcaaggggcaccagucuugaucugcccagugcagagccccaccaccaggucugcgaugaaaguguccucaguuuccccagaucggugggacaccaugacgccccagccauuggauugggccagcuuacacgccugcagggacucggucacagagccgaucugguucacuuugagcaagaggcaguugcaggacuucucgcucgcagccuuggcaauccgcuuaggguuggucacugugaggucaucgcccaccaccuggaugcccgcacuagccgugaacuucugccaggcgccccagucguccuggucaaagggaucuucgauggacaccacuggguaguucuggacgaaggacuuguacagaucagccagcuggucgggcgugauguaccugcuggggucauccggagacuugaaguccaggucauacuugccagaccuguagaacucggaggcagccacauccaugccgaugacaaccuggucaguguagccggccuuugcgauugcagucuugagcagcuccagugcuucuuuguucuccaggauguuaggugcgaauccacccucaucacccacauugguggcguccuucccguacuucuccuugaucacguucuucagguugugguaaaccucugcuccaaugcgcauggcuucccggaagcuggaugcccccacaggcaggaucaugaacucuugcauggccagcuuguugccagcaugagaaccaccguugaucacauugaaagccgggacaggcaggaugacuucaggguugccggccaagucagcaauguggcgguaaaggggcacccccuuuuccacggcaccagcuuugcagacagccagggacacucccaggauggcauuugcaccaaauuuagauuuauucucugugccguccaucucgaucaucagcuugucaaucuucucuugcuccacaacauucacuuucuugcuaaccagagcaggcgcaauaguuuuauugaugugcucaacagccugugagacacccuuccccaugaagcgggucuuaucauugucucggaguucuagggccucguagaugccaguggacgcaccgcugggcaccgcagcucggaagagaccuuuugcgguguacagaucgaccucaacagugggauucccacgggagucaaagaucucucuggcguggauccugagaauagacauggcgaauuucuggcaguaggaucgcugcaaagcaaggaaagagggucuagaaaauauuuuuaucagcugguaggauugcuugacugcuuuuuagguuuguguacuuauguaauuauacuccuguaaaagcuaaaauagaaccucucuaaauuaaauuuuucucugcuacauuaaauuuuucaaaaacauucuuuca

SEQ ID NO: 878 - RNA, 82785 nt, Mus musculus
uaaagcuuuccgcauucuuaaacaaaagucccucagaagugccuggaggaaccagggaacggggugugccugguucuuuuucuuuugauugcagccaguccccggcuugcagggcuucggcuggaggcgcgcugccacugccccccugguccuuuggaucugggccgcagucccgggacagccucggaggaccggccgccagcgcgcacggaagugcgcccggccuucuccugugggaggccaccgugagcgcgacuuccucuuucggcggggcggcccggccuggccggcuccuccuccuccccggccuccucccccaguccgggcugcucacgguuccgagguacugugcucgccccgccacuucucagcgccaggcaccgcgcgagccagcgacagagccggagucccgggucggacaccgcuccuccugggugccgcccggcucagcuucgcgccgcccggccgccccgccgcccuugaccgcaagcgcacagcacagcucggcaguucgggggcgcgcaggcggcgggccgcggccaccgagcaccgggacagggacugaagucuuucggcucugcgccccgcgcgcgccccggcgauggcugcucccgggcgccugcugcuacgcccucgccccggcggccuccugcugcugcugccgggucuccugcugccccucgccgacgccuucaaccuggacgucgaaagucccgccgaguaugcgggucccgagggaaguuacuucggauucgccguggacuucuucgagcccagcacguccucguaaguggccgcgcucgaguccccaggcgcccccucccccaccgcgcacccucagcggauccgcacccagccgcuggcuccaggguccucccggccccaaacccgccuacucucuccaugccgcggcuggcccaggucuggcauggaugaaacuuuuguggggaugaccuaaccugacacucagcauccaguuucaccguguccccaacuucuucugauuggcuggggacagugcgagagagcuuugaaggagcucuguuaagcauccaggaaaagugagacaucuguacaggcuuguccugcgagacuuuuggccaucucuugucauuccguaacuugcuucacuuggccccagaauuuuuuucuuccguaucaaccaguuagccucuuccuagugcuuuuugcuuucugaaauuagcucuuccuucgucugauucucucucucucgcucucucucucucucucucucgguuuuuuucccacuccucuucuagacacuccgaugacuaaagugaccaaauuguuguauuaauuuguaaaggacuaugagaccuuugcgcguuuaagguccaccagaugaauggaaugcgucaucugcuccuuucuaguccacuauuuaggucauuguucagacagagcgaggguguuugcugaguuuucacucucugcaggucacuucaaugcugaagaauacagcaggucacguaggcuuucaaauuacucacgucccguguugcaaaguuccugaggauuugugacggcuaaugucguguuuuuggauuaaaguugucuuugacucaacgcuggcaucauucucaucccuacuaguguaggaaaccccgauuaaauugauguuuuucaugucuauuacauuguauuuccaaagaaacgguuucuuuaguuacuucuuaguguaccccuugggguaacaacauauuuuuuuuuuaccacaaacccccaacuccccccccaauuuaguuuuggggaggugcaaggcauaauuuugauggguaggugauacaagguucauuugaaggugaccuaaguauuugucugagguaguuggggcagccuccaggguuugucaccguuuuccugaacacugaugaguaucauaggaaccaguccuuaaagcaaccuguagcuugggugggguuggcaaaaaucgacauuguuuauguagagcacgguuugauucacauugucagugcuuucuguuagaccugagcucacacucuccaaaaaaacaaaaacaaaaccaaaaaaccacagaagcaccaauugcagacauuuaaccacucccgccaugcgaaugaucucuuuguauggauagaguagagcuugggguucuacucaggggcccaggcugcugagucuguaauauaccucugagcuacagccacauccacucuaucagaccgcuuuaguuagcucacuguuuaaaaguuucuccuuuccauguauuuuuuguuuguuuguuuguuuuugguuuuucgagacaggguuucucuguauagcucuggccauccuggaacucacuuuguagaccaggcuggccucgaacucagaaaugcgccugccucugcuucccgagugcugggauuaaagacgugcaccaccacacccggcuccauguauuuuuuuaauuguaugcuuuuuacaucauggccacugcacuugcccccuggguguaucuuuuagauuaaauuauacagaaauuuuucugacugaaaauauauucucugccuuacaggaauuagcaguuaaauacuucagaguugauggaguguuuugcagauguuauuacuuuuuacuguuauuaauuuaguugguuuuuguuuuuguuuguuuguuuguuuguuuuuuugcuucuguuugucuauggcaaagauuuaguauccaagauacauccagaaacauggcaggcuggcaagcuuuuaauugucuuuugccauggaaaacagcaguuuugagcuguuggugguauuuacuauuguugauugcaaggaauguaacuaaucuuuggaaaacauauggauaugcaaugagcucauacauuuacacagucucauguuuacaggaacuuaugcaugaguuuuaauaguaagauauuguggaacuuuggagauugcauguuguauuuugaaacagucacuaucaacuuugguaccaagagaccagccuaacauaaaaaagaaagcaacuuugaggggcccccucccucccaauacaccuaaacaacgguuuauacuuacugacucuuccagauuaaaugaagauuauuacaaaauuauacuuaaucuuaaaauagaaaaaaaccaaaaccaaacaaaauuucagauggugguagcacaugcuuaaauccuaggacucuggaagcagagucaggcagaucucugaguugaaggccagccugguuuacagaaagaauucggggauagccaggacuacacagagaaaagcuaccucaucccaccugccaaaaacccaaccaaacaaaauuaugcuuaguauuggcaaaggcaccuguauauucacuauauauucagcaagcauuagaauccacaguauuguaugucauuaucuguugcauauauugauaguuccuuuuuuccuuuccuuuccuuucucucccuccuucccuccuucucucucucucucucucucucucucucucuuucuuucucucucucucucugccugcccgugccucccaagugcugggauuaaaggcaugcauuaccaugccuggcuuaaaaacuuuuaaaggagaacuauguaguaaaauguuaauaaaagagcucccccuaugugaaaaaaauugauuaaggaggagaguagcugugauccccacauauuccaguuucagaaaucuaaauacuacggaacggguucacuucuucuuuuucuuuuucuuuuuguaaauuuuauuuauuugaauuuuauauauaugaugaguacacugucccugucuucagacaaagcagaagauggcaucagaucccauuacagaugguugugagcugccaugugguugcugggauuugaacucagaaccuuuggaagagcagucagugcucuuaaccgcugagccaucucuccagccccucuuuuuucuuauaauagaagauuaugagugagaauaucaucuucauauuguuauggaaaugaaugcaucaguacucacuaaaaagaaguguuaagcaaagcuuccagaauggagccgggcauugugguagaaaaugcuuagaaaaugcaucuguaaucuuagcacuugagagauggagguaggaggaucaggaguucaagccccacuuauguccuguguuccaggccugcugggguaacaugauaccuuuucucagaacagaaaaggcccuaguuucaaguucuuuaucuccauuaggaacaauauugcaauagcugugggccaguuagcccgaauuagccguguuaacucagcuaaaaaugaauucuauuugcaucaggagauguugguugcaccuccacuucuauuaauggaacccuccuuucucuguugcccuggagaucauuucauauuccucccucugauuuucuauuuuacuuugccucuccugcuacacuccucugagauuagucacugcuuagucaccaggcagaaggacuuacaaucucuuccuugauaaugcuuccuugcugcuagcucgcuuucugcuucugcuucucacuugagccuggcucugggcggcucagagcuucuugaaucauucugccuauuuggcugauagaccugcaaaacauguuauauguuucuacugcuuuuauauuuccaaaacuuuuuuuuuucaguaguuccauuggcagaggaaauccaaacccagauuaaggccuccugaaggaaaauuuucaaauuuccaugucacaauaccuuagaaaaugacucaaaguaguguacuuaccugaagucccagcacccagaaugcugaggcaggagaggauugucacaaguuugaggccagccugggcuagguagugaguuccaggauggcuagcuuuggcuacagagugagaccuggucucaaaaacgcacacccaccccccaaaaagaaaaaaaagugcauguuuuaauaaacuugaauguacuguguugguuaauuuucuccaucauaaauaauacaucugguuaaacuacagucuuuauuauuuggaaagcaaaccuuaggucuauuccuuucgguuaagaucauagauuuauuggguggaugugaugguugguggauaccuuaauucccaggccucgggaugcagaggcagggcaaugccugugaguuccagggccgugcaugaaaugugguaguuacugucuccguuuuacuuuacauaguuguugacccaaagcauuuguuuguuuguagagaaaaucugaaacuugaauuacaccucaacuauuuuauacacauuuccuuuuauguauauaaauaguguuuuuuuuuucaggaguucccauuggacaccucagagucagcuacguauaugaaacaagcuuuaucucggaaaggccagugcugagagcagccaaagagcuuaguucauuuggaaaguuuggaaguguacuugucauuguuuggccagcugcccugcuugguagccagacuuguauucugugaagcaacugcccuuccucuucugcacuggguaggaagugcagcucagggccauccucacagcgugucucuuuccccucuuucucuucccacccccacccaaacugcuuucuccuucccaucucuugccuuccgcuccucucgcuccucucucucucuuucucucuaucucuuccuuucuuuuccugcugcuucuuagcaucuccccccauuccuuggcaucgcaugaauagcacacucauuucuggaguccuaaagaggcauuaguacaaauaaaucgaguuaccaucgagugcugguguagguguggcucuuggucauguuuuugggcguacuuuuuuuuggagugagauagagacagcaaggagagcaccgaaggcauguuggaucuuacguugcuuagcuucaaaaauauacacauucuuccgugaggucuuuccagccccgugcgagcuuaagguagcuccccaccugucggcuuugccaggaaacgguaugagccagcuuuccugcccuucgcuuuucccucuucuccuuugaguuaguuacuugagcacuaauggcucuguggaaagaaaagcuccuuuaaaagcagacuuuaaauuacuuccuauuucauuaggaaauaguuuauuaaguauaucaacugcugguuugauugcuaacguauuguuuucauuuaucgacuggccaccugggaaagaauuuaaguaacgacagagcguuguaccucuguucuggagaccugagaacggagauuucaagugacuccucuugacugcuugccuuguuugugaguugaccccuucuguuugcacuggguggugcugcuuguuacacugcaaacaacuuuucuauucugucuccucuuuucuuauaccuggacuucugcaggcaaucagcagacaguuuuaguugacuuuuaaguaacacuacuugcuuuuuauaaaguguuucauugaugggcuuacagguugguuuguuuguuuuuuuuuuuuguagcauaaauaacuuuugucuuaauuauucuuccucuuccucuucuuccucuuucuucucuucuuccuccugcuucuccucuuucuuuuucuucuccuucuuguaacugugaccuuucuaugccugccccaguucccaaauaaugcuuccucugacucugaguagugcaucccugugccauccuccuucccagagccaaucagucacucucucucucucucucucucucucuucagaagucccaccuuacuauuaugcuuuuuguuauaggucauaggcuuuuuauuucaaccaaucagaggcaccuuaagcaggcaaggaaggacagagauacgucuucacaaaguguacaaaaagaucacuucuaacaccaccuccaucaccaccuccaucaccaccuccaucaccaccuccaucaccaccuccuuucuccucuucuuccucuucucuuccucuccuccuuuccuuggucucucuguguagcccuggauauccaggcauucacucuguagaccagguuggcucuaacucaaagaucugccuaucucagccugccaagugcuggaauuaaaagugugcaccacaucagcccagcuuccuuaauuuucuuagcaucuuuuucccacccuguacccuccagucuaugggaauacuuauuuauuuuuuuuaauauauaacuuccuucuaagauucuuuacuuuugaggcuggagagauggcucagagguuaagagcacugacugcucuuccagagguccugaguucaaaucccagcaaccacaugguggcucacaaccaucuguaaugggaucugaugcccucuucuggugugucugaagacagcuauaguguacucacauacauuaaauaaauaaauaaauauuuuaaaaauucuuuuuuuuuaaacuuuuuccaaaucuccauuuguuucuuuuaaaauacuuaaauaucuuaaaaguaaccaaaguauuacagugauauuuguauaaaaaacucuguuucucauauuuuuaaucuuauugauuuuuaaucacuaaccugggauuagacccugacaguuuucacaaguuccaucuucauuauucuccuauuucuauguauuuuaccagugggcaagacugcacaugaagggaugcauagggaaacuguugaacaucaauauuagcucuucuaauuaccauccuuucaugccuguaaugugcggacagccugaugaaagcagaagccugguuccuggacuccugcaagcacucaggcugugugcugccaacagagacauuuuuauuccgugcucucucccacugugccccuucagcuuuagccagaggccguccccuaauaaguccccuaauaauaaccgaugagugcucgcgguuuuacaguugccaagucaagaagauaacucaaguauaaaacuaaauugaauuguuacauaaggacauuguuuuaaguauaauuuaaauaaucgaauuauuugaaaaguacgguuuccgugacccaagaguugauggaguacuuugggaaugacuuauugcuauguaguuaguaaaagacagagaccuguagcuaaugaauguguuguuaucugcucaggcagaagggugaacuagagccccacauucaaauaagcacuuauaaguugugaaucguuuugaaaaaaaauuauagaagguucugaacagaaauguguaaaagacacucuggaagugaguugcuugugggugucaaggcaaaucuggggaccagcuguucucacuuggaaccccauugguccacacacuaagggcucgcauauuucugugcucugauggccagugcaagaacucggaaggaaggaaccaaguccucgucaaggugcagacuuugacaagcagugcauggauagucucaggucaccagaucacugacuacuuugugacucagccuucuccugaccccacagcuugcauuucagccuucccguggccaaagaaaagggcagagcauaggaaccacugaauaccggucaccaccuuucagccugaaggcuaggggaagggaugugugcuagacuugacagcaucacauagugggagaaggaacuuggcuccccacuccauccccaguggaaggauggcaucccacagaggcuuacucuguguuagguacauuucuguugcuguguuaaaauaccaaggccagaagcaacuuugaaaagggaaaguucaugugggcucacgguuccagagguauaguccauauagcaguggaguauagucuguauagcgguggaggcaugcagcaggugguuggaguaagaugcugagagaucacauuuucgauuacaaacccaaaguagagugaacugacgugaggugaagcauauacucccaguccuuuucccuugauacacauccuucagcaaggcuaugucuacuaaaguuuccauaacugccccaaguuucaccaccgacuggaguccauaucuuaaaauaccugugccuacgaggggcuuuucccacucaaaccacugcauucuccucucuucugagcuuuugucccaguuccccauugaugaaaccacugauuggaaaaucacaguccauggaccacaucuccccacugccugccuggguaaauaaaguuuuauuagaacccccaaagaaaagcagcauauuugcaugaguuauucucuuggaaauuucuuuagauaaaaaugaacauuuaugguaucuccucccaccacagcgucccaguuaaaaaauguuauuuuuuugagagaggguuucauguagcucaggcuggcucugaucuugucagguagcauuauguagccaugguuggcuuugaacuucugauccuccuaucuccuguaugaugcgauuaugggcauugcccucacaccugauuuuaggugguacuagggguugaauucugcuuuguuuucuuuguuuuugcaagcgaggcaaagcacucugucaaaugagcuacaucuccuacucacuuugccugauuuuguggugcuagagauccaaccucaggcuuuagucaagugcugugacagucagcugcguguccagacuuguggcuaaaguucugaucuaauugagaggaaaacacacacacacacacacacauacacacacacacacacacacacacacacacacacacacacacaauuuacagcuagauuugccuuuguaaauuuauauauuuauagcaaaaauuacauauucuaauuugccuauguuaaucaacaaguucugaaagaauacagguauuguaaugacaaggaauuucuuucucuuguagugauaccaaucucacacucaacucuuuuuguuuuuuguuguuuuuuuucugugaaaggaagauucuugcugagugaaaaccaaugauuucuuacucagaaucauuacugugaugggagaaggccagcaguaggguuuuacugcugccaaauaugacugcauaaagauuuauuaaacagggcguggcuugcucugcaguuuaguuuggauuuugaauguguggguuucgagauaagcgucugaguaaaggauacuuauuucuaagcaguccacgcagcagcuuucuguuugcucucgcugaggucugacugcuacuacccagaagugagguugaguggauuauaaaaaauuacgauaaguaucguauacauuuaagauguacguugguuauacuuugccagaacuuaagugacuuguuuaaccagauggaaugguggugacggcaguaucuaucuagugcugccucccucgcuccccggcucucugcacgccccuuuuuugauaucgcuaaacuaaaucugucaguuccuugaaaaagcaagguggaggguuucuuuuucuuccuucuuccucauagcuuacucuugucugucugucuucucuuccaacuccuucugggcacagaucuccauuuucugcugggacuuacuuaggugucucacagacagaggcaugggacggacugagaacugaguucauguuuuccagggaucugcacuccucuccccuacuugcucgacaagcaccuucgaaugugaagaguuggauguuguuuuucuguuucucccauuucuguguucaaauccuagguguugucucucucuguucauucuacuaacuguuucuuucuuucuuucuuucuuccuuccuuucuuucuuucuuucuuucuuucuuuuugauuuauuuauuuauuauauaugagugguugcugggauuugaacucaggaccucuggaagagcagucagugcucuuaaccauugagccaucucuccagccuucauucuacuaacuguuucuuaacucuuucuccaucuccuuuggcuaauggcgcucgcucaccauccccuccuugagcguuuuuuuuuuuuuuccguuuuuuucuuuaauucuccaaagucaagacaguccccuuuccuaagguuuuaaauggaacugagauaaaacugaugguuuuaccaugucugaaaggaacuucauggcuuagcuuuugccagacucccagguaguuauuuugggccacuccuagcuugcucucuaugcuuagugauaccucuugucucuucugucugggaggcuaaguucuuuccuacccaggaucauuaugcaguauuuaaggugucccacccuccuuuucaucgcccuuucucaccuccccuuucccuuccuccuacagcaacuuccuagaugcucucucuccuaagcagguuccuccucucaagucacugugcaguccguagagauuguuuccccggaguacuuuaucucuaaaagaucuuuuuccauuccccugacaccuuccuggagagaguucccuuucccuaaaggaagucuuuccccuccauuccuugaagguaacuuuccuuuaucuaaggaaggccugccaucuucacugccaagaaacccucucccuuggccaguuguuugucuccuucagagcaaugucgcaugcuuuguuggcuggauugguuucuguggagaggacagugucuagaccaggcgucuuuagugccagaacugagccggaugcagcaaauauguucaagccuccacauuaauuuuugaaugagaagaaaacaaaaaguuagcucaggaguaguggugcccaugguuuuaaucuugguaccuggaggcagagaugggggcgggggaggaucuccaugagcgcaggaaggacagccauauuuugaggucuuuuuucaaaaacaaaaacaaacaaagaaaacccccacaaaaauaaaaaacaaaaaaaggcgagguggguggcaggagaaaaauaaaacuuaagaaaaaaaaguacugugugugugugugugugugugugugugugugugcgugugagugcgcguguaugaggacuauggugaacauucagggagaacagaggacaacuuccaggaauuaguuuuuuuucuaccauauaguuucuggaaauugaacucgggucuucagacuuggcaacaaucaucuuuacuaucucacugguccaagaaacugcauguacuuaaaauguauaguuugggguuagggaaguagcucagaggauaagagcacuggcuguucuuuuagaggacccagauucaauucccagcaucuacaaguagcucacaaccaucuguaacuccaguuccagggcauucaguaaacacucucuucugaacuccauaugugcaggcaugaguguuguacacagauauacaugcaggcaaaacacucagacacagaaaauaaauaaauuaaaauguacagcuuggauaauguacauuuuuaagugaacgcaagagaaauuaugucauagugggggaaauuaugcuuccugaaaguaguuuuuaaaaguauuuguggauaauaucaaaagaauguuggucguaaaucauauuauaaagaugacaaauuugugucauuugaaguaucacccggcuuuuguguuuuagcaggauguuucuccuggugggagcccccaaagcgaacacgacccagccugggauuguagaaggagggcaaguucucaaaugugaaugcucauccagccgccggugccagcccauugaguuugauucaacagguaaaccuugaugcuguuguccggucucuugauuuaugccauuugguuaguugguugguugguugguugguugguuuuggagacagggucucacuauguauucuugauuagccuggagcuuguuauguagaccaggcuggcuuugaacucacagagcucugccugccacucaaccuucugacaacagugaugccaaaggcuuguggcaccauacccggcccauuugguccuuuuucuugucuuguuuuuauuuuuguuuuaauguaacaacagggcuggagagauggcucagugguuaagaacacuuguggcucuugcagaggacugggguucaguucccaaggacccacuuggcagcugacaaacauuuguaacacuauuucugggagauccaguacccccuucuggccuccaaaggcacgggucaugcacaugguauacauacaugugugcagacaaaacacuuaugcacauaaauaaagguaaguaccaccuaagccacaucaccaccccacguccacggagagacuuagcuauagaaauggucuguacguguuugcuacagcaguucugugagucuccauugcuuuggaugucuuccagcugaagcuuacacuguccauauguagacaucuugggaaaaucuacuaagacaagucucuaucuccucagggaauagggagcucucaagaacaggagagguuucugcaguuugacugugagccaaggugaggcaggauucacugauuacugcagauuaccccucaacucaucaaugauucccaggcuuggugugaugcaaaaaacaaaacaaaaaaaggaagaacaacaacaaaaaaauaaguugagggcuggugagauggcucaguggguaagagcacccgacugcucuuccaaaggucuggaguucaaaucccagcaacuacaggguggcuuacaaccaucuguaacaagaucugacucugucuucuggagugucugaagacagcuacaguguacuuacauauaauaaauaaauaaaucuuuaaaaaaaacccaaaaaacacuuguaccaaaguaaaaaaaaaaaaaaaaaguugaggaaugaucuugaguagguaaauagauuuaggugacaaaaaaaaaucauaaacacauuuuuauuuaaaagguacuggaaauuuauauuguauuacugauaacaggauaauuuuguuuuucgaacaaauuuuaaugucaaucaagguguuggcaauaaaagaaaaguggaucuaaggaagaugaguuauucagauuuuauauucacaucguuagaauaaagcauacagacuccuauauacauauauguuggcauauuuuuuuuggggggugggagaugcugaagagauggcucaucacuuaaaagcucuuguuaucuugggaggucuuggguuugguuuguuagcacccacaugguagucaacaaccaucuguaacugcaguuccaggggaucugaugccuucuucuucuuuuuuuuuucucccccgagccaggauuucuuuguguaacccuugcuguucuggaacucacucuguagaccaggcuggccucgaacccagaaauccaccugccucugccucccaagugcugggauuaaaggcgugcgccaccacgcccagcuucugaugccuucuuaugaucucuguggguaugaggcaugcaugugguauauacauaacugugcaguuaaacuguauagaugaauguggagacuauccacauagcaggcuaauauggucuguuacuucuggauuguauucaagccaaucuuagcucccuauugcuggugucaaagcuaucucaacccugguuucuuucuuuuuuauugcuggagauugaacucaggaccuguguguggaaaacaugaccacugagcuuuuccucuaucccuagaugucuuucaacaacacaggguuauuacagccaguccuagaaguuagauaucugcaauggaucucacugggcuacccugcauuucucucggagccaauagcggggaaccuggagcuucuggcuucuuccuucagcuaaggccagcgguguucacaggauccagugcugccucccucuacugaugcucguccuggcccuucuuggacacacccagacguuggcggaugaugugacugaucacaccugccaagucuuuuauuaccuaggaagguucugggaaguaggacguacaucucgguuggagugguguuauucuauuggccggaaucucuuuacauguuuuaaaagucgauauugguuaugcugaaggcugcuuccagcaagagcuguguuuauauaaguaggcucagcuccuucucucguucuuuuucuguuggcagcugugguuacuuggaaagcaaacuugacuuagaagacugggauucaggcucggauacuuacugggugaccuuggaaaagugauuaacauuugcucaucgcaucagucuccuggguugucagagaaagcagaguugucauguagaucaaaggaguccacggcuugaauucacuuucuagauagcaaagugcuaugcuacacaagggaagaauagauuguuuauuacagccuguuacuagaucugggugaagaguaaucaugaaaaaggaauuacaagaaaggaaagaaauagagauaauuguggcuguugaguuaugucuugguuuacaacauauucucuguuauugugacuuuuggcaaaacccucuuauugccacguguuuuccuuuuccaaggaagcagauguuacuaacagacugaucaguacccaguuuuauuuauuauaaaaagagucuuuuccaguugcaaguggccucaugugccucuuauuccagcccugugguuggcagagacaggagggucacuggggcacgcuggcugccagacuagcuucagguccagugagagacccugucucaagggaauaaggcagagagcgauaaaggaggaccaggccucuggccucugcauacaugagcauggaugugggcauccacaccucugaaagcauauauaacacaccgccacucccuccccuuccaugaucauggucuguugaucuccacuggggaaggaacauugaucuucacuggggaaggaacacccuccucuuuccuuggaaauacaggcuugacugcaagcuuacgaauagggucuuuuaaaaguagaaggaucuaacuucauccuagagaaggucagauguaagguuccccuuuucacccugaacauccuguuacugcaacgcucaagcguguuucuagguuucagcugcaggcagcggacaagccuggccaggcagacucucauccagaagaaugcgguaaaguuauucccccucccacuccucccccauuccuaggcuuugcuuuaaauaacaaauguaaaaauggccuccgugguguacacuccccagcuuauugaagcuaauacacuuagguagacuggaaaacagcuuucugcaagucuaacuuccuccuucuggugaguuuuucugucuuuuagagauaugucuagauuguacauuuauaguagccuuuauaaauuacaaaguuaaaacaaaugaaacauaguguucuuuugcuacagugugaauuuagaguaaagauuuuucuuuaaugagcauguaucuuccgacagaaucagucaucuccugguucagaacugugggauuggagcaccuuaggaauacauacuuuuaucuaguucuuuuuuaucgauuaacauauagcuaauaauaucuuauuuaauaucaguaacauuugaccaaccaguuucacaugaucccuuuaaauccuacuucucacaguuugauccgacucauguccauucauucgcucaagacugggguugauuuuauuuuauuuuucuuuucgaaucuccaguaaagggauuuuguuuguaacuguuugaaguucuccggaucacuuccuccccaacacuagcaggaaacaauccagcauugagagagcagucggcucacacaagccuguguucuuugugcuguguuccugcagaaccucggagaugguggcuggugggaugaggggggaagagucugaauaaggcuaaauaaacagugcugguacccagaaaaaugagcuccagccuguuucuuccggauacacuuugcugacucuucuuguuuaucuuuagaggauagcugucuuagguaaacaauguuuccagauaguucuguggaaauuaguaacagcagccagcuucgguagggacacauagaguaugagaggaggaggggacaugcaccagccagaucagcugaaucacccuggugaccagcagaaugacagcugacagccacauugcucccaaagguguccuucaccaagagcagcagaggccuugggccucauucccggcugcaucccuaccaucuagacagaggauuuuaaugaaugaucaaagggcuuucuuccucugaccuugaaaguuucacauaaauaauaacuucuauugagagguuuuuuuuuuuucuuucucacccaaauuuauuuuuuacuaauauccaaguugaaguuuuauuuggaguagaaaacugcucgaggaagguuuuuuuuugguuuuuuuuguuuuuuguuuuuuguuuuuugguuuuuuuuuuuugguuuuucaagacagaguuucucuguuuaauccuggcuguccuggaacucacccuguagaccuggcuggccucgaacucagaaauccaccugccgcugccucccgagugcugggauuaaaggugugcaccaccaccgcccggcgggaugacauuguuuugacagcuuguuuuagcaaacaaaaaccaacaaauucucuaaggacccaaaucaucuaguuauuuacagaacccauaguaaugaauaggaacccaauggccgaaaacacguuugacuucuaaguagaagcuucucucguauuucuuuuggauauuucagcauuucucauuuaaaaagagugguauaaucuaguccaaaagauguucuuuagucauaaagagaagagaaaaaacuaucuguuuuaggguaccaggguaucuucaucuuaaaauucagcauaauguuaaugauaguuuaguucuccagcaagcugaacccucaugucugggcaguggcuugugaaacacucuggagagcauucgauacucacacugacugggugcuccuguuacggcuucugcccugaaggaaacaugcccuccugggaguuugguggggcacaaagaacauauuuuggaagauuguaaaaaaaaaaaaaaaaaaaaaaaaaagaggguuuaauuuucaagucucuagugauuugcuucaugauuuuauauuuauuuuuauuaguuuuaaaauagaguuucucuguguaguccuggcugucuuagaacuugauuuguguauuagccuugaacucacggaagaucugcuugucucugcugggauucaaagcaggccacugugcacccccccccccaaguuuauuuggguaauaugagccaguuguccaacacauuugagguaaaaaaaaaacaaaaaacaaaaaacaaaccaaaacaaacaaacaaaaaaaaaccccccaaaaaacaauguuucuuccagcccuggaauccccgaucuguauuuuauuuccuuuuuaagaguggcaacacaguccagcagucugggugguucagcauagugacagcgggacagcagcgacuucggggcugugacucaaaauauuuacuucccucauguguuccagaguggcugccaguccccgccagguccugaaugagcugccuguggguuuguuuggagagcggccuuuccuugcuuucucccgcccacucuauucacacuuccuuucagcggggccacugucugauguggacucuaguauuuuaagacuugggcucuuagugaagacaaacuuccuuugcagcaagcuucuugaaaggauggagaucuggagucguggcuguugaagcuggaggcaguuagauguaguagauggcguguauaugugugcauuuuuaugauuauugacuuaacuuuggguguuacuauaggccagugcauauaucagcuguauuuaguaauguaauuggacauuuggugaagauuuguguguuuggguguuucgccugcauguaugucagugcaucacguguaggaacuucaaccauuggauccccuagaacugaaaccacagauggucaugacccgccaugugggugccaugugggugcuaggaaucaaacuggauccucuggaaaugcagccagugcuuuaaagugugucaccucuccagcuuuggaacugaaaacauugaugcauggugcuuuaaggcauggcuguugauucugaacacuccuccacuucagagaagcucuauguuguuuuggaaugagugcccuuccugcugcccuacuuccucuaagguaguaguuuucaguugagaccucuuuggcaacucuuaucuuuaaaaguacuuauacuacaauucagagcaguagcaaaauuaugauuacgaaguagcagugaaacagguuuaugguuggggggucacuacaacaugaagaacuguauuaaagagucacaguauuagcaagguuggggaccaacuauauuaagggucacaggucaggcaaguugagcaccacugcccuaaggaagccaggccuuuuaauauuuaauguaauguaauuuauuuauuuauguuuugaagacagggguucuacuugcuugaacaggcagcccucagacucuugauuuaccagccucgguguccugagugcugggguuacagacuugcaucacaaugucugccuuaaauuaguuuuuaaaauuucugcuuacauccaaaacauaugucugauaucugaugcuuuaaaaacaaaacaaaaugaaaaaccucugaccaguauucauuuguucuuaauaagugguaaauauguuuucauauggaaaagaacuauggauuuuaaacugguugauaagcauaagaccaaaaauauagaauuugcauguauuuucugugacuuuucuagcuuacauuaaucuugauauccacagagacaagucccugagaagcauuauggcaggaaguaucuuuuuuuccuuuccuucuuuuuuuuguuuuuuuuuuuguuuuuuuuuuuuuuuuuuuuuuguuuuuuccagacaggguuucucuguguagcccuggcuguccuggaacucacuuuguagaccaggcuggccucgaacucagaaaucugccugccucugccucccgagugcugggauuaaaggcgugugccaccaugcccggcuccuuuccuucuuucuuuuugaguggugguggcacacgcuuuuaaucccagcacuggggaggcacagacaggcagauccuugaguucgaggccagccuggucuagagagugaguuccaggacagccaggaguacacagagaaacccugucucaacaacaaaacaaagcaaaaccaaacaggauucccuccccucccucccucccucccucccucccucccucccucccucccucccucccucccucccucccucccucccuuccuucuuucuuuucuuccuuuguuucuuucuuuuuauaacauauaauauauuuuaaguggaacacagacacuuggggaugcacaugggcuucuccaugaggaucuuguccacagcagugggugccucccauguccauagugagcugcacagaggcaucugcaucuugggaacuaaacaggagaaacccuuuucaaacaagcggaagaaaucgcugcagugggaaaggcacaggggaagacugcccuggaucuaggacagccucccuuuucacuguaugauucauuguaaagaggaagugagcucugagaaaaauaucugaaguauucugguaggggggagaaggcaguucuccaggagcuccaggcucuggguaccagcguggcucuuguacugacuugggcuuucaggaacuguuccuucccuggugucagugucucgugcaugcuugcucccucucacccccaugucgcugcacacccauacagcauucuggaggaucugcagcagacauccugaaggucauagccuccaucucgaguuaggcugcugagguuuggucauucuuagucagcaguggguugcugacaaacauccagaagaagggcugcagucaaccugggugcggucauguguacuguaggacccgguggaauuggaacuggcaccagccagggcaguggucacagcaguagacuagggguuguguugagccauuuacacgaagucaaaggggccccauccuuccaugucucuccuugcgauguuugugacagcuucugaguucuuccaucuuucucccucaaaaccagauccacuuccccaaagcccaaacucuuuagcucauguucaauauccucccaugugucagcacaugcccugccucauccuuccacauaggcacugccuugcacaucuccccgagguuugccccauccaggugauggaaggccuuuagcugguggugccauguccuccgccucugcagcaggcugcuuugagagaaaggcagaggaagcaaaccuggcaggccaugacguugauucacucugaggucccaggauccaccaggauaucuacucacucgaaacaguaacacugguacagucagggcuauauaagaacugggagucccugagcaggagauggagcuagcucuaguucagguccucacaggaaaggaagaggguuuccaggaacuuguccuuaugugggaaacaugcuccucccucaaacaagggcugcuacacguacacccuacccuggagacuuccacgacaggcagauagaugucuuugauguucugucagcucacggugacuuaucacuugaugaucucucugccuaggaggugaggcugaggacagcaguuuccuggagucuaccaguaucacguccaugauaugaucagccuucaggcucaggaaggguuucagcuauugcucuuccagguggccgacagggucaggggcaaagcuaucuggaaucaccauguuccaagagagagggccuuggagcaagagaaaggugccuccuaggaaccacugauguugucugcuagaaggaccuguguaccggggaugguauaggaagagguauuuuguauaccauuuuguuuuauauuuuauuuuauuccuauacuguuaucaaagucauuuauuuuuaguuauauguauuuuugaaugucuguggguggguaugcaccauauguaugcaggugcccuuggauguuauuggaucccaugaggcugugagucagcccccauggguacugggagcugaacuuggguccucuggaagacuagggcaugcucaucacaucugagccauuucuccagcuguuucuaccuugucagucuguuuuguaaggagagugagaccaugguggcuguuccaagcuucugcuacuugacaguguacaacaacauccggugcuaccauauacaaacuuaaauaaagcaaaguauauuucuugagaaaaacauuuguugagacaguuuuggaaaguagcauaauuaaacaaaauuuuacaaagaggaauugucuucuaaacauccaggccuaaaauaauugaagaaaaauggcuuagcacagggucauuuucagcaugaauggagggcguucuuuagcacaguggaaaggcccuucacaauucuuuuccugacuuuuccuccccugauguagagaacaacccuuaauucccuuagaauccaggaaugccuacucuuuuauuucuuugcauaaaacuuggucuagagcagugguucucaacccgugagucaugacucuuaugggauguuguaugaccuguacacagggcucaccuaaaaacaucaggaaacacauuugcauuaugauucauaacaguagccaaauuacaguuaugaaggagcaaugaaacuaauuuuauguuugcggccacuauaacaugaggaacuguaugcagcauuaggaaaagccacugaucuagaagguauuucuuuguugguacuguacaacuguauucguagccucucaugauuguauuguaguagacaugcguuucuauaaguauaugcuggguuuucagguagcauuauuauuucaaguggaaggaaugacguuucccaugcaaaugagccuugaauacaaaggcuguguauagaaaugagacuaccuaguuccguggacugaagacaggcauaggguaauauguauuuuaguaguaacuuaaguguaucugagauauuuggcuugaaauaccuauuuaugggugaaaaugcaugcuuuaugcucacgaaagcauucuuuaggagagaagccaaaaaugucagcagaggucauuucuuugugguguuuaggccucucuuuacguacagcucuauuuugcuacccuuugccauuccucgggauucccuguguucugacgucaguauaugccuuuaugauauggcaggaaugccugggaguagaacagguggccacagaguuuguuauaguuacucaacaauuuagggaauuucacuggaaaccuaccuuaugaugacguuuccacaucugugauauaauugauagugcuugcaguaaaccugacacacuaacaugcccuuuucuuucuuuuuaauuuuaauauuauguguauugguguuuuuuccugcguguaugucugugcaccgugugugugugcagggaucucagaagaggacuuccuggacuagaguuacagaugguugugaguugccaaguggguccugggaacugaacucuaguccccugcaagagcagcaaggaccuuuaaccacugagccaucucugcagcccccacacuuccuaauuagcuaauaauaguccuaaguuauguaaaguacaggagauacugcaguguaggcaaagugacuaaucaaagggacacuuuguuuguuuguuuguuuguuuguuuuucuuuuugagaagugaucacaguauguagcucuagcugcccuagaauucacuuuguagaccagguuggcuuugaacucacagaaaucugccugccucugccuccugagugcuggaacuagggguuauggccccugcacaccacaaagguacacuauucugaaccuggccggauagaaauagauucucguguucuagaacagucugacuuguuucugaccacacacacuguucuuuuccaggcaaucgagauuaugccaaagaugacccacuggaguuuaagucccaccagugguuuggagccucugugaggucaaagcaggauaaaaucuugguaagucuuuaggaacuaccucagcugaggggggccgguuuauguggagcacaggaagucuuguauguucaaauugguagugaaauuuggucuggccauuggugcaggccucugaucaaaggugggccaugggagcaugcuguuacucuccccuccugcuguuucccagguuucugcuucugcagccugccugcccacacucuuucucucuuccugcucaguuugauagucuccguggugccauugaacaaagucaaauccuguuuucucacacaccuuuuauuuauuuauguauuuauuuauuuuuuuauuuauuuaagcauaauucuuuguugauucuuugugaacuucacaccuuacaccucaaucccacucaauuuccaguccuuccauauccgauacuuucuacccuuuuaaccaccccccccaaagaaaauuaaaaauuaaaacaaacaaacaaaaccaaacccugccgcgugcccuuuacccaaucaucuuugcuuguaaauauucauugcgaugagucaucggucucauuugaggucuuuggcuucugcuacccuaucaauacuggacccucucagauauccuguuguugccuuuugucuuggagauccugcgggaccgggucucuucaugugcuccagcagcucauagcugggguugauguugggcugggccaacucaagcccugaaucugggucugagugguagcugaguuggucagcugaccaacucgcccacgcccacgccaccaggccaacucucucgcacugcugagguaagggcggggucagcucuucuguauccucaccacuggugccaccacacaguggcuggugaggggugggaucugcucaccaugguccucagacaucagcaugacaucaggcagacugcugaugaccacugcauggccuuaggugguaacgugagccauggacaucgacacagaccucugcugcaguaggaccacagacccugacauggcccuugguggaagcacgaccuagaaauuaucauggccccgggugccacucgcuacucaccucaggcuguuccucaccacacuccagcucagccucuucauggcacagaaaccacuccacuucucuuucucccccaucucuccaccacauauuugcucaucacaguggugacugccugcccauccuuuaaaaaacgauuuuauguguacgaguguuuugccagcuuguauaucccugcacuucaugcaugcagagccaauagaggucagaaaaaggcgucagauccucuguuacuggaguuauagaugauugugagcggccauguagguguuggggacuuagccugggucccccggaagagcagccagugcuccuaacuggagagccaucucugagccauuuccacagcucccucuccuucccacaguuuuaagcucccucuauccccccuuugagacaagauaucacucuguaacagggcuguacacacagucuuccagguuccaagauuauaaguacaugucuucaugccaggcuuaguccuuuuugugucuuggguuuaugugacacuguauaucuauauauuuuuuaaauuuauuuuauuuuuuauuuuuuaacauauauaagaaauaaauggaagcaaaaaagaaaaaagaaaaagucuuugauaagauucaacauacauucuuuuuuuuuuuuaaagauuuauuuauuuauuauauguaaguacacuguagcuaucaucagauacuccagaagagagagucagaucucguuaaggaugguugugagccaccacgugguugcugggauuugaacucuggaccuucggaggagcagucgggugcucuuacccacugagccaucucaccagccccucuuuuuuuuuuuguucuuguuuuuuuuguuuuuguuuuuuugagacaggguuacucuguguagcccuggcuguccuggaacucauucuguagaccaggcuggccuugaacucagaaaucugccugccucugccuccgaagugcugggauuaaaggcgugugccaccacuggccggcucaacaugcauucuuaauaaaagcccuagaacaaguaggacuguaggaaaccuauuccaacauaauaaagguuauguaugacaaacccauggccaauaucauccuaaaugaaugaaaccauuaauaagccccauuaaaaucaggaaugggagaggacuguccacugucccuacugcucauccauaaugugauugaagcauuagcuggagcaguaagguaagagaagggauacaaaugggaaaauaucaagucaaauuauuuucaauugaagauuauauuaucuuauauccaauguucccaaaauuugacuagaaaaauuauagaaauuaucaauaauuucagcaaaguguuaugauacauaauugacuuacaaaauuuaccagucuuaauacauauggguaacaagcaugcugagaaagagaucauggauacgcucuucuucccaguuucucaaaucaaaucaaauauuuagaauauacauaacaaaauggguaaaaaaaccucuacagugaaaacuuuaaaugugugaagaaagaguugaagaaacaugauaauuugaagaccucccaaguguagcuugguagaauuaacauugugaaaaaagaccuucuaccaaaacagcuuacugauucaaugaaaucacaaucaacauccucaucucauucuucucauaaauagaaagaaaauccucaaauugauauggaacaacaaaagacccagaauagccuauuauuaguccuagauaaguguuuguuucuaugccuucugcucguuuuaagugcaucuguuuaugaccccaacauauauauauauauauuucuauugaguccauuuucuuccauauuagaauggcuaccccagcuuguuucuugggaccauuugcuuggaaaauuguuuuccaaccuuuuacucugaggcagugucugucuuugucacugagguggguuuucuguaugcagaaaaaugcuggguccugauuacauaagucuguuaguuuaugucuuuuuauuggugaguugaguccauugauguuaagagauauuaaggaaaagugauuguuacuuccuguuauuuuuguuguuagagauggaauuauguuuguguggcuaucuucuuuuggguuuguugaaagacuucuuucuugcuucuucuuucuuuuuuuuguauuuuuccuccuuguguugguguuuuccaucuauuauccuuuguagggcuggaauuguggaaagauauuguguaaauuugguuuuuucauggaauaucuuguuuucucugucuaugguaauucugauaggucugccuuuauauguuacuugaccuuuuuccuuuacugcuuuuaauauucuuuuuuuguuuaguaaauuugguguuuugauuauuauguaacgggaggaauuucuuuuugaguccagucuauuuggaguucuguaggcuucuuguauguucaugugcaucucucucuuuagauuagggaauuuuucuucuauaaucuuguugaagauauuuacuggcccuuucaguugggaaucuucgcucucuucuauaccuauuauccuuagguuugguuuucucauuguguacuggguuuccuggauguuuuggguuaggagcuuuuuugccuuuugaauuuucuuugacuuugugucaauauuuucuaugguaucuucagcugagaaucucucuucuaucucuuguauucuguuggugaugcuugcaucuaugacuccugaucucuuuccuggguuuucuagcuccaaggccuuuuuccuuugugauuuauuuauuguuucuauuucuauuuuuagaucuuggaugauuuuguucauuuccuucuccuguuugauuguguuuucuuguaauucuuuaagggauuuuuguguuuccucuuuaagggcuucuagcugcuuaccuguguucgccuguauuucuuucuuuuuuuaaaaaaaauuauuuauuuauuuuuuauuaguuauuuucuuuauauacauugcaaaugcuaucucgaaaguccccuauacccucccuccgcccugcuccccuacccacccacucccgcuucuuggcccuggcauuccccuguacuggggcauauaaaguuugcaauaccaaggggccucucuucccagagauggcugacuaggccaucuucugcuacauaugcagcuagagauaugagcucuggggguacugguuaguucauauuguuguuccacuuacaggguuacagacuccuucagcuccuugggugcuuucuuuagauccuccauugggggcccuguguuccauguuauaguugacugugagcauccacuucuguauuuggcaggcacuggcauagccucauaugagacagcuauaacagggucucuuuagcaaaaucuugcuggcauaugcaauagugucuggguuuaguggcugauuaugggauggaucucugggugggguagucucuggauaguccauccuuuugucuuagcuucaaacuuugucucuguaacuccuuucauggguauuuuguucccucuucuaaggaggaauaaaguauccacccauuggucuucccucuucuuaauuuucuuguguuuugcaaauuguaucuuggguguucuauguuucugggcuaauauccacuuaucagugagugcauaucuaaugacuucuuuugugauuggguuaacucacuaaggaugauaucuuccagaucgucuguauuucuguaagggaguuauuuauguccuucuuaaaguucucuauuaucaugguaagaagggauuuuuagauccgaaucuugcuuuucuggugugaugguguacccaggacgugcuauguugggagaauuggguucugaugaugccaaguaaccuugguuucuguugcuuauguucuuacgcuugccucccgccaucugguucuugcuacuucuaccugcccuugcuauaucuggcuggagccuguccuuccugugauccugguuguguuagaacuccucagagucaagcugucucugugauccugugauccugagaucccggguguagcagagcuccugggaguaaagcugccucuuggaccgugagguucuggugugaucaagccccugggauucugggauucugggauucugggcguguuagaggaccugggaguggagcuuccucuggguguugugggacuggcugcagagauugggcccaaguucugcucagggcaccaagccagacuggaaggaaccggugccacugaucaggcgggauaccugcauuccuggauccagcuugucccaguuacuccuggugguguugggacagauguuauguccuccucaccucugauccuacuauuccugggugcuuuagaguuccugggaguggagcuuugucuggguguugugggacuggcugcagagaucagcccaaggucugccagacuggaaguauuaaauuuuauuuccuucuauuuugcucacuuuuguuuuuuguuuugguuuguuuuuuguuuguuuuuauuuuuguuuuugguuuuuuuuuuuuuugagacaggguuucucuguguagcucuggguguccugaaacucacucuguagaccaggcuggccucgaacucagaaauccaccugccucugccucucaagugcugggauuaaaggcgugcgccaccacugcccggcuugcucgcuuuuuaaaugucucugguaauacuuuuuuugugagcauccuaaccauugggguguuuuugagcucuacuaagucucuauuguuuucucuaacuaacccauuuacccagagguuccuuucauuuuccaugucugugaauacaaucuauacauuacacucuccaauaucucuagcuauuaguuggccccaaaauuuuaaauggguacuccuaacuuaugucugcuauuuuuuauuugucucucuaauagaguacucugaaugaagauggucaaagugggauucuuguuagccucugucaaagagcacgaacaagcaacaggacugacuuaucccugggugguuuggcuucccacucuaucaguggucccuauaaaauauauccaccuccgaaaugcauuucuugauagaucuccauccuugcucuccucccugcagcuaaccuucaccuuugcucaugcaggccaguguaguuguuccuguuccucucugucaguuuccucucauguccaggcuacagccuguucugcagagcaagacuuaagggaaucugcaauccccccuugaugaaaacaguggaguggcuuucuaucucugaauuuuaccagccaggcacauaaacaucccuaagaucaggcucauuguagguaggguuucaguugcugagauaaaacaccgugaccaaaagccacuuaagaagguuuauuucaguucacacuuccacuuuauaguccauuacccgaggagucaggguaagagcuagaggcaggaacugaagcagaagccauggaggguugcugcuuacuguccgggucaucauggcuugcucagccugauuuuucuguggcacucaggaucaccagcccaaggguggcuccacccacagcgagcugugggcucccacaucagugacagagaagaaaaugccccacauucuaauuuggugagggcauuuuuuuuuuuucuuuuucaguugagguucccucuuccaaaaugacucuagcuugugucaggaugacauaaaaauuagccagccaaaggauaugggcugaguuucuguuaccucaguccaucauagcuauuuuagugacacuugucuuuggguuuauuucuuccauaucccaggccauuucaaccaguaccuaguguuaugucccuucuacccggaguguuuuuucuugauuuuuuauucagccauuucauuuuguucaguguucacuuuuaauuucauuuucucagagaguccaucguaguuauuucauuuuuacuuacauuuuuaaaaauaugauaaugaaguaugaaggaaaauucugcuaaaggguugagguuacagcaggacaucaccuuggaggaugacaugucaaguccguagagcggaaggcuaggugugagauggggcuugugagaugcagagauugauggcuggaaaccaagcaggccaugcugcuuauccucccugcaguccaggaccugcagaggggcaacgccuccuguucuaaguuucaccagaguggauaggaaauaguucaaggccaggguuucugucggaaaguuauuauagaaauaugcugagcuuucuucuagcuguuacauuuuugcaaguuuuaugugccauuaaagcguucauuauuagauugcuucugugagauauugaaaucaaacccuuggaaaguucccacaguuuacuuggaaaguacauaggagaagcgcugcaggguacuuuugcuugcugcuuacucgccgucuaacgcagggguaucuccuacacacacaagaauggguuuaguucaaaaggugacucaaucugugaccuucagcucagaaucuagaaauaaugguucaugaaacaagagcucugcugacugcuaaagacaggaaauaugagcuacgaguauagucuucagaaaaucuacuccuuauuguaccugaaaaacuucgaagugacagagaaucugaagaaaaccaacaaaacaaccaaaacaacagcagcagcccuucuuuuagaaucguuauuccugugauaaagcagaggcuggguuugaaguuuucaauguuuagugcucuuguauucugaguuaguauagauacuaggauuguuaguuuuucagaggauucuuguaccauggacuccaccuuuguuuuuuaggccugugcuccauuguaccacuggaggacugagaugaagcaggagagagagccaguuggaaccugcuuucuucaggacggcacaaagaccguugaguaugcuccaugcaggucaaguauguaugaaaagcugcaccuucucuuaacaagagacccuaggagccuaguuuuugugugagaugcaugugugugucuguaugacaaauuguguggacauugugagguuaauagagcaaaaugaccuaacucugcucauacaaagaaauuacaaaugugaauugaccauguuucuaagaacucaguuuggucauccuugauuugugauaauuaauaucuacucuuggaaauauguuguguccaguccuaguuagugaaaagacguuuauauaagcuucucucaaggaggagugggcaucacaguuaaagauuccgagucacuagaucaggccuggcaccuacauuuuaaucaagcucuguaaggucgugcuguugcaccuaaguaugagaaacacaguuguagaugaauaaugacguuaaaagaaaaggacagugaagauaguguuuagguuucuuaagucuaaaucugcuaggcuuugcuuucauuuuugcuucaacuaacauuagugaaaagccugcgugucuguugguugcuccaaugaaagucacacccaggugaugucuugcagguaucauuuggcuacacuuuucucugcauaucuuucuuccgcuggagaucccagaccuuuugcaagccugcuucuuguugaauuucccugacuuuacauucucuuuauaccaaagacauaaaaauagauuguccaagcugggcuguggugauguaugccuuuaaucccagcacuuggggggagucagaggcagacgaaucucugugaguuugaggccaguuggucuacagagugaguuccagaauagccaaugcugcauagagagaccaugucuuggaaaaaccaaaaaaccaaaaaacccaaagucaaccaaacaaaaaaaauaggucauucaaaugcagucuugccuugucuaugaggcauauucuacaagauguuccaucgacaccuaagaccauagguaguaugaaauucuacaugcuacuaaauuucuuugaugaaucauuuauuuuagacaaucucccaaguagugacuucagaacagaauuaauagugagugacugaaacaguuaacaguaaaauuaugccaaaaauggggaacuccagguagucuaccugguaucuuuuaugaugcucaaccaaauaguugagcagacagaauuaaccaguaaagucucaacaggugaaacacuugcuagaagauucaucuccacaugagcugacauauaacauuagaucaaaggaaugacagucuuccaacuacaaaguauuugaaucuccagggaauugcauuuuuuuuuauuaaacaguuauuucuuaguugaccacuugaucauccuaccuacuguaaaugggaaauacacaucaaggggaugcuaccuguguagaaagcaugcgcugccuggguggaggaagucagagcuccauccucugagcuuggugccaucugucucacuacauucgugugggugguuaggucaccguagcauccucagugguaguguguagggaauguaaggaccacuuuaguguuuuuaaugccgguauuucaaaaacacucauuuugaaaauauaacuucauagcucugaggagagagaaugccuuauccugugucaguaaagcugacauagaauacauaaguacaugcauucacaugcgugcacacagauuuccgugcaugugcacacacagacaggcacaccaaccaucacucuucucauuugagaaauguggaaacagagacucgggacagguggggcauauuccuccguauauuccaugguaccaaauggucaaauaagaguuugaacccagguuguaauauuuuuuuucuuuuggugcuagaugcugagcucaggucucauguauguuaagcacuuucaccccugaacugaacccccagucugucuuuacuaaccagagcauuugcuuuacauuuccggcgcacgccuuuaaucccagcacuuaggaggcagaggcaggcagauuucugaguucaaggccagccuggucuacaaagugaguuccaggacagccagggcuauacagagaaacccugccuggaaaaaaccuaacaaacaaacaaacaaacaaacaaacaaacaugucugaaaagagcacuuagcgaugcaucuaugugcagcuaguucuuuuacuuuuuuuuuuuuuuuuuuuuuuuuuuuuuugguuuuucgagacaggguuucucuuuuagcccuggcuguccuggaacucacucuguagaccaggcuggccucgaacucagagauccgccugccucugccuccagagugcugggauuaaaggcgugugccaccaccaccuggcuguguagcuaguucuuaaugcuuccauuauuuguuuuagacauaaaaauuaugaaguaaugaagucauuauuuccuaagauacauucuaacuacagugauuugugacuugugaaccugccuuugcaaacaccuuuaaaaaaagauuauuuauuuuauguauauuaguacacgguagcuguacagaugguugugagccauuaugugguuucugggguuugaacucaggaccucugcucacucuggcccugcuugccccggcccaaagauuuauuuauuauuauaugucaaugcacuguagcuaucuucagacacaccaaaagagggcaucagaucucaauauggaugguugugagccaccaugugguugcugggauuugaacucaggaccuuugaaagaacagucagugcuuuuaacugcugagccaucucuccagcccuacaaauaccuuuuuuaugggaauuuagccacacccauuugcuuauucacugucuggaaaguugagucauucuggaguugacauaguuaguauaugaccccuguuuccugaaguacuuaaaugucuggaucuuuucaggaaagguuuguggaacucugguccaagucaaacaucucaaagaaaagcaucauagaacacguagacagaggaaaugccucucuuagcaaaccaggcuauaguacaugcucuuuggucagaccuuugacauaggacauaccagcaggcuccaauuaagaaggcugaaacuuacccagaguggacacugaggaggaguagagcuggaaaaccugggugauagccucggauuccccuggcucugaaccggagcucugggcaaucaauccccuuaaccacgcugagcccucacucccuuauuggaaaaacaccgaaucugcccaagccuuuccgagguacugcuuggcguauguuuuucuuuucuucuguuucuuuuuaaaauucuucucucauauguaaguguccccucucuccccuccugccagcaccguuugauaguucguguucauucaugcuucaguaaccuguacagcgcagagcaggaugguuccaguuuugugaggcugccugcugaccucugagccuuugccugcuuggcuguggcgguuuauguccgugugugcuggggcuggcuuuguuguuguuguucggcuggcugcugaugcauugacuuuuguuucuagcgugaccugcguauacagccuggauaaagagccucacucuuagccucccaauuacuuccuuauuguucguguuugcuuguggcuuuaacagcaauauccauaaucacacuuggccuuaagcacuaaccagaugucugucuguugaaaaccugacacgguguggagacucuuugaacgcuaugcuccccugaauccguugcucccgaccucuaauuuugauagccauauuuggauaguuaagguuucuaguuuuuucuuccacuuuucagauaauggccaucagguugcugaucaaaauagcacagcucaguaguauucauagugccagcugguuggcuguugacaagucacuuaaugccucuagacugggcuucugaacccgugacuaguaaucacagcucuccaaggauuguucugagcuaagugaauagcuuccgguaagugcuuaaugcacgccuguggccucucuguccccaaucacuccuugucauaauauuuccaggcuugacaagcggaaguaguuuuggcuaucaguggagauaaacacugagcccuucacugaacuaagcuguuguauucagagaguuuuuaaauugucagaagcacccgcuuuaguacgugccugucaaggauauuuuaaagaaguuguauuuccaacuggauaucucaggaaaccaaauaaagcagaaaguugcauaguacaaauaaaaaaagcaugucuucauaaacggcuuaaggccauugcccagaugcagcuugaauggaggaaaugcaugguggaguuaagguugaaguacaauuccuuggugugacucacuagacacuggaaaccccaguccacauuuuuccuauucccucuugguuagaaaaauuuacauuacaguaguguuacacuuuuguggccauuuucuuaaaacaacaaaaaaaauuauuuuauuguguaaucuuggggcaguucccagauuuuaaaauuggguuccaagauuggaagggauuguuugcccccccccccccaauucuuagaaguuugacauuaugauuaaaaugaacuauuuuugguuucuauacuugaguggccugacugggaguaacuuaugauguaucugaaaugcaaggaaaacaaauuuuuuugguaacuaaaagauggcaucuaauaaaggaagaauuaaaaaaaaaaaaaaaaaaaaaaaccaaaccugagcugccucucuauucuggguguaguauugcucaugauuaaaguuagcuuaaauuaauuggccaguuacuuagaucagaaucagucacuuuuccugagacuuacaaagaacaaacaaacaaaacagaguaauuacaggaaagcaaauuauugacugcuauaguuggaggacacuugagagccauauuuaaacgaacuuaaucagcuccuaugacuguagcuacagaauaguggcauaguuuacucugcagauaacauuaaguuuggacuuugcaauuuucugaaauucugcaugguguuauuuguaguuuguuuuuguuuuugugauagggucucuugacauaagucugguugucuuggaacucacuauguaaccaggcuggccuuguuucauggaaauccuccugccucugccucccaagugcugggauuaaagaugugugccaucccuucagaccccuccaacuaguuuuuguguuuuaucaucauccgugaaauguauacauaggaaauauauuauuaagacuguauggaugucuuuguuguuuuuccuaagaacuuugcaaagacauagcaacuguaagguaauggggagaaaguauuucaaauagaagacuuaaauuugcagaugaaggcucagugguuguuaagguaaaaugggucauuauugguaucuuuuugaaaaacaagauauaauuguauagagaauguacauuauagagcacauugcaucucauaauauuuugugagauuuuaaguuauguauuuauuuugcauauucucaauguuugaugcauuguaauacaagguauaauauuucugugaguugugauuggaaaaaguaguuuaauccagcuguggcaacaugugccuuaauccuagcacuugaaaaauagagacaggaggauccugaauuugaguccauagauuguauggacaauacaguggaauucuuaggaucuuagcugaucuuucugguccuuggugacuggcccacaugcucuucacagcggugucucuguuuuguaucugggagcagcagaugguccugaugaacagaugaacaugugagcuaguguaacaguagccagaugccugagugagugcugcagagaaaccgugguucaacaacagcagguuuauuucaugcuuuguuuguguuauuugcuuguuuugggguuuguguauauuucccauuuuuuuuuuuaauuuuagaaaauauugaugcugauggccagggauuuugucaaggaggauucagcauugauuuuacuaaaguaaguucccauguaagauagauucagaucuuucuuuacugacucaacuggcuuuaaaaaugcgugcuccuuacuucagcuuuucaagaauuauuguguuuuaaugaaaaaguaugaagugguccguucauuuugauauucguuucuuucauuuugauauucuuugauuuauaauauuauccucuucuucauaaauauugcuuauuuaaaauggugagauagcacagugagacuggggaagguaacuaugacggcauuggaguucccaggggagaugagaggcucagccagugggggcgcuugucacccaagugugaugacuugaguucagucccugggacccacaugaacugacucuacagauguguccucuaaucuccacauguacaccuccccuacuuacgucaugcccaacagaccccacacagacacagagacacgcagauauauacucacaacuuccacauccacacauccucaaacacaaacauucucucucucucucucucucucacacacacacacacacacacacacacacacgaaauuuccacuuacggaaaauuauagacuauuacaguuuuguuuucaacugaaauuguuuuuuuacaaaagcuauuaauaggauuuuuuuuuuuuuuuuuuuuuuuuuuuuacaaaauuaguuuaauugcaugaaagcugagaaacgaaucuguuugccaucuguuuuuuugucuguaggugccaagugaagcugaggcagucuaaucaugguggaaaaucucaugagcaggauucuaauuuuaauuaaacugacaugcuccuuaaacucaauaguuuuuaaucuagcuaaauaaaaaguucaucagcauuuuuaaagacaaacuuuuuaaaguauucuucuuuaugauuuuuuuuguuuacuuuagcaucuuuuuuuuccucagcugucuaaacguguuggauaucaagaugauaauaucuaauauauugacuuaaaguagagcuuccuggcccugggggguggcacacaucauaaucccagcucugaggaagcuaaggcagaugauugcaaguuccuacuuaccuuggcuauacagugagacccuguuucaaagcaaggacacccaaaguaacaauaacagcaauaaauguggaguguaaaguuauaggugcauuuggggagggaaaugaccugccucuagcaagaaaaaaauuccaagacaccaucauguacaaacacaagauaccuugaauuagacccuuacaguuuguuacagauuuuaaaaaaaugcuggugucuuuacuaaaauuuucccucugaagccacguaucuuuagguuugugagauacuaaaauaguuuuucuuuagcagaacauuucuuagagaucauuagaaaauuuaucuuaaguaauuguagaucuacuauaggaaguuagcaaacuuuuucauauugcaaucaaauaauauucccaccaguacuucauucugaauguacagaauagcccagaucuucagaaaaaaauguuucuguguuagaugaaguuauuacauuccuucuuaauuccucuuggaaguuacuucauacugcugaagcugagaugcugaggcaacagcuugugacuuaauuaugauguuuuuagucugugcauaaguaccuguaaugcuuagugcacugagggcgggguccaugcucaugguuuuuaagcaucgcacuucuguucugugauuugaucuaggcugacagaguacuucucggugguccugguagcuuuuauuggcaagguaaguucagaguuuucaaaugaauacuagucuacucacaugcccaugguauauuucaaauuauacuaaaaaagaaauagaaaauguaauuuaaguauauaaauuaucugguauucaguauuuuuaggaaauaauuugauguguauucuauggugaauauuaaaugaacauauauuuuagauagaaaacaacaauuuuaaaggugaauuuaaaguaaacauauagaguaauuuuuaaaaguuuguuuguuuuguuuuuguuuuuuguucuuuugguaagugguuuguauuuuauuuuuauaauccagacaccauggcauauacauuaguaaguauagccugcugaaagcuagguguuuucaauugcuuauuagaauacccaaaugauugcuuuagccuuucuaaucacugcccuugagggcuuuaaagguuagaucuuagcuggacauagugauccgcaucauuaaucccagcauucaugaggcagaggcuggcagaucucugagaguucaaaacaaacacauaaaaccucaacuuaacuuuuaaaaaguaauuaaauugguggugauauaaagauaaaacacuguauccauucuagaaaagucuuacuacaauagccaucucauugcugacauuuugagggagggagggaaaaaaagagaaaucacgaaguagaaacaauguuauaagacauuguacacaguauauacaagacuaaaauccaaagaguaucuucauuuguuugauuuguuagagauacauauuuguguagcuaauacgcuccuuguuuaguuucuguuauagagagcuguucaccgggucauagcucuccuuuccuaacaguccaguguaaggggcuuuguuugcaagcacuagaaaggacgugaugguaucuauuugaaagucuuuuucacuuugacuuuugcuuuuucuuucacucugauuuuccguauaaggcucuuucugggaaacucugugcuuucauuccaugucuagacagagauagagagagaagggaaaagcgaucaguguuggugcacaccuuuaaucccagcacuugggaaacagaggcaggcggaucucugaguuugaggcuagccuggucuacagagugaguuccaggacagccaggacuauacagagaaacccugucuuaaaaaaaccaaacaacaauaacaacaaaauaaagaauaaaugaaaaguugagaaaacaucuagaaaaaccaggcaucaacagcaacagccugggccacucugagaaacacacuagcuaagacagaaaaguguguguucugugaguuaugcagcuauuggaaaguggugcucaugaaaguuuuaauuacauuuuauuucugugaaacaaaagcagcauuuuaagaaggugcaaaugaagaaauaagggcugcugcuuucuuguuaggcagagcugcucugacagcuuccauuuauagccuggagugugccacuuccugauggaguacuuauaggccuguggggcuucaaccccuagcucccaggucaggggagagaaaacguaauaccaagcuuggguuuguuuuucuucuuacuaagcaugccuuaaccuguuaguguagccaagcgaguagaauuuggguauuucuuccaaacaacuaugaacgaagcuagauuuugugauucucaguaucccacuaacuuaagacaccucuucuaagauguauugacguauugauaucauguuuauauaacaggccugcaauauacaauuaaaaggcucaauucacagaggauuauuuuacacaaggguuuuuuuuuuuuuuugguuguuaagaguuacuugagacugacuaguaauuagaaauaguaaugucuagccaggaucuguaggaaccccagcccucagagcugaggcagaagaauugaguucgagaccagccuggaguacauagugagacccccaugccacgaacagcaaaaugaaaugaaacaccagaaauaauaauaucuagccagcacuuuguucaugaaggcaccacucugaaguucccuugagagggcuauuucacucauucuugucuucccuccaccacaggucagcucauuucggaccaaguggcagaaaucauaucuaaauaugacccaaaugucuacagcaucaaauauaauaaccaauuagcaacacggacugcacaagcaauuuuugaugacaguuauuuggguaaguaaacacaaaauauacaguugcauggagauuugguaugguugcucuguaauuuugcauauacuacuuuaaguaaaaaaacaaucacugugaaauagauuguuuaaaaagcgucaaagaggcagauagcuuugaauagguguugaacacauagguuaugcucuaauucagcaauuaaaacugaagaaagugcugauuuguacauggcuaguaauaauaaccuugaaaugucacuccugugcucugggcguugucugugcuuccuuuguauugcuuauguaauccucgaaagucugcagcacacaccguuuucaugucuguaugaugaggaaugaugcugagggucagagggcaagcugcuugcccacuguaccaagucacggcugaggcguuuucacuacugcccuuuggacacagguuuuggucugagacuacaucaguguuuguucucacucucuaaauuucuuuguuauuuauggaagcaagucacaccacggagggaggacuuggugccugagaaucuguuauuccuugugccugcagacuucccugucuuuaacacuccuugucuuaguuuucugauacggaccggaugcccuuuuugaguacuuggccgacucgcuuuaaacuuuucuugucacaugcguguaaauucuuuaccccuggaggagaaagaagcuucaaagagucugaagagaaucaccgugucucaccuuucguuccugucuagguuacucuguggccgugggagacuucaauggugacggcauugaagguaggaagaacuuggguuacccaucguguucuccaaauaagcgcuggaaacacaaaggcuggaaagcuuagcaguuugcaacccuggcuguggaacauacagaaggaagaaagugucggaggggugggguugggggugggcaggggacaaguucugccuggcaggacugcugggggcugggagggggacaaguucugccuggcagaacugcugggggccuggagcucuuugcuugucccuuuugaggcccugguaaauucugucuggguggagaggcuuuuccucuuuuggguuaucuguggcuuguggucauagucgggagcaggcuguaccuccuuccuccuugcccugcuuccaguguagccaccuggaaaucacauagguccugcuucugaccccagccacagucucauuucagcuagguauuguuuuucccuacuguaauauaaccuccccaccccccuugaucuuucuguuccuguuuaauaagauggugagucauuugagggcuuacaugcauguuuuugaguuccuggcuguccuugaacucacucuguaaaccaggcuggcaucaaaguuaaucugccuaccuccacagagauccuccugccccugccuacugaguguugguauuaaaggugugugccaccacuccuggcauauuugaguucuuaauacuguuuuuauaauuuaaaaugcaagguagguuacuuuguauccaacaucgauccaaaaggucucuaguuuguuuucuacugaauuuauaaaauuuaaagcucucugguagaguaccuccaucuguaaauuccaguguuugucuuaaaaaaugaguaauuaagcugggcgugguggcgcacgccuuuaaucccagcacucaggaggcagaggcaggcgaauuucugaguucgaggccagccuggucuacagagugaguuccaggacagccagggcuacacagagaaacccuaucucgaaaaacaaaaaacaaaaacaaaaacaaaaaaaagaguaauuaaguuuuucuuucuuucuuuuuuuuuuuaaaaaaaaaaacuggauauuuucuuuauuuacauuucaaauguuauccccuuuccaguuucccucucuacuggaaacccccuaucacauccucccccccugcuucuaugaggguguuccuccacacacccacccacucccaucuccccacucuugauuccccuacacuggggcaucuauugggcauucauuggaccaagguccucuccuuccauugaugccugacaaggccauccucugcuacauaugcagcuggaacuauguguacuccuuuguugauggcuuagucucugggaguccuggggggucugguugguugauauuguuguucuuccuaugggguuacaaaccccuucagcuccuucaguccacucucuaacuccucuauuaaggacacucagucaagugguuggcugcuaacaucuaccucuguauuuguaaggcucuggcagggccucucaggagauagccauaucaggcuccuuucagcaugcacuucuuggcauccacaauagugucugaguuugguaacuguaaaugguaugagucaguaauuaagguuuuauucccccccccccccagauuuugucucaggaguuccaagagcagcaaggacuuugggaaugguaagaugaaaaaggguguuuuuaaaccuaugggggagaaugggcuggggagauggucagaagauaucucaaaagcaugaggucugcuauuuggauuccgggugggcaucugaaaggaggcccaucacgcuguaacccuggugcuguguagagacagguggaccccugcugcucaccagccagucaccauacaaaugaacgacugccucaaaaagggaugaagacacucaacuuugacacauguacaagcacccuuccccuccccccaugcccauaucuccacaaacauauucauaugccacccccaucuguagauaucauuaauuuuaaauauuucucuuuuuuuugcacagguuuauauuuaugaugggaaaaauauguccucuuuacacaauuuuacuggugaacagguaugguauuaaaauucacaccccguuaugaaaauucacugaggagaguguagaaagugaaaauacagaagucaucugcagaguagccugacacacacugcagaaggccccucuugcugcugcuguucaagucugcaugacagauuccauuuccaguguguuaucuugugucagucaguguuuuguggaaauaguuuaauagguccauacauacaaagcuauaaauagaauuaugacaggcuuugggguuuuuguuuguuuuuuguuuuucugagacaagguuucucuggauaguccuggcacucacuauguagacuaggcugaccucaaacucagaucuaccugcccucugcuuucacugcucaccugguuucagauauuuuaccuuuguuuuuauuuuuauuuuuuuuugaaggcaggugcugcauuuauuguagcucaaccuuuguuuuuaaacagaauaucaugguuuagcaaauccuuuugucuccguauaauauagcuuguuuuuguuugcugcuuuuuaaaaaauaaaacuuauacaaaagcauaaaauuuccuugauaucaucaauguuuccuuaaagaauuauccaauuggggccggggagaauuacccaugaagccuuuaauucuagcacuagggaggcagagccaggugguucugugaguuugaggccagccugaucugcagagugaguucuaggacagccagggcuacccagagaaacccugucuugaaaaccccauaaucaaaagaaaagaaaagacaagaaaaggauggcuuacguguuuuaguuuuaucaggugccaaaagcacacuacagguguguauauuacugaugacauaugcauagcugcauugcaaaauauaaguucuucauuuuaguacaauccuuuuggagugaguagagauguuuuauaacauucucguuugugugucucagggaacuaaguuacaaauugguaacgucaaaggagaaguuacacagugggcagagaaagguccucccaguguuguauggaggcuggagccucuuuccugcuguguuaggcucagagagaggagggaugaaaagccucauggcuuaggcccugcgaugauggacaugaaauguguucugcuuauaaaucuagaaaaauuaaaaaagccucauuaacggauggccauugucuuaggaagcagacaaaaagacccuaaaugcacagagaaagaaaucagccuuucucuaagauauaaauauuaguguaaauguucaucuggcugaaugaaauguaaauguuuuguucuaucuucuucuucagauggcugcguauuuuggauuuucuguagcugcuacugacauuaauggggaugaguaaguuuuaaaaaauuguuuccagaaaccauuuuuccucuguguuuauaagugcuugacuaaaacuaaacaguguuucuucuguuucuuugucuucuuccuguuacucuucugucauuuuaagaaaacaaguugaugcucccuaauaauaaauaugaggaaauccuugaguugguccuaaauuuuaacucuaacacagugguucucaaccuuccugauggugugacccuucuucauguuguggugacccccaacuauaaaauuauuucauuguuacuucauaacuguaaguuugcuacuguuaugaaucugauguuacaaauaugaauggaaguaucugauauuaagaauaucuaauauucugccucuaauauuugccucugacccaaccaaccacugggucaaggccaaucgguugagaaccauuaucuuaaaccaggacaauguaauuuuaugaauaaccuaccauugagccauguaguuauaagaagccugcaaacgggugggaaguggagacugagugaaaaagaggaguuuuaauaagaaugugcugaugaggagcuggaaagacugcucaguggguaagagcacuggcuugucuugcagagggcuuggguuugagccucagcacccacuugguggcucauaaccaccuaaauccaguucuaagggauccaaagcccuuuucuggcaucugagggugccagguacacaugugguacacagacacacaugaagaccugguacccccuuacuccuagaagaaucagguggaucucuguuaguuugaguucugccuggucuacagagcaaguucuaggacagcaagggcuacacagagagaccuugucucaaaaagccaaaccaaccaaguaaccaaccaaccaaccuaaccaacccaaccaaccaaccaaccaaccaaccaaccaaauaaaaaaacccacccauagaauaaaauagaaaauuaagaggaauaacaacugucagauagaguuugauuuugugugugaggauguucucuucuuucaguuacgcagauguguuuauuggagccccccuguucauggaccgagguuccgaugggaaacuccaggagguuggccaggucucagugucucugcagagagcagugggagacuuccagacuacaaagcugaacggcuuugagguuuuugccagguuuggaagugccauagcuccauugggagaccuggaccaggauggcuucaaugguaagauccaagcgccuuucugugucaccagaggaaguccuaaaacaccauguacaggagcuccuaugugcaaaccucccggaaagauggagagcacaucacagacaccaaauuuaaaaccagauugcuauuucuuuuuccuugaaaaugagcaaaaaaugucaaaacuuggcuuucaugagcuagagaugauugaauucugaaaggagccuccaaucucagggagcccucugcauccugcugccugucagugcccucuaguguccauuugcuuccaagugaaaaacuaccucccagccuuugucaaagcaguaaugacuuaaagccuaacucaggcacgaguuuccacuagagguuuuuuuuuuuuuuuuuuaaauagucgcagcuuuauagugaaaccucagagagagguuauauaucuuuucauggggacuuguaaauggcuuaugcucauuguguuaugguggccuuauauuucaauaguuucagauaccuuuuaaaauaaaaguuggcuuuuacuacacagcucuuuuccgaagccugaaauacagauuaaaaauuagauacauaaaauuuagguuacaaggauuuuuguaaaaggauagugaggagagaagaauuguugguuucuuugcauaaucagcaauauauuuggguuuaagcaacauauuagaaaguuauuaggaagaagacucgauaaauucagugguacagaugacucugacugcauaguggaaggaaacaccuccauuccugcccuguggacagcugugugucacaggccaguuugaauaaccuuagaagauuucagacuuagggaauaacuagaccaggguauauuuugcuuccuaaaauagucuuaaaauuuuuuuuuugucaucaaagaacauagcauucaaccuuagaauaaagcuuauaacaaguuauggaaagaccacuguaggucacugcucacugacaguaaaaccuggagguaagaaagaaaacuguauuugauuuucuaccuuguguaaaauuaucaggucccuuucauuucagcugggcucugucucccaggcuuucuggaacaacuaagacagaaagcuguugcuuuguuccaaagguauuccagucacuuuaaagucacauuuccuggauauugucaucuugcuuuucauauuuuuguuauguuauuugacagcauguguaaacaacagcaaaaaaucuuugaaaagauuuuuacaaagaaguuuuacuguuaggagauaaauaccuuaggagguguugauggucuguagggaaccgugaaugguaauucuuuaguggaagauuaccugagccauguuuauguaaacaugcauuuuugugcuguuaguuccaaucucauuuuguucagaucugguaacagugaaugccuguuucaguccuccaccucacuagguaccagcaaaaggcgaauuaguuacguguugcuguuaccagauaugaagcaacuuaagggagugucuuaguuaggguuuuacugcugugaacagauaccaugaccauggcaacucuuauaaggacagcauuuaacugagccucacuuacugguuuagcgguucaggccauuaucauuaucaucuucaucuucaaggugggaacauggcagcauccagguagacauggugcaggaggaccugagaguucuccaucuucaucugaagcuugcuagaagacugucucccacauggucuuuuagcccauacccacagggacacaccuacuccaucaaggccacaccuccuuauagugccauucccugggccaaguauauuuaaaccaccacagggagaaggguuuucuuuagcuuacagucugagagcaguggcagcagaagcauaaaguaccuggucuaucugucuaucugcagaaugcagagcacagaugggaagugaggccagaugauaaggccucauggccugcucccucucccugaaacacucauccacuuucccagucaggguccaccucugugaugucccacagcucuccaggucagcgccacuagcuggcgaccaaguacucaaacacaggagucuaugggcugagggacaggacauuucacagucaaaucacagcaaaauggauguggaaaaggaaacauuaaguuaggcuuuguauuguuauguagacucggguaauucugugcaguuuuugucauuauugccuaacaaaacaaaacagagggaaggguuaaaaccuaaagagaaugcuccacuauggucauagcagccuuauuuauaguagccagaagcuggaaagaacccagauguuccucaacagaggaauggauacagaaaaugugguacauuuacacaauggaguacuacucagcuauuaaaaagaaugaauuuaugaaauuccuaggcaaauggauguaucuggaggauaucauccugagugagguaacgcaaucacaaaagaacauacaugguaugcacuuacugaugaggggauauuagcccaaaaacuuagaauauccaagauacaauucacagaacacaugaaacucuagaagaaggaagaccaaaguguggauaauucguuccuucuuagaauggggaacaaaauacccauggaaggauuuacagagacaaaauucggagcuaagacagaaggaaagaccauccagagacugccccacccagggauccaucucacauacaaccaccaaacccagacacuauugcauaugccagcaagauuuugcugacaggacccugauauagcugucucuugugaggcuaugccaaugccuggcaaauacagauguggaugcucacagccaucuauuggauggaacacagggcccccaaugaaguagcuagagaaaguacccaaggagcuaaaggggucugcaacccuauaggaggaacagcgauaugaacuaaccaguuacccccuccccaacucccccagagcuugugucucuagcugcauauguagcagaggauggcguagucagcuaucaaugagaggaaaggcucuugguauuaugaagaucauaugccccaguacaggggaaugccagagccaggaagcaggaguagguggguuggggagcagggcagggggaggguauagggggcuuuggggauagcauuugaaauguaaaugaaaaaaauaucuaauaaaaaauuaauaaaaaaaaccuaaagagaacaguagugcaauccagggaggaagugagaucaugacagugcaaguggcuccagacagcagcagagagggagacaauaacugugcaugcaauauugacgggguuagaaagagacagcucauacuaaauaaccccauagacuagagccaucuuuuucugggaaacuaaucaauauuuucuuuuuuaauuaaugaauuuaauuaauuuuauguauauguauacaccagacacaccagaauauacuguaguugucuucagauacaccagaagaggguguuggaucccaauacagaugguugugagccaccaugugguugcugggaacugaacucaggaccucuagaagagcagucagugcucuuaacugcugaaccaccucuccaaucccagucaguauuuucuuaaugcauauguuaauuugaauuaucuuuuaaagacuuagaaaagguuaaaaggacuacuuuacaugaugcaaauacauauuuucaaagaaugacauauucuuagggcuuguggcuaccagauagucuucuaggugcugaaaaucagaggcuagucaaagcuggaaugauggugcacaccuuuaaguggagcguucuggagggagagguaagcagaucucuaugaauuugaggccagccuagucuucauaguguguuccaggccagccaaagcuacauagagagacccugucucaagcaaagcaaaacagcaagaaacaaagagguugaucaccuacacacauccuuagucagguggugguggcacacaccuuuaaucccagcacuuggaaggcagaggcagguggaucucuugauuuugaggccagccuggucuacaagagggagcuuguacauagagaaucccugucuccaacaaaacaaaacaaaacaaaacaaaacaaaacaaaaaagaggguaaucacccacacacauucuugaggaacucagcgugcaauagggugaguguauauguaggaaauauucuuuuuuaaagagcacuagaauggaguuaccaugguguuugagauauuuccagccuugauggucucacauaaagaaugcaaaauccaggcauguuuaguaugucaggagauguuaccaaggaggcauaagguuguuaaguaaggacacugaggcaauuugguauagcugguaucagggccauuauaagucaaagagauguccauguuuggacugguagcaccagaagaaggaggaauugguauguuuaucuucaagccaccauuuagugucacauaggauugcuuuaaaaaaucaaaaauuuuguguuuauuuuguuucaguauaaauugaacagaaugaagaaggcagaacuuugaaauuuaugaacuagauuuucauuuuguaagauaaaacucacaaaugaauuagaaggaggggucaaaagugucaaaauggacuuuugaugaguguuuucauguguccucauccacaucuguaauguaagaugaagcauuuuagauucauaaaucugaagucucuuguccaaggucagacccagggcaccugccucuagauuaaugucacuguugcauaguuuucccuuuuguuuucugucaucuucagagagucuugcucuggagccaggcugacguugaacucagaguccuccuggguuagucucuugaguucugggauuauaggcuuguuccccuguuacacccuagacugcuguucugcagaacuuuaccucaacggcugaccuaacagaucgguuguaugaagaguguuaauaccaagaaugucuucuggccauccugcccacuuuccuaauucccuauuccucuucucuuccucuucuccacccuguucccucuuguccacagauauugcaauugcugcucccuaugguggugaagauaagaagggacuuguuuauaucuucaauggaagguccacaggcuugaauucggugccaucucaaauccucgaggggcagugggcugcucagagcaugcccccaagcuuuggcuauucaaugaagggagcuacagauguagacaggaauggauauccagguacuuuucugcaaauaugugugacucuggguuuuucauucccaaaguauuaauuauucuuuucuuguccaucaucccauuuaauguuuaaacacugaugaagacuuuaaacagcucuuuuugaugggaguauacaauaugaaauagaaagccaaaugcacauuccaagguuuguuuguuuuuuuuuuccccccgagacaggguuucucacucuguagaccaggcuggccucgaacucagaaauccgccuuccucugccucccaagugcugggauuaaaggcgugugccaccacgcccggcuacauuccaacuuuuuaaauggcaucuauugccuuuugcuuuuaaggagcuaguauuuuaugaacuggugcaaucacucuguguguguguguguguguguguguguguguguguguguguauguauguguguguguaugcaugcauacauugaaugcauauguuuugagacaagguccaucacuggagcucauaaauuuggcuaugcugguugagcaagccuagagauccugcugucucuugcccuagucccaugcuaggauuacagguucauagcacugaaucuggcuugaguguuggggaaauacaaacugaaguccucauguuuugugcgguaggaacuuuacccacagagccaucugccuagccuggacuaaucacucugaucuauaacaaaacaaaacaaguaccauuucacugaauuuucccaacagcaauguuguggaauuuaguuaauggaggucacuauggucacuauauugaggccauuuuguagauguugaaguaacuguaaaaggguaacuuacccaagguuucccauggaguuagucuguuagagugagacagaccaucagcuuagauuucuacaucuuuugaguaucauaguggguuuaggaucaaaauugauccuuuccuuacgugaaguaaaauuuugaagacccagaugaucucuguuguugaaauagccacuccagauucugggucuuagcuuggugccaugcuuuagaaaugagacaugagguuugucugugagcuggcauuauuucagagcuuugucaugagugcagugugugcacuccagagcuuaauaucaccaaauguaucugcauauucccccaaugcacuuguauuuugugauuguuugaggcacuuuuuuuuuaagauuuauuuuauuuaugauauguaaguacgcuguagcuguccucagacacuccagaggagggcaucagauuucguuacgagugguugugagccaccaugugguugcugggauuugaacucgggaccuucggaaaagcaguuggugcucuuaaccacugagccaucucgccagcccccuuuuuuucuuuuuuuuaauguaccccagcuuguucuggaacccauaaucuuccugcuguugccuuuugaguggcugugauuacaggugugcaacaccaugcccagaucauucauucauucauucauaugaauauacaaauauaucaugcauguauaaaugucuagguuuuuauuauuuuauauaagugggugucuuacuugcauauauguuugugcaucauguguucagugccuacaaaggccagaagagggugucacaccccaugaacuguaguuacagacaguugugagucacuuugugaaugauggaauuaaacuuugaucugcaggaagaacagccaguuuaacugcagaacuaucucuucaauuauauauauguauauauaauuuaaaaaaguaacacccugcuuuaguuacuuuucauuguguauuuuauuucuuugauacauuuauuauucuaaaacaugaauuucauauuucccauucuaacaaauaaccacuguauccuauuuuaccuuuauuauauauauauauauuuguuguuguuguaugccucuacacauuuccucaggacaaaauucuauaucuguuacuucaaaggcacccacucguguguguguguguguguguguguguguguguguguguguguguuuauguguguggugugugccaagguguggugguguuugacuuaggugugucucugguacacgaggagguuggaggauguguguggagugucuccuuaauugagacaagaugugugugcugcugcaccuucacuggcuugggagcuucuagagagucucauuuccaaguaggggcacauuaggauuagagccacuugcacaacuguguccagugcuuguaagcaccaaagcaucucucuagcccucuaaacguucuugacuggcugaaggagagucuaacugaggaugacaguuuauucacuguuuggaaauaguuuugccuugugcauauuauccucaaacuucuuggcuuugagaauaaaacccaggagcagugaacaugccagaguaauguauauuuuaaaacuuauuuuauuauuaauauguuuuucucucucucaagacuuaguuguaggagcuuuugguguggaucgagcugucuuauacagguauguugcauauacuuuaauacaggaauauuuuaaauuauuugaaaaauguuuaaguauucauuugaauuucaguuugauuuucuuauagugacaaaauuauucuauucaagaaacucucaaagaauagaaagcuauaguuuuuuaaaaauauuuuuuaaagacuauucagaauuuuccuucauuagccuuuacauuuugugugaagacauuguccuacguuuuuagucacuucuaaaauguaugggugguaccugccuuguguacacaaaacacugggcuugguccuuucgauauagcugcauugagugaggcuaugccagugccuggcaaauacagaaguggaugcucauggccaucuauaggauggaacacagggaccccaauggagaagcuggagaaagugcccaaggagcuaaaggaacaacaauaucuaauauaaauaaauaaauaaauaaauaaauaaauggaaaaaaaaacccaaaccaaaccaaaaaaaaacaaaaacaaaaacaaaacagaaaaacaaaaacacacugggcuugggcccccugccuccccagaaugaauuuaagaugguaaaggcuuacauuuuuuuccaauuuuuuauuagguauuuucuucauuuacauuucaaaugcuaucccaaaaguccccuauacccuccccccacccugcuccccuaccacccacucccacuucuuggcccuuacguuccccuguacuggggcauauaaaguuugcaagaccaaggggccucucuucccaaugaugucugacuaggucaucuucugcuacauaugcagcuagagacaugagcucuggggguacugguuaguucauauuguuguucuaccaauaggguugcagaccccuucagcuccuuggguacuuucucuagcuccuccauugggggcccugugauccauccaauagcugacuguaagcaucuacugcuguguuugccaggcaccagcauagccucacagagacagcuauaucagggucagcaaaaucuugcuggcauaugcaauagugucuggguuugguggcuaauuaugggauggaucucugggugaggcagucucuggaugguccauccuuucgucucagcuccaaacuuuaucucuguaaaagguuuacauuuuuauagaagaggcagugaaacuaaguugguacuugugccucaguauuacaugaccauaaagguguuaugucauaaacaucaaaacucuuauuuaaucuagaacacaaauuuuuuagcuguauaugugcucucaguucuaugggucaucacuuccucugccucagaacaccacugaucuuuugaauagguugggguucuuguacuguuaugggcugaacuuggcaagagaguuuccacuggagccauguaagguucugugauucaucaacuucaucauagccacggagaacauaaacuuacagacccagccagauguaguggugcacaccuuuaaucccagcacuuaggaggcagaggcaggaagaucuccaggaguucaaggccagcuugguguauguagccaguccaggauagccagggauguuacacagagagaccuugucuugagaaccacaacaaacaaauacggcccaccccaaccacaacaaaaaacuaacaacaaaaucccuuacagacuuccaagauuuaucauucgaagcggccucgucgaccugaccccacuguucuugaauauaaaacuuagacuugugcaucugaacuuugcaaaaauguagucuuaaguugaauggucauuguuugaaacgcuugggaccacaagugcuucagguuuuggagguuuauagguuuuuaaguauuugcagagacucaguuaagcaugaaaccuuccuacucucaaaguccaacacuugaaauaggccacaacauuuuugaucaccuuuuugguacucaaaauguuguacauuugagacuguauaauauuuuauuguuuggauuuucaggacguggggaugggauacucagauauauuuuaguuuauuguuuucguuuuauaauuacuguuaguauaauucauaaguuguuauaaaauuaauaaacacuugcaugagguaaguauguaagaaauuuaaagggcuaaaauggguuggagagauggccuagcagcuaagaauggaguucggagcaugcacuguucuugcagaggacccaaguucaguuccuagcaucuaugucaggcuguaccuccaucucccggggaucugauauccuuugcuggcuuuugcaggcaucugugcucacucccacccauacuccacuccaaaugcacaaaauuuaaauaauaaaaacaaaucuuuaaagaguauaaaauaagcauguguaugcuguacuguaaauauucucgucauuaagaagucaugucugccuuaaguaugaucuguaggaauucugccugccuugcaggaucuguucuccuauacauaugccugucagcacagaugggcuuaugacacacacauuccuccccguguucacucuaauuagcuggaugaccuauaacuaguaacaguugugcuuuagugugcugaacucagguaggcugaucgauugucucacuugccuggaauugaacauuugccaaggugcaggacugaauuaggucaguuguggguaaaaugagacagucaggcaucuuauguuuacaucuagacuaguacaauuaucguugcuauuaccaauaguaaugggcauugaauugcaucuguauugaaugagaauuuaaucaauuuauuuuuaaauaaccuuucucuccuuuuccuccuccuccucuucccucccucccucccucccucccucccucccucccucccccucuuucucucucauuuaaaacuagagccagacccguugucacuguaaaugcuggccuugaaguguacccuagcauuuuaaaucaagacaauaagaucugcccguugccugggacagcucucaagguuuccugguaaggaucuuuguuuaguaguugugaugauuaauaguucagucauuguacaaacaacacaaacuuagcuggcauagcugaaagaagaaacccaggcaguuucuaugaaugcaaucuauauccauguuacagauaagguuauagaagguacacuuucaaggaagcugucuagaagguuccagaaauaguuuauaacuuaguaugagaaagauuuuuaauguauuguauuuggucaaaaguauauucaagaagaagaaaaagguaagcagacuucaaaacauuuuaauuuuaauuauaaauaggcccuucugaaaauuuaaguuuauaacaggauguguuuuuucucagaauaaacacaugcgaauaauauuacaaaaauuauuuuucccuauuuugucuuuugcuuguuaugcgcgcgcacacauacacacacgagucuauuuuucauaaaucuaguguguuaguucucuguaucauaauuuuuuuuaucuuaaauaugaaauuucccugaguuuugcuauauuuucauuuagcuguacuauaauuaucuuuuauuuaaauuaauucguguuauuuuaaaaacuuaaacauuuucauguauguccaaauaaauauaaaacucaacuaauaaggagucuugacucaaguauaaggagagcagcuuaucuugaggaacucuguucaugguccuuugcagaaggucagauagaacuuacaggugugauguguagauuggaaaacuuuauaugaaaugagucugagaagggcauuuuccuggcucucuugaaugauugcuacaaacauugaaaguuugcaguccucauucuccauuggauuacgcuaagcaguauguaacacuugcuaugugcuugguuggcaaccaggcuguuuaggguuuagcugacauuuugacuguucuugucugcucucaccuuuucugugagugcuggguaaguacugcuaauguagucaccauuagagagcuucuagugggauaccuagagcagugcaugcggacacaacccgguuugacagaggagcccgggcucuucuaauagugaucaugguacagagugacaaauauauuuugcauccuauuucagugaguaagaggccaugucucaauuagacagagaaugauaggggaggacacccaaaguggacagcugacuuccauguaugugcacauaagugaguacauauguacguauacugcauauguacauacauguacauacaaacacauacuuaauacauagauaaauacuagaagaguauuaaaacauaaagaaagaugaaauuuuuuuuauaaugcagacucuacuaucuguuuucugcauuugucaauccaauaaaucauggagagaaauauagaauaaaaauugugucucuucuggagaugggcagacuuuauucuugucauuccuuaaaaaugcaauacagcagauauucacauaguauuuguguuguauaaaauguuauaacuaugcuguggguguugcaacuauucugugggugggugacuuaaaguuggaggaugucggcugucugcagacacaacaccguguuaugucagagcucucgugauacgcugauuuguuguuggagaguaaacggcugguugcuagaaccaucucccaccaccccgauaggaaggggcauauacauuagaaaugugagauuugugugguauucaguuucaguacuauaccuaaaguagauuacagaauuuacauuugaaaacauuuuuucuuacaguuuuaaugucagauucugcuuaaaggcagauggcaagggaacccuuccucggaagcuccgugaguaucuucuugugcugggucagcagcuucagggcacacgaugcaguuauucaaggagcuguuaucccucuaaccugaauguuugugcuugaagacauuuaagauuaaguaauuauauacaaguauuuucuuuggcagcucauaggucagcucagaggcaguauuuuguuguugcuggacacugagcauaagaaugguaaauaggagccagcauugaggauguugagugguuaaugauaggagguaaauggggcccaggggaggugucauuguuuaugaaucugugcucuacugagagcuggggaaggccuuuccuugccuuggaaaggguguaaccuuuguguugcugcguuuagucuguggcaccgacaccauuccuucucugcugaaaugauugauguggucugagagcaaggcuugccaguugaauggcuggugacuucugcuagugaguaggagcaggcuggagaagaagcuaaaggagcugcucucagugggaaugugcacaggauggcaagcaggaccucacugcaagaucagauuuacguggagaccacaggagaugagagagcagagggaugccucggacuguuuaagucugugguggagugagcucacuuugucuggggagcugcauggauguacccauggagaccagagaggggauacacccgcauucgcauucgagauuaaacacuuaaagaaguagacaaagagacuugagguuuuaaaauuuugcacaaauuccuuuuaagcagcuucuuaaagagauaaauacuaggaggcaguaauuguaacaauugccugcauauucauuuauacgauuuguuacccauuagauucucuuuggccauaugcugaaggagggacguauucaguugucacauuaaagggcagcuucauuggaaacaccguugcaagugauauaaacuguuuguaauacucaauguaaugguuuggaugcacguuaaucaauacuuagcauaucguguguguguguguguguguguguguguguguguuguaugccuauauauacuguaagggggauggaacccagggucucaggcauucuaccagcagccugcuccccucacccagugggaaaaaccuuaauuuacuucuguuucaguccaggacauccuugcuuagcuuaaaugaaaagccuuuuuccccuuagcuuaaauuaaaagcagauccgcacccccaccccaauaacuugguuucacuacugucauuguaacugcauaugacauuuugggggggacgacaagugaauuauuuaguuauuaguuucuggaguuaauguguugcugucucaccacaaugcuuaggcauuuaaauaaauauagaagaaaguugcuuuucagaaaugaauaucucugccugcaggaaaagucuagauugcuaggacagccaugugccggccaggaauguguugguuauaaaugcugugguuuguauagacuuccagguggagcuucuacuggauaaacucaagcagaagggagccauccgacgagcacuguuucuccauaacagguccccgguccacuccaagaccaugacuguuuucagggggggacagaugcagugugaggaacuggucgccuaucuucggguaagacacuuucugcaccauuaacuuuuccuuguaguuacucucccucuccgcuucauguaugugauuuuuccuaccugugaauugguguuuaguuaaaaugaaaagcccccacucagagaaauacaccugagaaaacuggcuuuuccagucagugucaaagccaauaucgaagguagaguuuauuccugucagauggauguuuaaagaggcuagaguguuacugaaugaguccugaaaaagcuuauuucuggaaauauugcuggacucucaagucugcaaaacuuucuaguuuccaaaaaguaagcaauccacuacagauucccgguggcuaaguuuaaaaucugaguuguaaacuucugugugagucuaguuugaggcgagagacggagccugacgcagggauggguuugaguguagacaucagccagagauugagacuuaacggaagccuuuugcagucugaggcuuguuugauccuuguggagcaugaaggguuccuggcacagagaugcaucuggacucuggcgugguggaguacagggcccuugcauaguccaacuuggcaaucacgugauguucagucaaagcaggaauuauuuguuguauguguuuguuuuacuugcaugcauguuuguauguauguauguauguauguauguguaucauguaugugccuggucuaucuaucuaucuaucuaucuaucuuucuuucgucgucugucuaucucugucuauccauccaucucuuuaaaggcauauuccagauauuaaggcugucuauuaugcuuccuuuuagaacuauguguaucgcuguuuugccugcacgugagacuauguaccauauucaugccuggugcccugugguggucagaagauauuagguccccuggaaacagaguuagagaugacugugagcugucaugugggugcugggaauugaacucagguccccuggaggagcagccagugcucuuaaccgcugagcccucucuccagacccuaggcuuucuuaaagcuuuuguugccccaguuccaccaagccuuaaccauguagacuuguggaggauaccuaagcuccaaaccacuuuaggaaucaguaauagaaaaguaaguugaaaaauugauuggaaaaagacagggaaugugauuuuuagguaaaagcaauuauaagggaaaauuacuuaaauugucaauggacuaucauaggaguagaauauauagggaaaagguaugucuacuuuaaaugcuauuuaauuuacacggauugucugacaaauuuaaaaaaacgaaaaagcauuuacauaaaauuuguaauaaaaagggauauaagaauagauaaaauuucgacuuaaauuauaaaguuucuuaacuaaucaauauauaggaaaacuuggauuuaaaaaaaacauaauucuuagacauauguaacaaaccugccauaaggagauacaaaaacccaauagcuauaggaucacucauauaggauuauauauagacacuucuaaaauggaaagguauuuggaaucaguuuuguuuguuuuuggaggcaguguuaccuguugucuagguuggccuugaaccaugcuuuguagcugaaaaugaccuuggauucauaauccuccugccuccacauccuaaguccccuuuaaaacaaaacaaaacaaaaacaacaaaacuuuacagauaggaacauaaggccuagaugauuuuuaugcaauauuauaauuuaggaaugagccauuucugauacuuuauuaaucucuguucuucaaaugaaaaguaaaacugaaaauuuucuaauguucuaugaagcuugacauaugucaaguuaccaaaucaauaaguuugccaaggugaauucauucuaggcuggacuaacauugagaauuuagaaggaggacuuucugcaugaauaaagaagggggaaagaagcaagaccauuuuguguagcugcggaaaaggaaagccugugaucugaugaaccacugaggauuuauuuuagaggcagucaugacugugaacagauccgagguuaaauuuaauucaggucuguuuguuaacuaguccaggggugaugcguggcagcuccuuccuugcugaugauccuuuaguuguuaugcagguuuuggaaaauaaauaagaacuggugaauuuugugacuauuuaaguagaaucaucacugcaacaaaaucuuguaauaacaaaaacaaacugggaaaccacaaguaaucuuugacagaagaauggauaagcugcuauaacauauuaccuagcagugauguauguccuagcuguauauauggaacagcauagaugaggcuuaaacuguuaaaugggaagaaaaucagagguuauauaugagcucauucccaguuauccaaaggagaaacaaaaaacaagugagggacgcacuguucggugacacaaucucuauaaaaaguggcgccggcaagauguaaauaccggccaccaggaaagagugaccacaagagauuucuagacaaguuugaaaacaguggugucagcagagcaggcagggaugggcgaacugaaauucagcagcccuuacacugugaaggaaagcaaagguugaaagguugggcagcuuaaagccacauuaauauuggucugauuacuguguuggguaucugccugaguguuccuuuuaccguguuggcauaaaaucacagucucacuuuaaggaaggcaagagaagaauuuauucaaggaaugugagugacucuggcuggaggccucguccucugaagcacagacucugggcuguguuguguauguuuuuacggacacaggacaaagggaggcuggugcgcuauugaguaggugagcuacaaaagacagcggaaucucugcuguaagguucacaugucauccuuaacaucuucuucagaauucagaucuuuaucccauuccuugguugcuggaggggagagagccaccagguuuucugauggauuccaauaguuuuagcuagcaauggcaaaauaagucagaugcagagauuuauagcuaagaguuauuagaaaggacucauauuguucuauaacaacucuggcucauuaucugaaguauuacaccucugcauaauuggcagagcucagcucuuagcagacuguuaaguacgugugguuuuuucagagaacuuggguucacagcuaaugcacuucauagcuucuugguuguguuuugagucaagcguuacauuauaaaacuaacccugaugcacaguucuuacugaacagccaugugaguuuuacguuaugcuugccacaguuaacacaguuuuucagauguuguaaccgaacauucugugaugaauucagcugcuuuugugguuccccaccauuguggauuucuccaaacuguuuagguugaugucaccuuuaaccugaagcucuuuuguuucaggaugaaucugaauuuagagacaagcucacucccaucaccauuuucauggaguaucgguuggaccagagaacggcugcugaugccacaggcuugcagcccauccugaaccaguucacuccggccaacgucagucggcagguaaugcaugccaaaguuauuucuuauaucauccuuugaucuuuugauaaggcuuguguucuuaagggauuguuuuuacaguguugguagauaauuaagaaaucagagggggaauaaucagaauauuuaugucugagaucuuuaaaccuauucauuaguuacaugcauugaaagacugggcuacauuuuguauacagauaauaguaaaauuauuuaacggaaauaacaaaaggccuguuuauuuacaugcaguuuuuaguacuuacaucuuggguguacauuuugugguauguguguguauaaauauaaacauauuuauacauauauaugcauguauguauauauauauacauauauauguguguauguauauguaaugcauaugcaguuuuauguauaugucuuauauaaguaauugcuaaguccagccuggcuuggucuuggaaaccugacugggggcgauggaggacugaaggacaaacaaacacacauguacugaaaagcuggggucagauggguuaugugcacuccgauggaggaguaccaaccaucacacagcaucugggggccucaguguguuugcuauguacaacccagggggaaggguuagcuagucuuguaggcagucucugugggugaggacucucagcagguaaaccucugggaggagaaggugcgauugcuaggcuuugcacacacugccaacauuugcacugagacgagaggaaagcauugcuaguucuagccugcacuguauggggaaggcuuugccauucccgugggucuggugcauugcuccuucaugcugcuuugcccgaaucaaacaguaaguuuucacccaguacuacuucugcucgugacacauacacucagagcuccugcacaccacgaguaaugcuuuucauaaggcaacacaaaauuacaaacaguuugguaauuuuguaaaacccuuugcacaauaucucucuuuaaauauuuuuucuauaucuuccuugaauguuauuacguguccuuagggcucggucucucagaguucauuagcauaaucuagguugucccuucuucuuugacuuccuuucuaagaccuuuugagcaguguuuauuucugggggguacaauuugagaauuguaauaugacaacauagaaagcaaauugaaauauuuuaaaaguuuauauguaguuuauguauuuuaacaaacauuuuguuuuguaucugccauuuuuuacuauccacuagcaaaggacuugugaacauaguuaguucuguguuccgaguuguuacugggguggauggauguuguaccauugguuaauuuuauaucugagcuucuuaguaugugugcuuuaaugugguccuuucuuuacaaauaacuuuuuaccugugucuuauaguauguauuuugaugacuauuuuuucucuauaguuuuagaauuauuuuagaaaucuuuaucauuauuguuacuauuuuuuuuugagauaagcucucacuaaaauagcaacaaauaagccaagaaugaccuugccuuuauuuccccuuuucccuucaugcuuuguuccuucuauguguucuaccaacaucucucuuugugcauugcuucucuuuugaggguuuuucuacgugcucuucauggcacauccccuuggccagagucagaaaaagcaaguuuagauuuuuuugauguuuucuucugguuuaauuaauuaauuaaugauuuugguuguuugcuuuuuuguuuguuuguuuuuuguuuuuuuguuuuguuuugucuuuugucuuuuuuuaaaguuucuuucccaauauuuuguacaugcuaaacuuauuuugacccuuuccucccuaguuaauauuugcagccaguuucugugauaguagcagaggucaaugucuuaacgaggagcccugauuauuuugucacugcuuguguagguuagccaggagcacauuuaaaaggaucccucauuucuuguacuagauagacuuuauuccaaaaugcuaacagcugauuugagaaauacaaaauucuaaguaauuauauuuugcucaauuuuuucccuuuauucuugauuaccuauacugacaugcuuaaagaugaguuucuaguauccaugucgaaaauaauaaaauguuuuucuuuaaggcucauauucuacuugacuguggugaagacaaugucuguaaaccuaaauuggaaguuucuguaaauagguaaguuguacccuaaacugaaaauagaaaaauauaagaaauuuaaauggaaaaacacacuuuucuauucaagaugcuaauguuuauaaggagaauuauuuacaguaaaggagaauuaacaauuuuuuucacaauaaagcaauuaauaugaugguuaaaaaaauacccacuguguuuuugcuuagcggccuggcuuggcagguuuaugaccaucagccgugguuguaccacgaguccuacuaauugccuugauacacuucacuguggacaagcucugaacugaggaauguccucaccacuugauaagacuguugugagaauuaugacaaaagaauaauucgucuuuuuagcaaagccagcaaggaauuagaaguacaugcacagauguaaugugacauugguggcauguguacagagccaugcucugugagggcuaccagcguucagucgcacaauguggggcacuggacuugcauccagugugcuauuuucuguuuucuguugagcuguggagaagccgugcgugaccuaucccgagacagugaaggcugucggccaugugacuuaccucuggaucggcucccuccccauggcgucucuuuucacuguuggauuugaauuaacuugcagugaucaaaagaagaucuauauuggggacgacaacccucugacacugacugugaaggcgcagaaucaaggggaaggcgccuaugaagcugagcucaucguuucuaucccaccgcaggcugacuucaucgggguuguccggaacaacgaaguaagcuagcaagcugucucuuuugaaaaucacagcgcacucccggcucuuauuaacauuaaugaggcaggccguauuuagugaagcccaagcuuagccauucgaucuaagacuaaauugcuaaacaauaguuuaauaauuccuuucaggccucaugcuuugcauaauauguuauuguagaauuauuagcuuugccagccaugcaucugaaaagaacgaggucagcuagaucuagccugcccaucacauugcuagcuagaugcacugugaccagaaucuaguccucuaggggucugcccaacauuuuuacauuuacaugcagcagugguccacagccccgacuucuuucucuauuuacucaauagauuuuuuggcuucauaaaaagaggaauuugaauaccuacagaauauuggguaggaacuuuguaguuucugcuuuuuuggcuacuauuaauuucuuuuuucaucccaaccccacuucucucucgcuuucuuucuugucuaucaaaggccuuagcaagacuguccugugcauuuaagacagaaaaccaaacucggcagguggugugcgaccuuggaaacccgaugaaggcuggaacucaaguaaggcauuugaauuugauggauuuucccccuguaaauagaauacaauggguuuuuucccccaucgagguuuguuuauaguaacuucaaacuaaguuggguuuuucauuguuacuacugguugguuuugugugccaggaccuugcacaugcuuggaaaaugcccuaccgcugaggucuaugcuguccuguuuuguuugcuugugcuuuuaagauaggauccuccucuguaagcucagcauagccacaaacucaaguucuucccaccuuugcccacuaaaugcuacauugcaaggcugcuguguaccaccacggcagcucuagauuauaccuuuauuuuauuuuauauacuuuuuuauuuaaauuuuuuauuuauucacuuauuuuguguguguguguguguguguguguguguguguguguauguguguauuaugccuacauaugcaugcauguaguugaccacaugcuauggggaggucagaggacaacuuuuggaaguugauucucuccucccaccguauaagaccugggaacugagcucaggucauuggaucagguaauaagugccuuuacccacugagccacuccacuugcccucaaaguaguaccauuaaauuaguuuugauuuagaguuuaauuauuaguagagcucuguuuuuuuuuuuuuuuaaacuaggauacuaaaauuauagguggaucuguaugcacagcaaugccgguuaugugcacaucuguugccauggucuaagcaucgcaugcuuacgcguuccucggcaggcagccaucauccuggauagacguguccuagagaggagcucugugcuuucccauccucucugguuucuagcuuaugacucuugaaguuccugguuuuuuuguuuguuuguuuguuuguuuguuuuuuccuuucuucuucuuucuuucuuuguuuauuuugguuuuuuuucaaggcagcguuuuucuguccuggaacucgcuuguagaccaggcuggucuccaacucacagaucugcugggacuaaaggugugugccaccaugucuggugguuccuggcuuuucuaaauagccuacuccagacuuuguaaugugaguccagcccacucagaggugucuuuuuuacguacaauuacgugaaccccaagaagcuugcuaucuuauauguguaguucaguuguuuucuuuaaagccagucagguuccugccuuggaccuuagguugucccgagggaaggggacugagaguggugugagagggagauucugcuuccugucuugcuuccuaacucaagucaguugucagauuccuaugucaagucuuauacucaauugugcauugcuuucacuggaacaacaauaaguuuuagaaagacaguuaauaucauuguagggaggugugauuaaaauuaauaguuguuaaauagccuccauuaugacuucaguggaaaaucaguuguaauuauuuuuguucaguuuuacaauaaacucaugagaguguauuuuagaacccacuuuuuuauuuggaugucauauuugauguuucuaacuuaaagaauauacugaccgccauuguuaccgcuucccuucucagcugcucgcuggucuucguuucagcgugcaccagcagucagagauggauacuucugugaaguuugacuugaaaauccagagguaugaaaacacuccauuaggauaaaauaacuauuuuauuuuauaaauauauuacauacccccuuuaaagauggaauaauguagauuaagccuucaguacugcauuauaggauuuuucacaaauuuauuuguuuuaauuuuuaaauguacaaugguauuuugccugcauguauauuugcaugaaggugucggauccucuggaacaggagcuauagacaguugggaguuaccacguguaaaugccaugugggugcuggaaauggaacccgcuccucuagaagaccagccagugcuguuaacuccugagccaccucuccaugccugcauuauagaauuauuaaaucaauauuuuaguuauacaaaugauuuugaugucaauuugacauuauaaaacaaagcuaaacauuaggaaauacagcuuuucuccaucuuugaauuaaugguaauuaagauaauugguugaucgguagggcuucaguuucuauuuugcuuugaauuguuuaguuuuaguuccccugaguucucguuuucauagcuuugaugauaaaugugcccaauccagcccugaacauguuucuaucuuucuuguuuucuucacuuuucagcucuaauucuuuugacaauguaaguccaguugugucuuacaagguugaccucgccguuuuggcugcuguggagauaagaggguaagugugcauuucaagcugaguaucucguuguuguuguugugcuugcuucugaaauguggcugcgggacuuucugcaggcagccacccugccaccccagcuuagugcugcuuuaccaaggcaguggacgauguagagauaaggcccugacuguucuucgagucccaaguaucuuucugguggucuuucgaaaaggcaugguagcagcaaucuuaaagaaguugauugaaccuucacaacacuugcuuacuaguucaucuguugcaugcugauuuagcaacgguggcuuuuaugcauauggucaucuguaagcuuuuccuuuaugccuuuuuaaaauuagcucugauuuuauuuagcugaauauaggauauuuaggaaaaugaacugauuacacuguuugauauucaugguaguuuuuuuuuguuugucauuguuuagaguuucaaguccagaucauaucuuucuuccaauuccaaauugggaguacaaggaaaacccugagacugaagaagacguugggccuauuguucagcacauauaugagguuugcagucauuggaccuaauagaaagcuagugaaggggucaauggggaaagcaacuaaaccuuuuaaaaccaauucuauuucaucuuuauuugcaauuugcauaguguaaacauguaccagaaguacuauuuguaaguucauuuuuauagacaaauaccuauauuuguuuaaugaacauaaaaucaacucuugaguaaaagagauagcucugugugugccccaugaaauuuugaaguucugacuaaaaaacuggaaaugccuguaauuaugcaaaguuuuauugcuucuacgaagguuauuaagucagcauucaguaacucuuuaacagcuuucuauacacuuucauccucguagaucuuccuguugagagauaagcaucuguuuggccuguguguacaguggucaugcuugaagucuaucaguagcaacugcugcucuucagaucccguuuuggauaggauuucuagugcuaacauuguagaagaauuguagaacuaauuaugguccaaggugcuuacguuuuucuuuuccuuauuagcugagaaacaaugguccaaguucauucagcaaggcaauucuaaaucuccaguggccuuacaaauacaacaacaacacucuguuguacauucuucauuacgacauugacgggccaaugaacugcacggcagauacagagaucaacccuuugagaaucaagguacugugcuuuaaguagcucuuuauuaucauaacuuuuauuucuuccuaaacauauaaaugaaacuuaaaauaaaacaacuauuuugaugugugaacucugcaagaaguuuuugaguucacaaccaauacacuaauaauuagcccauuuaugcaauagguaagaaaucugugaaauucuugaggaccuuauguuuaugaguggucaauaaaccucaggagauauuccugaccauggcccauugcaauaucaguuugucaaauguauaacacucuauuuaaagcuauucuauuguugaaauuucuguuuuuagaguaagauguacuauuuuacuugugacuugauuuacagagucuagggaagugccauuuuauaggacuuuauauacuuuuggugauagugaucuuuguucuagaguauauauuuaucuaaaaauauuacaucagucugggcagugaugacagaugccuuuaaucccagcauucagaaggcagcugcagguggaucucugaauuugaagccagccuggucuacaaguuacaggacagccaaggcuacacaugaaacccugucucaaaaaaaacaacaaaacaaaacaaaacaaaacaaacaaaacaaauuacaucauauacagucuaaggaaauuucagaaaacaaauaaaguaagccagacuugacggcacaugccugaagucccauaacaaguuugauguuauccgggauuacauuuuguguuuaaggccagucugggcuguauaguaauacucuguuuccaaaaccccaaacaaaucagacucaagccuccuaacugacacucauuguagacgugcugaagaacuucaggcucuuucagcagauaucaguuucccuccagggaugccgggagaagcagugguuaggaaaaggcaacauuuguaagggcaauuaaugacguugaucuuuuucuuuccuguucacuaaguaguaaguuguaaauuuucugucauaccacauuuucauagauugcaugcuaaucauaucuaaguauuaguguccaaaugucaguguaagauuuuuuuuuucuguuaucguuuaaccaccaguguaauccaugucugucuuuacagacacccgaaaagaaugacacagcggcggcgggacagggagaaaggaaucaucucaucaccaagcgggaucucacccucagagagggagauguucacacuuugguaagcgccaucuccagugcacagagaaucagcaucuaaaaauacacggguacaggccacucgacaaccaacaccucagcaggaucacuuaaaaaaaucugugguccucuugaucuucuuccuaguuacguuaaagacaguucucaacugauccauuuuauacacuguuuaauaaaagcauuuuguauucugccugccucgacugcucuuccagcugggcacuuuugaucucaucuuccucuuuggcacuucaguggcauuuugcacgagaaaccuggagacacagugaugaaaacuguacaaagggaauaauuaguucaguguuuuaacuuuaauuaugucagguuauucagggacuguacuguuugauagaaaugcauuguuauuuuuuaaaaacccuuuuuuauuuaauuaugcuauaauuuuucuuuguggcacauacauccugucugguaugucuguaaaggccagaggacaacuuguagaagugauuucuuugcuucuaacacagcuugacagggagaaccuuuaccuucgaagucaucuucccugugaagccaucuucucugcccacacccacuguuuuuauauaacugaguccuguggucaaaggcucauuauucaaauacugaauuuucuucccaucacuacaucagggcauuauucucuccccguucuccaucugcugcccuacucuccucggucucaguuuuuagauuugugaccucuacacgaaccuucaggcuccuuaauugcugauuagaauuucuuucgaaccaugcaucagcuuuuucugauuugaccuggaggagagccaggguuuuuucguaguucuuuucaggucugucacagccggucugggcaauaguucaaagacugauguggucccagggugauggacccugguuucaauauccaaccccugaaaaggaguucauugaucaaaagcaaguccugacaacugaugauccauucaucugucuacgaacagcgugguccucuagugggaaaaaaugaauaaauccucuguauuuuuacucugaugaaaaaaaaaaaagaauuucucuuaaaugucuaucagaaaauaacaaaucuagaaauacauccuggaguuuucccagcauuugucuuuccacacugaucuacagggagugacuacaaaccccauucucuaaguccuugcucugugucucucagcuccuacauccugcauuucaguaaauuucagccccgucuacuuuguaaagcaccuccccauccuaacccaugugcaccaacuccguuccuucacagggugacccacaccacuuuccauuggccucugauuuuaugcucuuaucuccccuaaugucuauuuacuacagaaccuauagggguucuuugaugugugggucacugacaggucacuacuggaguuucugaguugacgcagaaaaaucauaggaaagauagcucagugguuaagagcaccagcugcucuuguagaggacccgaguuugguucccaggacccacacaggcaacucacaacuguaaccacagcuccagagggacuaacuuuuuccgguuucagaggacauuuauauccauguucacaccuuccuagacaguacacauaacuaaaaaguaaauauucaugaaaauuaggcacuguucuaugggaacauauaauagcaugucauuaggagucauuuuauugguauauucuuugaacagaauaauaguacuagguuuuccccuugucccugaccuagcuuaucuaaucccaggcucuuagccacauuuuuaucgucagauguggguuccaucuuauggaauccuaauuuaaaaacagcuguugguuacucacauaacauuugugccuccauugcaccagucugucuuguugacaggucacuguagucggucgcaggguuuguagcugggugauauggaugaugacauuucuccaccaguagcaugcaggguaccuuuuccagucccaugaagguuaagucagucaguagcgguggaacuucuaguuaggcaccaacucgacuuucccauguuagaugacguaaauaaguguuguccuaucaauagggcuuugccauuagguuguggagaacaaccaagagccuggcuaauacccuguuauaaagagagcagcaacaagcauggaugaggaaggaucucuguagugugauguagcgcccuuugggugugugcccaagagugguacagcuggaucuuguaguagaccaauuccuaguuuccuugugucuaguuaacuucuucagacugaagguuuucuccuaguccauucuguagagacagggucucucccugaaccuggacuucacugauuggcuagacuagcuggcuagccagccucagggaguguccuguuucuuccucccuagcaguaggauuucuggcggguguuucuaggcuuugcuuuuauucugugggugcugagaaucagaacucagcuccuuacacuugccuagcagguacguuacugacugauccauccucuacuucuugcagaauucuauucuauugauuuauaugugcagucuugaugauaacaaaucguuuuuauuacuauagcucugcagcaaguuuugaaauccuucucucucccucccucccucccucccucccucccuccuuccuuccuuccuucuuucuuccuuucuuccucccuucuuuccuucuucccaccuuuccuuuccucuuuguucuuucucguuucaaacauagaccauucucacuguagcucaaguagacacuucuacagauccucccaccucagcuuccggaguacugagauugcaagcuuguaucaaugcauuuggcuuauuuucuucgagucuaagcuuguuuuugauguuuggcauuuuuagcaauucuuuauguacuuuagguuaaguauauacacuucuuagggcuacuuacaucccacuaguaguuuguggguguaacccugauuggagaacucuugugucccagaacacgggcuacccaguuagguucucuucgacuccuuucaacaauauuucaguuccuuucaaguuuucauaaaaaagcuuuuaguuuucaagauauuagcuuugcacuugauuuucuucuuguuguucuuuuaaccauuguugcuauuguacagccaacaagucauauuucuauguugaauuuguaggaacugugcucuguuguuggucuguucuuguuuauuaggucuuuauuacuuuuaguguagcuugcuuggauuuuguuguuguuuuaguuugguuuuuaaaacauaaggucuuuucaucuacugagagauguuuuaucuguuuauuacguugcuacuggaccacacuggcuagaccgugcagcagacuagaagcagcguguccagaccccuugccuuguuuguggucuucucuuaaguguagauuuaguugugcuucugucaaggaugcccuuuaucaaguggagggagcucacuucucuuccuguuccucagcugcugaugccauuaacuggacagcgagcucuguggugcaugcgagugacguagugcaaugugacuggcacaugaaaggugguggauauuguuucucuuagcugccgacguucaaguuccugaugaaaacacuaauuauggcaggugucaucagcgugugauuuucuuucuacaggucucacacagaauaauaauuaaagauucacugcuuucuuugcuuuucuacagaauuacugugauccgaugucuuaaaacgacuauauucaggguuugccuagagaacguuuaguugcugucauaaaaccgaacucuucaauauuaggcuuuaaguugcuagaauaaauuacacuauggaacaaugcuuuugccagguguggugcauauaccuuuaaucccagugcugggcaggcacggguaggcagaugugagaucaaggccucuacuuaaucuguguaguaaguucuaggaaagccaaggcuguguuccaagacccugucucaaaacauacaaagaaagaaacaaaauaaaacaaaagaggccugcucuuuucugaagggaaccauaaaggaguggaucuuggggccagggaagaugguggggagggcuggggggagcagagggaggggaagcaguggucagguguaauauaugagaauuaaaaagaaaagcccagagcuagcuguuguccuguuuguuaagcuuuaugccuagaagacagagaaucuauagaguuucucuuuggccuucacguaaggaugcuuaauguucaacuguuacaaaugccagugugaucucacuguguaaggaaauggucuguucuggcagggcuguggaaucgccaagugcuugcagaucaccugccagguuggucgacuggauagaggcaagagcgcaauccuguacgugaaaucccugcuguggaccgagacguucaugaacguaagcagacagacguaccagcagguguauacauuuuuucaaagaguuauaaggcuugcuaucuaagagaccaucgcuuguuauuucugugcagaaggagaaccagaaccauuccuauucgcugaagucaucugcuuccuuuaauaucauagaauucccuuacaagaaccugccgaucgaggaucucuucaacucuacacuaguaagucaccggcuucagagcacggauaccugccgugcaaacaccuuagugauuuuaguggaaguuuaacuagaacaagugaaaagauaaguuauuggagaggauuauagaauggaaagcauucucuuucuuuuuuuaaauuacauuuguuguugcugaggagggucacguaucacagugugcaggucagaggacagcuuuucagaacugauucugggacgugaggauuggaccuuggauaugagguguggugaccagggccuuuagcugacgagucaucccaccgacccaggcucuggucccuugguguucuuguacuucauuguccuagaauuaguagagcuggcccuuuuucuuuagcacuuggugcuguguaacaggguuuuuuuuuuuaacuguauaccaaauuugucaggggauauuuugggguuacuuucuccccacaguuauaagguuggaaacuaacuacuaacuacuaacuaacuacugcuaaguaaacauauuuugaagauaucuaaguauugaaaauaggaucagcugccaugaucuguauugggaaauuuacuagucauuucaauuuaaaucugaugucaaccuauugucagagucuugugugugcgcuuuuguguguguguguacgcaugugcuauggaugccuaacgugcacucacuaaaugauuguaugagaaaaagaacguggugugacuaccacuaaauuuauuauuaaaagaaaguugaguacucacugacuaggccagugagcuauuuaagacucaguguguuuucugcaacaggucaccacuaacaucaccuggggcauucagccggcgcccaugccugugccugugugggugaucaucuuggcaguucucgcagggcugcugcuacuggcuguguugguauuuguaauguacaggguaaguaaugggcguugaaggggguagggggauggaauaagagaagaagggacaggaugaagggaguaaagaaaaggagaaaaggacccacaguguugcugccuggugagcagggcuuauuucaggaugggacacuaaacaaaaacgccauuugaauuuucgaggugauaauagagucggucauacuuucagcgaucuguuacugagcuagaacuaugcuuuuucuuuaacuggcagaugggcuuuuucaaacguguccgaccaccucaagaagagcaagaaagagaacagcuucagccucaugagaauggcgaaggaaacucugaaaccuaaggugcuucuuaaguggcgccacuucuguccgcuccaaguucaccaccguggugguggauuucaacaucucucgugaacagugaaaucccaggacuguauugcugagagcacccagcagucucaguuuauccacaaaauugaaauggauauuugucgacuucucuuuaugaauaaguucagauuacauuuacuucgccuacacuaacguguguucuuagggacuuaagugauggaauuucaagugauuaucuuuguucaguguacauaagacagacagcacugagucagcacguuacauagcauaguaccucuucaguuacuguuccuaauugacugugugggguuucucucuucgacguuacguuagggcaauuaggauuguaaagcaguucaaauuuagaccaucaguaaguuugcacaggcacuuagaacagguacacauuacacuacaguugacuucauaagcuacugaagacuuugcaauugcauggacuuagauuuuaauaucauuuacacaguagaacuuuuaaauaacacgauaccaucaaaauucuuuccugggacuauagcucacuucgaagcgugugcaacucccuggguucaauccugcacacugggaggaaaaccagcaguuuccuguauuaacaaugguacaguauuuuuauaugaaaguuagguuuuuauuuauguguagucugcauugugucuuauuguauuuuaacuuuuguaauuuaaauucuacaucaaauccuuuaagucguuuccugcagaaaauuuuauaauuaaaaauacccguuaaguaauaguguggucucagcugcugcugcugcugcugcugcugcugacugaagcccguggaguuggaagggguuuuugaaguacaucuauucccuuuguuuggcugccugcaauguggaaaagcccuggagacucuccaugggucucuacucuaacugcucaucaaaaagacauucuuuaauuggaccagagcguuuaauuauuaguaauuuauuuuccuccuguccucauauuuuccuuccacuuccaaaacugagaauggcucaagaccuucuucauaaccuauaggaaccuggaucucgcgcccuuaccccacgagagaugccugggacccacauuccaaagguggcucaugggaugguuucuagcaauagcaugguagaaccucagguuaagcaaggugaucuauaaaaccugccuccacugucagaaagaaugcuacaaagguguuuuuguaagcaguucuuguuccuuaaaccuucuaacucugucuuacauuuuuuaauuuaaauuaccuuucugggacuuuaauagaggcagcagaggaagcacgggaccgucuuaagugguggugauuuauucacaguuccucaaggccccgggauaacuaucaauuauagcucuauuuuugugcaauuacaucauguuaugcauuggaaguugagaauuuuaauagcuuuuuaaaaugcuguccucauuaagcaaugaaaaauauuucucuuaaauaauugaauauuuuucuacauuuuaaaaguaauugaaguuugucucaccguaucuuaggcuaauuccaugugcauauggaugagcuaauuuggagaauauauuuucauaacaugaagcacauuuaugugaguuguacgaauuagaauauagacaggacccuauauuuagcuuuaauaaaauuuuaaauuaaugaguucuggcuugaaagaucauaaucauauaugcaauaauuauuuuuuuaaaccaauacauuuaaauucuuuuaagaaacauuuuggucuuagggacaagugucucuaagcuacuuaggacuaccacacaggucacuaaguuggccuauacaaacuuuuaccuucuuugucugucaacauaauaguugucauuccugaaaaucaaugaaauucauucuuuguaaaaaucaauauugauuuuuacaguuauuccuauuauggcuucuaugccaaggaauaacuuucuguuagagauugaaagauauuuguaauuggaaauuaacaugauguaguuuucaacaauagcauggauuuucuuuuaaaaaauauaaauuuguaucucuguaaacuuaggaacuguaauuugagaguuaacacucugaaaaaaauguugagauacucuuuaucccauaacagcauaggcauguagucaacaaaauagcaagagauuauuuuagauucauauuuguaauuuaccaauaauuaacauuuauuucuaagcauaaaauuuucauaauauagguuaauuaaagaaauugauugauccagaggacauuugacacaugugaggaauauuaacguggauacugauuucuuauagagauauuuauuuuagaguugguacuuuaaaacaucugugugaggguuacuuuccucccuuauguuuaauuaucaucauaauucugauuguguucugaaugacuacggaaggugaaacagucaaaauauugucuuaaaucuaccuguauuacaauauuacuuauuaauaguaaauccucaugaauacauuauuuauauaaugaggaaaaucacuaagagcagacaagaguuuguugccgccuuacgagaacagugugaguuucuguagugagucuaaccccgaggagggaauuuaguggcaaaguauauauugguagagcaacugguucuuguagggcaacagaaggccaagguggcauccauccccauuugagagaauucuggggagagccucaaggagaaggaaaggaaguuguucuagagucucuguguguggccauugccuaucucugugucaccuuguucuuacucguggcuagcuuguacauuuaauuugaugaguaaggggagaugaccaaaauguauuaugggaucuaaaaagacaaauacaauugcuugaugucuaguaauuuguaaagguuucuuuggacuugguccuuuuauuugaaccaugaaccuguggcuaugccaucugcaguauacacuggcauucauuauaauuucugauaugucauggacuuccugugagguacugaaucuuugaauuuuguugucauuguucuuaagugcaauauaacaauguaacgaaacuuaaauauaagucacuauuuaguaaucuuaauccgaaauuuauuaguauuuuuuuguuagcagaaaagaacaacucugcuguaguuguagauauauaggugaaauuuuuuguuuuuugcuuuuucuuugcuuuuuuuuuuuuguuuguuuguuuuuuuuaccucuaaaccauccaaucugcauuuuauuuuagguggaagaugaacuauuccuuaccaguuuuaaaacacuuucaguauauuaagguaacuuggaagcuguguguaucaaauucuuuugcucgcuaaguaaccuggaagauaauuuuuuuuggcuucucucgugaucacccacauugggugagacauaagaugagucucuccugaaaucugucauuugcuaacuuguuuugaguuaguaaaagcagguaccauguucugcuuuguuuccaguguguaacuugugacuguacaauaaacuugaacguguggugccagcuu
